United States Patent 9,328,346 (POLYCOMB-ASSOCIATED NON-CODING RNAS) - sequence listing, part 128

SEQ ID NO: 191533 - RNA, 49665 nt, Homo sapiens
gcagagcgcgcggggcgcgguugccguggcagcgccggcuccagggagggcugcuggcgccgggccgggaccgcggggccugaggcggagaccggagagcccgaggcccggccggaggcagcucgggacaggcuugagcggcggggcgcgcugcccggccggcggggaugcgggaccggcugccagaccugacggcggugagcggcagccgcggguagcgguucaggcccggccggggcggcgucuggagggcgggcgggggcucggggcgucuugggcggggcuccgggaggguccccagggcggggaucuccggcguucuggggcgggggcugcgggcagggucucagggaguccugagcggggacugcuggugggguccccagggcgggggucccgggaguccuagggugggggcuccgggcgggguccccagggcuuccugggcggaguccucagggcggguuggggcaggaggagggagcggggaaggucccggccucgacccccucuucgagcguggcucccuguccgucacuccgcuuggcggauuguaucuggcgcuuacccagccggagcccacuggccuaacugugguccgccccacgggguccccgcagcuggcgucagccccggggagcaggccggguccucuuggucgcugcuuuaucccuggggcuucacaaaggacugugcaccaagcgggaggcaacagaugggugugaaaugugggcaccuuagagugcugggugcuugggguggggcgagcgcgaacagcagcuugugucugaucucccaguaguuugcuuuggaaacugggaccguguguugacucugaacgcaccuuacgcgcccagcagccgggcacacagcaaguuacuguuuacuuuagcaagggaaaagcaggucacuaaaaauuuuggaaggauuucgaugcauucuacacguguaaaggugacaggacugugcauggugcagugacagcggaaugauagugauggucgugcacuuuccaagcuugucuaacccaggacggcuuaggccagcagaaguaguuaugacuuuuucccuuuacaauacagguacuaauucaugcuacgugugugcacagauagagccucuggucucuaaauuguuggcagccucagaacaggggugcuaaggcccacagcccuacgacacccacugcauguaaugaauuauucucucuccucugcugcuagaauggagcuguuauguacccccgagugggagaauagagaaaagagccacuuaaaucauuaucuguguucugugguucagaugaggagcucugguugagaaaggcaaugauuucauccuuaggaucauggaaauuaugcuuuauauucauuccaaggaaguuucuucacggugauuuuuccuuuuuuauuaauggacaaauauucccuguguuccgcagaucaauaucaucuuaaacacagcaaauuauaguuguguugucuugcccgauggauuaucuuucagugccguguaguaggagcucagguauuuauuuaaugaagaaaagcuguggcucacuccuguaaucccagcagucugggagaucagggugggggcaucacuugagcccagguauuggagaccagcuugggcaacacagggagacacuguuucucgaaaaaaauuaaaaaauuagcaggaggccagucgcaguggcucaugccuguaaucccagcacuuugggaggccgaguuggguggaccacuugaggucaggaguuggagacuagccuggccaacauggcaaaaccccguuucuacuaaaauagccggaugucauggcgcacaccuguagucccagcuacucuggaggcugcggcaggagcaucgcuugaauccaggaggcggagguugcagaaagccgagauugugccacuguacuccagucugggcaacagaaagagacucuguuucagaaaaaccaacaaaacaaagcacgcacaaaaaaacuauccaggugugacucgcaccuguaguccuugguacucaggaggcuaagcuaggaggauuccuugagcccaggagauagaggcugcagugagccaugauugugccaugccacugcacucccgccugggugacagagugagacauugucucauaaaaaaaaaaaaaaaaagcucaaugucauugaacgugagagcugugacuauuuuggcaaaauacagccaaauuuauauguuggggaaucgugagaaaguacguuuucuuggcuugaauagcaaaaagcaaauaaggcaauuauuugucacucaguuucuauauauccaaacccuuccugaaacaguagaacaugucaaucaguuuuguucuagaacggcagagcuagaagucagcucaucuacuucaauaccauccugcuuuagacacagcagcugagcagucagagaguauauccguggaaguuuccacucauggaguuucucaucuugggcaaauaauuuuuaaaucucucaaaacuuuuucuuguacgugaaauggggacagugguaucucucuuguccaccucauagagggaguuaugaagcauaaaauuaucuaaugugugaagcucugggagaaggugggagggagcaagugcuauguaauuauaagugugauuaauguuuaccagauuuuuuguuuuuagggaguuauaaaaagcagccuucuggcugggcacaguggcuuucacuuguagucccagcacuuugggaggcugaggugggcagaucauuugagcucaggaguucaagaccagccugggcaacauggcaaaacccugucuuuacaaaaaacauacaaaaacucagccagguguaguggugcaugccugugguuccagcuacucaggaggcugaggugggaagauugcuugaguccaggaggcggagguugcagugagccaagauuuugccacugcccuccagccugggcaacagacagauugagacccugucucaaaaaaagagaaaagaacaaccuucucccuaguauaaaauaguaaguuaaaacugaauuugaaguuuaauaacuuuuaauauuuaaaaacccaucuuaaaguuaccagauacaaguuuaauuccccucccccgccccgccccaggaaauguguccuuucccaguaguucuuagaguaguugaauguguacucacaaccgugcuuguaaauggcugguguuuuuuucuagguaaaguugaauauuuuguugguuaaaaugccucaucaacaaugucugauuaacaaaguauuugugaugcuuccaugaaguuucuuuucuuagcugcugaugcuuguuccugugaagaacgugccucugacaguuacguggacagggcuuaaagaguaaucugcucaauacaaucuguacugacagauguaguuucuaaccagugaugcuguuuuugagcaaccagucauuugggcauagaaaguuugcgugacuugguccagaucucugacacucuaaauccagaaagauauuucugauuuacagaaaguaaaagacucgcccauccagcagguacuugaaugucaggccucuagcagaucaugugcugggugcagagagacacagcagugaacugagcguggguggggaugcaugcagccugggaaggaagagugaccgagguguaaugaaauucacuguaggacguaagcaaaauggaauagcuauucuauaagauaaccaccccaaacguauuuugauuacuuuuuaaaaaaaguuuaugaacauugauguauuuauauuugauacauauauaugauauaucuauuuauuauagugaagaauagagaaaccacacauuucaucugugggaauuguuugcaugauaauaaacaauaaauacacaguagcugugugguguucuuaguagaccuaaaagaaaugagaacguuauuuuucauccugguuucaaggugaugaauugcaaaucucuuuuuuuuuucuuugagacaggaucucacugugucgcccaggcuggagugcaggggcacgaucauuacucauugcacccuugaccucccaggcgcaagccauccucccgccucagcuuccugaguagcuaggaccacaggcgcgugccgcugcacccagcaaacuucuguauuuuuuauagagaugggguugcgcuguguugcccaggcuggucuucaacucuugagcucaagcaaucugcccaccuuaggcucccaaagugcugggauuucaggcgugagccaccgugccuggccugcaaauauaauuucuuaaagggcggaaaacacugcucagauauuuuuaaaaguuauuuuuugacagcucauguuuguccacguagugcagaauguuguauagugaagaugcagguuccaauucauaaaauaagaagauuaaaaaacuucacuggaacuuaaaauacuaagaguuuaauauaugaacauaauuuuauauaugcauauauuuauaguuuagaaugucauaacuuaugcaauccugccaaauuuuuauauuuuguguguucucauacaaacaguuccuacaguuggagucuauaguuucucuauucuuaauuauaauagguuuacucauuuguauaucuaaacauguccuuuaguuugaagagcaaaaucuauauguuuuuacagauuaaucacuucuuguuuuuaacuugaggucuauucugaauuuaaggaguagcaacuguaagaaauaacugauccauagaagagcucccuaggagcccagaucuaucgccuugugguggcaggauuugcuccugccuccggacugauacgccccuccucccugcccuugcaggugcugcucccuuugucugaaccacuggacuucucccucugcgccuucucucuugccuuguaccuuuuuuuuuuuuuuuuuuuuugagacagagugucgcuuucuugcccaggguggagugcaauggugcaaucucaguucacugcauccuccgccucuaggguucaaggaauucucccgccucagccucccaugacacccagcugauuuuuguauuuuuaguagaaguggaguuucaccacauuggccaggcuggucucgaacucccgaccucaggugauccacccgccucggccucccaaagugcugggauuacaggcgugagccaccacauguagccuugcaccuuuuuuagucucagguuaggcaucacugggaagccuuccugccucccuuuccucgcauguucccacagauggcccaucuugucuuggggcauucuggacacagaugcaguccuguuuuuuccugcacccuucccccagugcuucagccuuuucaggacagaugcauacugucauuugugcucugaagccucaguauucugcauggugccugauccagagcaccugccagguauuuauugaaucagucuguuuccauuugaaaaugcccaugguaagaaaaauguagaugccacuggaaucuguugucuucaaggccuuuugguuaaaagggacagaaacccaucagcuaaagcagaaaagggagauuuauuaaaaggcagaaugggcugggugggguggcucacgccuguaaucccacuacuuugggaguccaagguggaaggaucacuugaggucaggaguucuagaucagccuggccaacagggggaaaccucgucucuacuaaagaugcaaaaauuaauuggggguggugguaggugccuguaaucucugcuauuugggaagcugaggugagagaauagcuggaaccugggaaguggagguugcaguaagccaagauccugccacugcacucuagccuggcuaacagagugggaauccaucucaaaaaaaaaaaaaaaaaagguagagugauuucucccaggcuuugagggcacguaguaccaucagcccucaugagggauggaguuaggacggagcgagccacugagguccuuccuguccuugugucguggccguuuugugcuugcggggucuuagucugugugugugucucuguuuccguuuguugacguuugucauuuguguguacuuucccacucuccucccccuugucugugucugcccuucucuugcucuucauucauucauucacucguuuguugaccuggucaucacugacuggcggcugggugccaggcacugcugugggcagaaugccuggguugugaaaagacagaaguccuugcucuuguggaaccugcagcugggagauagacagcagcugagcagaugaaucaagugucuuucgcaauccuugcugugaaggaauaagcagggcgaggguguggguguggcugccuuggccgggugggucagggggccaccccgugagcugagcuguggauaagaaagcggcuguggacagggcugggggagggugcccuggguagaaggcacagcaaguccagaggcccagaguugggaacgaagucaugcaagggacagaaagaugcugucgguagugaguggauggucagcagugggcggaggugagacgugagugagcugaggagguuggcuggagcgagauccugaggguuucucuucgucuccacggccugguguaaggggcugcccccgcccccaaguuuaaaugcucucuaguucacgcucucuaggcuucaucaugucaguucugauccucauuccuggggcgagaucauguggugggcccuugguagcucaagauuagccuggcagugucucauguccaugugccaugcugggggcauccaauuuauugcaagugcuuuggagagcaauuuggcauuguuuagugaagcugaagacgcuuaaaccccauggcucggugguccucucucugcauguguguguauguuccagaaaaccauccugacaugcaugugcagccuuguaacugugguucguuauauuguugguaauggaaaaauauuaggcacaauaggagccuggauggcuaccucauggcuguuuauauaauggaguguaugcagcaguaagaugaauguaugagguugaaccauauggugugguuucaccuaacacuagagcaauauaugcugaguggagaaauaugaauguauagcugagaggaaaaaaaaaaaugauuaaauugcagaggcaggccggguguagucgcucaugccuguaauaccagcacguggggagaccaaggugggaggauugguugggccaagaaguucaaggccagccugggccacauggccagaccucaucucuaaaaaaauaugugugccuguagucccaguuacucaggaggcugaggcaaagggaucaccugagcccaggagguugaagcuguugugaacugugaucacgcuacugcacuccagccugggugacagagcaagacccugauuccaaaaaaaaaaaaaaaaaaaaauugcagaaguguaauacuauuuacauaaagucuaaaugccuguuaaaaaguauuuauauaauaauaauggaaacaaguguuaguaaaaauacaaaaaaauaaaaaaguauaacauuuuauuauagguauaaaaguguaauucaccauacaaaauaugagaaaguagguuacguuuagcaccauauuuacaaacuggcccagagucagcauuuacauauuuauuuauuuguuuuuugagacaaagucccucucuaucgccaggcuggaguggcaccaucacugcucacuacagccucagucuccuggcucaagggauccucacaagugugagccaccacgccuggcuaauuuuuguauuuuuuguaccaaaaaugggguaucaccauguugcccaggcuggucucaaacucuggagcuuaagugauccucccaguuaagccucccaaagugcugggauuacaggcaugagcugccgcacccggccagcuuuuaccuauguuuaauuacaaguauucuuuucuuuuuuuacccaagugauuuaauugugaaaaguaagucaaaguauucuagcaacaaaguacuaaaaccacuguguauaugucaagguuuauaauuuauuugcccacaauuauuauuuguauggaagguccuuagcaugugugugugaacaacaggcagaagaaagccaggauucuguccagcuuuggauucugccauuugugguaguucagcuucuauugaauuauaaaugaugaucguuccaauggcaaauuacucuucucuguuaaauagucucuaaaccaggaagcuaccugcuaccuguuucugacaauaguauucacacagggagaguugugauuuuacuauaaugcuacuuuuaaggagacuucuguuaacauuuaaccgaaauggaauguugauauuuaaauguuuauccuguacuucgacacuugggaaaucaaguaugucauauagagaguauucccuggcuuuuaguaaauguuugccacuagcaguuugguuauuuacaauaaauacccucucauaaucauggcuguuguacagcuguugcacuaucucagccugaaagacugaacauggacauucauugaagacaagaauaauguagcuuagggauaaagccaaaaagauugcuuuggucauuuuguuuuguuuuguuuuuuugaauggaaaagcaaagacaguauuauugggucuguuuccuguuaucuaaucaguuuugagacuuccagguagaaauaagacauauaagucaaggcuuaagaauaagaaauaagacaauagaggaaacauauuccagucauguggaucuuuccuggucuacagggagagaaacaaauuguuuaccagcaagcgaaugacuuggaacaaaaauccgcccgugccguggguucagaguggaggaggauugacgccacgccacuguggggggugcaucgcgcagcaugggacggucaccaugggagaggaggguugagccucugguuguuuacgccacgccacuguggggggugcaucacacagcaugggacggucaccaugggaaagcagcuugcuuucacagggaagcguggcgcuggggagcauugagaugggugcagccucuuuccuggagcugcaggugcagccuccacaguagcaucugccucaugggauuugccucacgauggucuuguggugugggggguaggaaguagugggaagugguggguguccaccugaaacaagacaggcuguggcuugaccauuguugagccugggugauggcgacacugagggcucaccauaguauuccuucuacuuuuguauauguuuacaguuucccaaacaaacaaaaaugaggugacuuugaaucuagaaccuaaaguuccuggcagagcagggaggugugagaugcccugagagccauguggcaccuccaggguggggugaagcacuuuuauggcccggggcucagggccacaagggccgucugcagcucacuuucagcucuccaccccuccuccccacccccuccauggguauuugggugaaugcacagucagucaaugacuuaaagcggugaugcuucacuccaucauuccuggcccugcgccucugagaccgcacagcugagaagacaaggcagauagccauagggaagcagugagaccccgugcccagcuagugggauuuaaugcccaagugagcacuuggagacagggagggagcaggcugugggcccgagaggcggggcuggcacgcacaggggaguagauccucuuucuaagagagggggucccccgcaaggggagucugugggaccuggccaccuggccugcauggcugguggggcuccgcagcacagcuccuccccgcaucccaucuucccccaggguagagugugcuuguuagagcaggguguguggaaucacagucacaggccguuuucugcucugccgucccugcgagugaucccugcacuguguuucagccuccucacuggcaacauggggaccauaaaauuaaugagaacauguguguagaguauuucaaauugccaacucuugugagcuggaaguaaaggacggcucuuacucuuuuuaagagggucaacaugguaauaguacaguuguuaagaugggaaguuuuguaaagucagaccuggcgucagcuacugguucggcaccgcuuagcucugagaccauaaccauugagcauguguucuacucugaaauagcgaugccagcaccugccucaugguggggacuagggggugugguaccaggaagauugacagauaacgcaccuggucugacuccugcagacccugggaaccgacacucaauauccuucagccauucuguuuugguuuuuggaguggugugggauccuggagaagaguguuaaacuaugugggucuaucuuaauguuaguuucugcugcuugucgguugauugccauuuugucuuuucuuuucuuuucuuuuuuuuuuuuuugagacagagucuugcucugucacccaggcuggagugcaguggcgcgaucucggcucacugcaagcuccaccucccggguucaugccauuuuccugccucagccucccgaguagcugggacuacaggugcccacuacugcgcccggcuaauuuuuuuuguauuuuuaguagagacaggguuucaccguguuagccaggauggucucaaucuccugaucucgugauccacccgccucggccucccaaaguucugggauuacaggugugagccaccgcgcccggcccauuuugucuugaagugcugcuuugcuuagaauuacgaguguacaggcugggcgaaguggcucaugccuguaaucccagcaauuugggagggugaggcgggcggauugcaugagcucaggaguucgaaaccagccuggccaacauggugaaauccugucucuacuaaaaauacaaaaaaaaaaaaaaaaaaaagccgggugugguggcaggugcauguaauccuagcuauucaggagguuggggcauaagcauuacuugaacccagaaggcggagguugcagugagccgagauccugccacugcacacuccacacuccagccugggcgacagagugagacuuuguuuccaaaaaaaaagaguagggacuagaaauaauuuuauuaauagaagccuuuauugguuuauauauuaauauuacccaugaaaguaguguuaccuuauaaaacacugauaaauaucuuauccuuagggucuucugauggagaugggacaauacuaucucuauuucauggacaagaggcagagacugagacaagcuaaugggcugcuggggaggaggcuggagcccaggucuucagcuccugaucaauggucguucuucuggguggugcugggguuugcuuuguuuuguuuuguuuuuagagacagggucacugcagccccaaccugccagguucagguaguccucccaccucagccuccuaaguagcugggaccacaggcaugggccacuaggcccagcuaaaccugccagguucagguaguccucccaccucagccuccuaaguagcugggaccacaggcaugggccacuaggcccagcuaauuuuuuguagagacagguuuucaccauguugcccaggccggucuugaauuccuggacuuaagcauucugccccccucagccuccuaaagugcugggauuacaggcgugagccacugcggcuggccaguguuuuuacuguuuauggaaaauaugcaacaccagcaguuucacuucuugaggguaaaacuggccuguguuauauugacuuacauagugagaacuaaaugauucuaagcagcuuaguucugagaaagccaccccuuguuucucuccaggucuuccaccuucuggcugcuucagccaggaucuguuguguugaaaauguugcggaguucaguuggaguagauagugguggcugcuagucuguuacaauuuggugcuguagugaguugagaucuuguggguauugaacuguuuuuguauuucaguucgcuauuugugccuacauaaaaauuuuaaaaaacugaauuuuccauuuuucauuguaguguaggaagaaugaugauggagacacaguuguugugguugagaaagaucauuucauggaugauuucuuccaucagguaagagcguuuaaugaaacccaaucauagccugccuaccuguccucccucccuccccccaccccucccuccuuucuucccucccucucccuuuccuccccuccccuccccaccccucccucccucccuuccuuucuuccucccuucuuucuuuuucuuuuuccuuuucuuuuucuuguuuuuggagacagagucuugcucuguugcccaggcuggagugcaguggcacaaucucggcucacugcaaccucugccucccagguucaagugauucucuugcgucagccucccaaguagcugggaccacaggugugugccaccacacccagcuaauucuuuuuuuuuugcacuuuuaguagagacgggguuucaccauguugccuaggcugguuucaaacuccugagcucaggcaauccgcccgccucagcuucccaaagugcuaggaugacaggugugagcccuugugccugguggcuuucuucuuuaaagauuuauaucaauaugauugugcauuuaucauauuugaaauaauacuuaagcuaauauuuuuaaaaguuguuguuugaauuacguaaguucucuggaauuuuuaguaugaucacaauguuaauaaugagaaaaaugcaaaucaucguucuaaugcaguccgggagggaacuggguguggaugguggagcugugcacguggccuccgcguggguuggggccgggccugcagcgcccucugcuggugggcggccacuucucccacccggugcuggcugcugcaggagcaccgccuccuugcaggcugccuuuuggagguccugcggcgccccuuaagagaguuuuacaaaggccuuccugcaagacuggcagugucucagaacgaggccuccuugguucuucaggaaguggugguuccggcagcagagguggcgccuggcugugggggcaggggucaggugugcguggcucccaccagcacugccauccguccacuggugggugugaguccugaggcaagugccuagagcagagggcucagggucugaaaucggugacagaucagcuguauaugagcucagguagaagacucagaggaaagucacaggugacccaguggcugauauuuuaaaauguggcggccuggcggugcugggauccuaucugaggugugaggccucccccuccugcuuaucuccccagcucagcucuugggcuuaggcccugcugaaauucucaaaccuaagaauuaucugaucuaauguugcuuaauuucaaauuuuugaaauugagucacagaacaaauauauugaccuuguaaaacaugaagaaacgaaaacacacguccaguggguuuuuuaaugacggaaccuucauugcaggacucgucuugauuaugcugagucucaugggauaguuucacucagcagccucaucuggccuagcagugccuggauuugaacauuuuaauagguuuauaaaagcauauggaaaguuacuaguuuuucagauucagccagaauuucuugaauaucucacguaagccuagucacugguuuucuaguauuuguuaguugcuacuguuauuuaaaggaaaaaaccaugagauuaaauuguuagcuacaaggaacuuccuuuaagguaugaaggaguuaagaugcugggauuuccugauuucacuucuuggaaaugagacuuuuuaaauugucuuuagccuuccugcccccuuugucaaauuacuauuuuucugauuuuauuccuuuuacuugguugcuuaacucuuccauguaaguucuuuguaaaaauguauuuauuuuaaagaaucuccugccauuaaguguugcauuuaauagaaaagucacauagugcaggccgggcccaguggcucaugccugugcucccagcacuuugggaguccgagguggguggaucaccugaggucaggaguuccagaccagccaggccaaugugccaaaacccugucucuacuaaaaauacaaaaauuagccaggcaugauggcaagugccuguaaucccagcugcuugggaggcuguggugggagaaucgcuggaaccugggaggcggagguugcagugagcugagauugugccacugcaccccggcuuggggcaacagcuugggcgacaaaaaaaaaaaaaaaaaagaacagaaaaguuacauugugcaauucacugagugccauuaagcuguggucuuugucuaucuggugccagucugucuuugcugcuggcgucucaggggcaugugggaaacagguuacucguacuuuaggaaggcuugcccggugcuugccucauuggguucuaacuuaagcucaagcuuucauuuguuaaauagucaauuuauuuugcacuuaauuucugugaaaugacuuccuagacaaauacagaagcaaauaauguuugguaauauaaacucauucugaucuucaauaucacauagaaguuugcaagagaaaugaauuucacauggugaguguuugguuaacacuaaaacagugcucugaaggguggccagggagucuuguuucugugaagaugauuuauaauggagccaaaggaccccugugcuauguuauucccggacauaaaaugguagcuggcaccauucucucucagugccugucuagguacaggguguauagcccugcggucuccuguuccucuggagccauacgggggcuuggaguuagcagcgguguauauugcagaacucuccaagaguuaaaauaauguuuuuuucuuuuacuuucuaacauauguguauuacuuuagaaaugguaauuuuucuuucuuuuuuugagacggagccucgcucugucacccaggguagagugcaguggugugaucuuggcucacugcagccuccuccuucuggguucaagcaauucucuugucagccuccugaguagcuggugcuacaggcacaccaccacgcccggcuaauuuuguauuuuuaguagagacggcauuuugccacgcuggccaggcugguuuugaacuuuugaccucaagugaucugcccgccuuggccucccaaaaugcugggauuacaggggugagccacugcuccuggccugcaugauucuuuaauacuuagacuuuucaaaucugguccggggcuuggguuaggagucccuggggucccuaagacccuuucaagaggauucuguggucaaagcucuuuucaaaguaauacuaagaugaucauugccauuuucauugucuuaugacugcacaaugauggaguuucucagagccaacacaccaaacccagaaauaucugugaugaucagggugcugucuauuaagcuggacauuagauuuacaaaaagugcaaaucacugccucuguuuccaccgauuuuuuggagaucuauuuuucacagaaauguguuauuuauguugauccgugugucaguuuccugcugcugcuguaacaaaaucaccgcaaucacugugcuucaacaacacguuuaucaccuccuccuaguuccagggccuggagaagcucagaugcuggcagggcagagccgcaagccuccuggagcugccuuccucuccaucuuccgcaggcggccuguguucuuggguuuccucccucuugaaagccaucacuccagcugcuguuuucacaaucaaguguccuucuuccaacguuggcucccuugccucgucuuauaaggaauccugugguuacguugggcccacccagauaauccaggguagucucccaucucaagacucaauuugaucacaucugcaaaguucccuuugcuaugcaaggugacauauucacaggcucugggauuaggguguggauugugccacaacauguaaugguuaauaauuacuucuuccuuuuuuuguuuuuaagagcagggucuugcucuguugcccaggcuguaguguaguggugcagucacagcucacuacagccucaacuuccugggcccaagugaucuuccugccucagccuccugaguggcugggacugcaggcaugcaccauugugcccggcuaauuuucuuuuuuuuuaaaguuuuuguagagaugggggucucucuauguugcccaggcuagucuugaacucuuggccacaagugauccuucugccuuggcucccaaagugcugggauuacaggcaugagccacugugccuggccuauaauuacuauuuuaaaaugaggaaggagguaggagcuggcagcagagcaucuugcuccagggcucaccuugcugcuucuguagcuggaucuccaucuacugcugucuucuaagaacacuugcgacuuuaacccauuuaugcguaguguuccauuauuggaacgcuaagcuuuugcgaguuauuuauauccuacugcucagggucaucaccaaggucugauuuuucacacacacacauugcagccucuggcauaaauggguuaaugaggaccaaacuggagaauucaggaucauuucccgucuccagauccuuaguuucgucacaucugcaaaguaucuuuugcccuauaagguaacucccaggcccagggaucaggaccugaacaucuuuggggucauuauucagccugccguagagguuuuugaagauaauguuaugacuccaucuagauaaaucuugcuaaugauauguuacauuuugaaacaaauauugaauuuaaacauuuagaggucaaagauaauaauuaugaagccuuggcuguaugagcuauagauaccuccucccauaagaguauuauuauuauuauuuucuucuuuuuuuuuugagacagagucuugcucuguugcccacgcuggagugcaguggugugaucuugguucacugcaaccucugccucccgauucaagcgauucuugagccucagcuuccugaguagcugggaucacaggugugugccaccucacuuggcuaauuuuuguacguuuaguagagaagagguuucucuauguuggccaggcugguccugaacuccuggccucaagugauccgccugccuuggccucccacagugcugggauuacaggugugagccacugugccugcauguuuuaugggcuuacuuccugguuauacugagaauggguauuaguaguaguaugcuucuaauuggccccaucugugucaugcuugggacuugacuagaaauuuuuacaaccugauagguuuucccggugaauguugauugguacugcuuuagguaugaagguagaaauauucauaggauauaucuuuauuuuuuaaauuuaacgauaccagugugagaaugggagaggcuuuuauuucuuaugugguaauuauuuauuucccuccuuuauucuuccccuuuuaggggaugaaaaguggucacagauuugaguuugccaugcuguaaugacucucucucucuccuagguggaggagauuagaaacaguauugauaaaauaacucaauauguugaagaaguaaagaaaaaccacagcaucauucuuucugcaccaaacccggaaggaaguaaguuguugguuuucacaacaaaacguuugucugucugugugucccucuggcugucugcggcacaggccucaacucuggccucacgggagauucaggggaguuuguaugaaaugcugacacccuagagagucugaggcguuuggccuggggcgagccagggcaucuguauguuuuuuuuuucuuaaagcugccuguaugauucuaguggucagccagggugaggcccacugauggaucauguccuaaagaauacacgaaaguggcuucacagaacuuaggggccaagauuagaccacaguucagcaagacagcauuuucuguucagagggcagugaaucagggauugauuuggaaaacaguacuuguaagagcagagugaaauaggaagacgcacugaggcgacucugaaagucuugaggagcuuuuguauggacugugcugcgcucaguggcugugggggauggcacggaagaaacgguuuucuuucuuuaccuguuuauccaaauucucccugccucacauuugcuuccuuuugaaucugaggcacacaggagagugaaaggagcucaguggaagcagcuggagaaccuggauuuuugucucaauuugcuuccccgugguauuugcaucuccucauugggagaaaagacaugauuuuaaauuaacucagcguuaggggcgugggagcuauagagaagagaguuucauugcucuggaaugauaaauauugaaagcuuuacaggggacauggaucugagcaagccagagauuacaaauaggaguccacacaucaugguggggggaguuacuauguuaacaacguugagucuuugaauccaugaaaauggccccuaccuccacgacacaggccgccuuuaaugccggucugugcggugcuguggguuccgaggagggucgcgcacaucuuucguuguauuuauuccuagguagucaauguuuugauguuaaugcaagucguauguacuuuauuuuuuauuuaucuauuuuuuuuuuuauuuugagacggagucucacucugucacacaggcuggagugcaguggcacagucucggcucacugcaacuuccgccucccggguucaagcgauucuucugccuuggccuccugaguagcugagacuacaggugcccaccaccacgcccagcuaauuuuuguauuuuuaguagacaugggauuucaccauauuggccaggcuggucuugaacucuugacuuuugugauccaccugccucggccucccaaagugcugggauuucaggcaugagccaccgugcccagccguaucuacuuuaaaugucauuuucucuguuuguuguugguauauagaaauacaaugauuuuugcauauuggccuuguaccccuugccuaaucaguuauuaauucugauauucucuguagcuuauguuggauugucucuguacccagucauguaauugugaauaaauagugaccguuuuuuccuugcagcucuuaugcuuguuaguuuuaacugauuuauuuagcugaccuccaguacaguauugaauagaaguggugaugggggcacauguauucuuggucuuggaggaaaguugccagcaaauacauuuuuuguuggaauauuacuuaguguagccguacguugaaaaaauaagaaaguaguauuaaauugaaaaagugcauuuuaaaauuuuauguaucuuguaaaauaauauucugagccucuguuuaugcccucucagugacucagaaguguguuucccaaaauguuucuggagccgccgucucaugagcuaguccgugcagccagggugcugccugcggccagaucuuuccggggaccucuucgugccgucgcccagccccucuugggaaguugcaguacccguagaauaaucaaggcucugagaaggcuuccuagaaggaagccuguuuagcuuuguuuaguguuucacacauuuauuugcccguaggaccuuuuauguaacaucuguuaacaucaugcuuaaugcuuagggaaauuauauuugaauaaguauccgcauuuuuuuuugaauaauuuaccuccaaaacauuuuugcugccaagucauagcagagagaacuauuuuuugaguaaauuuagaacuguuacuguuucaugauagucccuuuugggcucuaaagaaaaccauugcuuuuuuguguuuuguuuugugacagagugugaaccaaaauguaggcagcagccuccagccgcuuccuuggucagucuuuaaaaagcaaaaugcagugauuccucucucccagugaugggcccgggguaacgcagagagggacaggcucuuggccuucccgccuuguuccuaaaggaagaggggagggugggagggaggaagggggacuacugugcuccgccucccgcgugucucccuauucucgggcaggcgcucugcuuaggucccggugagcagggcgauccccgggcugcugcccucccggaggucccccgucaaccucaggacccggggcagggcugggcacggcggccgccagguggcgccagaggcagccgguccugggcggguccccggucccagcaccgcccgcgccgcgccaccugcagccgcggaucccagggcagagagguggacgaaggaccuuuuaccugcauuuuucuuuuuucacuuucuacuuuuguauuauuucuuuuuucuuuuguauuaaaagagcgucuuugcaaaacguagaaauuucaggcccuccaagacgcggauccagcccugcaggagcaugaagugugugugauucugguuuggguuuuagugacgacgaggcugggauucccccugcaggacggcggggauuugauucgcuccugcagucagccgucagccuggcuugcacccuguguucgggugcggucguccuugcggcugcgcacgcucccguuuucucugcuuccuguucccucagccguucccuggggcuccgcuccgaaugcgcuggggcagcgucugcaccgucugcaccgucuccaucgucuccaucuccagcgccgccugcucccgugcauucugugcuuuuccgcgggaaaucagacucauggagacccggcuccuugugcggaggccccugaggcccuggaggaagccgcgccucuguggcucuggauucagauccugucccaccgguuaucccuguguggccuuggacgcaucacuuaaccucucccggggcaguucccacacgugugaaaugagcuagugguggcaucugccuuccagugcuguugugauucuuccucccccgcccucucccccccacccuccagaggagucucccugugucgaccaggcgagagugcagcugcgugaucucagcccacugccacugcaggcucagccuccugggcucagacaguccucccacugcagccucccgaguagcugggauuacagguuuaugccaccacgcccagauaauuuuauauauauauauauauauauauauauauauauuuuuuuuuuuuuuuuguagaaacagcguuucucacuguguuaccccucuccuguccccuccccugcagggcauggggacagcucacggggccuucucccuucagaaacgaagccgcgcguacuccccguaaggagcugcguggccaggcuccggcauccccucccacugcagggccuuccuggggagucuuggcuccgggaccccugcccugcuucagcccagcugcccccaccacaggcugggaccaccccacccgaggccuuccugcccuugcgguuccucuccccuuccuucuuaccuccuucagugaagauucgcuauuaucugaaauuauccucaguuuaguauuauucucgaaggauauuuucacugaguagaagauucuaguuuagaaguuguuuucuuucaccacucugaagauuuaaaacauauuuuuccagugucuuuuggcuuuacuuuuuuuuuuugucagcuaauuagagcuuuuaagauauuugguuuuuggucuuugguuuuagcaguuuuacugugaaguuuugagaugugguuuucguuuucuuuuucccucuucuuauaaggcuucuugagucuuuggacugacguuuucuggcuguguuuuugaaaaacuuuggccauuacuucuucaaguagcauccuugcuccguuuucugucaucucucuuugcggcuggaauuguaugucuuuagagcguuucaguguauccuuucugucucuccucuuuuguucucuauuuuucaucauuuuuucucuauauauuuuauuuugaaaauguuuucccugacuuaucguuugauuucucuucagcgauugucuuucaggucagggaaucuuucuucaucuauggaauuauuuuuggauugguuuuaacuccuagaauuccacuugguuccuuuuaauacuguccuauucucugacaaaauuuaugaucuuacauuuuaucucuuugaauguaauuguuuuaacgucugugucuuguaacuuuauuagcuggugccucuguggauggguuaguguugucucuuuuuguuggguuuucauucauguguuuuuuuuuuucuuuguuugccugguuauuuuugauugaguuuugagcuuuguauuggaauuauuugcaguaauaauuugaguccugaaugguauuuucuuuuuaaagagaugauuuauuuuuauuucuggcagauggcuagaagcaccagcaauucuggaucuaauuuuagggauugagaugauuuagacugaggcuucagccccugcgagggccagcuucccaccugacuguuccuccuagggcauugucucuccaagucagcacaguuuucucagcuucucugcagcucagcugccuuuuauggaguuggcacaugcccccagguaaaaguggcugcaaaaguggggcccaugucuuuggguuuucuucuucugagucuucuuuccugccuuguuagguuucuuuuguuuuuauuucuuuuuuuaauuauuuuauuuuauuuauuuucgcaccuuguuagguuucuaauggcuuuacacagauuuagaaagaguauugugucuacccuuucuaauuguucucagcagcaggauugagcugaaucaccuaggccgcuggaagaggagguuccugauccccgucuggucucugauuugaaauaccaccuuuaucaaaugugaccuuauggccugcgucugcagcuugcaggaucagacaggcagugccucuuuuguuuugcugaugaguugcucaagccccgugggccuguaguggcagcaaguucacuccgucaugagugccccccaccccugcuguguaacggccaagggcuuucuuuccccaggggagugaguccugcuguggcccgccagcucaagagggagacucucauccacuggcaggcccagcucucagaucuugugguuucuguggcugcgcgguggcucaagaccgucucccgagucuagucguccucagcugugcucaggcgcuggcugggccggaccccugcacaaaugcccuugcuguguguacguuuuagcuucgacuccuacacucagcccucauuccccaggcacaguggccaggccuuggggguguuugcaucagccucacgcaccacaggagccagcaccccugccacaaacuauggaccugccacccucuuuauucauagcaagucucucuaauuccugucaaaugccccauuuuauaaggcauuuuguguucccuuuacuauucuaaaaugaaguucauagaugauauagccuaccuaccuccaugauuuuaaaaaaacauauaauauccaaacuaauaugaaggagacauaaaauggaaguaacuuacauauugaaguacaaauuguauugugcaggcucaggcacaacaccagaaaacaaaauucaggcgcuugccccccuacaaacaagugcugugacugucacagccaaggcugcaagcugaugaggugcugugauucagcugccguuagcaggcuucccugugcuuuuccugaggcaguaggugucacugaaauagacugaaguacagcuuucucgccaugcagagcggugacacggcaguugcauuccugaaaauccacuggauauugaaacgaugcagaugaaaacagggcuuauuuguaagcuggagucagguucugggcucaggaaaacaggucuuuucuccugccugagugagcagcgugcaucuggcaguuaugcaggccagugggugaugugcugauguaaugagguucgaggguggcacaucucacacgcgcacgaacaccccgucgucacgcucaggaacuacaggaggauggaggccaguucuuuguuguguggugcuggcuggugccauuccuggcuuaugucuucuggaugccaguggcucucccuuuuuuaugaugacuggaaauaccccacaaauuucagaauaccccuuggggugguagaaagauuccccugagaaucucccuuuagaaacauguucacagaggagaaucacgaaaugaccccuuugugucuaguuucucuuuuuuucuaguuucauccauuaucagaauaauuuuucuuuguuuuuucuuuuucuuuccuuuuuuaaauagagauggcauguugcuaguugcccagguuggccuuaaaguccuaggcuuaagugauccuccugccucagccucugaaguagcugggacuacaggugcacgccacugugccuugcuuaaaaauaaucuuuuuaggcuggaugcaguggcucacgccuguaaucccagcacuuugggaggcugaggugggcggaucucgaggucaggagcucaagaccagccuggccaauauggcgaaaccccaucucuacuaaaaauacaaaaauuagcugggugugguggcggaggccuguaaucccagcuacuugggaggcugaggcaggagaaucgcuugaacccaggaggcggaaguugcaacgagucgagauugugccacugcacuccagccugggugacaagagcaagacucugucucaaaaaaaaaaaaaaaaaaaaaaaaaagucuuucuaaugcaucuuugcugaugccuuucuuugcugagaaaccuucagugcugacuggugcccucaguaaaagccccaaacucagcugggccugcacacuccugcccaggcagccuguaguuggccuccucccacgccagucacuacagcccaccgucccgcugcucugugccauagacccuucuucugccuggaauggaagccaccagucucuccacucccaggucagauguccccuccugugggacagcugcagcagacgcuucuccuccucgcugcccauggcauuuugugaacccugucucguccguuguuagucucugcguggcauuggcgcuuccuggguuugucuugucuguuuuuaccgaguuguuaggucccuggcggucuuguuagccuccuuagaugacacgggccugcacacagaaaguacucaguaggugucacuggugcgugaccugucaccucuggagaucacucagucucugaucuggcucugaaacccuggacgagccaggcugcgucugaugacuguagcugagcauggaaagaagacuuagcacacgcuugugugcaguggguacucggggcacccugcguaugcucagcugagggggugucaggaagagagugggcaucucugaaagcuuucauucuuggccaaguugucuacggcagaaacguuugccuuuuccccggcugaugcgugugagauugagugagagaggcaagugcaggacucucuaaaacgacaacaggacuccagagacggggcgggggccuuccuguuucagcaacuucugcccaaaggagagagaaacccccuucccuucuggucacuucagccacuggacuggcaaaugugagugugcggcauggagcagacauccugccacccucccugggcucuggggcagcuaggcaugaaagcagaggcugcuaugacgcccuggguggccuuaggucucagcacugcccuggagugucagcuccugcucugcuggccucccuccguguuaggaggccggccccugccuccaucgcccccugcuugcagcccugagugucugagaagccaggccagggcgaccggcccagcagcccugaagugguggcugugauuauucgggcguuuuggggagacagcugacagcacaagagaaaagcacacacacgggagacuuuguugagaucaucguuacgucuccguuuuccuuucccaggucuagguguuagcaguggauuuaggcagcaguuucauucauggguauagagcagcaagucucaaacuugugucaccuggaggguuugcuaacucagauugcugggccacuguccccaccucaguuucugaguagguccagggugggccccagggauuuguguuucuacuaagcugccaccugauauuuaugaaagcugcugucuagggacccaccuugagaaccacugguauaagcgguaguuuuucuuacagaaaaaaagugaauauuuacuaaggauacuguuucacuuaaauuuauuggauaucauuuauguuggauauuauagcucagaugcuguauuuuauuuuuuaauuuuaaauuuuuauagaaauaaaagaagagcuugaagaucugaacaaagaaaucaagaaaacugcgaauaaaauucgagccaaguuaaaggguaaguuugaaguuuuauguuuaauuauugauguugggaguauggguauuuguuauuuuuuucuuuauugguuuuuguucuuuuacauuuuuaaaaauuaaaauagugacugcuuuaaaauaaauuauuuguauguaauucagaguacuaauuaauauucaaaaagguuauguguuugcuuauaaacuguuauacuguuacauuuuugaugacauuucaggcuaaguugcagauguuugggaaggugaguugccaggcucuucuugaauggacccuuuaauugcucauuucuuucaaacuuucuguagaauuuauucgaugauguuuggcauuccacuuuagcagcaguaguuuuuugggaggcuuauagcuuugucauguaaaacaggggacuuaaacagagguugcuuuuucucgauuugguagaaaacauguuguauuugauuuuugcagaauggcaucaagaucaaaaacaaucucugugcagaugauaaaauacuuuuauuacggcagguuucagaugugugcagaagcagagagaggcgaccacaagccgaccccccagcuccacaguucuccaugagcucccacccgcacccgcucccagacuauucugaagcccaucccaggcaucugagauuucaucaguguguauuucaaaaacagaagcuuccccaaaagcacaaccacaauuauaucuaaacccaaauucauuauaauuacuuaauaguacagaauauccaggcagaauuuccccaguggucuuacgauuuuuuuuuuuuaaacaguuugcuugaauugagucccaaauaaggaccaaacccuggcuuuuaaaaaugagauucucccuucaugauuuuucucucugcacuuuuuccuuugguuggugaaaccaggucauuuguccuacagaaucugccaugcugcagauuuugcugauuuuaccucugcagcacauuuaauaggcucugccguccucugaauuugcuguagguugguaguuaaauucuccaagcuuuaucugauucagguguuuuuuguggguuuuuaaaauguaaagaugcagcaucugauuacagauuuuauguccucaugguuacguuaagauguuaaugguggccuggcacgguggcucacgccuauaaucccagcacuuugggaggccgaggcggguggaucacaaggucaggagaucgagacuuauccuggcuaacacggugaaaccccgucucuacuaaaaauacaaaaaauuagcugggcgcaguggcgggugccuguagucccagcuacucaggaggcugaggcaggagaauggcgugaacccaggaggcagagcuugcagugagccgagaucacgccacugcacuccagccugggcgacagagcaagauuccaucucaaaaaaaaaaaaaaaaaaaaagauguuaauggugacauuaacauuuuuucuuggcucuaaguaaguucaguaaaauuuuaaauaagauauaacauucuuuucuauucugugauauugucaaaaauggaugauuauuuccaagauccauaauucauuagaaguugcaagcaguaauauccugauuuuuuuuuuuuuuuuuugagacagagucucacucugucacccagguugaagugcaguggcacaaucucggcucacugcaaccuccaccuccuggacucaagcgacucuccugccucagccuccugaguagcugggacuacaggcgcccgccaccacgccuggcuaauuuuuguauuuuuaguagagaugggguuucgccauguuggccaggcuggucucaaacuccugaccucaaaugauccgccagucucagccucccaaagugcugggauuacaagcaugaauauccugauuuuauucuuccuucuuuguuuaguugcuggaauaguuaaaaagaaaccuuuccccuucaacucuugaauuggguaguuuggagaauuuaacuaugagcccacaguaaauacagaggacagcagagcuuacugaauguguugcagggugaaaucagcaaaaugugcaguguggcagguucuguaggacgaaugaccuggcuucuccaaccaagggagccaaagcacauucugggucacagaucauggaggacagagaggaucagcguuggacucucucucucucugguauaauuuucauaggucaguucccugggguccuccagagaugaccagggagagucucuguugcugcuugucguccaucaucgugaacacauggauuuaaacacaucugauguuuucauugcugcauuauccuuaaugcucagauggucucuuuggcuaguaggguggacucuugaguccuuuugguaggccccucauugucugugacagccuuuccacuuuuugcugugacaaaaguccccaugcucauuucaccccuuuccucccugggccuggcaucagccauuuccccaggaagcccugcuccugugucugaagaaugugaucuagacaccgaggucagcaugcuggggaauguauugcuauacaugacgaugaccugaccauucuuuccuaggcuuuuucaguggacugggcuaagauuuuuuuaaaagauaaaaugaaucaugauuuguuacugagaauccaaauuaaauuaagaauaaaggaaggacuaaaaauuuuuuugaaaggauuuuuacuuaauaagggcaauauuacaucuuuauuuccuuucaacuaugccccaaauucugguucucacugacacauaauuauucacuugcuauucauaguacacacacaacagacucaaaauaauuaugccagcaucuacugucaagaguaugauuacuuaaagguuuauuuuuuauuuuuugugucauucuuuuugucuauagguauaucccacugggcuagauaaucaaauuacuuuuuguuguuguuguuguuguuugaccuggggucuugcugugcuggccaggcuggagugcagugacuguucaccagugugaucauagcgcacuacagccucgaacuccuaggcugaagugaucccccgagcacuugugacuacagguacacgccacuguguccagcuacaaauuacuggguuuuaaaguugcuuugaauaguuuuuccucuguguguuuauuuuuuugagauggaguuucgcucuugucgccuaggcuggagugcaauggcacuaucucggcucacugcaaccuccgccuccugaguucaagcaauucuccugccucagccucccgaguagcugggauuacaggcacccgccaccacacccagcuaauuuuuguauuuguaguagagacaggguuucaccauguuggccacgcuggucucgaaccccuggccucaagugauccgccugccuuagccucccaaagugcuaggauuacaggcgugagccacugcacccggcuccucuguauguuuauaucauuaacuugacuuacuguuagguuugcuuuauuuuuucuuugaaguuuagggauuaauuuuuuuaaauuuaauuuugcauuaaguuuugugaaguauuuaugucauucugacgucaaauauauaaaacauauucggagucuagcuucuuucuucaucguccccuuguuucuccuuucccuuuagugguacccaguuuuaaaguuuguugguuauguuuccauuuuuuuguauguguguuuuccauguauuuguauauauguguguauauauaucuguguguaucuguguauauauguguguauguauauauaucuguguguaucuacauauacauguuuccucuugaugggguugggcgcaguggcucgcaccuguaaugccagcacuuugggaugccaaggcaggcggaucaguugagcucaugaguucgagaccagccugggcaacauggcaaaaucccgucuguacaaaacauacaaaaauuagcuggaugugguggcacacgccuguaauuccagcuacucgggaggcugcggugggaggacugcuugagccugggaggcagagguugcagugagacgagauugugccccugcacugcagcccgggugauagagccagaccuugucucagaaaauaauuuccuauugagggauugucuuuuuaguagauuguuuuagaaggucacuuguucauuagcuuuaguuuuauaaagauacuucaaagauaagaaauaaaaggaauuugaagucaggcuuggaacauuuucauuuuuaaauuuggaagguaauuauuuccuauuuguuccuagcuauugaacaaaguuuugaucaggaugagagugggaaccggacuucaguggaucuucggauacgaagaacccagguuugcuaucagccucguuuagauuaaaguaaugucgcagaauaaguguuuuuacuuucuucuugcagacucugaauaauuucaucuuuacugucaugcuuauccucauaguauuucugcacaaaaauaauauaguauuguaaaacaaaaguaucugagacagagguuuauuuugccaaaguugaggacacacuuggagaaaagaaauacaaauuagaguaggaucugugguuugugccuuuccugaagaggguuuugaggacuucaguauuuaaaggggaaagagcgggcaggagaggaaggaggaaaggggaaaaaaaagagaaaaaguggggguaggcagcgggguggccacacugcugugaggcuuugcucagggcucacugcguucacauuucacaugugggaagagaggagugggggucgauucugcacuccucccgugcccagauccgccucuuacgugggccagugugagccugaggugagggaggagcuauacaugcauuucucagggugggccgagggugacuucuagucuugucuuuguccuguaccugugaagguaagcggcuaauguacauugucagggugagauucugcagaacucuguuuuagaguuaguuuuuggugggggggauauggauucugaaagauucugggaccuacgaggaauuuccuugugagcacuuugugcaggaggcugcuggggcgaugugcggccuucugucacugcagccaucuguuugagaagaggagggagggcaguguuuugcaugacucaguucccaagcuuaacugucccuuugggauagugagugugagguccugcgauuuuauuuuccuuucacaguauuuauagaaaucucuuuauugugaagaaaaaucuauucgguccaucaacagaguucuauuccaaagaguagggaauuauccaaaugauuuuaguguuugugguaaggccgccacguuuuagugguuugugguacugcccagaggaagacagagcccugaggccucgagggcacgaggcgaugaagcacgcgggcucugggguccgccugccuggguccccucaugggcacaaggcgaugaagcacgcaggcucugggguccgccugccuggguccccucaugggcacaaggcgaugaagcacgcgggcucugggguccgcuugccuggguccccucaugggcacaaggcgaugaagcacgcgggcucugggguccaccugccugggucccagugcugaucuguguuuaucagaaaagccugugaccuugggcuaaugaccucaaagucaugguuuucuuuaaguaggguugugaccggcauaguaggggucuuguaaaaauuagguaagaucaugcaugcaaaguucuuagcacagaugcugccauggggacuuugccauugucauuuuccauuugcaggagcagaauaacauguaguuugaguuuccaaaaugcaugucuugcaugucacuuucaguagaaggcauggcccucagauacgaauguaguuuuccuguguuguuagcauucggugcugucucggaaguuuguggaagccauggcggaguacaaugaggcacagacucuguuucgggagcggagcaaaggccgcauccagcgccagcuggagauaagugaguaauggagacuccgucuuuguuaaaaucauguuuuucucccuuaaggucucacuucaaaugacuuuaacuucagaaaaggaaauccaugucuauuuucaccaauaguguaaaacccaaagaccacucguagcuuccuaugccgugagucaggcaaaccuguucuuccugucuucaggaaguccuaagcggugggguuuaccuugcucauugcuguugcuuuuagaguuucagggagauugggagagugcucagucauuuccucuuugaguguuucuguguccucagucccgcccugcccugguucgggggcaucuucauggcuccucacaucucuccuugucugugagcagaggcagcggcccuauugccccagacucuuuucaggggugucuauggggacaguuggcuguggcaguggagauggcgccuucuucggggacagacgggucuguuucagggauaaagguuggucagguuuguagacuccccauugugaaagauugggguucccaagcucggguccuucagcugugacacaaacccacugugaggacgucccacugcagcugcucugccucuccccaugagacugggggccguggacagcugcucaugagccucagguugccugcugugcugugaguaggaaaucccuuugucccugaccuggggccuuggaccuucugccggcccccacggagcccuggcaggccagcgugucagcucgcaggucagaugaagccucaggcccaucccggcucccaacgccgcacaucccccucagagaauguugucauaugcccgccaggccgcuugaccuugucccacagcucagcgaggcuccucauguuuuagauacucuuuuccaguguguuugguuuuggucaguuucucuugcuugucugaucugccuuuaaccuccucugguguauguuucaucggagacacugguuucuguugcuaguucugcuggguguuuuacaugucugcuguguugcuccccacuguacaacugggacgcacuuguaguaacuugaaccgucuuugucugccaacuccaguguccugucugcucugguugguugauuuccuuccuuucuguggcuuguguuuuccugcuucuuugcgagccugguaaguuucgagugugugccagacauugugaacguuacuuuguugggugcugaguauuucuguauuuugaguauuuuuguaaaucuccuugggcuuuguuuuagaauguaguuaaaucacaugagcaugguuuagccuuugggaucuugcauuuagagggagcagagcagcuuuauuugagggccugucauuccucacuccugagguaagacccuucugagcaccugcucugauggccgugaaccucauggcacccucgucugccuggcagcguguucccucuggcaugcuggucagcacuccagugagcaugcggggucugugcagcucgcucucugcaucucucucaucucucauacuccaucuugcaaauccaguugccuuggucuccccugagcucugugccuuugccuuaggacuuccccugggcuccaccugggcccuuucugcucuguggcugacacgagaguuccgucugagggcagcagcaggcucaccuggcuuguuuccaucuguugggaaucaguguguggccugaugcucagugucuuggaaaucguuuuguagauuuugguggguuugugguuauuucaaguggcagggaaaauacggucccuguugcuccauccuggcagaaaugcucaaucaugaugucgacuagacugcuuuucuaugaaaaaguuuuuacaaaccacuuugacuucagggaucuguuaguacuuuuuaaagugaaagucaucauuacaggcagccgguugcacugugaggauuuaugcucugggacucuguggugagcgcuuuucuagcacagaguuccccagccugggcuugaaggccccgcaccaucucuccugcagguccauccugucuucacuccccaugugaauccgguggcgugaucagaucgccuaagucucuucucucuuucccacauuauucuaucucagcccacagaauucauuuccaguuucuucucuugcaaucauacucuaucgaaugcaguacuguuugugaaagugucuuauaagcaaugaaguaucauauacguguugggaguuuuuuuuaguaauuccuuuaagucuguuaaauucuaaacccuccauguggcuauuccgaagugagcaggucuaugcaaacucacccccaaaggcugagcgagcugagacgccaaagaaagaggcuaacaaauccaguuucucgaaggaaacauuggcuagggacguacgaacagaagcccccgagagacagagacgguggaccccacagccgccugcccucagaaaguguucuuuauacagcaggcuuucaggguagaacgugugcagccggcccugucuucugacuugcuugacaacacuugggaccacuggucaggcuggaugagcaucuugaugagagguugccugugccggaggcaucgucuucagaccucauugcagaacagcuuggcaugcacgagucgagcaucggucaucacggugguuuugcuucaggauggcgucacucuggccacacagcgggcugucuucauacaguggucuucuccaaauccuugcaccuaaaaccauuuuguccccuuucuuucuuccuuccgucagcccugucaucaggcagguuucuuaccuuguaucacaggauaucuuuuccugugcuguaugcuuuguuucuucaaauggcaagugaguuucuucuuggaccagggcauguuacauagguccacagugcuuucucuggaaugguuggggcuguauguguuucagaguucagaauuuuucagauuuuaggaagauaguacaauguauaagagguguauuauguaauccccagguggggucuaggacugcacccuguaaucaggcacauucacacagcucuccagugaaaugugaguauucacaguaagggggaggaguuaagauuauaaauagccaugacucaguuuaggucagauuuugccgcucauugaauuuugacaucgagcuuaaggaaaacccaguuuucauaauguuguggauuucagcauucuggauaaggaauuacgaauguauacugcauuucacauucuguaaccccaggcuguuucuuagacuuagcaguuagccggugggaagaccuuugugaacgugagacaugaacuguaacuuuuaguuuguuuuuuuuuuuuuuuuuuuuuuugagagagagccucacgcugucacccaggcuggagugcaguguugugauaaccacuuauuguggccuugaacuccuggauccaagggauccucccaccucagccucucgaguagcugggaccacagaagcacaccaccauaccuggcuaauuuuauuuuuuguagagacgagguuuucacuauguugcccaagcugaaauuucuaguuuugaugauuauauuuuacauuauuuagaacaaguuucauguuuuuaaaaaagcaaagcaaaacucagagaaucuccuuauugagcuauuuugaauagauuuuuaaguuuuauuuuauuuuuuguagagauagggucuugcuguguugcccaggcuagucucaaacuccuagccucaagcaauccuuccaccuuggucucccaaagcacugggauuauacauguaaaccaccaugugugcucucaaauagauuuuuaaaugauugagaauuaccucccaaaaaauaguguaaguaaacaaauuuugcaauuuacuaacuuuaaaacuuuuuucauuaaaugacaucucaacaacuuuauugagaaguaaaucucuuaauaugugaaugauauuuggagcauacaauuaauucagugguuuuugguguauuuccacacacaaucaauuuaaaacacuuuuaucaacccaaaaagaaacuucacacccaccaccagucauuccccauuuccucuccuagcccaagacaacugcauucuacuuuuuacuccuguacauuuucccauuuuggauguuucauauaaauggaauuauacacuauguguucugugacugacuucuuuccuguaacacaguuuuuccaagguuucaccauggggugggcagggugugguggcucacauguauacuaaucccagcguguugguugggaagccaagguggaaggaucgcuugaggccaggaguucaagaccagcuugacaacauagcaaaaccccaucucuguaaaaaaaaauaaaaauaaaccaggcaugggugugugccuauaaucacagucacuugggaggcuggagcaggaggauugcuugagccuaggaggucaaagcggcagugagcugagauugcaccacuacacuccagucugggugacagagugagaccguaucuuuguuaaaaaaauaaaaagggcuggguacgguggcucacaccugcaauccgagcacuuugggaggcugaggugggcagaucacuugaggucaggaguucgagaccagccuggccaaaauggugaaaccccaccucuacuaaaaauacaaaaauuagccgggcguggugacgcacgcguguaguccccaccacucaggggucagaggcaugagaauugcuugaacccgggaggaagagguugcagugagcugcgacggugccccugcacuccaggcugggcgacagagugagacccugucucaaaaaacaaagcgacaaaaaccaaaagcguccuuuguuuuuguggcugagucguaugucagugugcagcuagaccgcaguuagcuccuucaggcaucgggggacggacguuugcguuguuuccacuuuuuggcaauuaugaauaaugcugcuuauuagaugacauuugaauuaugacauuuauucauuuacuuuugucuucuguggcacaaacuaugaaaaauaguaauuaacaauuagguuuccaaaaccuguguacauguuucuucgaagucauuacacauuuaacucaaaaggaaagcauuaacuuccaaacauggaaaguguucaggcaucugacucucauuacguggacuuuauugauccucauuuaauacaugcuacauucagcucaacccccuuuuacaugaggcggaguuaaacucuuagggaaaccagugugccgagacauuguuuaccgauuuccuuucugcaguuguuucucacuaauauuaaaaugaaauuuuauuguuuauaacauuuacaaaguuucucggaguauuuuuauuucuucuugcuccucaaucuuagguucacuucucauugucaauaucugcuuaagaaaagguuaaaaaaauuacugaaaaaugcuaacaacuaugauuguaguugcuaacuuaugguugcaaauggcuuuguuuuuaaauugugcugcauucugaguggggcugugguugcgggucuuucagcugggagaaccaccacagacgacgagcuagaagagaugcuggagagcgggaagccauccaucuucacuuccgacgugagugggggugcggcccuguggcuccauguccucuucuguagacagagcuuuuuaaaaacccuuuaacuuccaaacccaucauaaguuuauuaauauuaucuuuuauuuuuguuuuuccaagauuauaucagauucacaaauuacuagacaagcucucaaugaaaucgagucacgucacaaggacaucaugaagcuggagaccagcauccgagaguugcaugagauguucauggacauggcuauguuuguggagacucagguaguuacagacucuugcauucuccaagagagauaucagucauguguaaaaucuuacugcaucccacucugucuaguggauguaucuaggaaagcuguuauuuuggauccaccaaauucagguuaauugcaguguuauaugugaugcugaaaugcuggaagcagcuuuaacaguugaacuguuaacaggaagggacugguucaguugauuaaauuauggaguguucauaggucagccuuuuaggcaaccauaggcaaccuaaacuuuguucauggagaauucuuacugaaauaugcagauguuugugcuagaauuaagagaaaagggagauacaaagaucuucuguguaugcccguacauauguaugaguacauaaacacaaacacauggcacgagcuuggcuccauaaaacaguauccacagaaggaaaggcguauaucaaacaguguaauggcagugagacuaugggaauuuuaaucuucucuaaaaguauuuauuuucagauuuucuauaagaagcauauauuacaguaauaacuaggagaaaugucugaaagaaucaaccccaaguggggauacaaucuaugacacagaugcaagcuugugccuguuacacgggguuucccaucugcccaguaacacagauagggagugaaagcagguguggaaaggcccuucugagugaaccgaagaguuaaugcaauucuuaauaaauagaaaacuccucugggaggcugaggugggaggauuguuuaugcccaugaguucaaggcuguggugagcuaugaucaugccacuacacuccagccugggugacagagugagacccugucuccaaaaaaaaaaaaaaaaaauacacacauauauauguauguauguauauauugaacucuccauguaaaguacgggauggaucacagaucacaugcucugugaugugcauggguauguucacacucgcucuuugucuuugaauaaggucuucucguuauuuuucaaauaccauggagauaagacucuguugcugguuaggauucagcugaccaccaggugaagcggaagcauuuauaucaaaccauccuaaguaaaugguuuccucacuuguccugagccugguuucggaucuguuuuggcuggagucauccccuaaguagguucacaucugaugggcuuauuuucugagacugccuggauuguguaaggauaggaauccauccacacacaggauuguuccugccugcuucagcaaccuuguuaagaaacacuguauuuugaagaacuuuauaaugagaaugugugugaaaaacucaggcaccaugccuauuuuuuuuuuuuuuuuugagacagggucuugcucuguugcccagguuggagugcagugguacaaucuuggcucacugcaaccucugccuccugggcucaagcaguucuccuaccucagccucccgaguagcugggaccacagguuugcaccacuacgcccggcuaauguuuguauguauaagcauuugcuagaggaaaccaacagcuacacagagggcagggaugggacgaucuuacuccuuuuugauuuugggggccccguugccauucauuauaugguaaguggaguguggggagucugauuaccauugguuacuuauuuccaggaagcauuccaaaggaaaccagcuggacagaaagaacgagagaugauuucuguaauuacuaaagcuuuuguaguaccuuagacuucaauuguaauugcucuauaccaaaugcauugcauuaagcuccguuagaaaaauggcugcaucccuggcuuuguuucacuguuuccuuuuagaagucuguugguauugcauuauauugacucaucuaaugcaaaugugugcauagucagagauuacuaguaaguugaaguuugugacugagugaguuaacucuccgucauucuucaaugcuuuacgauucacugcugcagguugugucuggacagacaaccagguaauacguuaccucccucacacuuugcugaauucaccucuguuuacauuuugcucauuaauguagucagcugagugucagaugugagcuaugcucaguuuacugauuuaaagaaguaguuacaauuuucuacuuuguggaaaagaugucauucuuuguauauugucugucugugcauaaugguaaaauacuaguucaaccaaaagcuggcugccucccuucacccugcccaucugucgaaagugucugcguguuaaagguaucucagaauugacuugaggugccuuuaauuaucaacaugguggcccauuccuuuucauucuuuuuaaaauauaaauugaguuuugauugcuuugcacuggcacauguauaauggccucaucuuuuaucuuucuguaaaugugaaaaaaacccucaguauccauuacaugcacaucguguuuauauaaaaccuuuguucuaugguugucuuaaagauacaugauuaagccauuugaaaaugucuucuaaguuugaaacuuuuuguuuuaagggugaaaugaucaacaacauagaaagaaauguuaugaaugccacagacuauguagaacacgcuaaagaagaaacaaaaaaagcuaucaaauaucagagcaaggcaagaagggugaguuuggcuucgaagaauuaagcugcguuuuucucuucauuugguuucaaguuguaauacauugauguaagccugccuaaaagguauuccaagaaauaauuaauuaauaaauguuuuauuuuaaaauggaaauaauuuuuuuugcuaaaaauuuaaaagguuuauuagaugaauuauuuguaguucaucuuuuguguucuaaguaauugaaacccuagggcugggugugguggcacgccuguaaucccagcacuuuuuuuuuuuuuuuuuugaauuggaguuucgcucuuguugcccaggcuaguagagugcaauggagugaucuuggcucacugcaaccuccaccucccggguucaagugauucuccugccucagucuccugaguagcagggauuacaggcacccgccaccaugccaggcuaauuuuguauuuucaguagagagaggguuucaccauguuggccaggcuggucuugaacucgugaccucaagugauccgcccaucucggccuuccaaagugcugggauuacaggcgugaggcacggugccuggcaccaaauuguuggcuacacauuugaugcagugaacauuuauuuuuaauuuagguuauucgugacuucuugguuuggaggaaagaagagaauuauuugagaccguggaccugcagucuuagguagcacccacuuaaagggauccucaaaagaagggaaccccuuucacucaagaugcacagacuuugcauuaaaaaggguucagggaacccugugugauuuuuuuguuacggggcaaaaauuuaaaacuuacucuccuaacuuaggcauuuuaugauagugccccugacacuggagagauuauggguuuuucacauugucaccuccuugugcuaauacacagagaugcugauuuucaccguguuaggaaaaaauggagugagacgguguguguggaugcaccuccaggcgauggcccugagacgcacccccgggcugcaggcucagccgccagggcacacccucacucacacccccgggcugcaggcucagccgccagggcacacccuccgcuuuuccuggguaugucuaaguaugcucgucaucucugaaaugccagacaugguuucucauguuauuucauuuauugcuuugaaaaaauuggccccuaauguaaacugaggugaagagauaccuguauaaagugcuuaacuuaguuccaggccuaagucagcuuucauuaaaaacaggcaguccuguuccuuuucuccaugaccugaacacgucagucuggugaaaacgauagugaaaguucguugguuuuacaaagggggaagguggugggugugauacguuuucauucuccucuguggaugagcaagccuggcucugugaggugcuuggggucugugcgguagcuggcguauaaacucgucagagacgugaugccuguuucagaaaugacacugucuuuuugaugagaugccugcuaauggaacccuccuggcuugucucccuguccccuugccgcucaaaugcuuugcugcugccccuggcucaggugugggucguccccacuccuaguguccugcauuuauucccgcggagccauguggcccucagagggaggccaggcaacguuuguagaaggguuuuuuuuuucugugugcuaugucaggagcagugaagaaguaacugccaagaacauaaaagaaggagcgaaaggccaaguacugagugugucggggcuucaugacgaggcaguggggcucuccgucacugagcuagcaggcccgcaccucuguacaugcggaaaacuaacugcaugucucagucaucagaaauguggcaaaaugacuuggucgugcuguccccauggaugaaaccugaaauaacaguuacauagcagcuuaucgccaaguagucugaccuuauuaagucacucucucaagaagucgcccaacaguauuaagcaguguccuguaacuuagcuucuaaagugaguucugauggguuguuuugcuuuauuuuauuuuauuuuuuugagauggagucuugcucuguugcccaggcuggagugcagugacacgauccuggcucucugcaaccucugccuccuggguucaagugauucuccugccacagccuccugaguagcugggauugcagacccacgcccggcugguuuuuguauuuuuaguagagacaggguuucgccauguuggccaggcuggucucaaacuccugaccucaggugauccauccgccucggacucccaaagugcugagauuacaggcgugagccaccacaccuggccaggucguuuuauuuuaaaugaaggaugucuuuuaauguggcaauaugaaauuaaccaugcaugauauaaucagcuugcuuuucuuugacagaaaaaguggauaauuauugcugugucagugguucugguugccauaaucgcucuaauuauuggcuugucaguuggcaaaugaugguguggauaacgucagugugcaugccucucugccagggugggaguaaguaacucaucaacuaauuuacuuauuaacuuuugcaauuaaccaauaauaguauuugcuuaauuguaauagacauaaaacuaauaaaagcuugccagccacgcaguacagauaaugccaucuagugauacaucugccugugugcugauucgagugcccagccacuguguuuacugagaacaagcacaggcugggcgguaacucauuuuuaaaccaaggucaccuucuuaucccguuuuuaaaaguguuuuugagacagggucuagcugugucacccaggcuggaaugcaguggcgugaucauggcucacugcagccucgaccuccugggcuaaaacuguccuccuaccucagccucccgaguagcugggacuacagacgugcaccagcacacucggcuaauuuuuaaaaaaauuauuuuuaguagagacgagaacucucuguauugcccaggcuggucucgaauuccuggcccucagccucccaaagugcugggauuauacauagacaugagccacuguacucagccugaaucuuuuguuuuugaucuaagaccauuagcucuuuacauguaguggauccuucauuaaaugucauagaaauucagugaagauuaauucucaguuguaauguuuugucuccugaguuuuagcuuuuagaguaauugcaacacugaaagguacuuuauaaaauacacuaacgcaucauuuuacuauggaaucgagggcauggaugaacgcugagaaaaacauugacugaaaggaacauccuucgaccuuucuauaggcagcaucuauuuuauuuaaaaauauuuccuuuaauauuaaaaggaaaauuacguauuauauuuaguuagcaugccuguuaauucuuaaagaauucugaauauaaaagguaucaguuuauuuaaagaaucaaggugugagugucaccuuuccuaaacuucagcaggcuuugugguuucccccugguuuucuucugcauugggagccauccuugcacuggcccugaaguggcaaugcugucgguguguuacagguggacacagcagugauuucucuguaaauguuuggcacaauucuuguauuagacaguugugaacuguucccaggugucuagaguguggcaagucauccccaaugaauuuauucuuggguuauggaagugacugcagacuugauagucacccaaggcuuuuuaaaaaguuaacauacagcagaaaggaaucacgagcaugguuaagucucacuauugcuuuguaaucuuuaagauuuauuccuucaacauggcaacacccugucucuacagaaaaaaaaaaauccaaaaacuaauugggcaugguggcacacgugccuauagucccagcuacgccagaggccgaggcaggaggaucaccugagccuggggaggucgaggcuagagugagucuagaucgcaccacggcacuccagccugggugacagagcgagaccaucucaaaacaagagauugauaucuuaaugugagcaucuguuacgcucaccaugcaguuaccagaugagaaguuuuccaguuagucuucugacauuuaugcaaaagccacaaaauuacaccugaaauuacucuguaaggagcucugggaugcugcguguguuaacauuccauuauuuggcagucagaacucucuuaccgucuauuuuuauuaggcaggauguuuguguaggauguuuauuaggcaagauguucuauuuuuuucuucuuagcuuugcugaaaauauuguacgugauuuuucuucauuguuauaguaguauuuuucaauauuuucaugauucuaacauguacuuucugaguuuuuuccuaguagcuauaauaugguuaguuuaaugugguuacacuaaagauaaaauuacaauuuguagcgcggacacagugaaaugcgcgacuuuucaugggcacuacuuggcauuaagguugacuaaaagaaggcuccucucagugugaccccuggggaguggggcuugaaguccugugccccgggccuggcuggccauuucacccuagugucuguaaauaagaaugaacauagaaggauccucauucauaaaaagcagaccaaaaugaauaccagcaguuaucuuugcauaggaaggcagugguuaauguccuuaacuucacuuuuaaaauauuaacauagccuuucauccuuuagcaauuggccuuccuggggcuggcugcugccccucccugcagggugugccaggugcaggccugucaccccggagcaugggugggaugggcugcuuuaaggagacagguggagucuuacagguauucggugagagggcccuggcccagaccuggagcuggacuccccaggguguacccuuuccacucucgcugucaccaggagauuagaugacuccugaguccuguacccuagacuccauguaguugacagucauccugaaagccagauguggcaggaaagugcacacacaucgagcacccagacacguggcaggcagcacaacagcagcaggagaugagagcacgcugcguggagcugacuccagguggcccagcugccagcacacucacuugcugagcgggagggcgcgcgccucccucuggagggagggaaggcaucacagagaaaaggaagaagagguuucucuaggaaggugcugagaguggggcguaggagcgcauauagaggaugagagaguggcuggggcuuugcaggaaaugugcgugauguuaacagggaaccagaguuugagggaggggcccuccugcaggcagcucuccccgguccugaggagucacugggaggcucaccggggccugccaugcgccucuugauaacccuguauaacugacugagccggcagucuuggaacuguccaggcucagcaaacaggauuucuuagguaaaagcacucguacauuuggaacuguaauuaaaaugauggaucucugcuguucaaaaagagaacucaaaguccuacagcgcggugccuccuguugugucuuccuuuccuucccucagacaagcuuccuggaggagacuccauuuauuaagccaaagguggucucgcuuugccuugugugaggauacuuguuaauuuuaaaaaaguuaaaugcugugucgcacccugcuuccagaccaucagugcaguagaagaaugaaugaaugucuuguugauuucuuacacauuugucauauuuaaauguaaaaaauggauaaggccaggugcaguggcucaugccuguaaucccaacacuucggaaggccaaggcaggaagaucgcuugagcccaagaauucgagacuagucugggcaacauagcaagaccccaucucuuaaaaacauauuuuuuaauuagcugggcaugguggugcaugccugucauccuagcuccuugggacacugaggugggaggauugcuugaguccaggaggauguguuugcagugagccaugucugcaccacugcucuccagccugggcgacagagugacaccuccuuucagaaaagaaagaaaaaauaggauuuuucagccaacaagaaauucguuuaaaguuuuacaaauauguguaauucauccaauuaaaagcaauccuggaguuuuauuaugauuaaaagaaagugucggccgggccuggugccucacgccuguaaucccagcauuuugggaggcugaggcggguggaucacgaagucaagagaucgagacuauccuggccaacaugcugaaaccccgugucuacuaaaaauacaaaaauuagcugggcgugguggcggguuccuguagucccagcuacucgggaggcugaggcaggagaaucacuugaacccggaaggcagagguugcugugagccaagaucacauucuuuucuaugacauggaggaguccuuucuugauaauggauguauuuuuuaaacuaucccaaaucccagaaggauuaguuagcaaaugccauuguugauuucuuugauacauugcaaauuaauguuuuucuuuaucuugcagaaauugauguucauuauuauuuguguaauuguuuugcuugugauccuuggaauuauccuagcaacaacauuguccuagcaaccauaucccaagagccauuuauccuugagacucagaccacaucugcaaccaaaucagcauccugucauuucgugaaugaaucucagacgcuguaacccggcaucgagugcugaccuuguaauguaugaguucacggaagaagcacaaccgaacgucuuguucagugacagcgccguaagcacagugggugugaugcgugacccugaaugacacacuacagaaugugagcagugugagacuucucucacuggccuugaaauaagaaaauauugaacauuuuaauauuaaaaauauuucaguguuaacaaaugugcaugaaguuuaauuaggaaggaaugcuuuauguuaugaaggcuuuuuuuuuuuuuuuugagacggagucucgcuuugucauccaggcuggagugcaguggugcgaucucagcucacugcaaccucggccucccggguucaagcaauucuccugccucagccucccgaguagcugggauuacaggcaugggccaccacacccagcuaauuuuuuguguuuucuuuuuaguagagacgggguuuuaccaugcuggccaggcuggccucaaacuccugaccuugugauccacccaccucagccucccaaagugcugggauuacaggcgugagucaccgggcaggcuguucugaagcuuuuagaucucaggucuaaggcuuccuuucccucccucucccagcuaguuugugcuaauuaagagaccuuuuauacuguuuuauugccuguuugaagaaauaauuuuuaucacguuuuuguaagauaucuauaauuuuaaauguuuauaaauuguuuaauuuauuagcaucuuaauguaccccauuuuuauauacugaauguggccuuuugagugaaauaggaagcuucaugguguuggagccaccuuuguacaguuguuuaaaguuucccauugucacggaaaacauuggcugcaaagccccucaaagcccucaagugccuucugugaguuuaaaugugcuggugcccuccagaaaagccucggccucagcuccguuuccgccuguucccucccccaggauaaugaaugguuacugcacuguaaagaccguggucucuuuucacuaaauaggagauucgaguuucccaguuuacaugaaugaagucugaauuuaagacggugaugaaacugagguucaguacucucgggacucgaggaaauuauuccugagacauggaguaauucuuacaaauuuaaacuauuguacagauccacauacauguuguuaaguaccuaauguuuugcugaacuuuuaaaaguuaauuuccaaaauguauagggauucaugauaauuaaaccuuuuuauugcucauuuuuuuaguagaagaauaucacuuauuuuuagacuuguaaaauguaugaacuggugagcggacaucuguuaagagagucacuagucagaauguuaaaggagugcaugcaggaugccccaaaugucgugaacucuuguuacuccuguauguaguaguguaagcaugugacuuuuaacaccauuugguuugaaacuaauguagagaugccugauuccaaacagguguggagaauauugaauggcucagaagccgcgucccuuacuuaacacaauuccgaaucucccucauccaugaugcguccauuggaucacucgcugguggucacuguguggcaguuacuaggggaauucugccucugacuguucuuuuucuuuuggucuuuaaacacccugucgugggaugugcucacugauuuguggcuauguugaagguaucacuugucuugaggguuuucaauauuucaggaucaugcugguggcaaaaggacuccacgccucuguggaaucauguccacagggggaccugccucccgugaugucccaccuuuccuucaaggucugucauaugaguccuccccuuuuacaacacuuauuaugguauuuuucaaguuauucuucuuagauuugcaguaccuacugaaauuuguguuuuuauaguugaaguuaggaaaaugcuauuugauuuguauuuagauauuuaagucacuuguccaaugauguguaugucuaagccucauguaccgauuugaagucagacuuaaaaauguauuuacagauucacuugagacuuuuuaaucgguucuucaaauauuucauguuuacauuaaaaauuuccagagaagcauaaaaguauucacuuuccugccuugucauuucuggaaagauuuuggggagauauuuuauugcauauuaauuaauaaauuguucuacuaggaa

SEQ ID NO: 191534 - RNA, 23376 nt, Homo sapiens
ccggcgggggcgccgcggagagcggagggcgccgggcugcggaacgcgaagcggagggcgcgggacccugcacgccgcccgcgggcccaugugagcgccaugcggcgccgcgcagcccggggacccggcccgccgcccccagggcccggacucucgcggcugccgcugccgcugcugcugcugcuggcgcuggggacccgcgggggcugcgccgcgcccgcacccgcgccgcgcgccgaggaccucagccugggaguggugagcgcgcgggcgggacgggcgcggagcuccugggccggagccgggggucuccgcgggccggguggcggggaccgggaagaccccagcagugcacgucggcgucgcgcgggagcccuggcgcccuggacccauuuccuggguggggagacugaggcagggacgcgggcugagcgaccgggcgagcgcacgcgaguccuggggaggcgccggcugccgucccggcuccgugcgcugggagcgcgccgcagccgcaggagcccguggaguugugagggggucgcccacccggagcccgggucgccggcuugcagcagccccggagcagccgggcugggcgagagcaggcaucgcggccgccccgagcucugcgcgcugcgugcguuccgggugggaguggcgggggcaggagcacgcacccacaaagcgaggaagggcaggggcuacggagugggggcaccccgaaagccuugagcccccgaguuugcucgguugaggguguugggggcacagggaugcuggcccccagcuccccacuggacaaggaccuggcccucagccuccuuccccuccaccccaggucggccaggcuggcccugccuugcccugguacagugcugagccgggggcgcggggagagccuuccucacuccacacccaguagcuguccccagcucagcuuagaaacccugccugggggcagcgacguggccucuuccuacagcccccuccccuguuccgcagccgggacucgcgucuccuguggacccggaagauuuagagcacacgucguggggucagcgcccccccgcuggggcggccgggugaacucccgcuggguucguugguuccuucugaggcuccugccccaccgcugccuucaauggacuccuacccagggagucgggccaggagccgaggccuccccgccccacacaaguacucggccuggcccucguccgcggacagucucccagugggguccuggcagggccccucgcccagcgcaguggacauucaggagcuccaaaaccuugggguccaagcaagucagcgcagguguauuucaggcagucgaggcauauggaggggccacuuggguggcacccgcagccccugugguuggcaggacuuggccagggggucuggaugggaagccgauuuggccaccguuugccccaggccccgaagccaucugggagggugcuggccacugucccugcugcccgcguccaggugccugcagguccccacaguggcuuccuuccagccaggcagccugugaacuuggggugccccccuccaccuccucaagacccuuuuguaggugcggaucucccggaucccccacugagaaucacgcccugggggccuggggucuccagcuguggagggaggugaacccaggcccgccuuccagguccgagggugccgcagaaggggccggggcaaugccagggaaggacucaagguggggcccacacacucaggaggauggacccccggccgagccauguuggcugaucagacccagugcgguuuggaaguuucucgccacccaccugccccccugcccggagagagugggucaggcgcccuccucucggcugguaccugcgccucggucucuccuggcaccccgggggucacccgccccgcgcccugcgacagcaccgagcggaggauguggcuccccagccuggccgggggcagugaguggggccccgguguccagccggagagggaggacgcugcgggcagcccccugccuggagccccgcuccgugucgggcccggccuggcguggagccuccguccugccgcggcuuccugcucacacuggcggugcggggcguccucugcuggcccucggggaaccgcgggccgagcucaggcccaggggcgggcggcuuccccgcggggagggacgaggaggccgggaucugggcgggagcggggacuccuccuccgcccgcucgccggaggcgcucccggaguggacugauauucaggucugggcgccagggacgagaagugcuccuuugucucagagcugcagacagagcugcacccagcagggcuggagccggggcuggaggggagggcccgccccggagcgccccccguaugcacgugaacaaggccgggauucaggcugcugggcugcggagccgggcuuucaggagcccccggcggggacaaaagagcgcacuguccccccggggguccuuggcggggcugcuuguccuugugggccugaguuuuuugucuuucuguguuuugaguacgacauacagcgagcagcccagggucuccacaggcguccgccucccucccgccccugguuccugggcacggaugggacgcggcucuccgugccuuauuuuugcacgguggcaccgugggccgugcgauugcagcuucgcacgcuaucuggagugucugugccggagccgcccgucuauucaccugguuaagccaggcucggccugcagccugcuucuggccagaacuucccggacucgcggcgagagugucucgggaucuggguccuggguggcaguugugugguggcagauuuugacaagcugcucuaaaguuucugcuccauuucuccucucggcagcacagccuguggcugucaucaccgcgcccacggcacaguggcagcucccuugaucuucuguaggaggugggguggggcggggcaggugggggguacugcugagguugugggaugcugggccagauggugccagguggcagccgcccuccauguccuggcuucugccgguggccucuggguuccuggcccucaggaccuugucaucgcccuggcuggggccaggguguccccucucacccugcagcugcucccagagcuucaggcgagcacccccagccaaaaccaagacaggcaggaggguuagaccauggccugauuucgccaugagagacgucugacugucccuugcuccgcgguccccuucugacagccgucuucauggcuccggggauguuguuugccuuggacgugggcuuugccacccaacuaagugccgggccucagucucccugucugcgcaauggggccagugaggacaggcugccgugcgaucagcggaggugcuuccgaugguucagggacaggaagggggaaggcuggagaggaucuggggggggacgggaagggggaaggcuggagaggaucggcguggggggaccggaagggggaaggcuggagaggaucuggggggagaugggaagggggaaggcuggagaggaucugggggagggaccggaagggggaaggcuggagaggaucuggggggugacgggaagggggaaggcuggagaggauggggagggaccggaagggggaaggcuggagaggaucugcggggggaagggaagggggaaggcuggagaggaucugggggggacgggaagggggaaggcuggagaggaucuggggggggacgggaagggggaaggcuggagaggaucugggggggaagggaagggggaaggcuggagaggaucugggggggacgggaagggggaaggcuggagaggaucuggaggggaagggaagggggaaggcuggagaggaucugggggggacgggaagggggaaggcuggagaggaucggggggacgggaacggggaaggcuggagaggauccgggagggggaugggaagggggaaggcuggagaggaucuugugggggaacgggaagggggaaggcuggagaggaucugggggcacugcaggguguucccugacacagugucuuccuggggguuccaggggcacuuugcgcaugcgugaguuugccuccuuguuggcagcagaucccgugggacgcuugcccuggcuguggacgcagggcaggugucagacgcaugcagggcggcguuucugucacgcagugggugggagccuccugggcacccgccucugggauucgggcccuccugggcacccgccucugggauucgggcccuccugggcaccgucugagugggacaggacggcagggacaggacgggguguggagccuggcuuccccuguggacccugcaguaauaagcaaguccccuccucauguuggccccaagggcuccacgcgaucuggcccaccuccuucuccaccccgcccccugacucugucacacccgcuccucugcgcuguguguuuucccugccaaagggccuuugcacuugcuguccccaccaccgugagcaugugagcaccgccccacgcaucaccuggacagcuccuuccgugucccccaggauguucccugagcacccauuucaucagcccuccagcccaucccucacccccacacagcacaguggucacaggcggagacccggaagccaacagccugggcugagcugaggauacauguccgaacucccugugccuccguguucucaucuguaaacugggaguaauaagaacacccacuucauaagguuaacccucaguugccugugagcaccugcuuugugccaggcacccuccagcagggaccacccccagccuugcagugccugagggacaugggcacgaaugacgugggcaugguuggguagugcuggauaacuguuggcuguuaggaucgaauagagcaguuauuacuguucaggacauaaugaccgccugagacgcguguauguguucagguguuugcuauuuaucuuccucacgaucccgucuuccccugugggcagugggauggggucccgcggucucagucucuccccaguugcucagacagacggauucaggggaucuggcagugucccugcggaagaggcuggagcaagggggucacuccaaccgagggucagcccccagaggaggccggugcaggggaaccccgcauggcugagugggucagacgugguugcugggaccacaccacagcuccaucacugaccgugugcugugugaccguggacagguuauccacacucucugagccuuaguuuucucaucuguaaaauggggcugaugacaccugcucucccugcccccaggccccaugcagguugggucacagaugaguaugggggucgggcccucauucaucugcaggggccaggcccaggcgccaccaccauggcacagcaaggccacacaugcacccgccagccagggugcccugggcgggaggggccguuacaaccaaucagugcaacccaaagcccggggacggggccugcacuccauaaacuccccaaaaaccauaaauucccuaaaaaccgucaaagggaauucugugcugugugcauuacgcccucuuaaggcuggaaacagauacgcauugugucagacaacaagcauggcugaacggugaauccagagugggccugggcagcugccugcaucugcgucagagucaggggcugugggugcccacuuccugccugugccccccagggcagggcucugccucuggccucuguguccccaucuuugguaauggcccagcccaugggaggagcaggagagcggccgccucuccuaggcagcuccagaaaucagcaucagccaggggguggcugccguggguuggggcucccuggagcuccuggcagcccccucccgccuccucccuccucccggcagccccucccccuccccaguggccuucuggaagguucacccugcugcugcugcagcacccgcccgccacagccucuguugcccuggagacagcggucuccguggcgacagcagagggaggaccaggcggcgggugggcguggaggggggcagguagcagguucccaggaucagacgccccccugccugcgugggauccacaggcucuguagguacugggggcagggggcagggagggggacaccuggagcggggagucugggcccccaccccagcggccauccuacagcaggcaucccccuacccacugugggugggagugggucaggguagaggccuggcgggagaggagggguggggaggggcagccacauuugcccugagcugcuggcugcaguggggggguuugccccaggacugugcuccaggccugguuaaccccuacuccccuuagcuaacaagcccaccuugccaccaccaccaccccauuagccugggucaacauuuccaagcccuagccaggaaucagccgcccccucccagauggaccugagcugccuggugagcugccugccgccucuucccugcaggcucaggccuccccacagccgcgccuccacccacacugggagcacaggacaggucagggcugggcgagggcgccucgugggcucaggaggcccccuggggcagguggccacuucuaccuguguccacccgaaggcugguggcucccaaaccugcaaggcuuguucuguuggggugucccuggcaaacuaggaagugguucccacccucucacuccagcccccaagacggccccucccaggaugccuagccugagauuuggggcacagcccccugagcacaaacucguguuagguaggaggcacccaccagcccugccccacagacccaccaccccccaagauucgaugccauucuaugcucaaauuccagugccucuggggccacaggcgacagugccuguuuaucaugggcggggcugccugucccgggcuggugcuggggcccugguucuaugaguugaagcaggcuggccgcucacaccugcaacuaaaccaccugcuuccaaacauugggcaacauuccacagccacugggagugcugccugccaggcccggcuccacuuuccugaaaugcauguggccucguggccaggcugcccagcucccuggggaccagaguggggggugccccaaaccgccaccgugaaccccacagaguaaaugggccacucagugcagcuaccagccaugaccucagcuuauagacgggaaggcuggggggugaguuguccucccaaggggucucagcaccugcuggcccaacccaggcagcagcuggccugggugggaaaggcaccugccuguguggacccuucccuggugagggggcagggggucaucauccaauaucauagaugaugugaggaaacuccagagugcuuccuggaggaggugacaggcuauuguaaccaugaggcacaguggcccuguugagcugugaucuuaacaaaggacuaaaaagugcagaaugugcugaugggcaucuccagcaccuacagcggugacugaucaugggacacccucaguaaacccugcaggugcaagguagugugggaccggaugcucggggccaaagauccccacacccuggaggucagggcggaagugggaggccagcuugucaaggccaaggcugucacccccaaggccccuccagagaagcugcccaccccagucaugaacguccacuuugacguccugucgugccuauagcuuuggaggggcccccaguucuguacacacucuuggcuuccccaaggggcugaggggcugggcugggucaguaggguuuggaaaggggguaaaggcacagaggggggccccgggaaggacucagugcuuccuggaagggggaucucggggugugcagaucccauguagugucuugugaggccccuccuggccagcacggccuguugcugaugccccugggacuuccaggaugguggugccucauuccucugagcacugccugcuggugggcaggaggguuggccaggaccaccccaucaccagcuccugcagaccagaaccuggaggcccagcagguggcauaaaugagucacaagcauuuucuuuuuucuuuuuccuuuuuuuuuuuuuuaggauuucuuuaaaaaguuauguuuuuuucauuuaugcauuuuuuuagguuaagccacaugaaacuacuaguauuuauuuuaaaucagaaauggucaaaaaugggcacuuucauaugauuuggccaaugaauacaugagaggugguaaauaauagcgauucacaagcauuuucuaaauguccagagaaaaaaaaaaagacagguuugcaggcagggcagagcccccagcacaucaccccuggcuuguaccuuucuggagcccgccucaccccugcugugguucccugggcuggcgaguauccacagggcagagcagcagcuucauggcagccugcaagugggcacaggcgccauuuggcgguugaagaaacugaagcuagggguggagguagcccccacagauggcacccaggccugccauccccagguccccacgauggcacccagguccccacagauggcauccaggccccccuguccccagggccccuccaggguagcagagaugacuggggcauggggccagggcuugauuuaugcccagguuaaagggcugcccucauuccugcuccuacucagcuccgguguggguagccuugcacccaccccagugggcccuucagagcagagcuguccccugcgccaggugcuggugugaacauuuuccacguccuggcucacguccucaucaccagccugccaaggacucugaggaaggagcccagagggguggacugccuugccccaggcacacagcggggagguggcugagugggauuugaaccuaggcagccuggcuggaaccuggcuuuuguuucugagacagggucucgcucuguugcagacacagucugcaacuccugugcucaaacgauccucccgccucagccucccaaagugcugggaucucaggcauaagccacagcaccggccaagccugggcucuuaucucccccaugaauguacagcauggcccaauuccuuaaacuggugucugagccacagccuuucucagcuggggucccagaccuuggaugcuagacuucccugucacaagucagcugagagccugcauuugacacuggccacauuuaagagccuuuugaagguucccuagcauuuugcggucucaggaggcgugggguggggcaggguugccaugagugguuguacaggucgugcacggcacaagcucacaccaucuaagggacaucagauuuauuuauuuauucauuuuuuagauggagucuugcucugucgcccaggcuggagugcaguggcacgaucucggcucacugcaagcuccgccuccuggguucccaccacucuccugccucagccucccgaguagcugggacuacaggcaccugccaccacacccggcuaauuuuuuguauuuuuaguagagacgggguuucaccauauuagcuaggauggucuccaucuccugaccucaugauccgccugccucggccucccaaacugcugggauuacaggcgugagccacagcacccggccagggacaucagguuuauuaagacacuuuuccggcagcugcccagggaagagacaagaggugccuugugggcagauagggggcugggagggggccugcccggaagcagugguggcccguggcaggcuucucacuggguaggaccgggcccucuguugcacccccucacccugcucucugcccucaggaguggcuaagcagguucgguuaccugcccccggcugaccccacaacagggcagcugcagacgcaagaggagcugucuaaggccaucacagccaugcagcaguuugguggccuggaggccaccggcauccugggucaguucuccagggggcagcgggagcgccguggcccccgucaggucugcgcccgucggccaugcccccucugaucaggcacagucccgucuuaugcuugaaugaaccuggguccuggccugguguagcucagagccuggggcuggucccccaaagaugacgugggaggagggggcggcucggaggcuggugccagagucagggcucccacccuugcggaugcucgggauccuaggguggggagugagcugggcuaggcucugagcuccaugcuuucccugcagacgaggccacccuggcccugaugaaaaccccacgcugcucccugccagaccucccuguccugacccaggcucgcaggagacgccaggcuccagcccccaccaaguggaacaagaggaaccugucguggagguggguguguggccagggugaggagcggggccuccguggaggugggcgcguggccagggugaggaacggggucuccguggaggugggcgcguggccaggguggggaacggggucuccguggaggcgggugcguggccagggugaggaacagggucuccguggaggugggcgcguggccaggguggggaacggggucuccguggaggcgggugcguggccagggugaggaguggggcccccaugucuccgugucugggccugcuguagauauccacaaaccaggguacuucagacagcagcaggagcucucuccccacucuggaggccaggagucccugcaaaggaguaggcuggauggugcccuggggagguagagggagcaucuguccaggguucuauccagcugugcaguugcuggcagcccucgauggaaucaccagccucugccuccacccugcccuguccgcgcgcagccuccucucccgugucuccaggaugcuccucggauuuagggcccacccugauccagugugaccucaugucaaccccucaugacauccacaaagacccuauuucuuuuuuuuuuuuugagacagggucucacuucgucacccaggcuggagugcaguggcgcagucacagcucacuguggcccugacauccugggcucaagcaauccuccugccuccgccucccgaguagcugggacugcaggugcauaugaccacacccagcuaauuuuuuucuuuuuuuugacacagagucucuuucacccaggcuggggggcgguguugcaaucuuggcucacuacaaccucugucuccuggguucaagcaauucuccugccucagccucccaaguaggugggauuacaggcacgagccaccaggcccaacuaauuuuuuguauuuuuacuagagacagggcugggcaugguggcucacgccuguaaucauggcacuuugggaggccaaggcgggcggaucauuugaggucaggaguucgagaccagccuggccaacauggugagaccccgucucuacuaaaaauacaaaaauuagcuggguauggugaugugugccuguaaucccugcuauucgggaggcugaggcaggagaaucacuugaaccugggaggcggaggcugcaguaagccaagauugugccauggcacuccagccugggaaacauagugagacucugucugaaaaaaaauaaaaauaaaauaguaaagacaggguuuugccauguugaccaggcuggucuugaacucuugagcucgagcaaucugcccacccuggccucccaaagugcugggguuacaagugugagccaccacacccagccaacccuauuuccaaaccaggucauauucuaagguuccggauggacgugaauuuggcgggacacuaugugacccacucaccuucugcugucccccggagucaaaacuaucucagaugggcccuggcuagugugagggcuggugaaccgagagagccccuucaguggggagcagggggauggggcagacgggacgcaccguugagggcccuggggcugauggcuccacgcgggagcugacguuugccuguggccugggggucucagccugccugggcucucauuucccucccuccgucaucuaucccagugaacuacuggaaccgccgugagugcaucggaugacuccuggcguggggaggaaggcggaagaugggggagacccucauaggggcacccccgggcugaggaggggcguucagggaaccucggccuggggcacguggccuguucuccgugacucacucugggcugaccccugccugcaggguccggacguucccacgggacucaccacuggggcacgacacggugcgugcacucauguacuacgcccucaaggucuggagcgacauugcgccccugaacuuccacgagguggcgggcagcgccgccgacauccagaucgacuucuccaaggccgaccauaacgacggcuaccccuucgacggccccggcggcaccguggcccacgccuucuuccccggccaccaccacaccgccggggacacccacuuugacgaugacgaggccuggaccuuccgcuccucgggugcgucuggggcagcccucagggcagagucaggagccccagcggccugugaggcugaggagcagccauggcccccccauccccaacccugcggcugaaaacacacgcggcugcuccugagcacggcugggcauuucccacuaggccgaucucacagcaucugugcucggcccggcugaccucgcugggugcuggccugucgggcagggacaccgcuggcugagccgagcuuguccucaucacguucucagcaccugacagagcaggaggccugcgaggccucuguggccccggcucagugucacucccgcuaagucccguugucugcagaagucucagcucugcagaggcuguucugaccucuggacuguagccuugggaaccaugcaguccugggagcccaggcccgucuuguggggccaggggucagugcccacagcauugggccucaggucauccgaccgacaccuggccccauguaacccaggccccaggcacaagguguuaucuguguggccuuaugcagaaaagguuaucagccgcuccaugaaugguacaaagaccccaggccugggaagcccagcaggccccacagagcccccaggggaaucgcguuaauucccaguaacccugcagaaucccucuggcgcagccggcaucgaggcauccccauggucaccccagagcauggugggggccugcuggucccuccccgcggggacagggcccuucuugcccuuaguucacauggcucccuguguccccagaugcccacgggauggaccuguuugcaguggcuguccacgaguuuggccacgccauuggguuaagccauguggccgcugcacacuccaucaugcggccguacuaccagggcccggugggugacccgcugcgcuacgggcuccccuacgaggacaaggugcgcgucuggcagcuguacggugagugucuccccgaagccagacacagggccccuggaagaggggucagaaaccccaggcaccccugagcagagcccccccgggaggguuugcucuccccgcuguucccuccacggauggugccgugccagcugggacgcucuggccuguccacagagcccaccccugacguccccagagccccuagaucagaauuccaccucugcgccccagacacugguggaguuacgacaggcaggguugauggcgucccaggccugugcaaaucacauugcacgucuuaaaucaucugaucuuuguggccauauaagguaggacuacuguccccacuuuacagaugagaaaacugaggcacccagagguauguagauugccugggaaacccaagaguagccaagucaggcaccagggaccccucugcuggguucacaucaggaagugaggcagagccccuguccugggagcuggugccccggggagacagcacacgugcaucagaggccgacgcggucaccucacuuauacccagccccagcugcccuccacaccgcccaccacacccugcaguagugcugccccugccgcccggacccucccggccucagcaucguccuugccgcuucacaugcucugacauccaugcaucguuuccacuguaguaaaauucacaucccaugcaauucacuuuuuuggccggaugcaguggcucauaccuguaaucccggcacuuugggaggcugaggcggguggaucacuugaggucaggaguuugagaccagccuggccaacauggugaaacccugucucuacuaaaaauacaaaauuagccggauaugguagcaggugccuguaaucccagcuacucaggaggcugaggcaggagaaucacuugaacccgggaggcagagguugcagugagcugagaucgcaccacugcacuccagccuggguggcagagugagacugccucaaaaaaaaaaaaagaaagaaauucacaauuucaagguguguacuucuaugcguucaggacauucacaagguuguguggaugccaccucuaucugguuccagaacuuuuucaucacccacuaccaccgaaggagacccgacgcccaucccauccccccagccccuggcaaccccugaccuccuuucuucauagaugggccucuaaugcagccaugcaaccuuuugugucuggcucuuuuuuuuugagauggagucucacucugucacccaggcuggagcgcaguggcgcgaucucggcucgcugcgaccucagccuuccgaguagcugggacuacaggugaccgccaccacgcccggcuaauuuuuuguauuuuuuuuuuaguagagacgggguuucacuguuagccaggauggucucgaucuucugaccucgugauccacccaccucggccucccaaagugcugggauuauaggcgugagccaccgcaccuggccucuuuuuuuuuuuuuuuuuuuuuuuuagagaugggggucucacuauguggcccaggcuugucucaaaacuccugggcucaagugauccuccugacucagccuccugaacagcugggacuacaggcaugcacuaucacaccuggcuaauuuuuagauuuuuuuguagaaauggggucucaccauguugcccaggcuggucucaaacuccugggcucaagcaauucucuugcccuggccucugaaagugcugggaauacaggcacgaaccacugugcccggcccggcuucuuccacugagcauagcguguuccagguucaccccaugguagcauggauuugaccuggauuuauucucauggcugaauaguuuugucaucaugcagccuauagcaggcacuggguugucaccccuguuggcugcggugaacagugcugugaaggcugguguacgagcuccugugggaacgccugucuucagcucuuuaggguguaccccgggguggaauugcagggcagugcucacacacugaguguuuaacucggcgaggggucugacucccaccucgacgucagcucugggggcagcagucucgcugaucgcagcugcgcccccacagagccugucugcugaguggccucgguuucaucccugggauucagaagggcuggugggauguggggggaggcgggcgucggggguuugaggccguccuccuccuugucucccgcaggugugcgggagucugugucucccacggcgcagcccgaggagccuccccugcugccggagcccccagacaaccgguccagcgccccguaagcccugggcccacggucaccacccgcuggggucugucuguccucaucccugucccacgcaacauuugccccaaaucguggcucagaguccugggaaacgcacagcuguguggccgacugagcccccagugacauuuugucuuuucuuaaaccccaucuaauaccggcccuccccugccagggguccugcacagaaaugagaacuucagacaagguuuccucucccccucgucccugucagcuacugccaugugacaagcagcccagcuugaggaauguuucaucaagcucauggauucccagcaucaggaagucaggcagggccugcgagugucuggccugugcccccagcgggagggauguucacugccggggcccacaucuggugccagggcugggcccaacugggacggccacuggggcugcuccacgaggcaugacccucccacagcaacuggauucccagugaaguugucuugagagcugguauugccagaggccgguagaagcugugaccuugugccacccagccccagaugucacaggaccguacguguaacccucccgguuaaagcugcgaaggagccacgcucugugucgagucgucucucgguggacaugcaccuugucccugaccuucugucgcuacagccacgucgcugugaacacgcuucuuguaggaccgaauucuaggcccgggcuuggggucccguggcguggggucccguggcguggguguuuggcacccagccaggcccagggugcuacaccagucuccaccccugagcuccugcccuccccgcagcucccuggcgcucuguaugcucagagcguagaucucggcccccgcccgcugaagcgguggacaggcacccccguuuuaauuugccuuuagcagaccucuaggcaaggauaggggcuccacacaaggaugccugucccaugccgcucaggucaggggcucugccgcaggaugcccugucccgcgcugcccaggccccgccucccagcccaccuggcucucucccugcaggcccaggaaggacgugccccacagaugcagcacucacuuugacgcgguggcccagauccggggugaagcuuucuucuucaaagguaccuccaggguucccguggcgguuggcugagggccauggcccacucugggugcagaccgucucugcagcccggcccuccccucugugcccccaggcaaguacuucuggcggcugacgcgggaccggcaccuggugucccugcagccggcacagaugcaccgcuucuggcggggccugccgcugcaccuggacagcguggacgccguguacgagcgcaccagcgaccacaagaucgucuucuuuaaaggugggugggccuccccgucgcacuccgggcuucccgggcccucuguccgccucauggagggacggagaggguccagccugcguguaagcccuacgucugcccagaggcuggucgagcacagagcagcugguuugcuugugcacucagcagaugcacucugagcaccuacuguaugccccguccugaggcagccgcuguaggcacacagagggcaaaacgauggaaagcccugcccucguucuagucaggccacaguccacccgcaagucaggaggagcugaugccagugccguucgguguggucagaaaugaaggacaauggggagaggucuccuuagggagaugcuguacaagcagaaacuagggaacaguguuccagcccggggaacggccgugcgaggcaggagcagcccugccgagucccaaaaacaucaaaggggcugcagcuggaguaccaggggccuggaggaggcucgggacagaagcgugaggggccguggcugcuagggccggccugccucucccuggucggccccggugcccaccguuccaggaaccaccucguggcaguguuacaggaagcacuccuuuugccuccaagucuccgggaagggcaggaaagggagacaguagcaggggcagguggggguggcagggcugcaggacagagacccccaugcugggcugaaacacccggaguuucccucacagucuggaggccacgaguccgaaaucaagggcuaggcaggguggguccccucuggaggcugucccaggccucucccacauccagugucacccucagccacaucccuccugccaccgccucugucuccacccggccgucuccucccccaucuccgcaucuucucuuauaaggaagccgggccuugauucagguccccuaguccuguuuguuuuuuguuuuuuguuuuuuguuuuucugagacaaagucucacucuguugcccaggcuggaaugcaauggugugaucucagcucacugcaaccuucaccucccagguugcaauucuccugccucagccucccuaguagcugggauuacaaggugcccgccaccacuccuggcuaauuuuuguauuuuuaguggagacaggguuucaccacguuggccaggcuggucucgaacuccugacuucaggugauccacccgccuuggugucccaaagugccaagauuacagaugugagccacugcacccggccugccuaaucccaucuuaacucaucuuaacuaacacaucugcaaagacccucuuuccaaguaaggucacguccugagauucuggguggaugugaguuuggaggacgucauucaauccaauguggcagccacucccacagucacgggcgggaccccguuuccuugccgagguaaaggguguucugcgugucugucaggggaaccacuuccuguaacuccaucgccugcccggcccucagcauuugacuccgucacccccaucaccugggagcccuccggugacuguucccggaggccugaucccuccugaagggacagaggcugcagcuaccugggaggcugaggcaggaggaccaccugagccagaaggucaaggcugcacugcaccaugaucgugcacugcacuccagccugggcgacagagcaagaccuugucuaaaaaaaaaaaaaaaccaaaaugucacgcgcaguggcucacgccugcaaucccagcauuuugggaggccgaggcgggcagauuacaaggucaggaaaucgagaccauccugguuaacacggugaaaccccgucucuacuacaaaauacaaaaaauuugccgggcgugguggcgggcaccuguuguuccagcuacucgggaggcugaggcaggagaauggcgugaaccugggaggcggaguuugcagugaggugagaucacaccacuggacuccagccugggugacagagcgagacuccgucucaaaaaaaaaaaaaaaaaauccccaaagacaguaccuggacuaaaaaagaaaaaagaaaauuacuugcaaaccucaugaccaauugcuccuaaccuccccuaggccaccuugccaaaggccccagggugcccuguagagccuccccgagcaggaucccaucacgugcggcuccccugccuugcacacauuagaaguguucaggccgcuucccccagguggacccgucuggcaucuccuccagaucagguucugguuuugcacaucuggcaggaaugccaccgagggcagguguucugagccccgagccgcccugccuggugauguucgcuguggucaccuggaugaggugugucugcagguuucgcuaccauaaagccccauuucugggugugagggguuggucaccugccaggagagacuugagaacaugugggucucuugccacaggccgucucaccccugcucccccucuguccccugugucgccugccccugccugguucccuaccaggcgcaucuguccugguuccugcucagccauagcagggcagggcccauugguccucccaucaucuccuuaaucccucccccuauuuacagacaucacagcccuuuccagucuccagcaaaggacuuuuucuggucuuuuuauauuauuuuuauuuuuaauuuuauuuuacuguauuuuuuugagacagagucucacucuaucacccaggcugcagugcaguggugugaucucagcucacugcggccucgaccucccagguucaagcaguucuccugccuuaggcuccugaguagcugagacuacaggcgcucaccaccgugccuggcaaauuuuuuguauuuuugguagagacaggguucaccguguuggucaggcugaucucaaacucccgaccucaggugauccacccaccuuggccucccaaagugcugggauuacaggcaugagccaccacucccggucugguuuuuuggucguuuuaaauugugggcguggugagcacacuuuacuauuucagccauuuugaagccacagcucgguggcaugaagcacguucacguugcugugcagcugucaccugcguccaccucccgaagauuuccaccuucccaaacggaaacgcugccccgugaaacacggaugccccgccccgccccugggcagccccgccccuccccugggcacccccacuucgcuugcuguccccauggcucugaguguuccagggaccccaugucagugggacagacaggaucugccccucugugccuggcucgugucacucagcggaagguccucggggcucauacacgcgguggcacguggcaggauuuccuuccuggcugaggcugagcggcauuccauggcacggacggacugcaccucguucgccugcucacuuggguuuccucuacucugggcuccugugaaggacgcugcuaugagcgugagugugcaaacgucucuccaagacccugcuuucgguucuuuuggauuuauacccagaagcgggaaugcuggaucacgugguaauucuauuuuugacguuuuggggagccuauguucugucucccgcagcggcugcacaauuucauacucccuccccggcagcgcccggcucugccguccccauauccucccgacacaggugacuuuccacguucuugacagugggggcgagggggcgucucauugugguuuugagggcguuucuagugacguugaccaucuucaagugcucaaugccaucuauauuucuugggagaaaaguguauuuaacgcagggcacgguggcucacaccuguaaucccagcacuuugggaggccagggcgggcaaaucaccugaggucaggaguucgagaccagccuggccaacauggugaaaccccgucucuacuaaaaauacaaaaauuagcugggugugguggugggcgccuguaaucccagcuacgcgggaggcugaggcaugagaaucgcuugaacccaggggcggagguugcagugaaccgagaucaagucacugcacuccagccugggugacacagcaagacuccgucucaaaaaauaaugaucauaauaauaauaggauggcaugucgugggccucgguuuggcccgaguuguuguuuccaucgguaaagggguggccggcagcguccacaggcuggaugggauggcccggacugggcacaguaggugcucacuaaguauccauguggccccugugauguggggugauugcaguguggccgcugucccaucaagcccaggugaggggccagggcaagggcggcugacacaggagaaggaaaggcaggagccuccugcccuucgggguggggccgagccccggcccacagcuguuucucucgcccccaggagacagguacuggguguucaaggacaauaacguagaggaaggauacccgcgccccgucuccgacuucagccucccgccuggcggcaucgacgcugccuucuccugggcccacaaugacaggacuuauuucuuuaaggaccagcuguacuggcgcuacgaugaccacacgaggcacauggaccccggcuaccccgcccagagcccccuguggagggguguccccagcacgcuggacgacgccaugcgcugguccgacggugagugccagcuggggggacgggccaugcggccuugguuuccccaccaggagaggggcaucacuacagggcagccaagagguucccugaaaggaggacggccccggucggugugggcucugagggucccagccccucgccuggagcugccgacccugcaggcguccccgagucgcuccccgaaggccuggcccacgagcugcccuuguucuccccgcccucagcacucccucgccccugcugcucccccagccacgcuccugccccagggccuuggcacuggccaugccucgucugggcacacuuuccugagauguccacacagccccucccucgccggccccagcccugccaaacgcccuccugggcaucaccccugccacgucccacaguguagaagaaaccuccccacagggucagcuccagggacggcagcauccucuguuuuguuuucaacgcugcauccuugucaccuggaacagcccugcacagagugggcccucaauaaauauccaguaagggaaagagacucugagggucuccugguccauccccugccccagcaggcuccucuggagcuucccaggccugugaccaugccugcagagcugcccacagcugagcagaugcugaccccaucucagauauuaucugggcacccccugccaucuagcacgagccgccccccaccagccgucuggucugaccccccacugcagucuugugcaagcccccugcugucuggcccgacucgagccccuuccgcugcagcccucccugagcccaacgcucccuccucgcuguccggcucgagccccuccugcugcagcccuccccugagcucagcucucccuccucuucucaggugccuccuacuucuuccguggccaggaguacuggaaagugcuggauggcgagcuggagguggcacccggguacccacaguccacggcccgggacuggcugguguguggagacucacaggccgauggaucuguggcugcgggcguggacgcggcagaggggccccgcgccccuccaggacaacaugaccagagccgcucggaggacgguuacgaggucugcucaugcaccucuggggcauccucucccccgggggccccaggcccacugguggcugccaccaugcugcugcugcugccgccacugucaccaggcgcccuguggacagcggcccaggcccugacgcuaugacacacagcgcgagcccaugagaggacagaggcggugggacagccuggccacagagggcaaggacugugccggagucccugggggaggugcuggcgcgggaugaggacgggccacccuggcaccggaaggccagcagagggcacuguccgccagggcugggcaggcucagguggcaaggacggagcuguccccuagugagggacuguguugacugacgagccgagggguggccgcuccagaagggugcccagucaggccgcaccgccgccagccuccuccggcccuggagggagcaucucgggcugggggcccaccccucucugugccggcgccaccaaccccacccacacugcugccuggugcucccgccggcccacagggccuccguccccagguccccaguggggcagcccuccccacagacgagccccccacauggugccgcggcacguccccccugugacgcguuccagaccaacaugaccucucccugcuuu

SEQ ID NO: 191535 - RNA, 3423 nt, Homo sapiens
agucuuggcggaggugagucucgugguggaggugagggcaggcuccgggguauugcugccgggggaggauuugcuggggacccaaggcacccucgcgugagagcccugagagcgaaucgcuucgucugaccucgggguugucuggggcgagggcacgaaucaccccaaccuuuccgaagccugguggaauggcuugugaacugaucucaaaagcagcccaagucauccgucgcugggccggggagggggacaccgcggcggccccgccgagugcuaccugggcacugagccuguggggagaggcgacccagcgggguggagagagauaagggaccaguaacguccagcguuuguccgugguauugagcguucugugggucaaauucucaaagcacuccugcgaaauaggccugcccauuuugcagaaggggaacgugaggcuuggcgaaguuaaaguuaccgcuuuguaagcgcuguaaagaugagagguuggguaguggggaacguguaagcaucucugaaauggugauucaagccgggcgcgguggcucacgccucuuaaucccagcacuuugggaggcuugaggcgggcggaucaccugaggucaggaguucgagaccagucuggccaacauggugaaacucugucuuuacuaaaaauacaaaaauuagcucggcgugguggugcgggccuguagucccggcuacucgggaggcugagggagaagaaucgcuugaacccgggaggcggagguugcagugagccgagaucgcgccacuucacuccagacugggcgaaagaacuaaacuucaucuaaagaaaaauacauauggccgggcgcgguggcucacgccuguaauccuagcacucugggaggccgaggcgggcggaucacgaggucaggagaucaagaccauccuggcuaacacggugaaacuccaucucuacuaaaaauacaaaaaaauuagccgggcguuguggcgggcgccuguagucccagcugcucgggaggcugaggcaggagaauggcgugaacccaggaggcggcguuugcagugagccaagaucgcaccaccgcacuccagccugggcgacagagagagacuacaucuaaaaaaaaacaaaacaaaacuguuucuggguggaggggggaacgaaaaagaaaaaaacuguuucuggacuaaccuggacaguucuugugacaaaauucauguggcaucauaaccaccagaauaugagacuuuggaauuugcuuuucaggugaccaaagccacguaauguccguaguucgcucauccguccaugccagauggauuguggggaaggugauugggacaaaaaugcaaaagacugcuaaagugagagugaccaggcuuguucuggaucccuauuuauuaaaggugagaaacauucuuguuuccggguggcuuugguaaaucaccaccauguccuggguccuaagcaaaaaaacauuuaucucucaguaaagaugucuugucucucaucugcuuugagccaggcauuuugcuggucuguagguauaacacgguuuacacauuccaagaaaacaguuaaugucaauccacucuaacugcuguagucauucuguaugcaaaguacuggccggaugagguggcucacaccuguaaucccagcacuuugggaggccgaugcgguuggaucaccugagaucaggaguucgagaccagucuggccaacguggugaaaccccgucucuacuaaaaauacaaaaauuagcugggcauaguggugcgcaccuguaauccuagcuacucuggaggcugaggcaggagaaucucuugaagccgggaggcggagguugcaaugagccacaauuguaccauugcacuccauccuggacaagagcaaaacucugccuaccaugcacaauucacaauaggguuugugcuccuauaggaaucuaaugccgcugcugaucugacaggagguggagcgcaggcgguaauacucaugcuggcucaacgccacucaccuccugcugugcggcccuguuccuaacaggccacugaaugguaucagucugcugcccuggggguuggggaucccugcuugaacccaaagacaggcuuggaaacacggguagggaugaagacuggagguaagggaaugggcaaagaggcugcugcaaaagucuaggauggaaauaaggaccugaacuaaaguugauguaguggggauggaguggaaaaaauauuucaggaaggacagagucauugauuuguuugcugugcccaggggacggauaggugccaaggaugguuucacauccaaaguucagcacacagguggguaccaaugcuggucauuaucaaggauuagaaacacaggagcaagcugaagagugacugcaugauccuugaccuuugggagaccuuaguuugaauacugacucuuguuuaccagcuacacacauggcuuaaccucccugaacuuuucucauauguaccugcugcaacaggguuguuauaaagaauaggugauucuaggcugggcgcgguggcucaugccuguaaucccagcacuuugggaggccgaggcagguggaucaccugacgucaggaguucaggaccagccuggccaacauggugaaaccccaucucuacuaaaaaaacauacaaaaaauuagccgggcaugguggcaggcaccuguaauuccagcuacuugggaggcugaggcaggagaaucucaugaaucugggaggcggagguugcagugagcugagaucgugccauugcacuccagccugggcaacagagcgagaauccaucucacuggauugucucacuauaucacucaggcucuaauuuuuguacuagaagccuccuuaguaucuuaucuuuuccuaaguccuggcuuguuuuccauacguuacuuuuucauauuacauauuacauuaccaggucacagaugggaacuacugauuugcuucucucccucucucaacaguauuuuaauaagcggaaaaccuacuuugcucacgaugcccuucagcagugcacaguuggggauauugugcuucucagagcuuuaccuguuccacgagcaaagcaugugaaacaugaacuggcugagaucguuuucaaaguuggaaaagucauagauccagugacaggaaagcccugugcuggaacuaccuaccuggagaguccguugaguucggaaaccacccagcuaagcaaaaaucuggaagaacucaauaucucuucagcacagugaagcgggaguggaagaaggaucuaaagggaaaaacugacauguuuauguuauggaaaaagaaauuuuucuaaguuucaucacaaacuguguccaguuucucugugguguuuaugaaauagcuaaaagcaaaugaaguaaagggcauacuaugguuuuucacaa

SEQ ID NO: 191536 - RNA, 12015 nt, Homo sapiens
acguuagccuccggucaucaaauagcaaaacccaaaacaacagcagaugauaucuuccaagugucugcucgggacacggcuucagcccucugugguccccucuccccggggggcuuugggauucuugucaagcuccuucaagagccugcaagcacuuaaccgugaguagcuagcccagugauggacaaaagccaggugauaggcagggagcggggaggacuggggguggagaagauagaaacccccacauccauuccauccaugucucuuuucugaaggcggauggaccagggagaguggcagcauugacccuugaaaccuccaucugcaggaauuuucuacagaaaagagguccccgggacugaucugguuuuuggacucagaguucaggggagggaaguuaugugccaaaaaguaccaggccaggcaggcgcgauggcucaugccuauaaucccagcacuuugggaggccaaggugggagggucacuugaggucaggaguucaagaccagccuggccaacauggugaaaccccauaucuacuaaaaauacaaaaauuagcuggguaugauggcucgugccuguaguccuagcuacucaggaggcugaggcaagagaaucgcuugaacccggaaagcagaaguugcagugagcugagaucucaccacugcacuccagccugggcgacagagcgagauucugucuaaaaaaaggacugggccaccuacucccauguggugacccuguccacaggggucuugggaaaggugugagggguggguggggcaguagacagaggcacaaaguuggccccagucagagcuggggcuggggcaagauaaccgccuccucagccccccaggaaaggugagugcagccacaaguuggccaagcuggcugugccaaggacuggaggcuugcgccuaggcuggcaucucauauggggguccaaguguacuuucugcucauggagggcugggggagaggagagagcuagcgcuacccagcuuugggaggugaugaggcaaaggugcccauugugaggacuuaggacuuaccagcaaaugggcuuguuuuuaugggaaacagacagucccgggcuccgccaaguugcugauggggcaggcagagaaggccugugugugagcagcccaggggccuggcaccagcagaggggacuuguuauucuaaaccuucuucugguaaccaggcacccaguaguggggccaccaggauuccuggaacagccugcccaaucccggaggcagccagagcugcuguuggcuggucagcaaauuggcuccuuugugagaccaggccuucuuaggcccagaagcagugggggaaaggggguuggaggcagcuuuggcacugcugaguggcagguugggccuauuuucuaucugcccuuuucccuguugguuuucugcauuccucaaauccugcaucugauuuuguuuuguuuugucuuuuuuuuuuugagauggagucucacucuguugcccaggcuggagugcaguggcaugaucucagcucacugcaagcuccaccucccggguucacaccauucuccugccucagccuccugaguagcugggacuacaggugccugccaccacgcccggcuaauuuuuuguauuuuuuaguagaaacaggguuucaccguguuagccaggauggucucgaucuccugaccucgugauccuccugccucggccucccaaagugcugggauuacaggcaugagccacugcgcccagccuguuuugucuuauuuuuugagacagagucucacucacuccgucaccuaggcuggagugcacuggugcacucucagcucacugcaaccccaccuccuggguucaagugauccuccugccucagccuuccaaguagcugggaccacaggcccgagagccaucaugccuggcuaauuuuuguauuuuuugcggagauggggucucgccauguagcccaggcuggucucgaacuccugaccucaagugaucugcccaccucagccucccaaagugcugggaugacaggugugagccaucacgccacgccuaaauccuacaucugaagcaggaguugaguucccugguaggagccuccauguuccugacacaaagcgggguagcucagcgccucuguguacaggccugaguguccuggcucuguacugccucuauccugcagcaggaccccucagggcucacuggccauuguuaaguaggacauggggcauucuuccagcaggacccugagccaaagggguaccugcccaacccuugacucacauucaagguauagccccugccggacaccugcacuggguauggggggcagagauggcuaggacauccuagagaugauaaucuagugggggaggugacagcauacacugacaagugacaccagaggcggaccaggauggacccacccagcucuccaucccucagagcacccagcauggugguuggcaaagaguggguguucagugucugcagaauggagauguaaugaaugagugagugagugauuaugaaagucccaguuauggauagaauacaugaggaagggccaggugcaguggcucaugccuguaaucccagcacuuugggaggccaagguguguggaucauuugcagucaggaguuugagaccaucccggccaacauggugaaacuccaucucuacuaaaaauacaaaaauuagccaggcaugguggugcaugucuguaaucccagcuauucuggaggcugaggcaggagaauugcuugaaccuuggagguggagguugcagugaaccaagaccacaccacugcacuucagccugggugacggacugagacuccgucuccacaaaaaacaccaaaaacaaaaacaaacaaacaaaaaaacaugaggaaggagcagugggauggagugcaggaagccuguccuagaaggggguguguuuucagagaacacagucacaacaaggggagauaaggagaggcuacaggaguggccuauuuaaaaggaaauuguggccagguccaguggugguucaugccuauaaucccaucucuuugggaggcugaggcgggaagauugcuugaggccaggaguuugagacuagcuugggcaacauagggagaccccgucucuacaaaaaacuuaaauauuagggccuggcaugguguuucacgccuuuaaucccagcacuuugggagaccaaggugggaggaucaccugaggucaggaguucgagaccagccuggccaacauggcgaaacccugucucuaauaaaaauacaacaauuagccaggcguggugguaggugcuuguaauuccagcuucuugggaggcugaggcaggagaaucgcuugaaccugggagguggagggugcagugagcugagagccaagauugugccacugcacuccagccugggggauacuuuaguccuagcuacucaggaggcuagggugugaggaucgcuugagcccaggugguugagccggcagugagcuauaaucguaccacugcacucugguacagagauggguaacagagcaugaccccaucucuacaaagauuuuuuuuuuuuugagccggagucuggcugugucgcccaggcuggagggcagugaugcgaucucggcucacugcaaccucugccuccuggguucaagcgauucuccugccucagccucccaaguagcugagacuacaagcgugugccaccacauccggcuaauuuuuguauaguagagaugagguuucaccauguuggccaggcuggucucgaaauccuggccucaagugaucuaucugccucagccucccaaagucugggauuauaggugugagccaccacgaacggccucaauucacaaacauuuauuuggaacauucacuauaggccaguguagugccaggagauguaaggaugagugagaaacaguuccagaccccaaggagaacagccccugggucaggaaggcugacagcuucuuucuuuuccccucucagagccacccagaguucccucacugaagaucugagcaugacccgggacgaggcacugccggacucucauucugcacaggacuucuaugagaauuaugagcccaaagagauccugggcagguaaagcccaagcuuuccccacgaagugcuguccuaggcuccagcagacccugugggcuacagccagcucugcuccaccccgaguacuaacgccacuuucauccccaaagugcuguucacuuggagaaacccuuuguuugggguccugcccuccugaagccaggacagauaagagaaaccucucccagcaaaaaguucccaggggcaggcgcaauggcucacaccuguaaucccagcacuuugggaggcugaggugggaggauugcuugaggccaagaguucaagaucagccugggcaacauagcaagaccccguaucuuuuuuuuuuuuuuuuaagauagggucuugcccugucauccagguuggaguacaguggcaugaucuugacucacuacgaucucugccuccuaggcucaagugauccucccaccucagccucccuaguagcugggacaacagguaugugccaccaggucuggcuaaccaucucuauuuuuuuuuuuaaaaagggggggccaggcacaguggcucaugccugcaauagcagcacuuccugcaauaccagggaggccaaggcaggaggaucaccugagaucaggaguuugagaccagccuggccaacauguugaaaccccaucuccaguaaaaauacaaaaauuagcucugugugguggcagguaccuguagucccagcuacucaggaggcugaggcaagagaauugcuugaacccgggagguggagguugcagugagcuaagauugugccacugcacuccagccuggcaauagagcgagacuccgucucaaaaaaaaaaaaaaaaaaagcacugaacggcucaaaaaggaaaaaaaaaaaaaaaaaagagucacacggccugagagcaggcuuguuacucaccaguucugggcaaaucaccugucugugccuguauuuauucauccaccauuuccaaaagcucagaggaaguugggggaaaguguaaaucucugucaagggcaggacaucucugcugcagccucuaaucugggaccccccauggggugaggggccccccgaggccaucuguccucugcacucccaggggcguuagcaguguggucaggcgaugcauccacaagcccacgagccaggaguacgccgugaaggucaucgacgucaccgguggaggcagcuucagcccggaggaggugcgggagcugcgagaagccacgcugaaggagguggacauccugcgcaaggucucagggcaccccaacaucagugagugauggccccaagccacacggcagggugccccccugugauucugcccugacagcccaagccagggaguguggccccaccgcacagccaacuagaaccacccaggcucaaggcucccagcuccacccucacugcucugauagaaggggucccaggcagggauggaugcaggcaggggaauggggguuugaugucccugggcugaauuagccaggcaugcuggugcaugccuguaaucccagccacucgggaggcugaagcaggagcaucacucaagcccaguaguuugaggcugcagugaguuaugauugcacuauuacacuccagccugggugagacagugagauccugucucuaauaauaauaauaauaauaauaauaauaauaauaauaauaauaaagucccugggccugcccacaucccagguugacgucuuugagcacccuccugauuccccugucagcuuuugaaguuagcccacagcagccucggucccugacccccgugccccggcugccccugccugggcuccccugcuacuugagacaagcuagccauuuccauuucaguacagcugaaggacacuuaugagaccaacacuuucuucuucuugguguuugaccuguaaguacccagcacuggagcaagccacaccugagagaaccuccgacugcuguccccuccccaaccccagggcugccuggagaccacagccagcuccugcgcugaggaugccaaauacaaucacgguguuuagacagaucagccccuggggucaggcugccggcuuuggaaaccuggguucaccacuugugggcuggaucauuucuuuaaaucuugguuuucucaucaguauuaugggagugauaauagcacagugacuggcauagugugaauacuaauaauuauuagcuacaggcgggcgcaguggcucacaaccguaaucccagcaguuugggaggcugaggccccagcuacgcgggaggcugaggcaggagaaucgcuugaacccaggaggcggagguugaagugagccgagaucacgccguugaacuccagccugggcuacgagagcgaaacuccaucucaaaaacaaaaacaaaacaaaacaaaaaaaaccccaaaacucuuggccucacgugauucucccaccucggccucccaaagugcugggauuacaggcauaagccaccgugccuggcacaguauagugauauaauuguucuauuuuauuauugguuguuagucucugacugugccuaacuuauaaacuucaucuuagguauguacauauaggaaaaacauaguaaguauaggcuucagugcuauccaugguuucaggcauccacugggggucuuggaacauauccuaugcagauaaagagggaugacuguagacauauauaaaguagaacaagggguuagcaagagacaggggcuuccuuagaccgaguggucaggaaagcauguccaggaagugacccaagcagaggguggcaggauguaaggucggucagcaccaaagaccagguccugcaggcauuuuagccauaguaaggaguuuggagggucaagacugggagggugacaugaucugauuuacuuuuuuuuuuuuuuuugagacagaguuuugcuauugucgcccaggcuggaguauaguggugcgaucucggcucacugcaaccuccgucuccuggguucaagugauucuccugccucagucucccaaguagcugggauuacaggcacccaccaccaugcccagcaaauuuuuuauguguguacuguuuuaguagagacaggguuuugccauguuggccagucuggucucgaacuccugaccucaagugauccacucgccucggccucccaaagugcugggauuacaggcgugagccacugcgcccaggcugacuuccuuuugaaaagaucucacugacuaucuagggacgacuguaaugaggcgggauuggaaaaagggaggccagcaguauugaggagagaggcaggugguagagguugcaucuggggugugguccaaagaucaauaucaucaucaccaucaccaccaucaucaccaucaucaugccccugcuuuggcaucaauaggauuaguaagaugagccccuuauuucuaagcaucaaaugugaacaauacaaagugcucugugaaaugcaaauuccagacuuaucaugggccaggcacagugccucacaccuguaaucucaacacuuugggaggcuguggugggaggauugcuugaggccaggaguuugagaccagccugggcaacaaagugagaccccaucucuacaaaaaaauauaaaauuaaggccaggcauggugguucaccccuguaaucccaguacuuugggaggcugaggcaggcggaucagaugaagccgggaguucgagaccagccugggcaacauggcaaaaccccaucucuacaaaaaauacaaaaguuagcccaggauggugacagauaucuguaaucccagucacucaggaggaugaggcacaagaauggcaugaacccaggaagcagagguugcaguuagcugagaucgugccacugcacuccagccugggcaacagaggaagacuuucucggaccccuccagacucaccagcugcagcugucucgacugcucuguggcacuguccuguauagcccuuggggacagcucaaaugucuuuaaccuuugaagaaguugcugggggaagcuauuuuuaaugcugcccugaggagcccuccaggguauaacuagauuguucuagcagaguccuuucuagaucaucccaggagguaagaagauugaaccucaauucuuaauccuguaauuggcaaacuuugcuccugcaacucuugcacagccgauucuucccauuuguuuccugggaaaaaaucgggauacucggccaggcgugguggcucacgccuguaaucccaacacuuugggaggcugagacgggugaucaccugaggucaggaguugaagaccagccugggcaacaugaugaaacgcugucucuacuaaaaauacaaaaauuagcugggugugguagugggcaccuguaaucccagcuacucgggaggcugagguaggagaauugcuugaaccugggaggcagagguugcagugagccgagauugcaucauugcacuccagccugggugaugagcaaaaacuccaucucaaaaaaaaaaaaaaaaaaaaaucgggauacucacguccuucugaucugggucugggguccugggccagugguucauaguccccucuuucagccuccagccaucauuuaggccccgauacaucccaguccacacugucacuuccacagaugggaagacacugauacaauggagauggaacagaaauggugcuugggcugggacucucccaaguccaccaacuucagggcccagggcagggcaagguacugcucacagggccaccagcucggggcccauugcuucccuggucacuucuagccauccuggccuggaacuaggguaaugggaaccuggggaggggacuuagcugaagaaaugccuaccucaugaaauggugggaaaaauuuuuccaggggaaaaauucagucaggggagaaaccuaggccuauuccucggaggguugaugagagccugagccccugaugugggccaccucuccagccuccucugcuuuucucccaguucuuccagaacacuucucacuuccccggcuccucuccccagacugugguucuccacggagaguggcccacuuagcuucuagagguaucaggguggaaggcagcucucugggagcaggguaagggcagugguggucuugggaccgauccagcuaucaacccucuguuuccacaggaugaagagaggggagcucuuugacuaccucacugagaaggucaccuugagugagaaggaaaccaggugagggucccuuugcccuucucuccgcucccucccacguggcuuagggccacaggcacuggggucucaggggaggcagggcgugcacaugucugggcugggcgugugugcugcucccuugcaguguggcugaaaugugagcugugucucccugccuguuaccugacccugagcagaggaagaguaacaagugugugccccacccuagaaagaucaugcgagcucugcuggaggugaucugcaccuugcacaaacucaacaucgugcaccgggaccugaagcccgagaacauucucuuggaugacaacaugaacaucaagcucacagacuuuggcuuuuccugccagcuggagccgggagagaggcugcgaggucugguaacauggccuuggcccacguccaggccucgggugcucaaucaaccaucugcagaauagagauggucuggguuucuccccuaacuuaauuguucccuggaauaaaaauuccaccauuucaagggcuagggauuuuuuuuucuuuuucuuucuuuuuuuuuuuuuuugagauggagucucacucugucgcccaggcuggagugcaguggcacaaucucggcucacugcaacuuccaccucccgaguucaagugauucuccugccucaaccuccugaguagcugugauugcaggcacgcgccacaacgcucggcuaauuuuuguauuuuuaguagagacaggguuucaccauguuggucaggcuggucucgaacuccugaccuuacgauccgcccgccucggccucccaaagugcugugauuacaggcgugagccaccaugcccagcagggcuaggcauuucuucagguaaguccucucccagguucccauuacccuuguuccaggccaggauggcuagaagugaccagggaagcaaugggccaugagcugguggcccugugggcaguaucccgcccugcccugggcccugaaguugguggauguugggggagucccagcccgagcgccauuucuguuccaucaucuccauugucucuuuggacuuccucucuuuuuuuuuugaaacagagucucacucugucaccaggcuggagugaaguggggcgaucucagcucacugcaaacuccaccucccagguucaagcgauucuccugucucagccuccugaguagcugggacuacaggcacaugccaccacgcccagcuaauuuuuguauuuuuaguagagauggaguuucgccauguuggccaggcuggucucgaacuccuggccucagaugagccaccugccucggccucccaaagugcuaggauuauagaaaugagccacugcggccagccuggacuuccucuucugagugcccugcugaccugcccugaugaugacuguuccugcagaggucugcgggacccccaguuaccuggccccugagauuaucgagugcuccaugaaugaggaccacccgggcuacgggaaagagguggacaugugagugcgccgggaaaggaggagcacccagcuaggcugggcaagggaggaaguaggcagggcugggccggugccccuggcgcuggguaaguggcccugggcccucgcauguccagguggagcacuggcgucaucauguacacgcugcuggccggcuccccgcccuucuggcaccggaagcagaugcugaugcugaggaugaucaugagcggcaacuaccaguuuggcucgcccgagugggaugauuacucggacaccgugaaggaccuggugagaggccaggccaacuggcuccugggcucagggcugcgaugccaggcgccccugcccggggaggcccugccuuuccugacaugcuggaggggaccugccuugacauucucgguuccccucuccuccucucacaggucucccgauuccugguggugcaaccccagaaccgcuacacagcggaagaggccuuggcacaccccuucuuccagcaguacuugguggaggaagugcggcacuucagcccccgggggaaguucaagguacuaagcguccugauccaggcccgccagcucccuaagugcaaaccucuaagcccccuccucucccaggaguccuuacaccccgugaauuuccagaguacccaucccuccccucccagcugcccugugauggcuucaaagacggcaggugucagcccacuggcucggucccugaggaugcuggccaagugggaagugggggacacuaggaaggccccgcagaagccacccaaggcuucguggcaaacgagcccagagcgucccugugcuggaggggcagggccuggcagggcgggggcugcagcccagcuucuccgccuggcccugcaggugaucgcucugaccgugcuggcuucagugcggaucuacuaccaguaccgccgggugaagccugugacccgggagaucgucauccgagaccccuaugcccuccggccucugcgccggcucaucgacgccuacgcuuuccgaaucuauggccacugggugaagaaggggcagcagcagaaccgggcagcccuuuucgagaacacacccaaggccgugcuccucucccuggccgaggaggacuacugaggggcuggccagucagggagggcuagggggcagguggggaggggaagccauggaaauacaagucaaaggggu

SEQ ID NO: 191537 - RNA, 5370 nt, Homo sapiens
agagugcuaaauuuaucuucagaccggcgaccgcgccagccgcgaaucggaucucuauggagauggccuaggcgauaucccugagcugagagcaucacccuguccccgaauccuucuuuccucucuguuuuguuuuucauuccccucccucucuccccucccccuccaguccacgacgacuggcuguugacccuguucaggccucggugaaggugagaagcagagccgccgccgcggcuaagcggugcgcucugaaauggccgcuuccuggaacugccuaagauggcggucgcgggcucugcuguggaccgcggcgcugcugugcagcccagccgcggcaaaauccguucucuccaucgcugauggagaugaaauagagagaugguguugggugcugagacguuuucauguggucguuagcgcaggcggccgcccggggacgcgagagaagaccugaggcgagggugggcugcgacugguagggagccccccagucguggcaaucugugggcagcgcgcaccugugacagggaggagcugagggauaguuggcccuggcugcacauccaggugaccguuuaaaaaagcauuuagguguuggaaggagcaucuguucccaccuuuuuggcuggccugcacucagauccuguccuccugacccugaggguauuguucccagccggaaccgcccgaagauaggggagaaaggauugugauacuugucaguuuaaccggaaggagacuaaagacggaaguuuuccccgcucuucagggaguggaaaggaaacuuuacucucaaaggaguccagauucuuuguccucgagaaauucggggaaacaccuucgaagaggugggguugaggaccuucuuucugaaaacaaaagcuuccuacucuucuguguccucuggcaacgagagggauccugaucuuuuacgugaaccagcagcuccacagaguucuccguugcaaaauccaaaaggagacuguggaaggagaaucugcuuuuuugcucccaauaagaagcagggcuuuaugcuguugcuaguaugagacccucgacuuucuggcaguuauaauccauuguucauccguuucgcugcauaacccaacuccuaguaacgagauuuuuuaguaguuggggaauuaaaaguauucaggaacacccaaguaauggcuagacacaugggcuaugcagucaaacuuuuugggcucugaacuugguuuuucacuuacaagagguguuagcgagauguguuaaccugugucuguuuaucucuaaagugggguuauuaauaauccuugugucuucauagaugagauaaucuauaugagggauuuagcaguaauuggcauacaguaaacaaucaucagucauuagacauuguuuaccugaggagauuggucacuggggggcuaaaaaugauuguagugaaagaacugcuucauguaauaguucuauguauaauuccauuuuagauucaagaccuaguuuuagagacauugaugagguuguacuuuuaaaaauuaggcuuaguuucaaguucuagaaagugugguggugguguuguuuuaacauguuucuaugaagucaguaggugggggaacaucucaaagcaucuaaauugccaagauauugaacaggaugaaaauguuagaauuuuuacuaugcuaggcgucuucucuuucaguccaagaucugcauugcaguaaagaaucauuuucacugcuuagauccagaaagaauaaacccaucuuacggguuuauaguuaguucugcuuguuacuguaucuaauuuuaauuuuucucauucuaggcuuuugguuacuccccuucccaccccaucccuuaauuuuauucuuuugaagagugcauuucaagcugccaagguggagagagggauuacagaaaggagaacaccuuauuucagguaucuuauccucuaccccuuaauaggagaaccauuuugacucaagaucuaacaugagaauacaaaacuuacucuauagccagguuauaaaguuuaaaucaaaaguagcuauauuuggacagacauaauuuguaugccuugauuuauagaguuaauaguauucuuuagcaauccuuagauugcauuauccuuuuaauuuugauuuguuuuauuauaugagaaauaaaccucuuaaaugagaguuuauuuuuuuuuuuuagguccugguuaagucgucaccuguuguauaaauagaaugcagaguuaucuguaaaaauauacauuacuuucauugagucuuaauuuggauaauauaaacguuuauauaauuuaaguccagagaaacaguaccuaacuuuugauauacaauuuauucuucauuguuaacgcauaacauuuaggauacaguagaauuauguaucucgcaaaacuuggaacuguguguguguuuaauucacuucuucagaauuguugcuagcccugaagggacuucagauauauaauaguaucaacaacuaauacaucuaaugacaguaggcaucaaaagcuaaaagagauuucacaauacuacauaccaugagacagggcugauaaauuauggcccaugcugucugguuuuguacguaaaguuuuauuggaacacaccuguguccauucuuucauguauugucuauggcugcugucauguuacaacuacagaguugaguaguugcaacagagacuauauggcccuugaccaaaaaaagccugccaaccccugccaugggacauauucuucagggucccuuucuuaaaaauauguauaacaacucuuaauaauuuauuggcucagugauucccaaauuauguuuuauagaauauuaauauucucuaaguuaauaaauguuuugagaaaaugauugaugcuaauauugguuuuucuuuaugguugauuuuaauauguuuauuuaaauaugagauuaagacugcuaaacucauuucuauagcuuuuauuuuuaugugauaaucuaccuuuaagaaaagguguaccauaccugagagcaccaggaagucgcaugagagaucaccugauacaugaacguaugauguuccaucugcgcauugaugaauaggcagcauuuacaaauuaacugauguguugcuguauaucaucucuuugaugauugcuccucuucuuuguauccugucuuauaauuucaacacauuugcgauacucaaugucuauucuaaauuaaccauguuuuguaccacaaacucauugcccauggaucuguugcugaaacaaggaagucuuaaacaagaaguggaaucuuucuguuaucagauugugucugaaucaaaugaucagaagguuggaauauuacaaagugaagauaagcaguugcaaccuucaguuucuaaaaaaucagaaggugagcuuuccagggucaaauuuauauccaauuccaacaaaauaacauuuaguaaaaaaccaaaaagaagaaaauaugaugaaaguuauuugucuuuuggauuuacuuacuucggaaauagagaugcaccucaugcucaguguguauuauguaagaaaauuuuaucaaauagcucuuuagccccuaguaagcuucgaagacauuuggaaacuaaacaugcugcauauaaagacaaagacauaagcuuuuucaagcaacaucucgauucaccugaaaauaauaaacccccaacaccuaaaauugugaauacagauaaugaaagugcuacagaagcaucauacaauguaaguuaccauauagcgcugaguggagaggcucauacuauuggagaauugcuuaucaaaccuugugcaaaagauguagugaugcggauguuugaugaacaauauaguaaaaaaauagaugcaguacagcuaucaaacaguacuguugcacgucgaauuaaggaucuagcugcugacauugaagaagagcuuguuuguagacugaaaauuugcgauggguuuucacugcaacuagaugaaucagcugauguuucaggacuugcugugcugcuuguguuuguucguuauagguuuaauaagucuauugaggaagaccuacuccugugugaaucuuugcaaaguaaugcuaccggugaagaaauauucaacuguaucaacaguuuuaugcagaaacaugaaauugaaugggaaaaauguguugauguuuguagugaugcuucuagggcaguggaugggaaaauugccgaagcugucaccuuaauaaaauauguggcucccgaaagcaccaguagucacugccuauuauacagacaugcacuggcaguuaaaauaaugccuacaucucuaaaaaaugugcuagaccaggcaguacaaaucaucaauuauauuaaagcucgaccacaucaauccagacuauuaaaaauuuuaugugaggaaaugggugcucagcacacagcacuucuucuaaauacagaggugagguggcuuucucgagguaaaguucuuguaagacuuuuugaacuucgucgugaacuuuugguuuucauggauucugcuuuucgacuaucugauuguuuaacaaauucaucuuggcugcuaagacuugcauaucuugcagauauuuuuacuaaauuaaaugaaguuaauuugucaaugcaaggaaaaaaugugaccguuuuuacaguauuugauaaaaugucgucauuguuaagaaaauuggaauuuugggccucaucuguagaagaagaaaacuuugauuguuuuccuacacucagugauuuuuugacugaaauuaauucuacaguugauaaagauauuugcagugccauugugcagcaccuaagggguuugcgcgcuacucuguuaaaauacuuuccuguaacaaaugacaauaaugcuuggguuagaaauccauuuacaguuacuguuaaaccagcuucauuaguagcacgggacuaugagagccugauugauuuaacaucugauucucaagugaagcaaaauuuuagugaacuuucacuaaaugauuuuuggaguagccuaauucaggaauacccaagcauugcaaggcgugcagugcguguacuucuuccuuuugcuacaaugcaccugugugaaacgggguuuucauauuacgcugcaacaaaaacaaaauauaggaaaagacuugaugcugcaccucauaugcgaauccgacuuagcaauauuacaccuaauauuaagcggauaugugauaaaaagacacaaaaacacuguucucauuaaaauuggaggaguuugcaugucucaugauaaccaaauguaagaugaaaauaaaagaugauuuacuucaucucugguauuugggggauuuaaauaaaaugauuccauuuuuuuauacuauuuagauuuuaagaaggcuaaagaaucaaacguuuuaaacaua

SEQ ID NO: 191538 - RNA, 21629 nt, Homo sapiens
guccucaaccaagauggcgcggauggcuucaggcgcaucacgacaccggcgcgucacgcgacccgcccuacgggcaccucccgcgcuuuucuuagcgccgcagacgguggccgagcgggggaccgggaagcauggcccgggggucggcgguugccugggcggcgcucgggccguuguuguggggcugcgcgcuggggcugcagggcgggaugcuguacccccaggagagcccgucgcgggagugcaaggagcuggacggccucuggagcuuccgcgccgacuucucugacaaccgacgccggggcuucgaggagcagugguaccggcggccgcugugggaggugcgaucucggggcagggccgggaggcgcccgaaagcccggcggugggaguaggggagcccgggccccccgcagacuucuuccccugggcgucuccgagcuggggcccgcaggagguuaaaggucaacgggcuugggggcgccggcuugggggacgggggaacaggagcacccuggagggccggggcggauuaggcaggaggagaaaaggcucuugccgagcccuuucccgagguaaaggcugagucugugcaguauccuuccuuucaauauuuauuuuuaauuuuuaaaaauuuuuuugagacuggguuugcaccuguuucccaggcuggggcggaguggcgccagccuaacuucugagcucaagcgauucucccgccccagccuugcaauuuagggggugccaacacgccuggcuaauugaaaaaaaaaaaauuaucugggcucgguggcucacaccuguaaucccagcacuuugggagguggaggcgggcgaaucgccugaggccaggaguuugagaccaggcuggccaacauaacagggugaaaccucaucucuacuaaaaauauaaaaauuagccaaguguggugguucaugccuguaaucccagcuacuugggaggcugagucaggagaauugcuugaacccgggaguagagguugcagugagcugagaucaggaugccacugcacuccaacuugggcgacauagugagacuacgucuccaaaaaaaaaaaaaaggcaaaaaaacuuaaaaaaaaaaaaaagauacagggugucacuauuuacccaggguggucucgaacuccuggccucaagccauccucccacguugaccucccaaagcgcugauuacuggcaugagccacccacacacucuggccacagcggcaugcacugcacagagcugggcccggggaucgggagaaggugacaguuuagauguccugaggucagcucugccgaggcaggaagucccuugguuuucaagguucacauagaggacaggacaugacaucaggcccaggacgccaccccuguuccccuccugacuuggaugugaucugcagagaaguggaacugggugaggucugggcggcuuuugccuggucuacauccucuuauucugacuuugcagcauucaguacaggagggaaagaggagggggcugggugccagugugcaccccacucacaguguccuaagcaaagcuccccccauuccuccaaccagccuuccucccugugacaggcaguggccaucugccucuuagucacaggucugaaccuucuugccucuggcugggauguggcccugggcuugcuccugucucaggagauauugugccccauccacucugaggaggaacuccuggccccacuggcccaggugcacagaucgcccuggcaguugaccugucaucagcaaguuaucuguccuuucugccaagaauccccgcuaugugucagggcuugugcuaggccugggggcacagccgugcagcacacugguccuggacccuuuugggggccuaggagcugagcccggcucuucucuccacagucaggccccaccguggacaugccaguucccuccagcuucaaugacaucagccaggacuggcgucugcggcauuuugucggcugggugugguacgaacgggaggugauccugccggagcgauggacccaggaccugcgcacaagaguggugcugaggauuggcagugcccauuccuaugccaucguggucagugcggccaggagcaggcagggcgggugggggggcacggcugcugaacagcaugggaccuccagcugccacccacggcauguaugcuggggugggauggugggggguccugcccugcccugcccugggggcugugcccuguauagggggauagguagccugaucuaccccauugggaugucauucuucccgucuggcuggaaggccccggagccccaugcugcagguuaugugagggagugcccgauaguagggcgccuccucaugcccugaccugcagcccccuccccguaucuccugugucugcagugggugaauggggucgacacgcuagagcaugaggggggcuaccuccccuucgaggccgacaucagcaaccugguccagguggggccccugcccucccggcuccgaaucacuaucgccaucaacaacacacucacccccaccacccugccaccagggaccauccaauaccugacugacaccuccaaguggguaccauccugccuccauugcacacacccaccuucccgccccacccuguggucuuccugguagggacuggguggccuucacagaguggaggccuuggaucuggggaggccagggaggccugugagcugaggucaggggacccagagcaagggcccagcaaaccacaguccucccauccuagguaucccaaggguuacuuuguccagaacacauauuuugacuuuuucaacuacgcuggacugcagcggucuguacuucuguacacgacacccaccaccuacaucgaugacaucaccgucaccaccagcguggagcaagacaguggugagggcuucugguaggauccucucagcggggcccaggguggcucuguuuguucccuguuuggaaagcucucccaggaaaaaggugcucccagcaucucuacacccucacagauucccuuccaccuaugaagcuaaaauucagccugugugagcggauacgggcucccaaaaucacccgugugguugaccucgcuaggagaagaggggucuggccuaacgucacacagcucgggguggcaauccugucccuucucuauggugcuacucucacuccaucuccccuugcuacacaucgugcucaaggaacaggcagcuucgguggggggggcgccgggcaugguggcuuaugccugucauccagcacuuugcaaggaggcccugguauaaggaucacuugaggccaguaguucaagagcagccugggcaacauagugaggccaucaccacaaaaaauuaaaaaauuagccagggauggugaugugugccgguagucccagcugcugaggcaggagaaucacuugagccugggaugucaagggugcagugagcuaugaccacaccacugcacucuggucugggcaacagacgcagacccugucuuucuuuuuuucuucuuuuuuuuuuuugagcuggagucucgcucugucgccaggcuggagugcgauggcgugaucuuggcucacugcaaccucugccucccggguucaagcgauucuccugccucagccucccgaguaacugggauuauaggcacccgccaccacgcccggcuaauuuuucuauuuuuuuuuaguagagacaggguuucacucuauuggccugacuggucuugaacuccuaaccucaggugauccacccuccucggccugccaaaaugcaaggguuacaggcgugagccacugugcccagcugggauacccuguuuuuuuuguuuuuguuuuuuguuuuugagauggagucuugcucuguuguccaggcuggagugcuguggcguguucuuggcucacugcaaccuccgccucccggguucaaacaauucucuugccucagccuccugagcagcugggauuacaggcgugugccaccacguccagcuaauuuuuguauuuuuaguagagaugggguuucaccauguuggccaggcugguucaacuccugacuucgggauccacccgccucagucucccaaaaugcugggauuacaggaaugagccacagcgcucggucuguauuuaagaaaaauuuuuguuuuaaguuuuuuuucuuuuuaaaaauauaucuuuuucagggcgggcgcgguggcucaugccuguaaucccagcacuuugggaggccaagguggggggaucacgaggucaggagaucgcgaccauccugacuaacauggugaaacuccgucucuacuaaaaaugcaaaaaauuagccgggcaugguggcaggggccuguagucccagcgacucgggaggcugaggcaggagaauggcgugaaccugggaggcagagcuugcagugagcugagauugcaucacugcacuccagccuaggggacagagcgagacuccaugucaaaaaauaaaaauaaaaaaauauauauauaucuuuuucuuuuucugagaugaggcuugcacuguggcccaggcuggagugcaguggugagauuauugacagccguuguggggccgcgguucuaaguuuaaaagaauuuaggcugggugugguggcuaaugccugucaucccagcacuuugggaguccaagguggauggaucgcuuuagcugcaaaguuugagaccagccugggcaacauacugagacccuaucuaagaaaaaaauaaauaaauaaaauaaaauaaaugaauaaaaaagaauuuaaaaaagaaucccacagcaaagacaaugcaccauagagcaauuuauugccaaggaaagguauuuuggaaguuaaguuuagaacagccugggugcacuggcucaugccuguaaucccagcacuuuuggaggccgagauggguggaucacuugagcucagaaguucaaaccagcuuagccaacauuagcuggacauuguggugugagccugcaaucccggcuacucaggagguugagaugggagaauuguuugaacccgggagguggagguugcagucagcugagauugcaacacugcacuccagccuaggugacagagugacacccccaucucaaaaaaaauagugaagugcaaaaugcacaguucacccugagacacagaauucaggacaggcugcucguaaggaugagacagcaccgauuauuacuggggaaacucccuuucugggagucuuccgugaugaauuccuaaggagcugggaagagguguuacuguaagcacguucugggccguccucugguugcacaugcguaguagcuguacaugcuuguucacacgucacgugucucagugccgugguuggcaugucugagggacacggucacuuccuugacuaccuauccugccucaagaucauagcucacugcagccccgaacuccuggcucaagcaauccucccacuucagccucccaaguagcuggggcugccggggcugcaagcacgcaccaccacgaccggcugauuguuuguauuuuuagggaagaagugguuucccuauguuacccaggcuggucuugaacuccuggucucaagcgauccucccaccccagccuccucaaguguugggauuacaggugugaccacugcaccuggccaaaaucuuuuuuuaaauuaaaaaaagcaccgggugcgguggcucacaccuguaaucccagcacuuugggaggccaaggcggguggaucaccugaggucagggguucaagaccagccuggccaauaugacaaaacccaucucuacuaaaaauauaaaaauucgccaagcaugguggugcacgucuauaaucccagguacuugggaggcugagacaggagaaucaccugaaccccagagguggagguugcagugagccgagaucaugccacugcacuccagccugggggacagagugagacuccgucucaaaaaaaaaaaauaagaaauuaaauuuaaaaaaagcaacagaaacaaauggcugccuggcagcgguggcugcagggcgcuccuguuugugugacucaggucgugucccucccucagcccuggucucucuuguuucuugcagggcuggugaauuaccagaucucugucaagggcaguaaccuguucaaguuggaagugcgucuuuuggaugcagaaaacaaagucguggcgaaugggacugggacccagggccaacuuaaggugccaggugucagccucugguggccguaccugaugcacgaacgcccugccuaucuguauucauuggagguaauggugguuugggacaugccuaagggaggucuuuugcccccauguggugacccuggcuucagcaggagcccaagacagguggaugggcaggcaugguccucugagcuuucugauguuucucacccuuggugggaggcccauuuucuuuuuuuuuuuuuuuuuugagauggucucacucugucacccaggcuggagugcaauggccugaucacagcucacugcagccuugaacucucagccugcagcaguccuccugccuuggccuccugaguagcugggacuacaggcacaugccaccaugucuggcuaaauaaaaaaaauuuuguagccugggcagagugacucaugccuguaaucucagcauuuugggaggcugagguggguggaucacuugaggccaagaguucaagaccagccuggccaacauggugaaaccccaucucuacuaaaaauaugaaaauuugcugggcaugguggcgaacaccuguaauuccagccacucgggaggcugaggcaggagaauugcuugaacucaggaggcagaggcugcagugagcugagaucacaccacugcacuccagccugggggacagacugagacugucucagaagaaaaacauuuuuuuuuuauagagauggggucucagucugucagcaggcuggucuucaacuccuggacucaagugauccuccugccuuagccucccaaagugugggaacuccaggcaugagccaccuugucuugucaaagggaaggccauguuuugaagggcagguucccagggucagccaggguagggcagaaccucugauugcugcaucucugcuuacaggcccagaggcagcugcuggggugcacgaggggccuuccugcuggagggcaggccggauggggcucaggcugucggggugcucacaccuggugcuuuggcugucauaggugcagcugacugcacagacgucacuggggccugugucugacuucuacacacucccuguggggauccgcacuguggcugucaccaagagccaguuccucaucaaugggaaaccuuucuauuuccacggugucaacaagcaugaggaugcggacguguguuggggcuccuggguccuugucggggcugcuucuggucacccuccacuuucgccuucccuguguccugcaguugagggcagcucagggcaaugaggcaaauggcuccaaauggagagggggcucaugggguggcucuccaggguccuggcucucagaggaagugcagcuucgacagggacaggggucacuuggcucugcuaucuccuagauccgagggaagggcuucgacuggccgcugcuggugaaggacuucaaccugcuucgcuggcuuggugccaacgcuuuccguaccagccacuaccccuaugcagaggaagugaugcagaugugugaccgcuaugggauuguggucaucgaugagugucccggcgugggccuggcgcugccgugagucucugcugugcaccugcuccgccugcccagcccgggggcgucaccgugacccucugucccuucccuccuggcccgcaggcaguucuucaacaacguuucucugcaucaccacaugcaggugauggaagaaguggugcguagggacaagaaccaccccgcggucgugauguggucuguggccaacgagccugcgucccaccuagaaucugcuggcuacuacuugaagugagugcucccucccugcccucggcuagagugggaaggagacccuggcagguggcuggccucggugggcaugugcuguucaagaucggccucguguccagcccaaugggaaggccguccauacccagauaguucaggggaccaaauaucuacccacccaaauugugguuuucuuuuuuguucuuuuuuuuucuuuuugagauggagucucacuauauggcccaggcuggagugcaguggggugaucuccgcucauuacaaccucugccuccuggguucaagugauucuccugccucagucuccugaguagcuaggauuacaggcacccaugaaccacugugcuggggcuguuuuuuuuuuucaaaauggguucucacucugguugcccagguuggagugcagcggugcaguuuuggcuuacugcagccuugacuucccaggcucaggugauccuccugucucagccucccaaguagcugggauucuagaugugugucaucacgcccagcuaauuuuugcuuuauuuuuuauuuuuuggauaugcagucucccucuauugcccaggauggagugcaggggcaugaucucagcucacugcaaccucugccgcucagguucaagugauucuccagccucagccucccgaguagcugggauuacaggcacaugccaccacgcccagcuaaguuuuccuuuuuuccuuuuuaugagauggagucucacuccguggccaggcuggagugcaguggcgcaaucucgucucacugcaaccuucaccuuccagguucaagugauucuccugccucagccuccugaggaguugggauuacaggcacacgccaacauacccugcuaauuuuuguauuuuuagcagagacgggguuucaccauuuuggcuaggauggucucgaucucuugaacucaugauccgccugccucggccuccugaagugcucggauuacaggcgugagcuaccacgccuggccaacuuuugcauuuuucaguagagacgggguuucacuauguugggccaggcuggucuuggacuacugaccucaggagauccacuuaccucggccucccagagugcugggauuacaggcgugagccaccgugcccggcuaauuagagacuggguuucaccauguuugccaggcuggcguggaacuccuggccucuagugauccuccugccucaccuucccaaagugcugggauuacaggugugaaccaccacaccuggcccccuuuucuuccuuacaaucgugcaguucuaacucagcguucagaguuggauuuuucacuugggguagaagcaggagaggugguagaaaugccucuugacucauacagcacaccccaauuucaugcagugcuuugggcugagccaagucugcagcaggcagaaggcucugagaaguuguugcagccugggccaaggacaauucagagcuugggggcacaggggugugcucagcaggacuggguggacaggcccuuuguugcgaaggggaagaguacaggcuuccaggagcagguguuugaggcuucuuugggagguggccagaggagaugccuguuuucuggggcaggauuuggagggagccacccaggcuggagagguucagccaggcugucacaggcuuugaaguuucccaucugagagccuggcuguuggagaguguggguuuggaacuugaggcuaggggguucuuuucugaucugugccagccacagccuucggauaggcagagcaaugaugggggagggcguaaaagaagaaaugaacugaggaaagagaagaggaaaacaggcuucaacaacagucuaggcugggugcgguggcucacgccuguaaucccagcacuuugggaggccaagguggguggaucaccugaggucaggaguuugagaccggcguggccaacagauauugaaacccugucucuacuaaaaauaaaacaauuagcggaacacagaggugggcgucuguaaucccagcuacuugggaggcugaggcaggagaauugcuugagcccaggagguggagguugcagugagccaagaucaugucauugcacuccagccugggcuacagagugagauucugucucucaaaaaaacaaaaacaaaaacagucuguacuguggaggccucgggcaggugccaggagcucugagcacagacgggucccucuguuggguuuuucuucccuucuaagggccauuucuucuuauuuauuuauuuauuuuuugagauggaguuuugcacuuguugcccaggcuggagugcaauggcacaaucucggcucaccacaaccucugccuccuggguucaagugauucucccgccucagccucccgaguagcugggauuacaggcaugcgccaccacgcccagcuaauuuguauuuuuaguagauaugggguuucuccguguuggucaggcuggucucgaacucccaaccucagguuaucugccugccucagccucccaaauagcuggggccacaggugugugcggccaugucaggcuaaguuuaaauuuuuuuuuuuuuuuccgcaagauggagucuugcuuguugcccaggcuggagagcacuggugcaauuuuggcucacuacaaccucuaccuccuggguucaggcaauucuucugccucagccucaugaguagcugggauuccaggcgcaugccaccaugcccagcuagguuuuuuuuguauuuuuuuguagagauagacuuuuaccauguugaccaggcuggucucaaacucuugaccucaugauccacccgccucggccucccaaaguguugggauuacaggcgugagccaccaugcccgccccuaauuuuuaaauuuguuguagaaacaaggucuugcuauguugcccaggcuggucuugaacuccuggucucugguaaaacucccaaagugcugggauucuaggcgugagccgccuugcccggcacuugcaccauuucucugcaugcgucuccacucccacugcccaggaccuguggacuuagauuugagucacugcugagcaccucgcaccuagccccaugccugccucccagccugcacuccguuugcuugaugcauuaauaaauaucccucccaaaucugcauccauccaccuccuguguucaagagcuguuucagggcgucaaccucauuuuugccaguguccagccuagugaccucagcucuguguaccuggaagaguggcugcuccucuggggguauaggauucggagauggggguagaaggagugauguuagagagcucggucuaggacuagaggaucauaugcccuuauguaaaauacaucucaaguuagggaagaaagcagcggcuccaugcuuuuuuuuuuuuccccuuuguuuuuguuuguuuguuuugagacagggucuugcucuguggaccaggcuggagugcaguggcaugaucuuggcccacugcagacuccuccuucuggguucacgccauucuucugccucagccuccugaguagcucagacuauaggcgccggccaccacgcccggcuaauuuuuuguauuuuuaguagagacgggguuucaccguguuaggaugguaucgaucuccugaccuugugaucugcccgccucggccucccaaagugcugggauuacaggcgugagccacugcgccuggccgcuaauuuuuguauuuguaguagauagaguugggguuucaccauguuggccaggcugaucuugaacuccugaccucaagugauccacccaccucggccucccaaagugcugggauuacaggugugaaccaucgugccuggccccguguuguguucuggcgguggaagaugggacagagaggaugggagggugucugagccauuccuggacugauggaaccuguuucuucugccuuuuguggacaggauggugaucgcucacaccaaauccuuggaccccucccggccugugaccuuugugagcaacucuaacuaugcagcagacaagggggugagccuggggguccccaccccacuucucccugccuuugccugggcuuguccugaagccuggucaugggaacagccaggaagaaccaugcgcugccagucuggguuuuauuucauuuucuuuuuuacuuaaaaagauagagacagggucuugccauguugcccaggcuggucuccaacuccugggcucaagcaauccuccugccuuggccucccaaagggcugggguuacaggugugggccaccacaccccggccgcagccagucuguuuucacagauggucuuuggguuaaugagaauucucccccugcuuacucgccaggcaguguggcuuucucaauccaaggaggcugggcauagggagaugggauuuguuugcucaguuuggacucagcauuuuuugcacuucgauuuaauagacucauaaaacaucaaagauuuaagggagcuuagaguucaucuggcccacaccuggcugaugagaaucucuaggggaaguuuuuaugaaaugccagaucucugcauucugagguccugauuuaguacguccaggguuggaacuugaguuuuucuuuuucuuuuguagaggcaaggucuuacucucuugcccuggcuggagugcaguggugcaaucacagcucacugcagccuugaauuccugagcccaagugauccuccugccucagccucccgaguagcugggacuccagguuuucaccacugcgccuagcuaauuuuauaucuuuuuguagagguggcaucucucuauguugcccaggcuggucucaaagucuugagcucaagugaucuccugccuuggccucccaaagugcugugauuacaggcaugaguugcagugccuggcugacauuagcauucuuuauuuauuuauuuauuuauuuugagauggaaucuugcucuguugcccaggcuugagugaaauggugcaaucucagcucgcugcaaccucguccucccagguucaagcaauucugccucggccuccugaguagcugggauuacaggugcaugccaccacacccagcuaauuuuuguauuuuuuaguagagaugggguuuugccauguuagccaggcuggucucaaacugcugaucucaggugaucugcccacuuuggccucccaacgugcugggauuacaggcgugagccaccacacccggccagcauuuuuacuagaaagaaauguguucaggacgcauuagaaacuagccaguuggacacagaagccccugcugcucagcuguaagcaccgcuaugcugaagcuuggggugguccuacucggucgucaccgcccugcuccuuggagugacuuuucuggcccucugcaguccacagugcugccuugugaaagcucccucaagauccucugugacagccgggcaugguggcuuacaccuaucaucccagcacuuugggaggccgaggcaggcagauuacuugagaucaggaguucaagaccagcccagccaacuggugaaacuucauuucuaccaaaaauacaaaaaauuagcugggcgugguggcgcacgccuguaauccuagcuacucgggagacugaggcaugagaagcaccugauggugggaggcagagguugcagugagcugagaucgcaccacuaacauucuagccugggcgacagagcgagacucugucuccaaaacaaaacaaaagauuuucugugagaaugacugcaucggccccucggguggcagcgcuucuccagggcaaggugaggggaagcccagugaugggagugcugccuggagaggagucaguuccaguggugggggcccugggcuuuggcugagggcugugcguuggcagcugcugugccucucacagcccuucccagcggcgcacgucaugagugucaguguggagucccaggccuaccuccucugggccacuuugugaccauguuucuugccuauggcaggguaauuucaggaucuaaauugguacacuuggacguucucagccccaggaggcagcuguucccguucuagguuuuuuuuuuuuuuuuuuuuugguagaaaugggggcuugugauguugcccaggcuggucucgaacuccugggaucaagugauccucccaucuuggccucccaaugugcugggauuacaggcaugagccaccgugcccugcuaauuuucuuacuacuauuuuuuguaaugcugcagucuugcuguguugcccaggcuggucuuaagccauccuccugccucagccucccagagugcugggauuacaucccccuuaccuucucugccagaggagcccccgcagugugugaaugcugagucaugcugucuacugagugcugaacgggcucugcugcucugguccuaggcuccguauguggaugugaucuguuugaacagcuacuacucuugguaucacgacuacgggcaccuggaguugauucagcugcagcuggccacccaguuugagaacugguauaagaaguaucagaagcccauuauucagagcgaguauggagcagaaacgauugcaggguuucaccagguaagcaguguugagcuuucugcuuguguguucucucagggcagagaugucacucaccuccuccagccugaccugcgcccacugcacugcuccccucgcuucagcuuugggcucuccucccacggccccguccacguucccucaccgccaacagccaggccugugccccacucacuugguccucagagguggccuccuuacuggcuuuguuuccagauagccuccuaucacccgugcccaaguggucuuucuaacagauccaaauuuguauuuguuuuugagaccggaucucucugucacccaggcuggagugugguggugcgaucacugcucacugcagccuuaaccuccugggcucaagugauccucccaccucagccuccugaguagcugggaccauaggcacaugccaacacgccuggcuaauuuuuuuacuuuuguagagauggggucuugccauguugcccagacuggucuugaacuccuggccucaagugaucugccucaggcucccaaagugcugggauuacaggugugagccucugcaccagccacaguugaaaauuuugggaguccugucauuggcucccccaggcccacaggacaaagcccuaaccucuggucaggacacucaguguccucugcucucuccuggguuuucauccccuucuccccucuaucccagccacugaucuguuuccacugcccucgcuugcucuccugcucuugcuugagcuguuucuucugccuggaaugcccauguuggcaccauaaucaccaacuaaaauauccuuuuucuuaauuuucauauuuuagauauagggucuugcuauguuguccaggcuggucucaaacuccuggacucaauugaucuuccugccuuggccuccaaaagugcuggaauuacaggcaugauccacugugcuagccuuuuuuucuuuuucuuuuuuucagggucuuguuguguugcccaggcuggagugcaguggugucaucauagcucacugcagccuugaacuaaagggcugaaguaauucuuccaccucagccuccugaguagcugggacgacaggcaugaaccaccaugugcagccuauuuuuaaauuuuuuuguaaagauggagucuaucaggcuggucuagaacuccuggccuuacgugauuguccugccucagacucccaaagugcugggaauccaggcaugagacaccaugcccagccugucgucauuuuuuuaaucuaucucauuuuuuuguccuccucaccaaagauauguugguuugucuugugagguuuuuuuuuuccuguggauuccugaaccccauccagccccucauucccaccccagccagcucacacuuguuugucacagcuccugguugacacacagggaacagccacccacaguggacugcgcuguucuguuugcacccuuaaauuuaucgugcuuacagaaugccacuucugcaaacuagucaaguaggggaaguggcucuuggauauauuugcuugcgcauccucuuugaaaagguaaccagcucugaauucuuuuuuuuuuuuugacacagaguuucgcucucguugccuaggcuggagugcaguggcgcgaucucggcucacugcaauguccaccucccugguucaagcgauucucaugccucagccucccgaguagcugggauuacaggcaugcgccaccacgcccaccucauuuuguauuuuuaguagagaugagguuucaccauguuggucaggcuggucuugaacuccugaccucaagugauccgcccgccuuggccucccaaagugcugggauuacaggcaugagccaccgugccaagcccuagcucugaauucuuaagaaacucuugagagggucuaggucagugcugauagaaccucugcagugcugggcaugguggcucacaccuggaaugcuggcacuuugggaggccaaggucagaggaucucuugagcccaggaguuugagaccagucugugcaacauagaccccaucucuacaaaaaauuuaaaauuaguugggcaugguuaugagugcuuguaguccaagccacuugggaggcugaggugggaggauuguuugagcccaguaggucaaggcugcauucagcuaugauugcaccacuguacucccaccugggugacagagugagaccuuguuucaaaaaauaaaaaaaaacaaacuugcaaugauggaaauguucuauauuugcacugucugaaaugguacacacuagcuacacauggcuacugaggucuugauauaugacuaggauaacugaauugauuuaguuuaauuaaauaaauuuuuuugagacagccucacucuguugcccaggcuggagugcaguggcauaaucacagcucacugcucaaccuccugggcucaagcgauccucccuccuuagccccaaguagcuugaacugcaggcgugcgccaccacaccuggcuaauauuuugacuuuuuguagagacugggucucacuguguugccuagacuagucuugaaauccugggcugaagugauccuccugucucgaccuccaaaagugcuggcauuacagaccugagguaccaugcccagccugguuugguugaguuuaauuuaauuuaauuuuuauauauauauauauauuuauuagagacagggucucacugugucacccaaacuggagugcaguggugugaacacagcucacugucgcuuugaucucuggggcucaagcaguccuccaaccucagccucccaaguagcugggaccacagaugugugccacuaggcuuggcuaauuuuuguacuuuuuguagagauggggucuugcuauguugcccaggcuggucuugaacaccugggcucaagcaguccucccaccucagccucccaaauugcugggaugacagacaugagccacugcaccugacugaaagacauauuuuugccuguaguguaguuuagccuuaagacuguaccagcagauagagguggaaaaguaaugugaaacgaaugucaaauuacguuuauaaauaaagcagcugcucauuaagguuguuuuuuuuuuuaaaccuccuuuuuuauucuggguuacaucauucccuggcugucuuuaccccagcaucagugaguccugcagucacuauagcccccugugaagacagauauuuuggucaccaucaaguggaucuuuauuuuuaucuaacauuuacaauucugccaguucugacucuuacauucucuuugccuugaauccuaggauccaccucugauguucacugaagaguaccagaaaagucugcuagagcaguaccaucugggucuggaucaaaaacgcagaaaauacgugguuggagagcucauuuggaauuuugccgauuucaugacugaacaguguaaguggcaguuuggcucaugggauaacguacccguccucauuuuuucagguugccuuuccaauucuggccauuucaauuguaagaauauuggaaacaaaguuggggaagcugguuuaauccauguagguugcguugagaauuuucuaggaaaaguaaguuguguuuaggaaguaggaaagcaaucaggcccccgccucccaaauacggucaaaaagcaaacaggagagucagcuauagugaaucggaaauggcuggcuugccuuuuccuugucuauuuuguagccaaggaggaacgaaaaacgggaccucaucauggauuuacuuuugggauacacucauuauuccauagaaggguacaaagccugagaaacuuaagguauuucagucuguuguauauuacuugcgaaaagcaggcuuaucaaauacaggugaguuucaacgcaucuugaauuuggcagcauuuacaagucuucaggccagguguaguggcucacgccuguaaucccagcacuuugggaggucagggugggaggaucgcuugaggccaggaguucaagaccagccuguucagcauagcaagaccccaucucuacaaaaaauaaacagauuagcuaggcgugguggugugugccuguagucucagcugcuugggaggcugaggcaggcggauaaccugagcacaggaguuggaggcugcagugaacuaugauugcaccacugcacaagagccuggacaacagagugagacuugucuuuaaaacacaagauuggucuucaaagagaauaacaucugcggugucuugugaggauggaugaggggcugccaaguucgcaaugaaugugucccauuucuucuuaguuuauggacuuaccauaaacugaagauagcaguuugguggguuggagaagcaugugguaauggugggaauuauaauacauuacuuacagggaaagacaggccuuugaaagguaaagcguaagagugagaauggaauacggaugaaugaaugaacaagaugaggugagaaggaagagguaaagggaaaaggagaacaggaagcuguccucugcguggcaccugugauaaaugguuucuggggacaucccugauggcaguuuuguggagaggugcgaggcuuuaugcgguaagaaaugagcugcaggcugggcgcaguggcucaagccugugaucccagcacuuugggaggccaagguggacagaucaccugaggucaggaguuugagaccagcauggccaacauggagaaaccccaucucuacuaaaaauacaaaauuagccgggugugguagcgcaugccuguaaugccagccacuugggagacugaggcaugagaaucuguugaaccugggagauggagguugcaaugagcuaagaucacagcacuguacuccagcuugagcaauagagugagacucuuuuuuuuuuuugagacggaguuuugcucguuucccaggcuggagugcaguggcgcuaucucagccuacugcaaccuccaccucccagguucaagcaauucuccugccucagccucccgauuaacugggauugcaggcaugcgccaccacacccggcuaauuuuguauuuuuaguagagacgggguuucuccauguuggucaggcugggcuugaacuaccgaccucaggugauccgcacaucugggccucccaaagugcugggauuacaggcaugagccaccauggccagcugaaacucggucuuaaaaagaaaaaagaaaugagcugcaucacguugggcaagucaccuaagcuuuucauaagccuguccaguggggauaaugccaccuccuuguuggugucguaagggcugcauuugaugaaguacuuggcgaugccuguguucacuuauggaagaaacagucuugaaccuuuugguggggaaagcccccuuuccauuuaacauuuccauuuagugguggucuuacuggggacagagaauguccugagagcacagcccugacaggucguugccagcugugcuccuccaccaggcucagcucaggccuaaugaccaccaguggugggugcugccaagcuggacgucagccccggcggacuuugaacuccaugaguaggucccacgcagggaccuguggcuggucaggacccuggcucccacuaggcgcuaucucuucagaaaggcccaaggcuuuucaaggguaacugucccagauaccccuagcccucugccuacccaguuaccagacagcuggguacccagcauguaaaccuuaguuugcaaauaaaagauaaacuuuuagugcuuuuuuuuuuuuuggagauggagucucacucugucgcccaggcuggagugcaguggcacaaucucagcucacugcaaccucugcguccuggguucaagcgauucuccugccccagccuccugaguagcugggaccacaggcacccaccaccaugccuguauaauuuuuguauuuuuaguagagaugagguuucaccauauuguccaggcuggucuuaaucuccugaccuugugauccgccugcuuuguccucccagagugcugggauuacaggcaugagccaaugugcccagccaguuuuuguauuuuuaauagaggcggguuuccucauguuggccaggcugaucuugaacuccugaccucaggugauccaccugccucagccucccaaagcacugggauuacaggcguuggccaccacaccuggccacuguuuuggguuuuuuuccccuaacagacuagaaaacuagaaauuaacacaccagggaaccuggguguuugggcagagcagugguauuuaaauauuucaacccauaaauugucacuucagagcaagcauccugaaacuguaagaggacauuuggcugagcaugguggcuugugcuuauaaucccagcacuuuagggaggcuaaggagggcagauugcuugagcccaguaguuugagaccagccuggacaacauaaugagaccuugucuuuacuaaaaaauaaaaauaaaagauuaccgggcaugguggugcuggagaggcugaggcaggaggauugccugagcccaggagguugaggcugcagugagcuaugauugugucaccgcauuccagccugggcaacagggagaaaaaagaaaaaaaaagacauuucuauuuagugccuaccuuagcuccagacugguucuaacuugacccaucagaagacaucugaaucgcuuugugucuuuuuuuuuuuuuuguagcaccgacgagagugcuggggaauaaaaaggggaucuucacucggcagagacaaccaaaaagugcagcguuccuuuugcgagagagauacuggaagauugccaaugaaaccagguauccccacucaguagccaagucacaauguuuggaaaacagccuguuuacuugagcaagacugauaccaccugcgugucccuuccuccccgagucagggcgacuuccacagcagcagaacaagugccuccuggacuguucacggcagaccagaacguuucuggccuggguuuuguggucaucuauucuagcagggaacacuaaagguggaaauaaaagauuuucuauuauggaaauaaagaguuggcaugaaaguggcuacugaa

SEQ ID NO: 191539 - RNA, 17554 nt, Homo sapiens
gacgccaucccggccagaaaagcccuggccaguggcgggcgcgacacuauccgugcggccaggcggaggugagugcgcggcggccggaugggcgggacgggcguggaggacgccgagcaccguggcgcgcgcucacguccgcguccccaagggcugcgcucccucaagcgcagugcccagaacucggagccagcccggcccgggggacccugcuggccaaggaggucgucaguccggucuugucuuccagacccggaggaccgaagcuuccggacgacgaggaaccgcccaacauggccucggaggugagugggaccucggggacuccgguccuccuagccuccaaaggagagagugggggcgccagaccugccucgggccacccugcugggaaucgcccuccaggaagcaauuuugaaaauuaccuaggaagccugcacccccagcccucccgggcgcaucaucuggagcccagcagucaccuuuaccaggacucaccaguauccgcaggcagcccuuguggcaaacccaccaacccacacuacuagggguagaguggcucugcccucaccucacagugaugccugccuggccaggaaaaguggcucccaagccuucagccuuccaacucuuccuuccuucuuaccacguguccuccugucaggucccaccccacaccacaucccuucuccugcuagagcaauugucccuguuuauagaauaaagcucagccccuaaguguucuuguccuugacuguggcauguggaaagagccaggaaaaaggggacgucgccucguggcuccagcaacccuggugccuggucccuuccugucucacuggacccugccucuuagggucaguggcuccuggccucuccuccugaccacugagaugcuggauucccaggcagagguuuuccuuccuugggccauaguugauuuaucuggcaauggggguaauaauagcugucggccucacucuguaaggcacuagauuaugaggccauugcuuuggacccuucaggugagaggggcuguucgccugaugcuugaugaagggaacuccgggaagcaggaggucuggguuccaggcccuuuuggccuucauuagcuagcaauucacuuccucuuucucaaugcccugcaagcucagugcccugcaagcuucugggucauggcagggggguagggccuggacuuuggagccaaacagacuugguuucuguaccagucacuugagcccuuuaaaccucuuuccucauuugugaaauagggguaauauugcccaccucauaaaaggccguaauaacauaugugaaaucccuagcacagggcugagcaacaguaggugcucaauaaaugguggcuaaccacaacaauacugauauuucuacuuugggaggccgaggcgggaggacugcugaagcccaggaauuccagaccagccagggcaauguaaugagacccugucucuacaaaaagauuuugaaaauuacccaggugugguggcguacaccuguagucucacaggaggcggaggcaugaggauugcuugagcccaggaguuugagacugcagugagcaugaucucaccacugcacuccagcccaggcaacagagugagauccaguuucaaaaaaauaaaaauaaaaaaaccuggcaggcaugguggcucacaccuguaaucccagcacuuugggaggucgaggugggcagaucaccugaggucaggaguuugagaccagccuggccaacauggugaaaccccgucucuacuaaaaaugcaaaaauuagcuggguguaguggugggugccuguagucccagcuauucgggaggcugaggcaggagaaucgcuugaacucgggaggcggagguugcagugagcugagaucgcaccacugcacuccagccugggcgacaaagcaagacuccaccucaaaaaaagaaaaaaaacccacaagucccaaaaccaaaacugguauuucccauguacauucgaccuuaacuguugcucauucaacccagcccaacucagugccccauccccuggcccugaagagaccauucuggcccagauguguccuggcuuggaguagcaccuucugcuaccacacuaggccuccacucuccucagugcccaaggggaggcaccucacucugaucucccugugggguccucuuaugccugccaguaaggauaggaguuugguucuagagcagaguggucuggcuuccaacaagcccaguguucuaggugaccucagguugccccaggccuuccuguagguuggcacuaauugguuuggcugcagcuccacuuauuaaguaguuauuuuuauuacuaacaaccuaggcaggguggcccaggagcccgcugggggaggcggugccaggcuccuggcugaggggcaggcuggccccaauucugacuggcuggcuccagugaucaggaccagggccccacguggugcuuugcuggagaucuaggcuugguggggcagcugugggguaaggggcaggaccagcucaaagauggggugggggcggaggcugccucugcagggcagaguccuuuggcagucgggacuguugggcauagaggagucagcucacagcucagggccagagcacuggagaggucucuggggugcauacaggaaccaggaguggagcugaagcauguccuauccccugccagcccucccuuaguaacagcuggcauuucucgaguccuuccugagcaccaggcaccguguuauguaugcaauuugcaaauauuaucugauuaaaugcucacaauaaggcuaucagagagguacuauuauuauccuuaucuuauuauuauuauuauuauuauuuuuaagaaggagucuugcucugucgcccaagcuggaguacaauggcgccaucucugcucaccgcaaccucuaccuccaggauucaagugauucuccugcuucagacucccaaguggcugggacuacagcuuccugccaccgcgccuggcuaauguuuauauuuuuaguacagaugagguuucaccauguuggccaggcugaucucgaacuccugaccucaagcgauccaccugccugggccucccaacccugaggguuuuuguuuuuguuuuuguuuugagacagagucuugcucugucgcccaggcuggagugcaguggcacgaucucagcucacugcaagcuccgccucccggguucacgccauucuccugccucagccucccaaguagcugggacuacaggcgcccaacacccccaugccuggcuaauuuuuuuguguguguuuucaguagagacggaguuucaccauguuagccaggauggucuccaucuccugaccucgugaucugcccaccucagccucccaaagugcuaggauuauaggugugagccaccacgcccagccccugagguuuaauaauaggugccaggccaggugguuaauagaagucuggggcauuguagggggacagaggaggauauauguccccauuggccauuguagacucccuuccacaaaaaggacgucagugaagugacaugcccaccucuaccccacccuccucccaguccugggcacuagggcugcuccccagguguucuguacccccuccccacucugucccaugcccuggccucugcccucuuucaaaacauagauguggcuggcgccuaggcucaugccuauaaucucagcacuuugggaagcugaggcuggaggacagcuugagcccaggaauucaagaccagccugggcaacauagugagacccugucucuaccaauuauuuuauuuuauuuuauuuuguucauuuauuuauuuauuuugagacagaguuuugcucugucaccuaggcuggagugcaguggcgugaucuuggcucacugcaaccuccgccucccggguucaagcgauucuccugccucagccuccuaaguagcuggaacuacaggcgagugccaccacgccuggcuaauuuuuguauuuuuaguagagaccagguuucaccauguugaccaggauggucucugucuccugaccucaugauccacccaccuuagccuuccaaaaugcugggauuacaggcaugagccaccacucccaguccuauaaaauuuuaaaaaaaugucugggugugguggcgcaugcuuguagucccaacuauuggggaggcugaggcaagaggauugguugagaccaggaguuugaggcugcagugagcuaugauggugccaccgcacuccaaccuggguaacaaagugagacccugugucuaaaaaagaauuuaaaggccgggugugguggcucacacccguaaucccaggacuuugggaggccgaggugggcagaucacgaggucagauuaagaccauccuggcuaacaaggugaaaccacgucucuacugaaaaaaaaaaauacaaaaaauuagccaggcaugguggugggcaccuguagucccagcuacucaggaggcugaggcaggagaauggcgugaaucugggagguggagcuugcagugagccaagauccugccacugcacuccagccugggugacaaagagagacuccaucucaaaaaaaaaaaaaaaaaaaaagaauuaaaaaagauuuuuuuaaugaacaaaacaggcucggcacaguggcucaugccuguaaucccaagcacuucgggaugccaaggucaggggaucaccugagaucaggaguucgagaccagccugaccaacauggugaaaccccgucucuacuaaaaauauaaaacucagccaggugugguggcacacgccugaaauuccagcuacucgggaggcugaggcaggaaaauuggcuugaagccgggagguggagguugcagugagccgagaucacgccacugcacuccagccuaggcaacagagugagacucuaucucaaagaaaacgaacaaaacauagaugccuacauaccauuccucugcccuuggcuccuggggaguaagggaucacccagugaccuccuagaaggccagugacaauggggggugucagggugcuuuucagagccaagggagugguaggaauugggaucuuaguccagcuccaagcugugagggagagaguugcagggcacuuaagcuugguggagacccucaaggccucuuugccugucccugcagcaaagguucuggacaccagagccaaguccagaagcccugguggaacaggggugaaaagcauagguucugacuucagacugcugggccgcagcccuggcuaucccaccccaggugagagcaggcugcucugugccucaguuuccccaucuucauaguggaauuguauuggugccuacccagaggguugugucaacaauuaggauggcaccuagcaccuuggucaguggugggaaagguuccagaaguucugcuguggucccaggggugucucaggcccugccaucaucuccuuggaggggugccauguggugggaaagaaccccaacuucaaggccacacacaguggcucaugccuguaauccuagcacuuucagaggccaagaugggaggaucaccugaggucaggaguucaagaccagccuggccaacauggugaaaccccaucucuacuaaugauacaaaaauuagcugggugugguggcacgugccuguaaucccagcuacuugggagucugaggcaggagaaucucuugaaccugggaggcagaguuugcagugagcugagauggcaccacuguacuccagccuggccgacaaagugagacucugucucaaaaaaaaaaaaaaagaacccaaacuuuugguguucagccauguucccaugcucacucccaggguggugacucugggaaggucucagccuccuugucugcccaguuagaaugaucugaugccccugcuaccaucagacuugauaaguuucccaaagacucuuugcaagaagcacuguucuggaggguggaggagagacuaauuguucuugcucuccuggccagagugggaagcuuugggguggccgguuugugggugcaguggaccccaucauggagaaguucaacgcguccauugccuacgaccggcaccuuugggagguggauguucaaggcagcaaagccuacagcaggggccuggagaaggcagggcuccucaccaaggccgagauggaccagauacuccauggccuagacaagguacuugccguggcccaagccccacccaaggccccuucccuguggccccaggcucccaccaaaucccugagcaaacagugcaguguugcccaucugugguuucacauugaacuaauuauauacucaagugcuguuuaacugugugccuugaugacugccucucuccauccuuuaaugaccccuguggcccacauggcucauggguaaaggugugcugggccugagaugcccccucccagggugcgcuuccaggacucagcuccugggcagggacagucagucaccagggauagggugggaccaaggcaggggcucucuuggcugcugaugccugcucaccugaccccggcauugcugcuacccacuacagguggcugaggagugggcccagggcaccuucaaacugaacuccaaugaugaggacauccacacagccaaugagcgccgccugaagguacgaccccuggagccccaccgcuuuccuugccuccccucuccaccuugcccagggccacuuugagcauuagcaccauucuguuuacuucgccauuggcagacagcaugugagaccucaggacaugagccaggcacccuggcucaugccuauaauccuagcacuuugggaggcugaggugggaggauugcuugagaccaggaguucgagaccagccugggcaacauaaugaggucccacagcuacaaaaauuaaaaaaagaaaagaaaaaaagaacaggccucagcagaaauggcgagagauuuggggaggacccggagcccugggguauggagguagguuggcagggcugaugaggaaaacugcccugccuggguugacuccucuggggguauagaccgugacccugggucucccuucaccuccaggagcucauuggugcaacggcagggaagcugcacacgggacggagccggaaugaccaggugcuuuagccccuccacccccugcuccguguugucccaaccuugaggagcccagggggcaguuagaguucugcagcgguccuggcuccucagggaagcaacacaucggccucccugagcaccaucuccuccuugcacagguggucacagaccucaggcuguggaugcggcagaccugcuccacgcucucgggccuccucugggagcucauuaggaccaugguggaucgggcagaggcgugaguccuacagggacacccagggggcagacagaggugugauggaagccugaacaggagaccuagggggcaggggugaacagcgugggggugccaggcccugggggacaggggcaucccagaacuccaggaucgaggcagagcagccaggagugggccauuuccugcaggccccaauacucccaugccagucuagcucagcaggcagagaagacuaacccuucguggggcugggugcgguggcucacgccuguaaucucagcacuuugggaggccgagguggguggaucaccugaggucaggaguucgagaccagccuggccaacaugggaaaacucugucucuacuaaaaauacaaaaauuaggcaaugugguggugugcgccuguaaucccagcuacucgggagccugaggcagaagaacugcuugaacccgggaggaggagguugcaaugagccgagaucgcgccauugcacuccagccugggcuacagagcgagacuccugucucaaaaaaaaagaaaaaaaaaaaagaaaacucaccauuugcagauuugaaggcaggaagcuaagccaagcacagcuagcuuggcugugccuggagcagccagagucacuccccacacugccugucccccagaucccccauccuaagcuucgccuccccauccagcccaucuggcaaaagacagagccaaaggcugccuccugcuggccucauuucaggcuuuggcuucugggaccuggugucuuugggacuggauuuguuccuugcagaccuggacgaagagcugcugagaagucuccauguguugucagagaccccuccucuuccucaacucccugugaccccuguugugcagacuugggggaaaacaagggcacaagaauugucacccagcaggugguguggggcugcuaggaggaacagggagugucugcuacugaguucaggguuucuuuaauuuuuuguuguuguuguuuguuguuguuuuuuuuuuuuugagacaggguuuugcucugucaccuagucuggaguguaguggcgcuaucugagcuaacugcaaacucugccuccuggguucaagugauucuagugccucagccucccaaguagcugagauuacaggugugcaccaccauguccagcuaauuuuuguauuuuuuucaguagagauggguuuugccauguugaccaggcuggucuugaacuccugagcucaggugaucugcccgcgucggccugccaaagugcuaggauuacacccauaagccacugcgcucagcuuaauuuuuaaauuuuuaacuuuuuaaauugucuuuagagaugagauccugcucugucaccuaggcuggagugcaauggcuugguaauagcucacugcagucucaaacuccuggacucaaaugauccucccaccucagcuuucugaguagcuaggaccacaggugugcaccaccugugagacagagucuugcucuguugcccaggcuggagugcaguggcgugaucuccacucacugcaaccucugccucccagguucacgccauucuccugccucagccucccgaguagcugggaguacaggugcccaccaccacgcccggcuaauuuuuuguauuuuuaguagagacgggguuucaccauguuagccaggauggucucaaucucccgaccucaugauccacccaccucggacucucaaagugcugggauuacaggugugagccaccgugcccagccgcgaauucuuuaaauuuuuuguagaaacagggucucacuauguggcucaggcuggucucaaacucccggccuuaagugauccuucccucuuggccucccaaagugcugggauuaaagacuugagccaccgugccuggccuugaguacagaauuucuucauggggugaugaaaauguucuaaaauugguuguggugaugguuguacaguaaaguguaaacuuuaaaugaguaaauugugaaugauaucucaguaaagcugguuuauuuaaaacaacaggccaggugcuguggcucacgccuguaaucccagcacuuuggaaggcugaggcgggugaaucaccugaggucaagaguucgagaccagccuggccaacauggugaaaccccaucucuacuaaaaauacacaaaauuagcugggugugauggugggcaccuguagucccagcuacuugggaggcaggagaaucucuuggaccugggagguggagguuguagugagccgagaucacgccacugcauuccagccugggcaacaagagcgaaacucuuucucaaaaacaacaacaacaaaaaaacaggccagguaugguggcucauaucuguaaucccagcccuuugggaggccaaggcaggaggacugccugaaaccaggaguuucagaccacucugggcaacauagcaagaccccaucuuuuuuuuuuuuuuugagacggagucucgcucugucgcccaggcugaagugcaauggugcaaucucaacucacugcaagcucugccuccuggguucaugccauucuccugccucagcccuccugaguagcuggaacuacaggcgcccaccacuacgcccggcuaauuuuuuguauuuuuaguauagaugggguuucaccguguuagccaggauggucucgaucuccugaccuugugaucugcccgccucggccucccaaagugcugggauuacaggcgugaguuaccgcgccuggccacaagaccccaucuuuacaaaaaacuaaaaauuagcugggcaugguggcaugucccuuuagucccagcuacucaggaggcugagacaggaggaucgcuugagcccaggagaucgaggcagcagugagcuaugaucaugccacugcacuccagucugggcaacagaacgagaccuugucucuaaaaauaaaaacaaaacaaaacaacaagaaaacaggaccaucacucacagcaccucugccucugcccugccuacuugaaugaggugcagggcaucucaccugcucagagcagcccuugaaugagccccagcuauuucuaggguccucaaacgaaaccucccacggccaagucauacccaacaugggccuccuccccuauucuggccccugcucggagaugcugagugacagaggcuggacuugggguguuucuggcaaagccucacugcaggaagccccacagcucaggcccaguccuugguucacacggucccacuuccagcuucuuuugcccuuaagacugauuugucccugggagaucaccagaucccucauucagguggagugcugcagcgugacacuuuuuccaggggugacccaggccugcaggguuccagugucacaggcaggccuugcaugagccuccacccgagcuucugcuccuccucucccacagggaacgugauguucucuucccgggguacacccauuugcagagggcccagcccauccgcuggagccacuggauucugaggugagccaggugaggugcaggggcugugcuagaggggaggaccccggcugcccugacccuccugccccuggcuucccacagccacgccguggcacugacccgagacucugagcggcugcuggaggugcggaagcggaucaauguccugccccuggggaggugggugaggcuccagugccccgagggccugguggggguggcugcugcauagccuuagggauugacagagcugggaagugcagagugggacagaaaaccgccuuaucugcucagcgggggacucugcauggagccccagcucucgcuaaggugacgaccaagccauugaaugugucugagcagggccagagcccuccagcaaggcuccuggcaagcccagccugcugcccucagccugacaugugggaacaugugucaggagacaaguguccugcacccagggugacuuagugcuuggggacaaguguuuuguggacacuuggggacaaguauucuguacccaaggagacugggccagggaagaggcuaagcgccaggugguugcccuggcaaccaggacuugguucucugugugugcguucgugugugugugugugugugugugugugugugugugugugucagggcugccugccaggagcccuggucaccaugaaucccugucccugcaguggggccauugcaggcaauccccuggguguggaccgagagcugcuccgagcaggugagacguccugccccuccuccccagggagaaucacccucagcacccgccaagaccugcagacacaccugaaaccagagggcaggggccuguggcuccuggugaaaccuucauucauugccuaugggcacugaggucaucaaguucaggggucacucauggcagggaugccugguacugagagacucagggcuccugccucccuccugggacugugcaaaagaucccuccccccagcuguugccccacccugaucaggggagggggcugggcaaccuaguugggggagagggggccacucccuguccuccagcuuagcccugcuuccucccacccccccagaacucaacuuuggggccaucacucucaacagcauggaugccacuagugagcgggacuuugugggugaguccuggggagccaguccccugcccugugccucacuuuaguccuucagcccagcuucucuccaguuuccucccacaccuccacggacaggcugguuguggugauauuguacacugaaguauaaaccuuaaauggguaaaguggguggggcauggugguucaccaugcccagcacuggccaacauggugaaaccccaucucuacuaagaauacaaaauuuagcugggugugugguggcaggugccuguaaucccagcuacucaggaguucugaggccagagaaucacuugaacccaggaggcggaggcugcagugagccaagaucacgccagugcacuccagccugggcaacaagagcgaaacuccaucucaaaaaauaaaauaaaauaaaauaaaaauaaauaggccaggcaugguggcucacgcccguaauccuagcacuuugggaguccgaggcagguggaucacaugaggucaggaguuuaagaccagccuggccaacauggugaaaccccaucucuacuaaaagcacaaaaauuagcugggcaugguggugcaugccuguaaucccagcuacucgggaggcuaaggaaggagauucgcuggaaccugggagguagagguugcagugagccaagauugugccacuguacuccagccugugcauugggagcgagacuccaucucaauaaauaaauaaauaaauaaauggauaaauuguaugugagugauaacucaguaaagcugguuuauuuaaaacaacaacaauaacaaaaaacacgcuaggugcaauggcuuacguuuguaauccuagcacuuugggaggccaaagcagaaggauugcuugagcccacaaguuucagaacagcuugggcgacauagcacgaccccaucuuugcgaaaaaugaaaauuuagccggguccccccaccgccuaaccuccuccugcccccuguauggucaggcuggguggggaugggagaggccuggugacugggaaccuuuucucccagccgaguuccuguucugggcuucgcugugcaugacccaucucagcaggauggccgaggaccucauccucuacugcaccaaggaauucagcuucgugcagcucucagaugccuacagguaagcccugaacugccaccuccaucugccgcugccggccucuguaucccccgccgcccgcggacguggcugccuuccuccccgucccaccccuccgccagaccuggccauugcggcgcuggaccagccaaggguccagccccuucagcgccagcaccucuguccccagcacgggaagcagccugaugccccagaagaaaaaccccgacaguuuggagcugauccggagcaaggcugggcguguguuugggcgggugagcaaggcagggggaggggcggggccucugggcugaugguggguggccaggggggcaggaucccggguccagccccugugccucccucuucccgcagugugccgggcuccugaugacccucaagggacuucccagcaccuacaacaaagacuuacaggugcgaggccgggggaggccuggcuaguacgugccaguucucagggcucuggcacacucaggcagggccccaccccgggauugccauacauccucccauccugugcacacagcuccauccguggcugcccuugaacucucugcccuuccuuuguugggguauugaguguucuucccauggaaggcaguggggaugccucaguggggggguggggcuguggggacccugggugccagggggcugcuaggcccucaccuccugccaugugccucccaggaggacaaggaagcuguguuugaagugucagacacuaugagugccgugcuccagguggccacuggcgucaucucuacgcugcaggcaagacaucaccccccugcuucuccuccccuaggucccaggcacuggggugggcaugcggggaggguggccuugggaggaggugagguggggcuggaggaccuggggcagggaaggagaggugugcucgcuccugcuccuggggaacagggaaaggacagaaacugcugccaugcaguggaaguagaugagacucagggggccuggggccugucaaauggccugaccagaacucuuuaaaaaaagaaaaucuaaacaaaaggccaggugcaguggcucaugccuggaaucucacacuuugggaggccgaggcagauggagcacuugaggucagggguuugagaccagccuggccaacauggcguaaccacgucucuacuaaaaauacaaaaauuagccaggcgugauggcccacaccuguaaucccagcuacucaggaggcggaggcagaagaauagcuugaacccaggagauggaaguuguagugagccaagaucaugccgcugcacuccagccuggaccacagaguaaaacuccaucuacaaauauauaaauuaaauuaaauuaaauuaaauaucuuuaaaaaacauuuuuuagagacagggucacucucugucgcccaggcuggagugcaguggugcggucguagcucacugcagccucaaacucuugggcucaagugaucuucccaccucagucuccagaguagcugggacuacaaacaugcgccaccacgccuggcuaauuuuuuuauuuuuuguagagacagggucucccuauguuucccaggcuggucucaaauuccuggccccaagccauccucccaccuuggucucccaaggugcugggauuauaggcaugagccacuuugccuggcugauuucuuuuaaaaucaauuauuaugggaaauuuauguauauaacagcuagagaaugcauaaugaacccuauguaccgacacccagcuucaaugauaaucaacucacggacauccuggcuccagcugucuuuacccacagcucucucccacucccuuacccccuuauuuugaagcaaauucccaucaucacaucauuucauuccuaaauaguucaggauaugucuugaaaucaguguuucuuggcugggugcagagccucaugccuguaaucccaucaauuugcgagacuaaggugggcagaucacucgaggucaggaguucgagaccagccuggccaacauggcgaaaccccgucuuuacuaaaaauauaaaaauuagcuggguguggugguacacgccuguaaucccagcuacucaggaggcugaggcaggagaauugcuugaacccgggagauggagacugcagugagcagagaucacgccacugcgcuccagccugugugacagugcaagacuccaucucaaaaaaaaaaaaaaaaaaaaaaggcaguguuucuggaggcuagucccccaacuagcagcaccagcaucaccucagaaguccugagaaaugugaugugaggccccacuccagauggcugaaucagagacucugggggugcuccccagcaauuuguauuuuucuuaguaaauucuccaguggcuaggccugguggcucaugcuuguaaucccagcacuuugagaagcugaggcaggagaagcgcuugagcccaggaguucaaaaccagccugagcaacauagcgagaccuugucuguaaaauuaaaaaaauuaaauuagccagucgugauggcguguaccuguggucccagccacuuaggagacugaugugggaggaucccuugagcccaggagcucaaggaugcagagagccaggauugugccauugcacuccaacaugggcgacccugucucaaaaaagcccaaaacaacaacaacaaauuagcuaggcacgguggugugcauggcuguagucccagcuacuugggaggcugaggcuggaagaucccuugaguccaggcugcagagggcuauaauggccacugcacuccagccuggacaacagagcaagacccugucuccuaaaacagaaaacaaauccuccaggaacaucugaugcaugcugaagauaaggacucuuugaaaacauaaaggccaguaaaacauacaggccaguaaguguucauagcacauguaaauauuaucgauaauuaugagaagaugguucaaguugagagugagacagagccgaguggguaagagaguaucugcccaaggcagggauguccuggcagaggggcagguccugggccuggcagcuucagaucccaggguccccagggcucaccacucgcccaccugugcccccagauucaccaagagaacaugggacaggcucucagccccgacaugcuggccacugaccuugccuauuaccugguccgcaaagggguaaguguguagcagccagggggagggugaggagauggggugccccccccagagggugggggagcucaggaaugggugcaagcggcccagccugguggcucaccccuguaaucccagcacuuugggaagccgaggugggcgggucacuugaggccaggaguucgagaccagccuggucaacauggugaaaccccgucucuuuugauguaaaaauacaacaauuagcugggugugguggcacacuccuguaaucccaguuacucgggaggcugaggcaggagaauugauugaacugggagguggaguuugcggugaggugagaucgcgccacugcacuccagccugggcaacagagcgagacuuugugucaaaaagaaaaaaaaaaaaaaaaggaagggggugcaggcaauggaggcagaucagggcauggagaaaccugccucagcgccaucuuccucccuggcacccagaugccauuccgccaggcccacgaggccuccgggaaagcuguguucauggccgagaccaagggggucgcccucaaccagcugucacugcaggagcugcagaccaucagguacggcccauccccuuccccaugcugccuccuaggaagugagccugggugccuggagcccaggguggccuggcgcccuggcccaccucuuccucucuccccagcccccuguucucgggcgacgugaucugcgugugggacuacgggcacaguguggagcaguauggugcccugggcggcacugcgcgcuccagcgucgacuggcagauccgccaggugcgggcgcuacugcaggcacagcaggccuagguccucccacaccugcccccuaauaaagugggcgcgagaggaggcugcuguguguuuccugccccagccuggcucccucguugcugggcuuucggggcuggccaguggggacagucagggacuggagaggcagggcaggguggccuguaaucccagcacuuuggaagggcaaggugcgaggaugcuugaggccaggaguuugacacagccugggcaacacagggagacccccaucucuacucaauaauaaaacaaauagccuggcgugguggcccaugcauauagucccagcuacuuguaaggcugaggugagaggacacuugugcccaggaguggaggcugcagugagcuaugaucacgccacugcauuccagccuggauaacagagugagaaccuaucucuaaaaauaaauaaauaaacgaaaaauaa

SEQ ID NO: 191540 - RNA, 37336 nt, Homo sapiens
uuuuuuuucacccggaaaccgcgguugccggagcccgaacugaggcggcggcgggagcccgguuggcgucuggucuucgcgucggccccgcggagccagacgcugcccccggcgcggggagaagauggugccuagcggccucgggcccgccacgcgccgccacgagugagcccagcgcgaccgcgggcguccgccgagcagcuggcccggcugggcccggggcgcgcagcugcccgccggggcggggugagccggggcuggagggcgggcuggggucgggcccagucggggcugcccgcggggccgggagcggggagcgugcuggucgggagcggcuccuccgccggcuuuuuucaccgcuucucagggugcagaccccgccccaacugcuggcgggggucgcccagcaucggccgaccucggccugguccccccacacugggguuugcccacucgcgucccccgagccaggguucccugccggccuuggagauggcgggacuucccacgucuggagccgaggccuggauaauucggauuuggcacgggaaacaucuuggucguuugccauuuuucggcuuuggggaguguuugcguuucuucuccguuuggcagugaaacacaucucagaaaggugggagggagagacucacguacguccacaaaguuaaauggcauagugguguucccugugucaagcuugguaaauauccggaaugggguggauucuuucuucauguuuuuaauaaaaugaggagugaucgcaagguaaucuagaggcauguaguuucaguucccuugauggggaccaucagaaauaaaaccaggcuuguugugcuguuuugagucguuugaacgccguacccaucggacagcuggugaggaggccuuuguggaagaaucugaugucugaguuuaguucucaacuagcaggugacagcccucacuggcugaugaauggugagcuucucugaagccugcuuuguaaagauuguggcuuccgccugaacugcuucuuuccugccucaaaggugagccgcuacgggagggaaugggaagaaaaacuccgagacugcugaugaauaugugauaaagugguuugucucgauagcaccaucagcuugggucagcuuagggucucagcauguguaucucauuuguagaugaguguuccaucagcgcuugaccgauaaggguguccaucuacuuccucuuuucaucuagggauucugacaggaaauagaccugucgcgcaccuaagguauacuuaggugugcauugacccuaagugcauuuacucucuaggauuaaggauuuggaguuucaacuuguagugaagauucugggagaauuccuguggccugaaucagguggacuggaaucacugcuagcaccggagucucaaugcuaaaaucaccaaaggcuaguuaacuggcaccuucuccguuuaggcucuagcugcaucuguggcaaggaggaaagguagauuauauauauauauguuuuugagacagagucucacucuugucgcccaggcuggagugcaguggugcgaucucugcucacugcaaccucugccucccagguccaagcaauccuccugccucagccucccuaguagcugggauuacaggugcccgccaccaugcccagcuaauuuuuguauuuuuaguagagacaagguuucaccauguuggccaggcuggucuugaacuccugaccucaggugauccauccuccucggccucccaaaguucuggaauuauaggcgugaaccacccgcaccuggcauaagugcgaauauauuaauaguuucugccuguaaggaauguacuuagaggaagcaauaggcuagaaaauguggcaggacugaauugccauagugguauaccaacuguucaggauuuuguuaugguuaggaucagaaacuaacuuuuuuuuuuuucuugaggcggagucuugcucuguugccuaggcuggagugcaguggcgcgaaguuagcucacugcaaccucugccucucagguucaagcgauuuuucugccucagcugccugaguagcugggauuacaguugccugccaccacgccuggcuaauuuuuguauuuuugguagagacgagguuucauguuguuggccaggccuugaacuccugaccucaggugaucugcccaccuuggccucccaaagugcuggaaguauaggugugagccaccuugcucagcccgaaacucgugaaguaaacuuugagguggaccuagaaagaucaagaggauuugggccauucagaauuagcugggaaaugaaaaaacuagggccaguugguggacaagcacccaggcuagguagcuggacaaucagugccuagaaauauuggcagaggcagcuaguuaaggguuaaaugcuuuucuaagaaagauaagcauaagcuacccagucuaguuucucguagauuucuggguuuuuuuguuuuuguuuucuuugagauggagucuugcucuguugcccagguuggagugcagugacgcagucggcaaccucugccuucuggguucaagcgauuccucagccuccugaguagcugggacuacaggugcaugccgccacacccagcuaauuuguguauuuuuaauggagacaggguuucaccauguuggccaggcuggucucaaacccuugacgucaagugauccgccugccucagccucccaaugugcugggauuacaggcgugagccaccaggccuggccuuugguuucuaaagaauuguuuucauuuaaugaguuugucuuguucuguaagaggccguuggcauaaaacaaugcuuaacuuauuuuauuaaggacaaugaaaaagaugcugauugucauuccugucugguauugacaaucaggaaauuaaauuugaugucugugaguuguuucagugccuguguucaguuugcaggagcacagcucuagucuggucucugcagcucuggcuacagccaaaggauaaauggcaagcccuucaguccucuccagaggguuuuuagugaaaucugguccaugucacagagaugguguguuucccuugcccaguacugaagaaccuuugaagccauucacacaggaugccauguaauugcucuagaugauaugacugaucucaggaccucacuggccucagccuuagcccuuauuuuauuuuauuuuauauauauuuuuugagacagagucuugcucugucguccaggcuagaguacaguggcgcgaucucagcucacugcaaccuccgccuuccggguucaagcgauucuccugccucagccucuugaguagcugggauuacagaugcccgccaccaugccuggcuaauuuuucuauuuuuaguagagacaggguuucaucauguuggucaggcuggucucaaacuccugaccucaggugguccgcccacugcggccucccaaagugcugggauuacaggcaugagccaccacaccuggccuuauuuuuauuuauuuauuuauuugagauggagucucaccuuguugucugggcuggaguguaguggcaugaccucggucacugcaaccuucgccgcccaguuucaaacgauucuucuggcucagccucccguguagcugggacuacaggcacgcaccaccacgccuggcuaauuuuuuuguauuuuaguagagaugggguuucgccauguuggucaggcugguuuugaacuccugaccucgugauccgcccgccuuggccucucaaagugcugggauuacaggcgugagccaccagccccggcccuauuuuuuaauuaaaaaaaauaauuauuacgggacagaguuuugcucuguuguccuggcuggagugcugugggugaucauggcucacugcacccuccuccuccugggcucaagucauacuccugccucagucuccugaguggcugggagcacagauguacaccaccacaccuggcuaauuuuuugauuuuuuguagaggcaaggucucacucuguugcucaggcuggucucaaacuccugggcacaagugauccucccaucuuggccucccaaaaugcuagcauuaaaggugugagccacccaaaaauaacuguauuaacuauauuuaccacacugugcaauauaacucaaaaaagaaaaaauauauuccuuuucucuaacggacuuuguacccuuugaccaucaucucccuguuccccacccccugcuucuguaaccauaguucugcucucugcugcaaugaguuccauugucuucuagauuccacauauaaguggaauccuauauugugcuucuaugccuggcuuauuucucuuaguauaacguucaucgcuucuguccauguuguggcaaauagugcugcagugaacagacaucucuuugacaaucugauuucaauuugggguaguauauauucagcagugggauugcuggaucaugaaauaauucuauuuguaguuuuuucuuuuuuuuuuuuuuggagacagagucucgcucuguugccuggauucaagcgauucuccugccucagccucccgaguagcugagauuacaggugcacgccaccacgccacgcuaauuuuuuguauuuuuaguagagacaggguuucaccauguuggucaggcuggucuugaacuccugaccucauaauccacccgccucagccucccaaagugcugggauuacagacgugagccaccacgcccggccuauuuuuaguuuuuaaaggaauuucugugcuguuuuccaucuuggcuguacuaauuuacauucccacagugcaugacggcucccuuagcuccacauucucaccagcauuuguuuuucuuugauaaaagucauccugacaggcgcgagaugauaucucauugugauuuuaauuugcacuucucuagugauugugauauguuggccaacuauaucuguuggccauuugucggucucuugagaaacaucuguucgugucccuugcccauuuuuuaaucccuagggauuuggagaagcuacuugcaaaccauacgucugaaaagggguuaauauccaaaauauauacaaagcucaaacaacucaguagcaagaaaacaaaaaauccaauugaaaaaugggcagccaggcaccguggcuuacgccuguaaugccagcacuuugggaggccaaggcugguggauugcuugaggucaggaguucgagacuaaccuggccaacauggugaaacccugucucuacuaaaaguacaagaauuagcugggcgugguggcacaugguuguaagcaugcuuacaagcuacuucagcuacucaggaggcugaagcaggagaaucacuugaaccugggauguggagguuguggugagccggguucgcaccacugcaguccagccugggugacagagcaagacuccaucugaaacaaaaaaaaaaaaaaagaaaagaaagaaaaauggacaaagaaccuuggccuuucuuuaaaaugaaaaaacagaaaggaggaaagauagagguuuuagcaaauugaauuuucauuuagauugauuucgaacauggaaauccuuaaguuaacuuucucauguacgaaucaaauacauuugacaagaggucuguaguguuuuuucugcgugugauuacauaccugagugugauccuggggaguacaugacacagccuucgaaacacugccguuuggacuuuuguguuguuugguuacaagugcuguuuuucaaacaugucccagucuuacacacugaguuugguuacagaaagguuucauacugaacuauuagcuuuuguuugaucuuggcaucccucaugacuuguuuucuuaaaaauuaagccccagauuauuaaauuuuaauaugggaguacuuuuaauuuugguguuuaagaugguuggcaauuauuuaaaaaacuaaagaacaaagauaaauuauuuuccaucuugagacuguagugaauuuuuuuaagaagcggggggguugaacguuaccaugguuuuauaucaugauuuugaaaauggaacgaugcauucauuaacaaccguaagugaggagaaauaaacgggaagucugaguuuuagaaguaagucugguuccagacauguaauuaugucagccuacauuccuuuccuuuugucuuuaugagacuacugauguugccuaaacuacacguuuagcaacuaaaacuaugcuuucucuuguaauuucuuauuugaucuuuuuuuuuuuuuugagacaagguuucucccugucaccgaggcuggagugcaguggugugaccauagccguggcucacaguagccuugaacucuuggacucaacugauccuccugccuugcccucccaauuagcugggacuauaggugaaaccaugcccagcuaauuuuuuuuaauuuggguuuuguuuuuuuuuuuuuuuagggacggggucucacuguguuguccaggcuggucucgaacuccugugcucaagugauccucugaccuuggccucccaaaguguugggauuacaggcaugaaacaccaugcccagucucucuuugguuccuuuuaaacgugaguuauugugaaagucuguucuacacugugaauuguaucacauuaagaaacaagacacuauuggcagaagacugugccagucuuugcuucauacucuuaacugaugaaugagugcugagaugggaggaauccugcuaaagaaauggaaaauaggcugagcacgguagcucacaccuguaaucccagcacuuugggaagccaaggcagguggaucaccugaggucaggaauucaagaccagccugaccagcuuggugaaacccugucucuacuaaaaauacaaaaauuagcuaggccugcuggugggcgccuguaaucccauuuagucaggagucugaagcaggagaaucacucgaacccaggaagcagagguugcagugagcugagauugugccauugcacuccagccugggugaugagagugaaacucagucuugaaaaaaaaagaaacuaaguuaaacauuuuaaacuucaaaaaaguugaucucuuacuugugucuuuguuaaaaucagugacuaaaaugcacuuuguauaucuauggcaugugaguuguuuuuuuuuuucacuuuggcauuugacuugaaacugucuuaucaaccuuggcauugugauugauagcauggcuuuuggggucagaugaauuaagucagaauccauuucugccauuuauuugcagcaugaccuaguacaaauuacuuaagcucauuugcuucaguuuucucaucuguaaagugggaauaguaguaucuaucuagcaguguugcaaggauuaaaaaauauguuaagcgcuuggcacggugccugggaauggcauguucuaagugguagcuguuaagaaugcucucuucucacuccuucguccuugucaccugguuuuugccucuaucacccuagugaaagggguuuugcuuacaucacuauugaugucucgauugcaaaauuauauggaugcuuuucugccuuuucucauuugaugggauugacucuuaaaaaaauuuuuuuuuuccuuuuuauuuucauuuuuugagauaggguuuaacucugucucccaggcuagagugcaguggugccaucacagcucacuguagccucaaacuccuggguuccggugaucccuccaccucagccucccaaguagcugggacuacaggugugcaccaccacacccagcuaaauuuuguauucuuuguagacacagggucuucuuguguuuuccaggcuggucucgaauuccugggcucaagugaucggcuggccucagccucccagagugcuagaauuaugggcaggagccauugugcccugccagauugacuucuuuaugcaaaccuauaucauuuauuggaccgaaguagaacuuaaugguuaaugcaugggcucuggaggccaacuggauuugaauccagguucacuucccgugugaucaugggcacauuagcugacuucuauaugccuuaauuuccguaucuguaaaauagagauguuuuagggaucauacacaauaggugcaaaacucuuagagcagugccucucucaaaaaguaggcaaugacgguagacguuauuauuguuaagcaccuuccuggugucaggcacuguccaagguaggaggaaugcagaaacaauaucauggaaaugagagacaaauuuuuuuuuuuuuuuuuuuuuuuuuuuugauacagacucuugcucucgugcccaggcuggaguucaguggcuugauuuuggcucacugcaaccuccgccucccggguucaagcgauucuccugucucagcuuccugaguagcuggcauuauaggcgugcaccgccaugcccagcuaauuuuuguauuuuuauuagagaugggguuucauguuggccaggaugcucucaaacuccuggccucaggugauccaccugccucggccucccaaaaugcuggcauuacaucugugagcacccggcucagacaacaauuuaauuuggcugagggugcagggaggcagugucaguggggauggagugagagcugcccuugagagacacuuaaaauguggaaacgauaggacuugguaacugguuguaggagagccagagugucaaggaugacuggcaggagcugggcgcaguggcucacgucuguaaucccagcauuugggaggcugacgcgggaggaucgcuugagcccaggaguuugagaccagccugggcaacauggcaaaaucccaucucuacaaaaaauacaaaaauuagccaggagugguagcaugcacuuguagucccagcuacuugggaggccaaggugggaggaucgcuugcgcccaggaagucaaggcggcugccaugcucauaccacugcacucuagccugggcaccagagccagacccugucucaaaaaaaagaaugacuggcagggaucacuagguaaaugacgguguuuuuccuuagggaaggagccaguuuggugccuugggauaaguuuuggccuugauggccuuugggucaucuaaggagauagcuccaguaggugacuguuuggaucuggaggugaguagguacauaaaaugggauuaaggcaugaaugagcgugucccccuugagcagaggccccagcuggaacuugggaacaccagcuuuugaaggauccugagaaggaagggguggccagaugaauguuaagaaaacccggaguggaaacugggagaggauccaccccacuucuguaucagaugcugcagcaacaugaguuagggacuggagcuccagcuuuggacuuagcagcccagagauuacuggagaccuugaaguucuccugugucuucguugcuucucacuugucucucugaagguucauucugccugcacugcuuugcgguggggcaggaagaugguuucugcgcagugcuuggggcagcugggugcuggagcuugcacaggguuucuuugauaccaguaagugucuucagcucuaaguguuggauaaucuggcaucgcaucgaugacuguuguuuacuaggcucaggguuuguaaccccggccuuaaagcucuuugagggucucagacaucacaggauauuugagaaaugcuacuuucugcuacaugaaggugaguuucugucauucugucuuagcacaaguccgauguauuuccuuugguuggcguagagagcaggcuugcuucucccauccucucuuccucaacuuucagaaacuucccauuuaaccuaagguagaaaaucucauuuaagaugaauggugggccugguguggugguuugugccuggaaucccagcacuuugggaggcugaggcagguggaucacuugaagucaggaguuugagaccagccuggccaacauggugaaaccccaucucuacuaaaaauaucaaaauuagccggacguggugaugugcaccuguagucucagcuauuugggaggcugagguaggagaaucgcuugaaccugggaggcagagguugagcagagaucacacugcugcaugccagccugggugacagugcgagacaauaucucaaaaaaaaaaaaaaaaaaaaaaaagaacaguuuaaaacuacaauaaaguuaguuuaaaacuuggacaaguagccauguguacauaugcgggcuuuggagagagggagaaacugaaaggcuuccugugucuguggcauaaugaauguuaacuuacuuuuuuucugauaaaauguuauuaaguugcaaaauuacauuuuuuuuuuccaccauguuggccaggcuggagugcaguggcaugaucauagcucacuauagcuuugaccuccugggcugagccaguccucccaccucagacucccaaguagcugggccauugguguacaccaccaugcuuagcuaauuuauuaaaaaauuguuuuuuguagagacggggucuuguuguguuggccaggcugguuucuaacuccuggccucaagcaauccuuccaucucagccucccaaagugcugggauuacaggugugaguuauugugcccaaccaggaggccuuccuccuuuuuuuuuuuuuuuuuuuuuuuuuuuuuugaggcagagucucgcucugucacccaggcuggagugcaguggugcuaucucggcucacugcaagcuccgucuccuggauucaugccauucuccugccucagccucucaaguagcugggacuacaggcgcccgccaccacaccuggcuaauuuuuuguacuuuuaguagagacgggguuucaccauguuagucaggauagucucgaucuccugaccucaugauccacccaccuuggccucccaaagugcugggauuacaggcgugagccacugcacccauccggccuuccuccuuuacuagcugcuuuccuccccuuauauuagguugguacaaaaguaaucgugguuuuugccauuauguauuggugaaaaccgcgauuccuuuugcaccaacacaauuaacuguguuuuuguuaacucauguaauaaaaaguaagcaucuccucccacaccucucccuuucaccugaacuaguaguguuuugaaaguuuauaacacagucuuuuccuggccacccuuaaggaacuuguguucuugcaaccuguggguugcuugaaauauuaucaggguaaccuggauauugccuuuugcuuacguaaagcgccuucuguugguuaccuguugccucaguuucuccaucccuguucucaccucgccagauggaggauugugcagagcacaguuuucccugagaacuuuuuuuuuuuuuuuugagauggagucuuagucugacacccaggcuggagugcaguggcgugaucucggcucacugcaaccucugccucccagguucaagcaauucuccugucucagccucccaauagcugggauuacaggcgcacgcugccacucccggcuaauuuguuguauuuuuaguagagaugggguuucaccauguugcccaagcuagucucgaacuccugagcucaggcaguccacccgccucagccucccaaagugcuaggauuacaggcaugagccaccgcgccuggccgauuuuauuuuuuuauggcaacuguaugugauauuuuaagauccuguggguguuuuguuuguuuguuuugagacagagucucacuccaucacccaggcuggaguguaguggcacgaucuuagcucaauucaaccucccagguucaagcaauuugugccucagccuccugaguaggugggacuacaaccacgcgccaccacacccggcuaauuuuuuguguuuuuaguagagacaggguuucaccauguugcccuggcuggucucgaacuccugaccucaggugauccgccugcuucgaccucccaaagugcugggauuacaggcgugagccacugugccuagcucccgcuuuguuuuggugguugugggggauaagaacucacucuguugcucaggcuagagugcaguggcguaaucaaucauagcucacugccgccucaaacucccaggcucaagccauccuccugccucagccccccacguagcugggacuauggacgugugccaccacgcccagaucuuguguuuuugauagguacaauacuggggagaaauccugcuuuauucaguuguccccugcuauuguuggauauguaguuuuccauuuuuuaacaauugcaaacacuccaaaaauaacucugaguaguuaaaucuuuggagcaauggguguuuccuuagguuuaguucuuagaaguagaauguuggagauaaaauaugccagauuuuaacacuauugauauguauagccaaguugguuuccagaaaguuuauaacacagcuguuuccacgccccuuuuuaaggaacuuguguucuuguaacuuguggguugcuagagauaucuuugggauaaucuugguauugccuuuugcuugcuuacagugccgucugauguuuagcgucuucacugaguuagucucagagaucuaagguacugugcugauagauuuucaucacauguucucacgugcuugugaauuugccuuuuggccauguucaguguacccuaaaucccugaacuuuucagagaggcagcuucccagcaguggucauuucuuucuucaucuuggucaauaccaggaugcccuaauuggaguuggaaugaauuuagcgggaggggucaaauagugugcuuucuuuuaucucuuuuucuuuuuuuuuuuccuaaacagaacuuaauuuauucauuaauuaaaacuaacauuugccacugugacgcuuacagaaauuuucucguaacucuuugcagaggggauacauuuauuuagucuucauuaauuuccuauuugaaaacgcuugugaaugguagaaaggaauuuuaaguuuguaaaauguuuggaaucuuaauaguuuuauucaagcuuucuuuuauuauuauuauuauuuuauuauuauuauuauuuugagauggacuuuugcucuuguugcccaggcuggagugcaguggcacaaagucagcucacugcaaccucugccuccuggguucaagugauucuccugccucagacuccugaguagcugggauuacaggcacacgccgccaugcccagcuaauuuuuguauuuuuaguagaaaugggguuucaucaugucagucaggcagaucucgaacgccugaccucaggugauccacccgcuuuggccucccaaagugcugggauuacaggcgugaaccacugcgcccgguccauucuuucgcuuuuuuagugacuauaauuguccugugcuggaaguuucccuaaauuaaauuggcuuauguugacaauauuugccauuuuguggguauuucuguugauauaauuguuuaaauucuggugugaugugcuuuuaaugacuauuaguuuuccuugaagugaauucuaauucagauuuuucuacuguuuuccugaauguuucauaauuguaguuccaagugguaaguggguccuauucauuuuuauauaaggcuaagguuuugggccagguguggugguucacaccuauaaucccaacacugugggaggccagggugggcguaucacucgaggacaggaguucaagaccagucuggucaacauggugaaacccugucucuacuuaaaaaaagacaaaaauuagccaggcauguuggcaugcaccuguaaucucagcuacucagaaggcugaggcaggagaaucacuugaacccaggaggcggagguugcagugagcugagauugugccccugcacuccaaccugggcgacagagugagacucuuguguccaaaaaaacaaaaaaacaaaaauaaguuuuuguucuugcucaauaaauugaacucugauuuacuguugacauuuuuauuuaugaaucauauuaaucuuaaccuaacuaguguuguuuccagauuauuauuguuauuauuauuuuugagauggagucuugcucugucacccaggcuggagugcaguggcgcaaucucagcucacugcaaccuccaccuccuggguuccagcagcucuccugccucagccucccaaguagcugggauuacaggugcuugccaucacaccugucuaacguuuguauuuuuaguagagacaggguuucaccauguuagccaggcuagccucaaacuccugaccucaggugauccacccaccuuggccucccaaaguguugggauuacaggcgugagccacugcgucuggccccauuuacuuuaaaucaucucuagauuacaguaccuaaugcaaugcaaguacuauguaaauaguuuuuauacuuuuuugaaacggagucuuacuuuguugugcaggcuggagugcagaggcacgacguuggcucacuacaaccucugcuucccagguucaagggauucucaugccucagccucaugaguaacugggauuauagaugcacaccaucgugcccagcuaauuuuuauuuuuuuuaguagagauggaguuucaccguguuggccaggcuggucucgaacuccuggcuucaagugauccaccugccuuggccucccaaagugcugggauuacaggcaugagccaccaugccugaccucuugauuucuuuuuuagauugcucucuauuggcacguagaaaugcuacugauuuuuguagguuguuuuuguguccugcaacuuuacugaaaauuggucuaucaguucuaguuuuuugauggaguauuuagauuuauccaaauauaagaucauaccaucugcaaacaaggauaauuuauuuuauuccuuuccaguuuggaugcccuuuauuucuugucugauugcuguaucuaggacuucuaguacucuguugaauuacgguggugaaagugggcauccuuuucauguuccagaucuuagaggaaaugcuuucaguuuuucaccauucagugugauacuaguugugggccuguuguauauggcuuucauugugugagguaugauccuucuaagcccaguuuuuuugaggguuuguaucaugaagagauauuuaauuuuaucaaaugcuuuuucagcaucaguugaauggaucauaugguuuuuguccuuuauucugcugauaugauguaucgcuuugauuuaucugcauauguugaaccauccuugcuucuaagggauaaaucccacuuggucaugaugaaugaucuuuuuaauguuuugaauucgguuugccaguauguuuuggaagagauuuacaacaaucuucaucagggauaucugccuguaguuuuccuuuuuuuuuugauguaucuuugguuuugguaucagggugauacuggacuccuagcaugaguuuggagguacucccucuucuucugcuuuuugagauaguuuacguaggauugguauuaguucuucuuuuaguguuugguagaauucagcagugaagccaucaggucuugguagguuguguguguauaggaauucauccauuucuucuagguuuuccagccggugugcaguugcucgugguagccuguaaugauccuuugaaguccugugauguugguuuaaugucuccuuuuucaugucugauacuauuucuuugaaucuugucucucuuuuuucugacuucaucugguucaaaacaccaacucuuuguuucauugaucuuuuauauuuuuuuguuucaaauuuauuuauuucugcucugaucuuuauuauuucuucuaauuuuguguuugguuugcucuuguuuuucuaauucuuuaagaugcauugcauguugcuuuuuugauguuuuucuacuuuuuuauguaggugcuuauagcuauaaacuuuccucuuaguauugcuuucacuggaucccauagguuuugguauguuguguuuucauuuucauuuguuucaagacacuuuuuaauuuccuucuuaauuucuugauugacccacuggccauccaggagcauguuauuuaauuuccauguguuuguauaguuuccagaauuccucuuguaacugauuucuaguuuuauuccauuguggucagagaagauacuugauauaauuuuguauuuuuuuuaauguuuuaagacuuguucuguggccuaacguggucuauuuuugggaaugauccaugugaucuguuagguccauuuggucuguagugcagauuaagucauuucuuucuugguuuucugucuagaucuguccaaugcugaaagcagaguguugaagucuccagcuaugauuguacuggggucugucuuucccuuuaguucuaauauuugcuuuauguaucuuggugcuccaguguuggguacauauauauuuauaauuguuacaucaucuugcugaauugaccguuugaccuucuuugucucuuuuuauaguucuugucuugaaaucuauuuagucugauuaaauauagcuacuucugcucugcgcuuuuuugguuuccauuugcauggaauaucuuuuuccauuucuuuauuuucuuuuuuugagacggaguuuugcucuuguugcccaggcuggagugcaauggcgcgaccuuggcucaccacaaccucugccucccagguucaagugauccuccugccucagucucccgaguagcugggauuauaggcaugcaccaccacaccuggcuaauuuuuuguauuuuuaguagagucaggguuucucuacuaaagaaacugacuguuggucaggcuggucucgaacuccugaccucaggugaucugcccaccucagccucccaaaaugcugagauuacaggugugagccacugcgcccgguuauuucuuuauuuccauuugaugugugucuuuauagguaggguguguuucuuguaggcaacacaucguuggaucugguuuuuuuauucauucagccacugugucuuuugauuggagaguuuaguccauuuacauucaguguuguuacugauaaguaaggauuuacuccugccauuuuguuaguuguuuuuugguuguuuuguggucuugucuucuuucuuuccuuccuuccugucuucauuuuagugaaggugauuuuucucuggugguauguuuuaauuucuuuuuauuuuuuauguaucuguuauagguugggcuuucuuuauaggacagugaaaacauuugaaaauugauagugaggguuguuguucaaaucagugaauauaccaaaaaucauugaauuguauacuuuaaaugggugaauuguaugguaugugaauuauuucuuaauacuauuaaaaauaucaagaaccuuucuuuuucuuuucuuuuuguuuucuuuugagauggagucucgcucuaucgucgaagcugaagugcaguggugugaucucgacuugcugcaccuccgcccuccggguucaacugauucuccugcuucagccucccaacuagcugggacuacaggcacaugccaccaugcccagcuacuuuuuguauuuuucauagagacgggguuucaccauauuggccaggcuggucuugaacuccugaccucgugauccaccugccuuggcaucccaaagugcugggauuacaggcgugagccacugugccuggcuucucaagaaccuuucauauggcaaaagauaccauaaaccauauuaaagaaaacccagacuuggauuaauuauacguaacauauaaaacuguuaaaggcuuaguacccaaaacacaaaaggaauuucuaaacaucaauaagaaauagacuaacacccuauuaguaacuuaccagaggauucaggcaguucaguuaagauugggccuaaauggcugauuaaaaaagcggaaagaugcuuuguuucagggagauaccauuuaaaauaauagagauaucauuucacaucugucuuuuuggaccauauuaauaugccuuaggaaaucaaguguuggcacaaaucucauggaauggagcaggcuccuucacugcuggggaaguguaaacugguugaucuccuuggagaguggucugacaauaucagguugaagacaggcccuacucugugacuuuguuguacuacagccacucuuguaccuguugcaaugcgcuuggugggugaaacaguaacaggaacccagcuaggccccucagacuggaauaacucaaccacagaacaauuacauauauacaucagugaaauucaacgaacuagaucaacagagaucaacagagaugucagaaaaacaauguugagugaaaguggcauggaaaauguguugcuguugauuuuuaggggcuguugaugcaucuuuuugucucuaaaauuuaaacgcugauacagacuuuuuaaaaaauugcuuuuugcuaauguugucgcaguuugcucguguuuauaagugcucauugugugccagcuacuguucuaggggccaggggccagggcuguagcugugaacaagacaggcaaaaucuccacucucacugggcucauaaaugagggaugacagauaguaaacaaguaggaaaauaauugugcucuugguugaugcuaaacaauauaaaggaaauaaagcaggggcugagggugaccaaggaaggugugcaaaaucuccgcucucguugggcucauaaaugagggaugacaaacaguaaacaaguaggaaaauaauugugcucuugguugaugcuaaacaauauaaaggaaauaaagcaggggcugagggugaccagggaaggugugcucugaggagcuggcuauuaaacagagacuugcauuuuuuuuuuuaauugagacagucucauucugucccucaggcuggagugcaguggcgugauccugucuuacugcaaccuccaccucccagguucaagugauucuccugccucagccucccuaguagcugggauuacaggugugcaccacuauaccuggcuaauuuuuguauuuguaguagaggcgggguuuugccauguuggccaggcuggucucgaacuccugaccucaagugauccacccgccucggccucccaaagugcugggauuacaagcaugagccacugcgcccagccauagaugugcguuuuaagaagagcaaacguggaaauguuuggggaaagcauccaggcagauacaaaauucuucagcuacaucauggucaaaaauggcaggaagcauuaaauacuuaugaauaaacuuaauaaaagaagugcaaacguuaacacugaaaacagaaaacauuauucaaauaaggaagcuaaauagauggaaaggucugcaaggcucuuugacuagcagacaacguuguuuguuaagagagcagcacuccccaaagcgauccacagauucagugcagucccugucagucccagcugauuuccuugcagacauugacaagaugauccugaagaauagcaaguccaguguggccaaagcccaggagggaggaggggaaguggauggugaugcagucagggagacuggcagggcuucugaguccugaaaacccugugggccaugacagggagcuauugccgaccucuccuaggucugguagaagccuuaggagcuuuuaagcagggcugggauggcugugagccauauggcaaugagcaggacagaaugucgaauaaauagaauucagcuuuucaguggcaggaaaugagagcauccucacuuucuuucuguacauguuguguauuugugucacauuacugacccaccuaaaccuuuucuuaagugauacggaaguaacaguauuuauuauagaauauuuagaagauugagucuggguacggugacucacacuugcaaucccagaacuuugggaggcugaggcaggaggauugcuugaggcuaggagaucaagaccagccugggcaacauagcgagaccccaucucuuaaaagguaauaaauuagccgggcacgguggcucacgccuguaaucccagcacuuuggggggccaaggcaggcagauuacgaggucaggaguucgagacuagccuggccaauauggugaaaccccaucucuacuaaaaauacaaaaauuagcuggguguggcggcacaugccuguagucucagcuacuugggaggcugacgugggagaaucacuugaacccaggaggcagagguugcagugagccaagacuacaccauugcuccagccugggucacagagugagacuccgucucaaaaaaaaaaaaaaagaaaaaaaaaaauuagccgggcauagugguacacaccuuuaguccuggcuacucgggaggcugaggugggaggauagcuuaagccuaggaguucaaggcugccgugagcuaugaucacgccacugcacucuagccugggugacagaacgagagacccuguuucuuaaaacacacacacacacacacacacacacacacacacacaauauuuagaagauucaaacugaaagagaauauguauucaggauccugccacuuugagguaauggcaguuaacauuuaguguuucuuccuucuagucuuuugaaugaaguuaugauccgacauuucucaaauucaguaaugagugcccaucccacccagcucaccccccaacaccucaaaaggaaacaaaagaaucauagcuuuccuguuggcaagucaguccuugaagcuucugauucauuucuuucagguggagcugaucagaauaauguucagcaucaacccccuggagaaccugaagguguacaucagcagucggccuccccugguggucuucaugaucagcguaagcgccauggccauagcuuuccugacccugggcuacuucuucaaaaucaaggagauuaaauccccagaaauggcagagguauaguaugcucugacuucucccgggcuggcugguccuugugcaguggggcaacacccuguggcuugccauauagcuuucuuggguuuuggccuuucucuccuagugagaaaaaucaguauuuauucagaauuuucuguuuuccaucuccccaggacucacuuuguuaggaaauaccuagauggguauuguucgauuuaaauaugcuaccaguuucaguuagacuauuuuagcagugaaacaugcacuuuggagaguacauuuguaaaaugaucugugucaaaaagcuggagaccucaccucuguaauauuccaucucaaauggguucauugcuguuuuagaaaacugaacauuugguauuuuaaaaccacauaucaucauggaguuuuaucagcuauacuaaugguuuuuuucaugagauaagaaggaauccuaaagaaauucaaaaacaggaccuaauuuccaaauauauuuguuuuuuguuuuuugagacggagucucgcuccgucaccuagucuggagugcaguggcguacucucagcucacugcaacuuccaccucccgggcucaagcgauucuccugccucagccuccugaguagcugggauuacaggugccugccaccacgucuggcuaauuuuugucuuuuuaguagagacgggguuucgccacguuggccaggcuggucucgaacuccugaccucaggugauccacccaucucggccuccccaagugcugggauuaccggugugagccaccgcauccagccuaauuccugucuuuuaguagauuccuugggugccuucucuuauucuauuuccuucuucuuggguuuguugguggguggaggugggggugggaguggggcugggagugcgugguugccgcauugagugugccuugcaauggagaggagaguuguguuccauguaauugagaucguagcuuucucucaugcucuagggcauucuagaucuuaagugaucuuggcaaaaggaaccgccuacacaugugagcucuuucuagcacaguucaaguaacgaguuuuagcuauuucuaccauguaacccuuucaaagaguuuauuacuaagagacauacuggcuggcuuaauucucucucuuuucugacccugccucaaucuuuaaagguugugaaaacaggcugcccccacaucagggcugaaaaugaauauucuacucaaaacuaaagcugcacagccuccugccauuucuuucccgcagagcuugaguccauguugagcacuuggccaaggccagugguugcacugaagccuggauaauuagcccuuaauaauccaaauuaggccuggcauuggcuuuagccagcuguucaacguggacuccagcucuguaggaacgcauuguugagaugcugcggaacuuugguuaugauuaguuucgugauuuuuguuuucaaaugaggauccuagguuguaggaaaggcagugguguaugggaaacauuuggggcugugaaucagaacuuaaugcugauuuuaccuugaacuagaauuggagagucccuaauuugcccugggccucaguuucuucaugucuaggauuaugaaggacugagacuagaauguucauuuucaacccuaauguacuagaauggucaguugaguuuguagguguuagggaaaauguaauuugauagauccaguugcagucuuacuaaaugucacauacaguuaaacugaugcuguaaggguagacuuacugggcuggguagggguugcucagaugacuuuuuuuuuuuuuugagguggagugucacucugacacccaggcugaggcuggacuucaguggcgcgaucuuggcucacuucagccucugccccccuucaaacgauuuucgugccucagccuuccaaguagcugggauuacaggcaugcgccaccauguccagcuaauuuuuguauuuuuaguagagacaagguuucaccauguuauccaugcuggucucgaacuccuggccucaagugauccacccugcuuggccucccaaagugcugggauuacaggcgugaacuaccguaccuggccucagauggcuuuuuuuuuuuuuuuuuuugagacagagucucacugugucgcccaggguggagugcaguggcacgaucuccucucacugcaaccuccaccucccagguucaagcgauucuccugccucagccucccaaguaggugggauuacaggcacacaccaccacacccggcuaauuauuguauuuuuaguagagacgugguuucaccauguugcucaggcuggucucgaacuccugaccucaaaugauccacccaccuuggccucccaaagugcugggauuacaggugcgagccaccguaccuggccccuuccuuuuugaaaucguugcugcucuaaggugucaucaaaaguccauaagaaggggggcagugucccaaaugaguauuaguauucacugcuguuuuguguucuagagaaagagagcaagguguauggaauugaccuuuugggacauuauuuuaaggugacuuuauuuaaagaaaagaauuguaguugcaaaaugaguuuggauuaaugcuuuucuucaagcguucuuuucaaguuugguucugaggcuagaucauuuucucuaaguguaauaugcuggauuuuuuaaaaagauuuucuugaauaaauugauuugauuucacaguuuauugaguaucuugugccagugaagaguucauauuuuagguugugaauauaaaagugauuaggaaagccacaucaugcugccugugaagagggugguggccgaguugucaugaucuuaaaugaucagcucugaauuguaguuugcugaugugcugcggugccacacuggggucuuaccuguauucccgcagugggagacaggcgcugcuuaacacccauuucucuuucuuucacuuucccaaaggauuggaauacuuuucugcuacgguucaaugauuuggacuuguguguaucagagaaugaaacccucaagcaucucacaaacgacaccacaacuccggaaaguacaaugaccagcgggcaggcccgagcuuccacccaguccccccaggcccuggaggacucgggcccggugaauaucucagucucaaucacccuaacccuggacccacugaaacccuucggaggguauucccgcaacgucacccaucuguacucaaccaucuuagggcaucagauuggacuuucagguaugcaguagccacucuccacucaggcuccuuaggcaaccacuguuacaaaaagaggaugcaccguguauguuuuuacugacuauauuguacuagauuguagucuugcgcgugucuuuuuuuuguugaguuugaacuacaugaaccauuucuguuccaucguuacaugguaaaguaccuggcuagaaguaguuucucaaaagccuguaggaaugagaaacugugagaaaacuguuaaggccugucuaauauuuacaaacauguaauuuuaauucaggcuuguccuguuggaguuuucauuacuuacuacacaucuucuauugcuauuaguuuacauauuuuuuaauggccauuguuagucuggcacugugcuaagcugcugggaagaacuagaaaaugacuaagauggcugggugcaguagcucaugcauguaaucccagcacuuugggaggccgagguggguggauugccugagcucgggaguuugagaccagcgugggcaacauggugaaaccccaucacuacuaaaauacaaaaaauuggccgggcgcgguggcucacgccuguaauccgagcacuuugggaggccaaggugggcagaucacaaggucaagaguuugagaccagccuggccaauauggcaaaaccccgucucuacuaaaaauacaaaaauuagccgggcgugguggcaggcaccuguagucccagcuacucggguggcugaggcaggagaauagcuugaacccaggaggcagagguugcagugagcugagauucaugccacugugcuccagccugggcgacagagggagacucucucuccaaaaaaaaaaaaaaagaagucagcugggcaugcaggcaugguggugcgcacuuguagucccagcuacucaggaggcugaggcaggagaauuguuugaacccaagacguggagguugcggugagccgagauugcaccacugcacuccagccugggcgacagagcgagacuccaucucaaaaaaagaaaagaaaagacaaugccuaagaugggcccgugcgcaguggcucacgccuguaaucccagcacuuugggaggccgagguggguggaucacuugaggucaggaguucaagaccagucuggccaacauggugaaaccccaucucuacuaaaaaugcaaaaaaauuagccaggcgugguggcaggcgcccgugaucccagccacucuggaggcugaggugggagaaucacuugaacccuggaggcggaggcugcagugagccaagaucaugccacugcacuccagucuaggcaacagagugagacuucaccucaaaaaaaaaaaaggccuaacauuuggucucuuccuuuuggaauuuugggguuauggaagagacaaagauaaacgugaguuaauguuuaucaagcacuuacaauaguuccugccacaaaggaaaugcuacguaagugcuugauaagggauaugaaaaaauacauacuuauaaaauguggagcacugcccuuugaccaguacuaaacccaugacagacuguaaguguugcaggagaagggcuagaaggcaguggaagcuggaauaaucaggaaaggcuucauaugggacaccugggccuuggaagaauaaccuuuuguucuuugguuaccaaaaggcuuuuuaaaaauugcuuaggcuagaugcaguggcucaugccuguaaucccagcacauugagaggcugaggcaggaagauugcuugagcucagguguugaagcccagccugggcacauagcaaacaccugucuuuaugaaaaaauuaaaaaaauuaaccagguguuguggcgugcaccuguagucccagcuacuugugaggcugaggugggaggauugcuugaaccugggaggucgaggcuacagugagcuaagauuguaccacuguacuccagccugggcaauagagugagacccugucucaaaaaaaaaaaaaaaaaaaaacaagaaacaaauaaaaaguccuucaaggaauuuaagugcccaccagccuccuauuggcuguuagaggugagaauauucccauaauaaucaagguaugggugacuucuggguuuuccauguagcaaguggaccuguugcuuauggcauggcauaaggacaccuucgggauuuuuuguuguuauuuugagauggagucucacucugucgcccagguuggagugcaguggcacaaucuuggcucacugcaaccucugucucccggguucaagcgacuguucugccucagacucccgcguagcugggauuauagguucgugacaccaugcccagcuaauuuuguauuuuuaguggagacaggauuuuaccauguuggccaggcuggucuugaacuucugacuucaaaugauccgcccgccucagccucccaaagugcugggauuacaggcaugagccaccacgcuuggcuauuuuuuaauuuuaauuuuauuuuaauauuuuaauuuuuuauuuuaauuuaauuuuuauuuaaaauuuuauuuuaauuuugagacugggucuugaucugucgccaggcuagagugcaguggugugaucauagcucacugcagccucaaacuccugggcucaagugauccucccuaguaccugggaccacaggugugcaccaguacaccuggcugauuuuuaaaacuuuuuuguagagacagaaucuugcugucauguucaggcuggucgugaauucccggccucaagcaauccuccugccucagccuucuaaagucaaagugcugggacuacagaugugaaccacugugccuggcaauacguugguuuuaguuuaagcuucaucacuugccuuucuuaacucugaaacccucugaccucuguuuguucauauguaaaaggggaacagcugcacuucuucagucauguucaugggagaguaguaaauuuuaagugaaauaauacauauaaaagauguuugaaaauggcuagacagcugugcagaaaugcuggggauaauucacccagcccgagcuuuucaucucugaucugcccgaggucugguuuggcaucuccaggccauguacuggaaaguggccacuuccuucgcugcuucguggcucugaguugaguaggacucauggucagggucaggacugcucuucuuccucagaucccacaaaggcaggugccugggcugauagaugauuccuguguggguuugauuucaggauuuauuuguaucccagagaaugacaaguacgugguucuugacuuuauaaaaaaaugauuucucuuucauaggcagggaagcccacgaggagauaaacaucaccuucacccugccuacagcguggagcucagaugacugcgcccuccacggucacugugagcaggugguauucacagccugcaugacccucacggccagcccugggguguuccccgucacuguguaaguguacccggcaccugaugaacgugcguaacaagcuccacuugccgugaguacggcugggcugcuucagcuguaaauucucaggauggcucacuucacauuucuuuauagaauuaucucuacucggaccuaucuaaaggauuauuuaauuugucuaaaggauuauuuaauuuggaauucuaaagauagaacuucugcauauaaaaucagaaaguuagugcccccucgaggcaguaaaagcaccuggcuguuguuggacauucauaggcugucuuucccgcaggaguagaagcagcaaguuacagaaaagaggcucacuguggccgggugccguggcucaggccugcgaucccagcacuguggaaggcugaggugggaggaucacuugagccccggaguucaagaccagccuggacaacauauagggagacccugucucuauuuaaaaaaaaaaaaaaagaaagaaaaagaaaaaagaaaagaggcucucuaaagauaaagguuuucagccaggugcggugucucaugccuauaaucccagcacuuugggaggccaaggugggcagaucaccugaggucaggaguucaagaccagccuggccaacauagugaaaccccaucucuacuaaaaauauaaaaauuagccaggcaugauggcacaugucuguaaucccagcuacucagaggcuaaagcagggaggcagagguugcagugagcugagaucgcgccacugcacuucagccugggcaacagcaagacucugucucaaaaaaauaaauaaaucaaauaaaacaaagauaaagguuuuguucaucuccauuauccagaaagauauuuuaaaaucguugauuuuaguuuaucuugauuuuaguuuuaaaucaaguauaaaucaaaacuuauuuucuguuaauuaacuaauuuuaaaaucuaacauuuuaaaucauuucccauuaaacaguuacuuuaauuuuaccugcgaauuugaaaauuaguuuuaaaaucaaauauaaauugaacuuuauuuuccauuaaacaauuaagguuuuugaagcuuuuccuucaguguuuuugagcagcauucaguguuacugcuuugcauuuuagguuuuuuuuguuguugguuuuuuuuggucucuccugucucuauaaaggagauaauuaucuauaaauaaauaggugaaauacauaagauauagccuauuuaaaauaauucuauggugaauccuuuuuaaauaagaauuaucucaggauuugucuauuuuagacauuuggagguuuguaggacaagaucagauuaaguuaaacauuacuuuguguugcagugacugauauagaauuuuguagguaaagcuuccaguuguaacuaagugauaugcuuugggcugggcgcaauggcucacaccuguaaucccagcuacuugagaggcugaggcaggagaaucaguucaacaugggagguggagguuucagugagccgaggucacaccggccugggcaacagagcaagacuccgucucaaaaaaaaaaaaaaagaugauauaguuuggcugucuccccacccaaaucucguuuugaauuguaguucccauaauccucaugugucaugggagggacccagugggagguaauugaauccuggagauuguuacccccaugcugcuguucucauaguaagagaguucccaugagauaugaugguuuuauaagggguuuuccaccuuuuauuuggcacuucucuuugcugccgccaugugaagaaggauguguuugcuuccacuuccgccaugcuuguaaguuuccugaggcuucccugaccaugcugaacugugagucaauuaagccuguuuccuuuauaaauaacccagucccggguaugucuuuaucagcagcaugagaaaggacuaauauacuaagaguuuagcucauuugagaagauaggcuuaaaaggagcuuaugugcuuugcaucacaugugagaggacuguaggcugaauucugaaggcaaaaauccaacacccaaacuccuaaaugucaggcaccuauuuauuuuucuguuauauuuuuauuuuuuaaaaaagacccucaaacuaaaauauaaugguauuuaucucaaagaagcaugaacguguaaguuacauuuuuccuuuccauguguguugccguguucaguguuuuaccagcugcugugggggugacacaagugaaugacucaggccacugagcacgugucuuuccuccuccucuucuccugcagacagccaccgcacuguguuccugacacguacagcaacgccacgcucugguacaagaucuucacaacugccagagaugccaacacaaaauacgcccaagauuacaauccuuucugguguuauaagggggccauuggaaaagucuaucaugcuuuaaaucccaagcuuacagugauuguuccagauguaagugagaaaaauugugugugugugugugcgugcaugcauaugcacaugugugcgcaugugcugcaaccguugguguaggcccugcugacuucccuggguaagcguauccucugccacuuuagauuuccaggugaguuaggacacuaggcggagugguggaugcuuggaaaaacauguuacccauugguuaagaaaaaucugguuuuucucuucauuuucucuguuguucagcagcaguuauuucuugagcaacugccuaaucccugggggggguuacaagggauccuucuauuaauauuaucuuagagggauguucacagacguucauagaagacuaucuaguuaguguccgugugaacaagaaauagugcugcuuagaguucugaaagauagaagggaguaguaggaggagaugaaucuucggcuagagagugaggccugaauaggauuuaacuuaaccaagaggcaaggggaacaaaauacuuaccuaucucaucuaguagcugugugcugcuagcucagcuuccuacuuagacuugagcccacuuacuuuuuuagagacaggaucuugcucugucgcccagauuggggucuaguggcgcaaucauagcucacugcagcuucagccuccugggcucaagcuucccaaguggcugggacuacaggugcaugucaccaugccgggauaauuuuuaaacuuuuuguagagacgggggucuugcuguguugcccaggcuggucuugaaccccuggucucaagcgauccuccugccuuggccuccaaaguuucugggaugacagguaugagccgcugcaccuggcccaagcccacuuuuuaacacugcuuugauauuuuauaaauauguuccuuucuggcaguguguguuagcuggaucucucuucuuuuggccuggcccuuugcccuuuucuuuuuuucuuuauuuuaauuuuuuuuuauuuuuauuuuuugagauugagucuuucucugucacccaggcuggagugcaguggcacaaucucgguucguugcaaccucugccuccuggauugaagugauucuaaguagcugggauuacaggcaccugccaacacgcccagcuaauuuuuguauuuuugguagagauaagguuucgacauguuggccagguugguguugaacugcugacuucaggugauccucccaccucagccucccaaagugcugggauuauaggcaugagccacuaugcccgaccuuugcccuuuucuggggcucauuuguaggccaggguccugcaggagccagcuauggaggucaggcuggauggugggcugaggcccuuagugccuggccaagggcagucccugccuguguuuggggcguggguguugguaaagcaguguguugagaagacugagcugccccgcuauguuauaaaugaccugggggagcccagagcuguccugaggccuggagauacuagaggguaaaggaauggaaccaugucuggggucccuuuaguaacuugcagggucugggaauugacugcaugugggaggucaaaggguagugaaucacggaugaucucagcauuuucauccaaggacuuagggaaauagagaaaagcaggaggaagggcgugaccccuggggaggggugaggugccgaggccuuccuggugggggcauagucaggaguuaggaaugcagccucggcugucagccaugcaaccugagggcagucuugugacgaggauguguccagaaaggaguggggcuuaaagauggagugucugcagcauuugcaggggaggaagccugcuggaggggcaggguucaggcagugugggggugcagaaggcagggcagaggacagcgcuaggaaggcguggugcucuccaacagaggcucgggagcaccaugucuucacuuaaugagacccagcuuuggucauuuaggaggcaaaaggagaaaccuccucuugcagcuuaagaagaaaaguuguggcaagucuggaggcugucaauccugucucucaaaacccagcauuaaaaccuuucagucacucagagcagauguuucugauuuuuuuucucuucuuuauuuaggaugaccguucauuaauaaauuugcaucucaugcacaccaguuacuuccucuuugugauggugauaacaauguuuugcuaugcuguuaucaagggcagaccuagcaaauugcgucagagcaauccugaauuuugucccgagaaggugagcgguggaugggguccgggccagcauuuuacuagaggucucuguauacagaaagucccaguuauccuuauucuauuuauuguggguggcaccuuucgucuaaagaaaugacagucaucccuugguauccgaggaggauugguuccaggacccugguggauaucgaaauucaugaauguccaaaucccuucuguaaaaugguacaguauuugcauaugaccucugcacauccucuguaacuuuuuuuuuugagauggagucucgcucugucucccaggcuggagugcaguggcacuaucuuggcucacugcagccuccgccucccagguucaagcaguucucccaccucagccucccgaggagcugggauuacagucgcaagccaccgcgucccacuaaguuuuugcauuuuuaguagagaccgggucucaccauguuggccaggcuggucucaaacuccugaccucaagugauccacccgccuuggccucccaaagugcuggaauuacaggugugagccacugugcccagcucauccucuguaacguuaaucucuagauuacuuucuuuuuuuuuuuuuuuuuuuuuuuugagagaguuuugcucugucaccaaggcuggagugcuguggcacgaucuuggcucacugcaaccucugccuccugggcucaagugauucucuugccucagccucgagaguagcugggauuacaggcaugugccaccacacucagcuaauuuuuguauuuuuaguagauacaggguuucaccauguuguccaggcuagucucgaacugcuguuaucaagugauccaccugccuuggccucccaaagugcugggaucacaggcgugagccacugggcccagcuucuagguuacuuauaauaccuaauacaauguaaauacuauguaaauaguuguuacaguguauuuuuaaaacuuguguuauuuuuauuguuguauucuuauguauugguuuuuuuucuuuugaguauuuuugcuuuuuuaauuuuuuuuuuuuuuuuuuuugagacagggucucacuuugucacccaggcuggaguagaguggugcgaucguagcucaugacucaaucauaguucacugcagccuugaccucccaggcucaagcgaucgucaaccuccugaguagcugggaccacaggcaugcaucaccacaccugguuaauuuuuguauuuuuugaaaagacaggguuucgccacauugccuaggcuggucuugaauuccugggcucaagcaauccacccacauuggccucucaaagauuacaggugauuacaggugugagcuaccaugcccagcccucuuuuguguauuuuugguugaaucuguggauaugaaacccacaauuacagaaggccagcgguaguuucugucuucauuagaagugucuuuacucucaaccuaaauuauguuguuggauuuuuaaucauauacccaagccucuguugcuauuaaagggagugacuuggcaguuguucucaagucuccacuggagcacuacugacucuggguagcugccuccucuguaguuccaucagcauaagaagucuucuaacagaaugcuuaucaagguuuaaagacaguuaccucagcuagguggaccuguaaucccaggacuuuuaggaggcugaggcagaaggaucacuugagcccacgaguucaagaccagccugggcaacauagugagaacccuucucuacuaacaguuaaaaaauuagccagauguaauggugcaugccuguauucccagcuacuggggagguugaggaaggagaauugcuugagcccagaaguuggaagcugcaguaaccuacgauugcaccacugcacuccagccuggacaacagagcgagaccgugucucaaaaaaacaaaaaccaguuaauucugucuccgcacagugguuccagaugggccgcgucuugcaggagacuuugagauuucuaguaauuucuuccuaggugagauuuucuuuuuagggauuuaguaacuucacugucugguugauaugugcaauuaguguggcauccuggucuuuggguaggggcugaguuaccuaggcuucccuuuuuugacugguuucccuggcuugcugucuuccagguggcuuuggcugaagccuaauuccacagcuccuuguuuuuugagagagacugagagaaccauaauccuugccugcugaacccagccugggccuggaugcucugugaauacauuaucuugcgauguuggguuauuccagccaaagacauuucaagugccuguaacugauuuguacauauuuauaaaaaucuauucagaaauugguccaauaaugcacgugcuuugcccuggguacagccagagcccuucaaccccaccuuggacuugaggaccuaccugaugggacguuuccacgugucucuagagaaggauuccuggaucuagcuggucacgacgauguuuucaccaaggucacaggagcauugcgucgcugaugggguugaaguuugguuugguucuuguuucagcccaauauguagagaacauuugaaacagucugcaccuuugauacgguauugcauuuccaaagccaccaauccauuuuguggauuuuauguguuuguggcuuaauaaucauaguaacaacaauaauaccuuuuucuccauuuugcuugcaggaaacauaccuuaaguuuuuuuuguuuuguuuuuguuuuuuuguuuuuuguuuuccuuuaugaagaaaaaauaaaauagucacauuuuaauacuacucuaguuaggacagacuugugcuuuuauccugacuaaaaaguuaaauauuuaagucacauacaugguaaagaucuaaguuucauuuuccacauggaugaccaggaaccuggucuuguuggagcuggcauaggagguucuacugucuugucguccacucuugucccucccuucuguuaucaaaguuaaagcgccucuucacucaaaagggcuucaaaauguaaauggcucuagaguuagagugacuguuugcucuucugcuuucuggaaugcagaugacaguauggaaagaaagaauaaugauucuaucuaauaggaaaggauuucuucuuucuuuuuuaaagaguggguggauuuucucccuuuuguuuugcuuuuauuuucaugcuacuaacauaucuucagaaggaaauggcaacuaguagaucaguaaaauuacgaaaacgaugccugcaaaauuugaaggaaugcaauucugauuugccauuuaucagggaaaacugaaagcauuuuucuuauaacuuuuuuucuuuuucuuuuuuuuuggaggggggaggcagggucuugcucugucccucaggcuggagcuuagcucagugcagccuccaacuccugggcucaagcaauccucccacuuuagccuccugaguagcugggacuacaggcgugugccagcgcgccuggcuaauuuuaaaauuuuuuuguagagacagagucucccucuguugcccaggcuggucuggaacuccuagcuucaaaugauccucucaccucggccucccaaaauccugggauuccaggcgucagccacugcucucggcccucuuacaccauuuuguuugauugucuagucccuguuucuuuuucuuucuaauccuuauucauuuaagcaaaaccauacauuaucuuuuccaguccuuucuuguauucuuacuguuuuuuuaaaauaacuuuuugccuuaauagcucauugucacuaauaacuucuguguucucccaggcaguguuauaacagaagggcaaugaaaacauuggacaugaccaugagugcuuccuuuccuuaacucuagguuuguagucuguuuuaaauuaggauuaguuccugcauucugaaauacauuggccuagaacauuuuaucccaggcauuuuugaauagaaaacaguugcgugcuuuuauugaagauuguuaaaauaaucaccauaguaacuugauauguuaguauuuuucuuuuuccuuuuaguauguuucaagugcaguaaucguacuugucuauccaguuucuauguaugauacgaguugcuuacacgaugcauggcuaacuuguuaauuuaguuuucuccuuagagacuuugagacccuuaagagacaagauugagaaagagccauguggcuuggcucuagaaacgucauuaucauuaggaccaucagauuuuagauuaagcugcuauugaauuaauaaaaucccaaugaagcagaguuauagggauagauuuauagcuggcagagugguaucaaaggagaaaaacagugaaaaagccaauuucacugguucguucaauccagcuuguugcuaauauuaguuacccuuguuuuaaugacagagaguggcuggaaucuguagcuaggggaggggcaacacuguuagaugugaggaaaggaagugccaaaaaugccuggacagauggcuugucccaaggccaggacacacacuuuaaaauccaacauucaccuaagcaaguaauucuuaaagaucuuacagaaacgcagagucaaucagguuuauaaaggaaggcugaggggagagaggaggccugggggccuggacgaagaggccuaggaccugaagagacuccagcgagucucgggaagcccaggggaccugucaccaucugggcacuucccaggcucaaugcucagccagaguuugcugguggaccucaggauucgaagugugcaacagacggagugcgcuugcuguucagggcggccccgugcaggagcaccagcucacccucaggcaucucggacuggagggccagcagaaggucagcaacuuacucuuaaaacgauuguuucggaucauauugaucucuuuccuuuuuccuuuuguccuuucacuguaugacuugaaucaguuuugauucuauuuguaaguguuucuugucgugaggcaccugccaugucuguugcguuuuccucggcagcguguagggcuucagcuuccuggguuuucacccuuccugcaggcacugugggguccugagggccaguggguccauuucaccucuugcugcaugauggucaguagcugaucuguuauggcauucacuuccagauuaauuuuccguguuugaaguaugugcauaugugcuuuacagaauaaaacaucugaauuua

SEQ ID NO: 191541 - RNA, 7899 nt, Homo sapiens
aauaaacauaagagugguuuuauugauuacauacaauuuuagcuauauuaauauauauuauaaacuuuaagaauuagaaauaagugacuuuuauuuuuuaaccaagaauaaucuaaguuauggcagcauguucaaugaaagguaaguccggcacaauuuuucuauaucuguuucucagauaaucaggaacaucauccaagcuuuacauuacgauaccauaaugacccucagaacacaaguuccauuaaguagaaaugaagcaucauauguuuucuuuuuuaggaaagacccccccuuuuguuguauagacauaccccuaauaaucuuacucuacuguacaaauaacuuuucacccacaagagcugccucaaguaacuuucauuuuggaaagcuaucaaggcaugagacagaguagcaaaaugccacucuggacuuugcaucuuggaguuucaauuuugcuuuaggauuuagaccccaguuuauaauuaaaaccaaaucauucccacauuauuauacuuauguaggaaagccuugcuguguccacuguuaacacaaagauagaaaaugucaaauaguuuaagcaaguauuuggcagaccacagacaugaaacagugccgucggaaacggaaacacuuuaguguuuuagaggugaagagauugaugggugucauucaaauuucucaucuccuucuucuacaucuuucagauugaguacuuccaaagaaccuuugccuuuaguuuccuuuuuuauuagcucaucaauuucucggaagcagcccgggucaaucagacauaccugaaacauuuaacguagcagauuaccacaugaggaugagcaagacacagaauaaacucagcuuuaacuuccuuugaggcaagcacaaugcuguccagaucucuaauaauaccacaguucuauggugcaauagauaagacaauggguagggcggcacacuggguuccaguuuagccucugcccucaaguguccauguagcccccugugacaaggcauuaaucccuauguuuaaacacuuauucugauucuucagcuguaaauggaagggacaaacuagaaaacucugauucuucucauacuaaaauuuagcauuacauuuuauagcucaguaaagucaccuccacguaugaaggagaaaaagcaaugugaagacuuauguagacaccauguguauguuaauuuauuuuuuuuugagauagagugcaguggugugaucuuggcucacugcagccuccgccucccagguucaagugauucuccugccucagccucccaagaaacugggauuacaggaacccaccaccacaccuggcuuauuuuuuguauuuuuaguagagauaggguuucaccauguuaucugcucaccuuggccucccaaagugcugggauuacaggcacgagccacugugccuggcccauguguacaguuuugcaaagauuuuagaacuucaaguagugucagaugaguuaguucacaucuacaguggauacucacauacucaacacuucucuacagcucauuuacuuuuaaaaagaagcugcagacagggcgcgguggcucaagccuguaaucccagcacuuugggaggccgaggcggguggaucaccugaggucgggaguucgagaccagccugaccaacauggagagaccccgucucuacuaaaaauacaaaauuagcugggcgagguggcacaugccuguaaucccagcuacucgggaggcugaggcaggagaaucgcuugaacccgggaggcagagguugcagugagcugagaucacgccauugcacucuagcuugggcaauaagagugaaacccugucucaaaaauaaauaaauaaauaaauaaauaaauaagcugcaaagccuugaaaacaugaauuuguagacagcucaauuuacacuguguuugaagcuguggggugaggucauaaggacauaaugguuucgcugcuucuuuaaaauguucuguguuuagugucaccagguucacacacuaauauccucuggaaacacccucacagacauaccccaaacaaugcuuuaucaggcuucuagggauuccuuuccagucaaguugacaccuaaaauuacauccacaauuccaccccuuaucaacuuggcacccagacucaucucuuuaaaccauuuuuaauuuucaaaugaagacaauaacaagguccuagcuuuuccucacaugaugcaauuaaccagacgcgacuauccugcauacaacucaaagagugcuaauccuuuugccagaauucagcuuucagaauuucaucauucagaauucaaucuuuuuuuuuuuuuuuugagauggaguuucgcucuuguugcccaggcuggagugcaauggugcaaucuuggcucaccgcaaccucugccuuccagguucaagugauucuccugccucagccucccgaguagcugggauuacaggcaugugccaccacgccagacuauuuuguauuuuuaguagagacaggguuucuccauguuggucagacuggucucgaacucccgaccucaggugauccaccugccuuggccucccaaagugcugggauuacaggcaugagccaccgcgcccagccaggauucaaucuuuuggaacugugauuuucaagauauuagaaguucaggcuuuggacuuuagagauuuugauuuuuuuaugauuucaacauugggauuguggcauuugggauugucuuuuaggauuaugaucagcacuggaguaaagcaugcaauugagcuaucucugaaaacucaauguaaauuuccauagugugcuuuguacuaauuuuugcaaaauuuuuaagguaauuggaauuaucaaucuuccacuaaaauagcaauuuuuaaguggcuuauuuuaaauaguugcuaaauuugcuaaaaucauguaucuaaaacacuacgcauaauauaugacaaaaauaaaugcugggaaaaaaauaaaaggauuugugguaaacaaggcugaccaaccuuuagucuuaagaaaauaucuggcugggcgcgguggcucacgccuguaaucccugcacuuugggaggcugaggcagguggaucaugaggucaggagaucaagaccguccuggcuaacacggugaaacuccgucucuacuaaaaaauacgaaaaauuagccaggcuugguggcgggugccuguagucccagcuacacaggaggcugaggcaggagaauggcguguacccgggaggcggagcuugcagugagcugagauagcaccacugcacuccagccugggcaacagagcgagacuccaucucaaaaaaaaaaaagaaaagaaaauaucugacguuuacaacaucuaaauguuugcuacaaauuuauuacuagagaauacaauauuuagguaacaugaagcaaagaaaauauuugacucuuacgauuucuaacuguuggccauaaucuucacuuucuaugaccuugaucaguggcuugagcuuuucuuucagcuucuugccuucauugacuggaaggaugaaccgaagccucaugugagcacguucuaucuucauuuucucuuuuaacugcuuuaucacuuccaaagccuaccaagacaaaaucgagaaugcaauuucuucuacuauauuauuucauaagguuuucaaaaacaaaguaguuuccauguaguuggauuagguaaugguuucuuagguauaacauuaagaacauaagugaccguuaaaaaaaaaauagaaaaauuggacuuaucaagaagaaaagcuuuuguguuucaaaaaacuaugaagaaagugaaggccaggugugguggcucacgccuguaauuccagcacuuugggaggccgaggcgggugcaucacaaggucaggaauucgagaccagccuggccaacauggugaaaccccgucuccacuaaaaauacaaaaaaagaaaaauuagccgggugugguagugcacgccuguaaucccagcuacucaagaggcugaggcaggagaauugcuugaauccgggaggcagaguuugcaaaaagagggcggggggggugggcaaagaaccugaacagagauuucucaaaagaagacagacgaggcaccaauaagcacauggaaauaugcucaaaucaucauuaaggaaaugcaaaucaaaaccacgacaagauaccaccaggauggccaucaucaaaaaggcagacaaugacaaguauuacugaggauguggagaaacugaacucuuaaacacugauggugguaaaguaaaauggugcagcuguuuuagaaauagguuugguagucaccagguauacagaaaugaaaacauaugucuacacagaaacauacaagaaauuuuauagcagcauugcucaucauagcucaaaagugaaagcaacccaaugucuaucaacugauagaugaaugaacaaaauguguuucuuuccguacagugggcuauuauuccggcauaaaaaagaaaugacaugcugaugcagguuacaacauguaugaaccaugaaaaggccacauauuguaugauuccauuuauaugaaauguccagaauugagaaguccauaacgagaggagauuagugguugggaggggccuguggggggaaaaugggggauggcuacuaauggauacugacuuucuuuuuguggugaugaaaauguucucgaaccagguagcagggaagguuccaaaacuuuguuaauauaccacuuaaaguguacauacuuuaugagugugaaauuuaugguaugugaauuauauauaaauuaaaaaauucaaaaagaaguguuaaaaugacccuuuaaaaacucaaguuuugucuuuaaaaguuugauuuggauaggaagaagaaaguccuauauacauauuuguguuuacuugaaaaaaaaaaauuaccuaucuuuacaaccccguccuuuuccuccaucucuuccccaaaccucuacccacuugcuuccaugcagacccauuuuuuuaaauuuaauuuuuuauauuaaaaaauuuagagguaggguacgguagcugaugccuguaaucccagcacuuugggaggccaaggcggacggaucaccuagggucaggaguucaagaccagccuggccaacauggugaaaccucaacucuacuaaaaauacaaaauuagcugagugugguggcacgugccuauaaucccagcuacucaggaggcugaggcaggagacuugcuugaacgcgggagguggagauuguagugagccgagaucauacuacugcacuccagccugggcaauagaguaagacucugucucaaaaaaaaaaaaaaaaaauuuagagauggggcgucccuauguuucccaggcuguuuccaggccucaagcaauccucccaucuuggcucccaaagugcuaggauuacaggcaugaaccauugugccuggccccagacccauuauuuuaaugauuucuucagagaaaacugauuuccauggcuauauuuugaugacaugagaaaccacucaccugcuguuuuguacucuuguugguuuucaccgaauaguggauguccuucauggcucucucaauaaggaucacgguguauggucucuuuguuucaggauucacacauuugucugccacaauaguugcaaugucccuaaacaucugcuccaguugugugugucuuucuuuaucugauacuugaacuucuccuuuagucaaaaucuaaaaaaaugccaacacauuuaagaaaucacuaucuuucucuaucacacacuauuuauuaacuaaccauaaaaaaugaguaacuggauggagagaaaauuaaauuucauccucuccagcuaucaauauguaaguaaugguuugagcuuugcccaaaagaugcaagaaucuuuuggcugggcucaguggcucacaucuguaaucccagcacuuuggguggcuaaggcgggcauaucacccaaggucaggaguuugagaccaaccuggccaacauggugaaaccccaucucuacuaaaaauccaaaaauuagccaggcaggguggugggcaccuguaaucccagcuacccuggaagcugaggcaagagaaucgcuugaauccaggaggcagagguugcagugagcugagugcagugaagugcacugcacuccagccugggcaacagagcaagacucuguccccccacccaaaaaaaaaaggaucugaaagaugaaauacuugaaaacaaauucaguuuucagguauaccacauucuauaaauggggcaauuuauagaaaaaugagguaauuuaguagaaaaucugauuucaggagguuuuggcaaaaaaaaaaaaaaaaaaaccacaaaaaacaaacaaaaccaccaaguucuuuauuauuagaagugacacugugcaguucacauuauugcuugguuagucuuuccuccagaaaaacagccuuuaauguuuaauauaucuacaaauacguuauaaaugguuauuaggguuagcuaugcugcagcuguuacccaccugcuuacagauuucaguuuggucaucuguuccaaacgcacugaugagaucuuccuuuuuggcaaccugaccuuuagaaacauuuacaaacacugagugggucugcagaacuucaucgaggucuuuuucccuugugagggcaggagagaaaguccuaugugaauauacuugaaacuuggacaugcauuuacauuuaaauacgagauggcaacaacaugaacggcaagacacaacaaaucccccugaugaccuuuaguguagagggcaguuuucuuuuucuuaccccccaacccccgccccuagauggaauuucacuguuuuugcccaggcuggagugcaauggcgcgaucucgggucacuguaaccucagccucccggguucaagugauucucccgccucagccuccugaguaacugggauuacaggcaugcgccaccacacccggcuaacuuuguauuuuuaguagagaugggguuucauguuggccaggcuggccucgaacuccuggccucaagugaacugcccgcaucggccugagggaacauuuucaaaacucagaaccguauuugccuuaccauuugcucacuggagaaaaaugucaugggaggacguaagaaacacaagggugggguggggugcagacagcugcugccacggaaugccagucccuagauggcagcagugaagacacuacgcacuuuaaacugcuagggcuacugagaucuaugacaccagauguacccacaacuaugacaguauucguaagacuagguucucagccaucauuauucuaggaaaaggaccacaauuacgagauuucuuggcugcagcuuuuaugacaccaacaaaacaaaaccccaaaccaacaacccaauccgaaccaaccaaauaaagaagaaacccuuggcuuaggcgccaagcucggacagcgacgucucaugcucacagcaggaauguuccauuuccuccccggccaacaccccagccuggcccauucacucgacuugggcagagacaggccgccucggaggugacggcucaggcccaggcccaggcccgagggagggggcuacucacacgccgcuccgccagccgacgaccuuguuuuuguagcaggcgauuucgaagcgcuucccggcacgcuucauccguaccacggccacauugguuaggcggaucugguuggugggggugaagaucgacaucgcggcuguucaaagacccagaagccggcgaaccagggcugacccgcgccguccagccugaaggccaccagcgccucgcgguaacgaccgaucggcgcgcggcacugacccaaccaccagugcgcggcgccgcgacucacuagcuucaggcagccgucacagugugucuggcaggcuuacuuac

SEQ ID NO: 191542 - RNA, 7899 nt, Homo sapiens
guaaguaagccugccagacacacugugacggcugccugaagcuagugagucgcggcgccgcgcacuggugguugggucagugccgcgcgccgaucggucguuaccgcgaggcgcugguggccuucaggcuggacggcgcgggucagcccugguucgccggcuucugggucuuugaacagccgcgaugucgaucuucacccccaccaaccagauccgccuaaccaauguggccgugguacggaugaagcgugccgggaagcgcuucgaaaucgccugcuacaaaaacaaggucgucggcuggcggagcggcgugugaguagcccccucccucgggccugggccugggccugagccgucaccuccgaggcggccugucucugcccaagucgagugaaugggccaggcugggguguuggccggggaggaaauggaacauuccugcugugagcaugagacgucgcuguccgagcuuggcgccuaagccaaggguuucuucuuuauuugguugguucggauuggguuguugguuugggguuuuguuuuguuggugucauaaaagcugcagccaagaaaucucguaauugugguccuuuuccuagaauaaugauggcugagaaccuagucuuacgaauacugucauaguuguggguacaucuggugucauagaucucaguagcccuagcaguuuaaagugcguagugucuucacugcugccaucuagggacuggcauuccguggcagcagcugucugcaccccaccccacccuuguguuucuuacguccucccaugacauuuuucuccagugagcaaaugguaaggcaaauacgguucugaguuuugaaaauguucccucaggccgaugcgggcaguucacuugaggccaggaguucgaggccagccuggccaacaugaaaccccaucucuacuaaaaauacaaaguuagccgggugugguggcgcaugccuguaaucccaguuacucaggaggcugaggcgggagaaucacuugaacccgggaggcugagguuacagugacccgagaucgcgccauugcacuccagccugggcaaaaacagugaaauuccaucuaggggcggggguugggggguaagaaaaagaaaacugcccucuacacuaaaggucaucagggggauuuguugugucuugccguucauguuguugccaucucguauuuaaauguaaaugcauguccaaguuucaaguauauucacauaggacuuucucuccugcccucacaagggaaaaagaccucgaugaaguucugcagacccacucaguguuuguaaauguuucuaaaggucagguugccaaaaaggaagaucucaucagugcguuuggaacagaugaccaaacugaaaucuguaagcagguggguaacagcugcagcauagcuaacccuaauaaccauuuauaacguauuuguagauauauuaaacauuaaaggcuguuuuucuggaggaaagacuaaccaagcaauaaugugaacugcacagugucacuucuaauaauaaagaacuuggugguuuuguuuguuuuuugugguuuuuuuuuuuuuuuuuuugccaaaaccuccugaaaucagauuuucuacuaaauuaccucauuuuucuauaaauugccccauuuauagaaugugguauaccugaaaacugaauuuguuuucaaguauuucaucuuucagauccuuuuuuuuuuggguggggggacagagucuugcucuguugcccaggcuggagugcagugcacuucacugcacucagcucacugcaaccucugccuccuggauucaagcgauucucuugccucagcuuccaggguagcugggauuacaggugcccaccacccugccuggcuaauuuuuggauuuuuaguagagaugggguuucaccauguuggccagguuggucucaaacuccugaccuugggugauaugcccgccuuagccacccaaagugcugggauuacagaugugagccacugagcccagccaaaagauucuugcaucuuuugggcaaagcucaaaccauuacuuacauauugauagcuggagaggaugaaauuuaauuuucucuccauccaguuacucauuuuuuaugguuaguuaauaaauagugugugauagagaaagauagugauuucuuaaauguguuggcauuuuuuuagauuuugacuaaaggagaaguucaaguaucagauaaagaaagacacacacaacuggagcagauguuuagggacauugcaacuauuguggcagacaaaugugugaauccugaaacaaagagaccauacaccgugauccuuauugagagagccaugaaggacauccacuauucggugaaaaccaacaagaguacaaaacagcaggugagugguuucucaugucaucaaaauauagccauggaaaucaguuuucucugaagaaaucauuaaaauaaugggucuggggccaggcacaaugguucaugccuguaauccuagcacuuugggagccaagaugggaggauugcuugaggccuggaaacagccugggaaacauagggacgccccaucucuaaauuuuuuuuuuuuuuuuuugagacagagucuuacucuauugcccaggcuggagugcaguaguaugaucucggcucacuacaaucuccaccucccgcguucaagcaagucuccugccucagccuccugaguagcugggauuauaggcacgugccaccacacucagcuaauuuuguauuuuuaguagaguugagguuucaccauguuggccaggcuggucuugaacuccugacccuaggugauccguccgccuuggccucccaaagugcugggauuacaggcaucagcuaccguacccuaccucuaaauuuuuuaauauaaaaaauuaaauuuaaaaaaaugggucugcauggaagcaaguggguagagguuuggggaagagauggaggaaaaggacgggguuguaaagauagguaauuuuuuuuuuucaaguaaacacaaauauguauauaggacuuucuucuuccuauccaaaucaaacuuuuaaagacaaaacuugaguuuuuaaagggucauuuuaacacuucuuuuugaauuuuuuaauuuauauauaauucacauaccauaaauuucacacucauaaaguauguacacuuuaagugguauauuaacaaaguuuuggaaccuucccugcuaccugguucgagaacauuuucaucaccacaaaaagaaagucaguauccauuaguagccaucccccauuuuccccccacaggccccucccaaccacuaaucuccucucguuauggacuucucaauucuggacauuucauauaaauggaaucauacaauauguggccuuuucaugguucauacauguuguaaccugcaucagcaugucauuucuuuuuuaugccggaauaauagcccacuguacggaaagaaacacauuuuguucauucaucuaucaguugauagacauuggguugcuuucacuuuugagcuaugaugagcaaugcugcuauaaaauuucuuguauguuucuguguagacauauguuuucauuucuguauaccuggugacuaccaaaccuauuucuaaaacagcugcaccauuuuacuuuaccaccaucaguguuuaagaguucaguuucuccacauccucaguaauacuugucauugucugccuuuuugaugauggccauccuggugguaucuugucgugguuuugauuugcauuuccuuaaugaugauuugagcauauuuccaugugcuuauuggugccucgucugucuucuuuugagaaaucucuguucagguucuuugcccaccccccccgcccucuuuuugcaaacucugccucccggauucaagcaauucuccugccucagccucuugaguagcugggauuacaggcgugcacuaccacacccggcuaauuuuucuuuuuuuguauuuuuaguggagacgggguuucaccauguuggccaggcuggucucgaauuccugaccuugugaugcacccgccucggccucccaaagugcuggaauuacaggcgugagccaccacaccuggccuucacuuucuucauaguuuuuugaaacacaaaagcuuuucuucuugauaaguccaauuuuucuauuuuuuuuuuaacggucacuuauguucuuaauguuauaccuaagaaaccauuaccuaauccaacuacauggaaacuacuuuguuuuugaaaaccuuaugaaauaauauaguagaagaaauugcauucucgauuuugucuugguaggcuuuggaagugauaaagcaguuaaaagagaaaaugaagauagaacgugcucacaugaggcuucgguucauccuuccagucaaugaaggcaagaagcugaaagaaaagcucaagccacugaucaaggucauagaaagugaagauuauggccaacaguuagaaaucguaagagucaaauauuuucuuugcuucauguuaccuaaauauuguauucucuaguaauaaauuuguagcaaacauuuagauguuguaaacgucagauauuuucuuuucuuuuuuuuuuuugagauggagucucgcucuguugcccaggcuggagugcaguggugcuaucucagcucacugcaagcuccgccucccggguacacgccauucuccugccucagccuccuguguagcugggacuacaggcacccgccaccaagccuggcuaauuuuucguauuuuuuaguagagacggaguuucaccguguuagccaggacggucuugaucuccugaccucaugauccaccugccucagccucccaaagugcagggauuacaggcgugagccaccgcgcccagccagauauuuucuuaagacuaaagguuggucagccuuguuuaccacaaauccuuuuauuuuuuucccagcauuuauuuuugucauauauuaugcguaguguuuuagauacaugauuuuagcaaauuuagcaacuauuuaaaauaagccacuuaaaaauugcuauuuuaguggaagauugauaauuccaauuaccuuaaaaauuuugcaaaaauuaguacaaagcacacuauggaaauuuacauugaguuuucagagauagcucaauugcaugcuuuacuccagugcugaucauaauccuaaaagacaaucccaaaugccacaaucccaauguugaaaucauaaaaaaaucaaaaucucuaaaguccaaagccugaacuucuaauaucuugaaaaucacaguuccaaaagauugaauccuggcugggcgcgguggcucaugccuguaaucccagcacuuugggaggccaaggcagguggaucaccugaggucgggaguucgagaccagucugaccaacauggagaaacccugucucuacuaaaaauacaaaauagucuggcgugguggcacaugccuguaaucccagcuacucgggaggcugaggcaggagaaucacuugaaccuggaaggcagagguugcggugagccaagauugcaccauugcacuccagccugggcaacaagagcgaaacuccaucucaaaaaaaaaaaaaaaagauugaauucugaaugaugaaauucugaaagcugaauucuggcaaaaggauuagcacucuuugaguuguaugcaggauagucgcgucugguuaauugcaucaugugaggaaaagcuaggaccuuguuauugucuucauuugaaaauuaaaaaugguuuaaagagaugagucugggugccaaguugauaagggguggaauuguggauguaauuuuaggugucaacuugacuggaaaggaaucccuagaagccugauaaagcauuguuugggguaugucugugaggguguuuccagaggauauuagugugugaaccuggugacacuaaacacagaacauuuuaaagaagcagcgaaaccauuauguccuuaugaccucaccccacagcuucaaacacaguguaaauugagcugucuacaaauucauguuuucaaggcuuugcagcuuauuuauuuauuuauuuauuuauuuauuuuugagacaggguuucacucuuauugcccaagcuagagugcaauggcgugaucucagcucacugcaaccucugccucccggguucaagcgauucuccugccucagccucccgaguagcugggauuacaggcaugugccaccucgcccagcuaauuuuguauuuuuaguagagacggggucucuccauguuggucaggcuggucucgaacucccgaccucaggugauccacccgccucggccucccaaagugcugggauuacaggcuugagccaccgcgcccugucugcagcuucuuuuuaaaaguaaaugagcuguagagaaguguugaguaugugaguauccacuguagaugugaacuaacucaucugacacuacuugaaguucuaaaaucuuugcaaaacuguacacaugggccaggcacaguggcucgugccuguaaucccagcacuuugggaggccaaggugagcagauaacauggugaaacccuaucucuacuaaaaauacaaaaaauaagccagguguggugguggguuccuguaaucccaguuucuugggaggcugaggcaggagaaucacuugaaccugggaggcggaggcugcagugagccaagaucacaccacugcacucuaucucaaaaaaaaauaaauuaacauacacauggugucuacauaagucuucacauugcuuuuucuccuucauacguggaggugacuuuacugagcuauaaaauguaaugcuaaauuuuaguaugagaagaaucagaguuuucuaguuugucccuuccauuuacagcugaagaaucagaauaaguguuuaaacauagggauuaaugccuugucacagggggcuacauggacacuugagggcagaggcuaaacuggaacccagugugccgcccuacccauugucuuaucuauugcaccauagaacugugguauuauuagagaucuggacagcauugugcuugccucaaaggaaguuaaagcugaguuuauucugugucuugcucauccucaugugguaaucugcuacguuaaauguuucagguaugucugauugacccgggcugcuuccgagaaauugaugagcuaauaaaaaaggaaacuaaaggcaaagguucuuuggaaguacucaaucugaaagauguagaagaaggagaugagaaauuugaaugacacccaucaaucucuucaccucuaaaacacuaaaguguuuccguuuccgacggcacuguuucaugucuguggucugccaaauacuugcuuaaacuauuugacauuuucuaucuuuguguuaacaguggacacagcaaggcuuuccuacauaaguauaauaaugugggaaugauuugguuuuaauuauaaacuggggucuaaauccuaaagcaaaauugaaacuccaagaugcaaaguccagaguggcauuuugcuacucugucucaugccuugauagcuuuccaaaaugaaaguuacuugaggcagcucuugugggugaaaaguuauuuguacaguagaguaagauuauuagggguaugucuauacaacaaaagggggggucuuuccuaaaaaagaaaacauaugaugcuucauuucuacuuaauggaacuuguguucugagggucauuaugguaucguaauguaaagcuuggaugauguuccugauuaucugagaaacagauauagaaaaauugugccggacuuaccuuucauugaacaugcugccauaacuuagauuauucuugguuaaaaaauaaaagucacuuauuucuaauucuuaaaguuuauaauauauauuaauauagcuaaaauuguauguaaucaauaaaaccacucuuauguuuauu

SEQ ID NO: 191543 - RNA, 557733 nt, Homo sapiens
cggcggcaaggcccugggggauccgcuggggaggagcuggggaggaggccggagcugcauggaguuucuagggcgcgcaacuccagcggggccucggccacugggcuccggggcgcagcgaggcagccgcgcacaugggcugaacccgcgcggccagcgggagcgggagggguagaggagcgcgcggugcagggggugcggggcacacguccccagacgagagcagaggacaaggacagggaggcacgcgcccagaucgcgcuccgagucgacgagggggcucgugcaggucccggcgcgcgcguggggagcggcccgggggcgccgagggagccggcggcagcgaggaugccggcacggggacgcggcugccugcugggggugugagcgagaggcugagcgcugcccgcucggcgcauccauuccgcaccgcccccucccugcgggccucggaggaagccccccgcgcugugcggaggcgccucggcugccgggcugcggagccccggcccagcaagaggugagugccgccgccggcucccuagcuuacccgcgcgcgcgcucucuuuucuucuucccucgguccucgcuucucucuaggguguccaaacccccgggcugucgcgggcccuggugcucagagugggcagaugguuggcagacagcgccucccguaccuguuggcuccgacacuggggcacccaccccgcgggcugggggccgcgccggccaccuugccuuccguggagcuggcuccuggccgccugccuggggacguggggcuagggaagggccgcggcggacucggcugucccggcaccgugcgggcuggaggcugggagccgcucuucuagcccccaggcgccaguggccaccaggcugcgcgcccccgcccgcaggcgcccgggcgauggggagggagggcaggggacucggagccgcaccgcagcccaggugggagcgcccggcggcaaccaggucucuucgcgaagccggagucauggcgaucgggggaggcgggaggcaggguucucuccaccuccggccccuagcgcugacugcuugccuuucugggcgcacgcuccucgccgccacccaccccgaguccgggggcgccagggugcaagggguaaccagagaggccucugcaguccggcugggaccuagucucugagcuccaagcagcuggaugggucuggcgcccaggugggggugggauccgucuuccccggacagucuggguuuacucggguuccuaguuucuccggacuagcgcagcgcggagugaacuucccgagacuugguccgagggcgccuaggcagcagcagguaguucugggccacccuuggggcgagggcgagcgggggacgccccauccagacgggcuggggguacagagcgugcaccgaggggaucggcuugcgucuuagccuugggccacgugcgcccgggccaccagcccaccaucguuucccacugcucuuuuuucuuggacgaggcuugugugaggaaggcgccuuucuuccauuugggucgaagcccguagcuccugggugaagcggugccugcaguucccugagugccaagacuggggcgccagccauccccaggcccugagccgguuuucugcaaaaaaggagacuuuuuugggcucagggaauagcagcuuagcgccggcuguguguggcugggaagucuguuuaguggugauaauaacuacauucuagagugacccacaguagccucugcgacagaguugggaugaccuucucagaaagaauggguagauuucugcgcuguguguguugagacacacgcaacauucgugcacauagaacucaugagcuccuagcauuuucagguucugcuucuuuaacugaugacuuuugcucaaaaagggaaauuauuuuucaauucgggcaucagagcuuuggaaaggaauuuaaagccauuuggugugaaauugucuugaggcuagaacaggacguguuuuucauagaagccccauuccagcucuccuucuuggcuuguucgugguuuuauuucauuuuuuguggggugggaggagguguuggaagaagaauguggaguuuugauuuuuaucugcuaccuguacucauguccaggugucaccucagaccucucggccuugugguucugucaccacgcccaguuuaggauucauuccagggcuccaggaacugcauaacuuugcuaguucccccggcaguugguggggucuucuaccaaagccccaaggaugcccugagcuguguuuccagaguagccugcccugguggaagaccaguggaauggcucuguuuguugaguucacugcagacguguggguuuuucauggcaauagcugcaugaagcuguuuacugagaagcuguucuacaauggugaaguugguuacuggguguauccaaguggaguaaugaaaacaaaacucuuuggaaauccaauccucacgauauuuuauuggaggagagcuaaauccucuuagaauuguucaccaagaugucaccuuucccugaacucugaaagcaacuauugccaguaaucaggccuucggcuagggugcaggauaagggcuuuuuagaacgaaaauaauuuaauucagcugcuucuguugagaaacgaugggcaagacuugauugacacacaugaugcccuuuccucuguaaggggaggggggguacagguugagggguggaugacaacuguucauuguugaguuuuacauuuaucucuccaguggguagcuucugauccguucauaaauauugggcagggcuggggucgcauuuagaaauuucuuuuucauagaaacuggucucuugagggucaccagccagggugggauaucuguggcugguccuuccuucuguuguggugugugcaguggugucuuuuaccacauucuuguauugaccaccuaugcaguguuugcugguugucagaagggggcacugguucucauuacgagagaaauuccaauugauagacuuuggacguuuaaagccuucggagacccucuuaauucagauuucugagacccuacuugugugccagacccuuucacaccuuugagcucaugucauccucauucuucguguuuggaaacugaugcaaagggaagugaaaucacuuuuccuggggcugugaagcuugcaggucagaagcagaguuacgguuugaggcuaacaggcuggguuucgauccuaugugcggggcacuuuccacauugcuuccuuaggaaaaguauuuugggaaccuuugaccugcaguaacuuguuuagagucagacacagagugggugcccuauauucguugagugaaucuaggucagcagcucauuccucauuccuggugaggaaacugaggcacaggaggagcugugucugugcaguuggucugggguggaaggagaaucccacagcaaaacccuuucuuugucacgugugccuguacugguuugagcccagacugguuugaugauugaugguaagcuuuuuuuuuuuuuuuuucugcauauucccuuucuguacccauguugguauagguucacuugggacuucagcugguguagucagagugucugaaauguccuuucacgauugagaaccauuaagcagugcaaccagcaacagccucugaugcucguuaaaacagugugaguucugacucuuaagcuaugaaaccauccuucaagauuagcagaacauuggcagauuucucagaacgcucaauuugaggauaauuccaaaugugguucggaaggaggaaaaggaaaacaccauuguugcauccaaccugggguuuuucaaugugaauuaaguuuuuaaucauuuaacauucaacaaacauuuauucagugccuauuaugugguauggauagauagaugaaguugacacagugccugucaucaaaaaauucacagauuaguggggaggccagaccauguguuaggguugaacauuugugaacagagauggaugguagcuaggcaaggguggaggugaugucugagcugaguuuaaaggaugauuaggacgugguuagcuuuucauggguauucuggugcagaggaaagggugggaaagucugagaaauuagaacacguggagaauaugaggaagcagcugguaguuuggaguucuuggugcuuaaagguugagacagggagguacaaaagaagugaccagaaugauagauggugggggccuuuagucaggacccagggacucagcauuucuccguuaggauggcauggucaguuguggcuggagacuucguggugaauggauuuggcacugagaagaccagaaacauggauaccagggaggaagcuggcucugaaagccggacaaggcugaugaggccaugguggggaggauggagaagaugggaugaauuuggcaaacaggagaguugucaguuaggauccuuggguugcaagcaacagaaacuaagucuggcuaacaacgucaauaaagaucgcauuaagaauacugauggaaacucacaggauuaagaacaucccugaagaaccaggcauggaauacucaggcauuaggcaguccaggggaucucaguggcaggaauugacuuguggucucucccaggggaugcuauggaaguaaaugaucaccaaccuuuucuauuauuauugagguaggaggugggacucaacuuuggagguggggcucaauuugguccaaguagcuggaccaaauugaggaccagcuaaaacagggcugggguggaagcagcucuccauaagacacacccacacaugugccaugucaguuuacuguugccauggcaacaccgagacguuaucaccccuuuccauggcacugacccaaccacccagaaguuaccacccuauuucuagaaauuucugcauaaacuguccuuaauuugccuguaacuaaaaguggguguaaauaugacugcagcacugcuucuggggugcuaccuugcacacauugccuagggaauagcccugcucuacaaggaguaucucugcugcugcuguacacugcugcuucaaugaaaguugcugucucccauugacaauagcaaagacauggaaucaucuuacaugcccaucagugauagacuggauaaagaaaacgugguacauauacaccauggaauacuaugcagccauaaaaaaugaugaguucauguccuuugcagggacauggauggagcuggaggccauuauccuuggcaaacgcaggaacugaaaaucaaauacugcauguucucacuuauaaguggaagcuaagugaugagaacauauggacccauggggaugcacaaacacacuggggccuguuagaggguggagggugggaggaggaagagcaucaggaagaauaccuaauggauucugggcuuaauaccugggugaugggauggucugugcagaaaaccaccaugguacacauuuaccuguguaacaaaccugcacauccugcacauguaccucugaacuuaagauaaaacuuggaaaaaaaacaagguaacaguuggaaaaaaaauaaaaugaauaaguaaauaaauagauauucugugacuauuagaaaaaaaaguugcugucucacaccccuggcuugcccuugaauucuuuccugggcaaagccaagaacccucccaggcuaagccccaauuuugggcucaccuguccuccguuauuguuacuguaucauucugcugcauucaagaugcucagaggacauaucugauuggcauaguuuugggucccuguaucuagggguagguuucugaaaagucacugggauugggagagacuguuuuccuccuccuuuuucuuuuucuuuuuuuucuuucuuuuuuuugauggagucucgcucuguugcccaggcuggagugcaguggcgugaucucggcucacugcaacuucugccuccuggguucaagcgauucuucugcccccgccucuugaguagcugggauuaugggcucccgccaccaugcccggcuaauuuuuguauuuuuaguagagacgggguuucaccauauuggccaggcuggucucgaacuccugacuucagguaaucuaccugccuuggccucccaaagugcugggauuacagguaugagccaccgugcccggccaggagagauuguuuucugaaaggaaacuggaaggauucugcuaaaagacagugacagugauguugagcuugucuuccauaggagggaaaauuggcaggauuauuaauugguggggaagugggagaaagggaaggugucacuguuggguuucugguuuagguaacaggguggagaaguaaaaucgaaguccgagcaagacuaaauaacugguuugccuucccacuggcagggcugugggcagcucuccaugaccaggcuauuggagagggugacaaucuauuuuaaaaagccucauuaagggacugugcugcugugaauaagaccuauuuaaguagguuacuuuaucucaugcaccacaaaucuggauucuuugaaaaugcuuucauucauccaaccagaauguauugagcaucucugguucagguacuggggaaaaugaugaauucgucagacagagaugguacccuuauagucuagugguguaagacacaauaaaaaauauggaaauaaaauuggaggauauaauugagacagaugcaagcacugcuucagauuggauggccaacaaaggucucucucucuuuuuuuuuuuuuuuuuuuuggagacagucuugcucuguugcccaggcuggagugcaguggcacgaucuuggcucccugcagccucugcuuacuggauucaagugauucuucugccucagccuuccgggaagcugggauuacagacguacaccaccacacccagcuaauuuuugugucauuauucuuauuuuuugagauggagucucacugugucacccaggcuggagugcaguggcaugaucucaacucccugcacccuccaccucugagguucaagaaauucuccugccucagcauccggaguagcugggauuacaggcgcccgccaccacgcccagauaaauuuuguauuuuuaguagagacgggguuucaccauguuggccaggcuggucuugaacuccugacaccucaggugauccgccugccucagccucccaaagugcugggauuacagguauaagccacugcgcccgaccuaauuuuuguauuuuuauuuuuauuuauuuauguauuuauauuuauuuauuuuuugagacggagucuugcucuguugcccaggcuggaaugcaguggcgcgaucucggcucacugcaagcucugccuccaggauucaaacgauucuccugccucagucuccugaauagcuggaauuacaggugcguggcaccacgcccagcuaauuuguggauuuuuaguagugacggggucucaccauguuggccgcgcuggucucgaacuccugaccucaggugauccaccugccucagccucccaaagugcugggauuacaggcaugagccaccgcgcccaaccaagaaaggucucacugaugagcucuauuuaggcugauaccagaaugacaugaagggauaaaguggggaaauaucugcggaagaacuuccagggugugggaacagccagugcaaaagucucaaagcaggaaugaacuggguucauuagaggagaaggaaggagacugguguggcaggagaugaguucagagagaugggggcuagcucauauagggucacccuguggaguuuggguuugauacugaguucaguagaagccacugagggguuuuaaacaggugaaugauaugacuuagucuauauuuuccaaagaucauccugucuccagcuguccauucugccugcacuacugugguacaauaaagugagucuuuauccaucagaguguaaaauaaaauguaguguuuaacaguaacagauggagagaaaaugcuuuggugaccuuaauuuggugauuucuaacguaccaguuaaguguggauacaaacaaaacugcaauuauaguaugauuucaguuuuguuuaaaaacgugguacagaagaacaauggaaauaaauggaccaaaaauguuaacaaugcuuguccaaagcuguuggcguuaugaaugauuuuaugguuuugcaaaugaacacacauuuacaaucggaaaaauguuuguuuuaaaauguagacaccgggcugggcacguuggcuuacgccuguaaucccagcacuuugggaggccgagaugguuggaucagcugaggucaggaguucaagaccagccuggccaaccuggcgaaaccccgucucuacuaaaaauauaaaaaacuagcugggcaugguggugggugccuguaaucccagcuccuugggaggcugaggcaggagaauugcuugaacccaggaggcggagguugcagugagcugagauugugccacugcacuccagccugggcaacagagcgagacucugucucaacaaaaguaaauaaauguagacaccgaugaucaccaaugccuugaauagaauguugggagacuauaucuacaaaacacuuuccccuaccaucuuauuuugggaguuuuaaucucaaaaacccaugguccugguugggacaaaacacaggaugcucaucguauuagucuguucucacacugcuaauaaagacauaccugagacuggguaauuuauaaaggaaagaggcuugaugcacucacaguaguaccacaugccugggaggccucacaaucauggcggaagaugaaggaagagcaagaggaugucuuccaugauggcaggaaagagcuuguguaggggagcucccauuuguaaaaccaugaaaucucaucagacuuauucacuaccaugagaacaguaugggggaaaccacccccaugauucaauuaucuccaccuggccccacccuugauacgugaguauuauugcaauucaaggugagauuuggguggggacacagccaaacuguauuacauguuuugacaaggugcccaauaaguggcucuguuuugugcuuaagacauuuuuuagcgaugaaaguaaacauuuuuuuuuuaaaaaaagaaauuaaaagcuauacagaaauguuacauagaacuuggaaggcaccuuucuucacucucauucucaauaccauuaacauuucaaguacauauauuguuagauuuuuuucuaugcauuucaaauacauacaucuaaauuuuguugaauuugagguauugcuguaagaaguuacuuugcuucuaaauuacucuccaaguuucuucucauagagguugaaaccaagaugaccuuuuuuucccccuuuuaaacaaauuauuaggaaauuugaacacauaacuaggaagaacugaaccuugccuuuuuaguauucagaguguuacugaaagcauaauuuauacuuaugaagaauagagcaauuaaauauucauuaaaagcuuauuucugaacauuuaaacauuauugcuuucccaaacaucauuggaucccaaaaguuuguaucacgauuacaaaucgcgugcacuuuuucauuaucaaaaguuaggcaauaggaaaauguagaagugcaaauucgacagcuuggcuaauuauuuuggugucauauuuguuacaacuaaguauuauucuuugaaaacaggaaaagaaaaacguucaaugaaguguucguuuauuuauuuauuuuugagacagagucuugcucuguugcccaggcuggagugcagugccgugaucucagcucacugcaaccuccgccugcuggauucaagggauuccccugcgucagccuccugaguagcugggacuaaaggcacgugucaccacaccuaauuuucguauuuuuaguagagacggguuucaccauacuggccaggcuggugucaaacuccugaccucaagugauucucccgccucagccucccaaagugcugggauuacaggcgugagccacugcacccagccucaaucaaguguuacucagaaccauugauguguucuggaagagcuggauguucacauaaagcccaaguugaccuuguggucucauccuacagacugggcuugggggcuucauugucaggaauuaacugccacaaacucagucucaauaugacugaauaguguuggauuggagucucaugugauucagcagaauuacuaccuuaaaaaucauuaacuaaacauauccuuuuguggugaaaagaaugaauauguguuuagaagacauugacugcaaaguaauagaaccauggaauuuaaaggagaagaggaaccuugguuagcucauuugacagauggggagacucagucagagagacugagugacaugugcacugucaaacagaguucauuucacaccccagagcccuuuccccuacacucagcuguggcuccuuguuauuggaaaccgaauuuauuuuuguaaacccaagaauuaggaaaaugcuccgaaccucaugaaaaccgagaggguuuuugagcuguucauucauucugcaaauuguaaucuguuuguguacugauaacaggccuaauuacuguguaaacauuuuuauagccugguaagaaaaccucaaacaucuguacugaacacugauguggcgucucagccuccagcauuccuacugcugguucggaaaaccaguugcucugcuuuuuaaucugaucuguggcugaugauucauuuuauaugcauacacauaaacacauauuccaucucagcaggcaaacuagcuuagugcuuaguaggugucaucugcuuuauuucucccauuuuacagaugaagaaacagagauguagccaggucacagagauguugcacagggucacggcuuaguacuuggaaacccagagguauguaacccacuagcuaaagccuucauccuuucugugccuauccaagacaagcaaccuuugugcaaggacgaucaggaucugaguuuguaaaaccacuuucaauaguuaaauuaaggccaggcaugauggcucacgccuguaaucccagcacuuugggaggcccaggcaggcggaccucgggaggccaggaguucgagaccagccuggccaacauggugaaacugcgucucuacuaaaaauacaaaauuuagccaggcgugguggcgggcaccgguaauccuggccacucagaaggcuugaggcaggagaaucgcuugaacccgggagguggagguugcagugagcugagauugugccacugcauuccagccugggugacagaacaagacccugucuucuaaaaaagcccaccaaaaaacaguuaaaucacauuuuuugcccagaugucaagcggcagagaggucucugcgagguuauugcauuuucaagccuguuuuguggguugccaucaauccguucccuucaugagucacuuggugggagcaggucaccaauagaucaucugcccucagcagagaugggugguuuucuuuuccugccaagacccaagccucaaguuauuuaccuaggcaacuaacugacuugguuccugcauuauuuuuauuuuauuuauuuuugagacagaguuucacucuuguuuuauuuauuuauuuucgagacagaguuucaaucucguuguccaggcuggagugcaauggugugaucuuggcucacuguaaccucugccuccuggguucaagcgauucuugugccucagccucccaaguagcugggauuacuggugcucaccaccacgcccggcucaguuuugcauuuuuaguagagacaggguuucccuauguuggccaggcuggucucgaacucuugaccucaggugauccacccaccuuggccucccaaagugcuggaauuacaggcaugagccacugcacccggacagcauuauuuucauuuauuuauucagagacagaaucucuaucacccagacuagagugcagagucacaaucauggcucacugcagccucaacuuccugggcucaaaugauuuucccaccucagcuuccugaguagcugggaccaaaguuugccaccaagcucagcuacuuuuaaaauuuuuuuguagagacgggguuucaccauguugcccaggcuggucuugaacuccugcccuuaagcaauucuccugccuuggccucucaaaagugcugggauuagagguaggagccagugcacccagcaaucuuuaaguaaacgcugaaauucucuaauucucgacacccaaagagauaaaugcaucugucgagcuuccaaaaacccagcacagaacucccuggaacccucaaaggguaguaggcaacagggaaaaauuugagacugagagcaguggcucaugccuguaaucccagcucuuugggaggcugaagcggguggaucacuugaggucacgaguucaagaccagccuggccaacagggugaaacccugucucuaccaaaaaaauacaaaaauuagccggguguggugguacacaucuguagucccagcuacucgggaggcugaggcaggagaaucacuugaacccgggaggcggagguugcagugagccaaguuaccccauugagcuccagccuggccaacagagggagacucugucucuaaauaaauaaauaaauaaauaaauaaauaaauaaauaaauuacaucauuuaaaaggagggaaaaagagagagagagccagagcugaaaaugagcuuuccacuccuagggaaagauuuuggagguuauuggggaauaauauuaggagggaagguaaaugcaagaggcagguaugauugggacagugaccccgucauaaaugauaacuccagagaugggaugacccugcuguggucuuggaaaaggaugguuaucagugaugcuuuuucaggaaacagaccuuucuggaggaggugaaaucccuccagaacuuggauuugagugcuagaaucugaagcagagauuuuaauucagugguucucaaacuuugcugcacauuaaaauucucuggggaggcuuaaaaauuccaaugcucuaaucacaucccaggagucuccuggggccugggaggcaguggugauuccacuguacagccaacuuugcgaaccagggcacucggacaccauuucuccaagggaugugccaaccaggggaucuuguugaacugcauuuaaaaaaacaaaacaaaacaaaaaacccagagucucacucugucacccaggcuggagugcaguggcacagccucaaccuccugggcuuaagugauccuccugccucagccucccgaguagcugggacuauagacgugugccacagcacccggcuaauuuuuguguuuuuuguacagaugggguuucgcuauguuucccaggccagucucaaaaucuuggacucaagcaauccacccaccucagccucccaaagugccgggauuacaggcaugagccaccgugcucagccuaaacugcaaauuaugaucguugaguuuggggaaggcaacucuuuuuucccuuuuuuucuuucucuuuuuguucucuuuauuuuuuauuuuuuuuuuuuugagauggagucucgcucuguccccaggcuggagugcuguggcgugaucucagcucacugcaaccucugccucccagguucaagcuauuccccugccuuggccuccugaguagcugggauuacaggugcaugccagcaugcccagcugauuuuuaaaauauuuuuaguagaggcgggauuucacuauguuggccaggcuggucucaaacuccugaccucaggcaaucgcccguggagcaggcauuuccaacaagcugcagccaccacugcuauaggguggaccacagugggacuaccaagaugcuaguuaagagaagcauuuuccugacauccguagcuucacacgaagggcuuccagaaucacugccuuuucaugagaugccugguagcguggguucauccagggcaggguuagagaacaaaggacuggguuccugccuuucccaccccucagaacaagacagacucacugcaaaggcucacagcacacucugaguccucucuacagggucccucucagaaccaguugucaggaugaaacuuauuuauccuucaagauuuagcauauucuccugucccuggucaggaauuuuuuuuuuuuuuuucugugugguuugaauuacaaauugguuuuuuugcgugccuuccccuccccuccccuccccuguccuuuuucuguucccacuccacccaggauauuuauuuauuuaaaaauuuuuuugauuuuuguggguacauauuuauaggguacaugagauauuuugauacaggcaugcaguguguaauaaugaugucaggguaagugggguauauccauccccucaaacguuuaucccuuguguuaugaacaagggauuuuaaauuuuuaaauuuaaaauuaaauuauuuuugacuauaguuacccuguuguccuagcaaguacuaggguauuauucauucuuccuauuuuuuuguacccauuaaccauccccacaucccccacauucccccacuacccuucccagccucuggaaaccauccuucuacucucuaucucuaugaguucaauuguuuuaauuuuuaguucccacaaauaggugggaacaugcaaaguuugucuuucugugccugguuuauuucacuccuggucagaauuuauagugucagaauuggaagcuuggagaaauggaaaggaacuuaggaauuaucuagucuaaacaaguccccaaccccuuggccauggauggguacugacugguccauggccuguuaggaaccaggcuacccagaaggaggugagcgguggggaagggagcggugcugcuucuguauuuacagccacuccccauugcuuacauuaccguaaaccugagcuccgccuccugucagaucagcggcaguguuagauucucauaggaagccuauugugaacugugcaugcaagggaucuagguugcaaccuccuuaugagagucuaaugccugaugaucugucacuaucucccagcacccccggaugggaccauccaguugcagaaaaauaagcucagggcucccacugauucuacaugauggugaguuguagaauuauuucauuguauauuacaaucuaauaauaauagaaauaaagugcacgauaaauggaaugugcuugaaucauccccaaaccauccucuccugcccccgguccaugggaaaaacugucuuccacgaaacugguccuuggugccaaaaauguuggggacagcuggucuaaaccacuguguuuugugguggaggaagcugggacccagggugauuuguuuagagucacagaccacuagaacaggaggucugcucaggaggacagacguggcaggaagaugccaagagagaugacacuuugugcuguucuugguaagggagaaucaggagacagagcuauccagaaagacugcggguauagucacguuaaaggcaccugugacuccagcgaugucacaguuaauuauaccugugauuuuccguccccucccuccaggcaccucaccaacuuuaguuaacuacacagaagcuuaaugaaauucuuugcuucugcaguuggaguugacaccuugacagauguucaacagcuuguuuccaggugggacgcugauguaggcugccccacuucacgcaaaacaauuacguuuacgauuuucgcccaaaauauugucuccugucguugaaacccauagagaacacuuguaaccuauagauuucuugguguuguggugaauauguucagcuuguuguaagaauaguucauaauugaugcucuuggcauuuaucacccagccgugaugugcucaacgcgugaugacuaauaaguuguauuucguuggauccuuuuuucuugcuuucucaacccaagucaccugucucagcaugucagugucgacagggacgguuuccugcccggcucuuugugagcugccuugagaugaagacaauaaaugcgaaacucaaggacucaaauagacagugcuuuuucagggugugugcauuauguccuagaagaucaaguguuuaaauugaauaggugaagucuuagggggcagcugaaagugagcauaaagauugaggcagcauacuuacagcuuaugguuauguaagugcugcuuucuaaguacuuggcauagguuaauucauuuaaucuuuucaauaacguuuuuauggaugagggcaccuaaccccagagaaguuaaauaccuggcugaaagucacacagcuguggacuagugaguuuggacucaugacuucaaaagccaugcucuuaaccugcuagguuaggcugccucugugauucuuuuuuuuuuuuuuuuuuuuuuugagauggagucucgcucugucgcccaggcuagagugcagugguguggucucggcucacugcaaccuccgccucccuggcucaagcaauucuccugucucaggcucccgaguagcuggaauuacaggugcaugccaccaugccuggguaauuuuuguauuuuuaguagagaugggguuuugccauguuggccgggcuggucuugaacuccugaccucaauugauccgaccaccgcggccucccaaaguguugggauuacaggcgugagccaucacuuccagcugccucuguaauucuaauugcucaacuuguacaagugucugcagaguacuucuuugcuuaugucauccuaggucccaggaccguggcucuuuucugcuuccaucccgaaacuuguuaccucauucuugcuuccccaauaagagccacuccgggagcaugugcaccuggggaacagauagagcucccugaauccucccgcacuucaggcucgacucacuggacuggauuuccugggacuuacccuugccugaaugguacuggauugcucuaccguuuugcaaggucguaggcugggguccuagcccgccguccuagcccuggucagcagcuuggcuugaucuuggcccucccucucugccugcuugccugguauuacagccugauuuuuagaggaccacagucugcucuuuguuuuuuuaugagauggagucucgcugugucaucucgaucugucguccaggcuggaguguaacggcacgaucucagcucacugcagccucugccuccuggguucaagugauucuccugucucacgcccuggcuaauuuguuuuuguauuuuuaguagagucuggguuucaccauguuggccaagcugugccuagugaugaagucugggcuguuaguguaaccaucgcccgaauaguguacauuguauccauuaaguaauuucuuaucucucauccccucccacccuccuaccuuucugagucuccauugucuauguuuccacucucuauguccguguguacacauuauuuagcucccaaggcccaccccccuugccuucaguggacaucucaccccagccucaccacagauuuaccucuguucuuuuaaaaauuaaaaaauauauguauuuguuaacauaguauauugugcauagcuuggaaaccaaauaguauucugacuuauuucacuuacagauaauggccuccuguuccaucuauggugcuacugcauucuuuuucauggcuaaguaguauuccauuguguguauguguauaugauaugguuuggcuguguccccacccaaaucucauuuugaauucccacauguugugggagggacccagugggagguaguugaaucaugggguaauugaaucuuuuccaugcuguucucgugauagcgaauaagucucaugaggucucuugguuuuaaaagagggaguuucccugcacaagcucucugucuuugccugccaccauucauguaagaugugacuugcuccuccuugcccucagccaugauugugaggccuccccagccauguggaaccgugagucuguggaaccucuuucuuuuguaaauuguccagucucggguauguguuuaucagcagcaugaaaacgaaauaauacagaauauauaugucuauaccacauuuucuuuauccaguccucgauugauggacacuuaaguugauucuuuaucuuugcuguugcaaauagugcuuggauaaacauaugggugcagaucucuuuuugauaagaugauuucuuuuccuuuggguagauacccaguagugggauuguuggaucaaauguaguucucuuuucaguucuuugagaaaucuucauauuguuuuccauagagguugugcucauuuguauucacacuaacagacuaauaguguauaaacauucuuuuucuccacauccuugccagcaucuuuuuuuuuuucuuuugacuuuuuaauaauagccauuccugacacaugccugaaaucccagcuacuccagaggcugaggugggaggacugcuugaguccaagaguuugagacuagucugggcaacauagcgagacccugucucuacaaaaaaaaaaaaaaaaaaaaaaaaaaaagcuacacaugguggugcaugccugugguucuagcuacucaggagacugaggcaggaggauugcuugaacccaggaguucgaggcugcagugagcuaugaucacaccacugcacuccagccuggguaauagagcaagacaccaucucaaaagaaaaaugaaguuuaauuggaggacuaacuauacuguggagagcuagcuguacauuugauccucugucaucauaacuccuggacaccaauguggaaagaauaagcuugugucuguuugcaaggugguucuucugcaaggaauccugaucuucugucccuugcucugugauuuuuuugcuccagaguaagagggagauaauaguugagacacuauuggagagguugguaguaggagaagaaugaaagugcgucaaaugagcgacuucuuucagucccuugaauucuucagagaauuagcagaagagaaaauaacguaaaaucaagguguuucuuaaugggacccuuuaagaauaucugaacagauguuuaagacuugaguaucauuugcauugaaaccaaauaauucacguuguagaguccuuugaaauagggaugccccuuaugaauuugagugaaauuuccagaucagguuauugacagagggaggugagaccagagaaaaagggucccugugagcagccauagacgcucaaucagaaauaacacucaggucccauacuguuuugcaaaucacugggaaguagaauuugaucuauugcacagagugaaauauuuuuccuaaaggguggggugguuugacauucuuuuuuucuguauuuccaguucauucauguccuuacuuuuucaucuguugcgaggacauucuuuggauucccgguguuuaccagggcuggagccuccaauucuggggccggugucaugcuggugucucuuggagggagacauugaguucuuuuucuuagaaagacuggaaguaauguucuccucaaaucccuaaccucagcccuuucuuuccucucagccuagcacuccuuucugagucugggggggacuuccuaggccaggucuguccaggugccacacagguucuucucugaguggcagcagcccaguucgcccuguggucacaguucugucuccagcguuugcagcccagcugucccauccuaccagaugcuggcugucaucaguucucugguggggccagccaggcagagcaaacagaguugugggaacaguugugguaccaaacugcaacauuagauccucucagccuucauuguagaaauguuuaggaauaaauccucugugggaugauggcuuguaagacucaccaaccuaacagggauuuccccaggagaaaacugcugcugucucauuuuugcuuucucauuuggaaacaccuucccuccuuuucuuccuuccuucccuucccuuccucccucccuccgucccccccuucucucuccuuccuuccuucucuucucuuucuuucucucuuccucccucccuccuucccuccccuccugccuccuucccucccucccuccccugcucccuucuucccugccuucuccuucccuuucuuucuuuuucucccucccucccuuccucccucccucucucucucucuuucugugucucucuuucucucucucucuuucucucucucucuucccuccuccucuccuuuccuuccuucuuccuuuccuuuccuuuccuuuuuuuuuccuuuccuuuccuuucguuuauuuguuuauuuuucuuuugagaggcagucuugcucugucgcccaggcuggagugcaguggugccaucauaguugacuguagccuugaacuccugagcucaagugauccuccugccucagccuccagaauagcugggacuacacgcaugugacaccaugcacagcugauuucuaaguuuuuuguagaaacagggucucacuaugcuguuacagguuggucuugaacuccuggacucaagcaauccucucauccucccaccucggccucccaaaaugcugggguuucaggcaugagacacugcccccggccuaaaauauucuuuuaagugcauaaguaaaagguuugugguuaaacuuuuaaagauaagcaaauagaagaaaauuaaauucacucguaaucccacugaccccagagguaaucauugaugacaguuucaggcuaaaaugucccagagucugcauuuguguggauguugugugucuuuacucuguauuccccucuuuauuaucugaagggguugcagcauccauuccuaaaugaacuguuuuuucacuuaauauccugugaauguuucuguguuaaguuggugcaaaaguaauugcgguuuuugccguuacuuucaauggcaaaaaccguaauuacuuuugcaccacccuaauauuacauauucucccacuucaacauuuucaacgaauucaucauaguccacaaaugggugugccacguguuguuuucgauuucacuaaugaaaaauauugcacaucuguaaguauuuuuuuaaggacaaauucuuuuuuuucuuucuuucuuuuuuuuuaaagacauaaucugucaucugggcuggagugcaguggugcaaucucagcucacugcaaacuccaccuccuggguucaagcgauucuccugccucagcuuccugaggagcuggaauuacaggugccugccaccaugccuggcuaguuuuuguauuuuuuuuuaguagagacgggguuucaccauguuggccaggcuggucuugagcucuugaccucaagugauccuccugccucagccucccaaagugcugggauuacaggcaugauucgcgcccggccggagaaauucuuagaagaggaauuaucagguccacaauuugcagacuuucuucaagcuuuuuccuauuuuaauuuccagcagcaaugaaaagaggcuuuauuucuauccauccuuaccaaugucugcuauuggcguuguuuuuugaaauuuuuuuuuuuuuuagagacagggucucacugugucacacaggcuggaauacagugguauggucauggcucacugcagccucgaacuccugggcugaagcaauccucccuucucagccucccgaguagcugggacuacaggcauccaccaccacaccaucuaauuuuuuuauuuuuguagagacaggaucuugcuguguuuuccaggcuggucccgaacucccggguucaagugaucuucccgccucggccucuguuuuucaaaauuugacagcuaaagugguuuuguguugguguuuuagcuuggauuucugagauuauaagugagcacauacguuuuguuuucauauacuuauuggcugcuugauuuuuccuuuugugaauugcacauugauguuuuaugucuguucauuggucacgguuuuuuaaaaaauguuuuuuaaagaauuguaguggaaagaauaguagccuuuauuacauguugcaaaauuuucuauguuugcucuuuaucccuuuauuucuuuaguauuacuuuuuaacuuuguguuuauuauuaaaaauuauuuuuauaguuacagggucucacucugucaccuaggcuggggugcaguggugcgaucauagcucacugccaccuugaaccccuagcuuaagugauccuccugccucagccugccaaguagcugggaccacaggugugugccgucauguccagcuaauuaauuuuuuuuuuuuuuuuguagagaugggucucacugugugcugaggcuggucuugaacucuggccucaagugauccucuagccuuggccucccaaagugcuggguuuacaggugugagccacugugcccagccuauaguuuuuuuuguuuuuuuuuuuuuaacaaaauguuuuauuauuucuuuuuaaauauuuaaguuuuggaaucauguuuagaaaauuccuccccaucccugagauuacacaaauacuuaccucugcguucuuuuaaaaauuaaaaaauauggccgggcacgguggcucacgccuguaaucccagcacuuugggcagacaaggcgggcagaucaccggaggucaggaguuugagccuggccaauauggugaaacccugucucuacuaauacaaaaauuagccaggugugguggugggcacuuguauuccagcuacucgggaggcugagguaggaguaucacuugaacucgggaggcagagauugcagugagccaaaauugugccacugcacuacagccugggugacagaaugagacucucucaaaaaaaaaaaaucuauguauguguguauauauauguguauauauguguauauauauguguauauauguguauauauguauauguauauauauguauauauauauguuaacauaguguauugcacauagcuuagaaaucaaauaguauuaaauggcuuuuuacacaaaguggcugucccuugcugcccugggaaagugcuggaaagcaggaaucaggcguaggcucagcugcuggaauucugccgucagggagggggaugguggcagagggccccuugauucugugcauagacuggcucccccuccuugcccucagucgaccgacaccucacuccagcccugugcugggccugguguguccucuuauucauugcugccaaggcuggccugcaggcuuccaggaacacaggcauaggggcaaugugcugacuccaugggugagggacggggcucugucugucugcccuguugucuggcucauuugugguguagacccacaauaggcacagaauuuguccacccugugguuaccauucccucuucuuugugccuuccacaucuccuuugaaaucucucccuucccuuccucuguuuccuuguaguuuacaggggaguaucucccuugccucucuguucuuuguucuuauuuuagcaguguuuagguaaagagaggggaaaaugaguucaguuugccaauuauuagccagaagucucauauauagucccaucauuaaauuuuuuaauccaggcugggcacggugccucaugccuguaaucccagcacuuuaggaggccaaggugggaggauugcuugagccaggaguuugagaccaccagccugggcaacacagugagaccccaucucuacaaaaaguacaaaacaaugagccaggcauggugguacgcaccgauagucccagcuacucuggaggcugaguugggagcugucgcuugagcccuggagccauagguugcggugagcugagauuguaucacuccacuucagccugggugacacagugauacucugucucaaagaauuuuuuuuuucuuaauacaacuaguauuaauuuggcuaugguaggauauagggauguaacuuuauuguuauuuuuuuccaaauguuuuuucgauuuucccaauaaugcuuacuaaauaauccauucacugauuuagaaaugucguuuuuguuauguaccgaauuaccauacucaucuggguugaccucuaaaucuuuuguuucuucuccauucucccauccauucuuuuuccagugccacccugguuuaauuuuaguaacuuuaugauuggcaaggugcaguggcucauaccuguaaucccagcacuuugggaggccgaggugggcggaucaccugaggucaggaguucgagaccagccuggccaacauggugaaacccugucucuacuaaaaacacaaaaauuagccggguaugguggcauaugccuguagucccagcuacuugggaggcugaggcaggagaaucauuugaacccgggagguggagguugcagugagccgagauugcaccacuguacuccagucugggcgacagaaugagacuguguaucucaaaaaaaaaaaauuaugauagggcaaauguucccuuauucucucuucuauuuuaaaauuauccauauuuuuuucaauaggaaaauaagcaugaucuuuguggucacuauuuuucuaguugucccaaaucuuucaacuugucauaacuguuuguuuuccuuuucaaugaugccauuguccuucuuucuuugacuuacuuguccuuucugaauuuucugaaccugaggcaucuuuuccaaaguuacauuuugaauuugcaaaagaaaaaauaucuccuagcacgaggaucucuagguauacauggcucaccugcaacccaauuuucugcccccucaacugcaaaguggcccagcgcugucuguccuggggcacauggcuuauagguauaacauggggugaacaacaaaauccaaaauauuauagggaagugacuuacuuuuuuuuuuuuuuuuuuuuucugagaugaagucucacucuguugucuaggcuggauugcaauggcucacugcaaccucugccugcuggguucaagugauucuccugccucagccucccgaguagcugggauuacagauaugcaccaccacacccugcuaauucuuguauuuuuaguagagacaggguuucaccauguuggcuaggcuggucucgaacuccugacaucaagugauacucuggccucagccucucaaagugcugggauuacaggugugagccacugcgcccagccugggagugacuuguugaaaccagaaugcuucuuguagucuagggcagguggcuuuuagcaauguccagaaaugucaacaguauccuuuggggacauggaucuuacucagcuggaaguggcgccuguggcagguugcuucugccacugggucuuggaagccacuguuguuuuccucuuccuucuuucccaucacucuccuaugcucauuucuuggaucuuucauguuucuuuggaucauuccuauuuuucuucaaagucugagccuuguuguggcauucaaacccuucacagaucaccuuacuuugcuugaaauacaggugauggccaggcgcggugguggcucacgccuguaaucucagcaguuugggaggcugaggcagguggaucgcuugagcucaggaguucgagaccagccugggcaacauggcaaaaccccaucucuacaaaaaaaaaaaaaaaaaaaaaaaaaaucucagccaggcguugugguggcaugugccuguagucccagcuacuugggaggcugaggugggaggauugcucgagccggggagguugaggcugcagugagccgagaucaagccacuggacucuagccugggcaacagagugagaccuugucuuacacacacacacacaaaaaagaaaaaagaaauacaguugauccuuccacaaugcaagguugggguguugacccucugcacaguaaaaaauucacauaacuuuugacuccccccaaaacuuaacuacuaauagccuauuguugacuggaagccuuaccaauaauguaaacagguaauuaacacauauuuuguguauuugauauauuauauauuguguucuuacaguaaaguaaaauaaaauguuauuaguaaaagaaaauguuauuaaggaaaccauauagaagagaaaaucuauuuauuacuauucguuaaauggaaguaggucaucauagaggucuucauccucaucaucuuugcguugaguagacugaagaggaggaggaggggcuggucuuguuccccaagggguggcagagucggaagagguggaggaggugggaagggaugcaggagagaaaggcacacuuggcauaacuggaaaaauuccaugcauaaguacacccgugccuuucaaugucauauuguuuaaggauccaccguauauauauauuuucuucuucuuuauuuuuguuuuuuuuuuuuuuuuuuuuuaagacggagucuugcucugucgccaggcuggcgacagagugcaguggcgugaucucggcucacugcaaccuccaccucccggguucaagugauucuccugccucagccuccugaguugcugggauuacaggugcccaccaccaugcccggcuaauuuuguauuuuuuguagagauaggguuucaucauguugaccaggcuggucucgaacucccggccucaggugauccacucaucuuggccucccaaagugcugggauuauaggcaugagccaccaugccuggccugcucuuacguuuugauguagaugucaccagaugcaucaaguguccaccgccacaccaugccagcacauggcugagagcuggcacuacccaagguauuaucuaaauggcacuagggugaugucaauauuauaaccacagaagccaagauuccuuuuguucugcccucuguuccuugucuacugauauuagcacugcugcaucuaggccauugccauuguuauuagguaguaucucgaaugccaagagcuggaugcauuaucuucugaccacauaucagccucugugauaaguaucuucuggaucauaucaauuaacccucacaauggcucaaugagguagauaccuuacaacucccauuugauccauggcaaaacuaagauggaguagcauugugcugucuaggguuuuucagagccaggacuaggucagggggcuuuuuggcuugaaaaccagaccaaucuacuaggcugccucucuuuguauaucuagagacuuaaggguugcagaacuccuccuuccugagcaaguccuugaucaggacguuauaacagucagcuaguagccaugaguagucagagaaugaagacauggagggcagugugggggcaucccugggggaugcuggcggaccgaugugaacagggugcagugcucagggaagagaaugcuggcagggccccuuggagggcaucggaguuuguccaggcuugccccuggcccuggauagccuugaagcgggaagcgcagguuaaguuucugauucaaagucagcaaaucucccuggaccuggugaugaaggaaggucguuucaggagagaguagagagaugacuaaaugagguuggcuuuuggaccucuuuggcuuggagcagaaugugggaagugguccagcgcugucuuucuuggccggcugugggacaggagacgacagugcacagcgggggaccuugcacuugugcuuguuuugccucucccugcccuucccugcuugccacuucugauucaucagcuucccucccaugcccuccgccaagggcucuugaagguggcuucccucccuuggucacgcauguugccguuccuugagucccguguaacccuugugagccccccuccccuauucuuuucuguagcaccuuugacaccugccagggcuguguuuccaggccacaggaccuugcacgggacaugugcuccaucagaagagagggguccauuccugaguuccuugggacccuuuugagucccuucuugggugccaguggauuuauuugcacacagacugauguguauguuucaaagaguggaggcccuggcucagaaugugacuucagaaagaugaacaggaccggcauggauuucuaggauaaaugaaugccuuuaguugugucuucuccaucuggcucaggaugaguucugaauagucucccucccguagagccucccuccagguuccuggcuuaggugagaaaaugaaaaaggcaggcuauagagcuugugcaagcuguugccucuggagcuaaacugccuggucuaccacuuacuaacucugcaguuuugaaccaguuauuuaauuggccugugcuccauuuccccaucuauaaaauggggauaagguauaacugagacauuacuuaacauugccuagaauugccuagcacauagugagcccucuaaaaauguuuacuauuuuccugcaugaguuaguugcauggaauuucaugcaaaauuuuccuuugguacuugcauacaugccagaugggaaugauccccagggaagcuucuagaaucauuaucacuccaugaaaguucuucacccaaguuuuuauuguucugcccccaccgaccuugagguuguguuuuguuccgggaaggaacuaagaggagggucccagcugacaggagaagcaaaaaggcagagaccaaaaaaaaugaacacaaccuaacccaagagugugaguucaucagaaggacaugggaggaugguagcucugggggacucaucauuuuaugucaucugcaauguuuucauugcaguucccagggggacaggaucccucauaucguucauucauucauucauucgugcauucagcaaacauuuucaaauauuccuuguauaucugacauugggcuugacacugggagggcauugcauccaagcagcucaagcuuuggugguacuuuguggauuucuucuuucuuuccuuucuuuccucucucucucucucucucucucucucucucucccccccccacagacagcaucucacucuguggcccaggcuggagugcaguggugcaaucucagcucacugcaaccuccuucucccugguucaaaugaucuuugugccuuggccucccaaguagcugaaauuacagguguauaccaccaugccuggcuaauuuuuguauuuuuaguagaggugagguuuugccauguuggcggggauggccucaaaccccugaccucaagcaauccaccugccucggccccccaaaguccugggauuacaggugugagccacugcacccagcccuaguuuguggauuucugucguuuuguuuauuacacaucuugagcaaagaaaaguucugauuucuuguagcagauuucuguccaucaccgugucuuugugaagguuagugagugagaggacucacgaaauguccuucuggugaacucacccucuuggguuagguuguguucauuuuuuuuuuuuugucucugccuuuugcuucucuugucgucugggacccuccucuugccagcagauguccugaggcaacagccgucuuucagucauuguccucugcccggcuguugggaugaucuuguguccugcuggugacaucccuguugccggcugcucucugcagggcacuagugucugugucugcauugggaagucugugaccagcgucaccuccccacggcaucugcaccagaggcucagccaggagguugcuucuagucccuacucugcugucuuugaauaugcguagcucucaggcagucgcauugcccagauaauaucauaucauagcuauucugcaagcuuugcgaggccacaggcugugacuucugcucugauaccauccgaggaucacagcccauuagaugcguuaaaugcccacugcacugcacgagcgaccgagugaaugaacugaccucucuugcggccagacgggcuucagccuucguagggugugcccucaguuuuauggcagaaugagaagaaaccucaggaaaaaauaaugcaaucuuuguccucugugcuguagucuuauuuccaaacauucucaugcugucaacucaaaaauaacauguaaguuucaaauggcuuuccaucugaaugauggauugaaugaaucuaauuuacauacuauucauuuuauguuaauuggccaaaaugaagccaaucuccagagguccuguaccuuucugcuugaaucucuuaaaagccucuucugcugagauagggcuaauuugaguuuaaaaaaaauuacaaaaagcaaaaaccaaaaacagaagucuggcuagggccccugccugacuuugucugucuucaaucauauuugcugucgaccuaguuagugcuguggacugaacugugucccccaaccccaaauucacauguugaggcucuuccucucuuccgugugaugcuaucuggagaugggguuuugggagugucaacgaagagucagacucuguaaaauaccugaaaagauuuauucugagccaaauaggagugaccauggcccgagacaaagcccucaagagguccugagaaccaggugcccacgguggucagggcacagcuuaguuuuauacauauuagggagggaugagacaucaaucaaauacauuuaagaaacauaauaguuugguccagaaagaggggauaacucaaaaugggggcuucuaggcuauagguaaauuuaaacauuuucuuuuuuauuuuucuuuucuuuuuuuuucuucuuuuuuuuuuuagagcaggaaugagaguuuauuuaaaagcuuuagaacaguaggaaaagaaaagaaggaaaguacagauuggaaggccaggugggcgacuggagaaaccaaguacaccauaaauuuaaacaucuucugauugacaauugguugaguuugucuaaagaccuggguuccauagaaaggaaauguuuagguuaagauaaaagacuguggagaccuucuucugaaggcuuauaguggcugccguuagagacagauagauagaugacaaauguuuucuauucagaccuuuaaaaaauugcuagacucuuacuuaaucucuucaggauugggagggccuggaagaaaaagaucuagcuaugugaauagagauucuuuacagauguacauuuucccccacaaaggacagcuuugcaggaccauuucaaaauauggcaaagaaacauguuuugggguaaaauuuuuugauuuucuuccuugucuugucauguuauaccagugucaguuuggaaaguaagucaugauauacaagguuagauaaaacccaucugaugaguguuuaugguuuguagggcaugacucccuagaccccuuagauaggaauuugggcaagguaacuuuagucuucaggagguaauuaaguuuagaugaugucuugagggugggucccucauaauggaauuuagugcccuuauaaguagagauaccagagagcuugcccucucucccucuuucugucucuccccgaccaugugaggacagagcaagaagguggccauuuguaagccaggaagagaguccucaucagaaccugaccauguugaccucuugaucuuagacauccagccuucaggcuauaagaaaauuaauuucuguuguuuaagccacccggucuguagucuuuuguuacgguaaccugagcaaacuaagcuacuaaagucuuaaaagugcuguucuagagaacucucaacaaucaauguuggguacagugugcaguuauuucccguagaucaaauaaucccugaccucucacugucuugggagaggccucagccagcaggauucucucaaacuuugcagaaagcuaucuaaggcucucgguuugauacaggugucugagcagcuagaaguguaugguggacuuagcaggaccacuuuacguggggaucuugaaggaaguuacauagaaauucaucacaauuaaauccuuccauauucaacuuauuaauuaaaagagaucaaaacagccuuaagaaggagccuuaacaagcaguggaacuuuuuguguaauuacuuucagaaagaacaacucaaaaucaccugccaaaagcauuccugucggcaggccagcgccggcauccuugugaagcuggugcaggauuucuuccagcaggagcguucaucuaauuaccugaagguuugcaauccuccgcaguucucugggggccagucccaaucaaaaucaaaauugggaugggaggcacaugucuguccuggcugacacagccagcuguuaacacgggcccuuaaaggguuccaacccaggcucucuuuggaggccugggcugcagacagcaggucacaugcgaggcugcaggucacuguagccguggccaucaggcagccuugguccugucugagggcuuccuggggccuuacucccacguggaggaaauuccagccaggcucuuucauuuguaaaaucauuuuaauuucucucuagcuguaaaaaugaaauagacccaugucacuaaguguggagagguuaaacaacuaaauauacaacaacaguaaguucaucacucagcaauaacuaguauuuacauuuugguuuauauccuuugaagaacuuuauauaucucuauaaauauauauguauguggcuagguaggccagguaauuauauuuauauaguugugauuaugcccuacauaggauuuuauggccugaccuaaugaaaguaauauaagaauaggauaauaaaaaaacaaaauauaaguagauagacguaaaagagacgcuggcagcuauaccccccccaugucagaggcaagcauuguaagccauuuuucaucucagugauucugguggaugaaaucacuccaaguaaagugcuuacuugauuuuuuuuaaaauucauuuuaauuuuguagagauggggccuuccuguuguugcccaggcuggccuggaacuccugggcucaggcaauccccccuuccuggcccccgaacaccuuggccucccaaagugcugggauuacaggcaugagccacugugcccaaccuuaugugguuuugagcauccacuugaaaugggaucucuccauccucuccuuugaaagacaggaagaacguggagucuuuccccuuucccaucccagucucugccagucacauuuuuauuuuuccaaucugaauugaauagcuuuauugcuuuagcuuauaaacuuaagucuuucuuuauuaacuugaaaccauaccuuuggaccucccagucugaaagacggugguuucgggggagggcuuagcaccucuucauuucuuucuucuuuuuugcagcuugucuucuguauuacugacucuuagaguggcaggcauuuacauuuguucucuaucugaaauuuccaugauucuccuauuucaaauucaaaaccaaagauuuugugaauaugauuacuaugauuauguaaauaauuacucacugcagaaacaaauaugauacaagcaaucccauaacauuuacuuuuuauuuucucgagacagagucuugcucugucacccagaugagaguacaguggcaugaucagagcucacuaagccuugaucuccugggcucaagggauccuccugccucggccucccaaaguguuggguuuacagaugugagccagcacaccccaccuagugcuguaacauuuauaggaggaaaggauaaauaaauuggaaaagagagugaaggagggagggcgagcccacucucauuguauuuauuugauauuuaauauugaugcuggauucuccuucucacuaagcauaugcaguuucuuuuuuuuuuuucuuuuucuuuuuuuugagauggaguuucgcucuuguugcccaggcuggagugcaauggcgcgaucuuggcucaccgcagccucugccucccagguuuaagggauuguccugucucagccucccaaguagcugggauuacaggcaugccccaccacgccuggcuuguauuuuuaguagagacaggguuucuccauguuggucaggcuggucuugaacucccgaccucagaugaucuggccaccugguaugcaguuucuuuaaugcacugaugcuggaaguucacuucuuccuguccuccuuggcacugauuuacaacaccugcccccacuguggucuucugggcucucaccucauuguuagaauccaucucaugaauuagaucucauuuucucucauuucuuggacuccuuuugcauguugcugaaauaauucacugagugauuucuuuuuagaugaugucuaugaauuguaaaauuccuuuucuuuuuuuuuugagacagggucugucucugucaccagguuagagugcaauggcaccaucauagcucacuguauccuugaacuccugaacuccugggcucaagggauccuucugccucagucucugugguaacugggacuacagauggaugccaccaggcccggauucuuuucguuuuuuuuuuuuuuuuuuuuuuuugagacccucacucucucuccaagccuggagugcaguggcgcgaucucggcucacugcaacauccgccgccuccugggcucaagcaauucucgugccucagucucccuaguagcugggacuacaggugcccaccaucacaccugacuaauuuuuuguauuuuuaguagagacgggguuucaccauguuggccaggcuggucaugaacuccugaccucaagugauccacgugccuuggccucccaaagugcugggauuacaggugugagccacugcgcucauccuguuuucguauuuuuuguagagaugggggcuugguaugcuggcuaaucuggaaugccugcaccuccgaaaguacugggaugaugggccugagccaccacgcccagccaaauuguaaacuuucuaagccucugucuugauuggauuuugacuggguguaaauuaguuuuuccugugauguccagaccacuugcuccacuguuaucucgugucugaugaugcugaugugcaguuuaaugucagcaugaucgccauucauuaaaacguuguccguuccuuccucuagggcuuuaggugcuuucuuuaauucugauguucugaaauuuuaugagguuuggcucuuugugggucuuuucauuuaucccauauagcagcugacaggcauuuucagucucaagcuucaucucauccgcucugggaauuucucuuguauuauuuccucuccguggucucuguucucuuguucugaaacgcaucugcaguaauucacuguguauacaauuugaauuuucucuccuauuucaucaguucuuuaaacuuucuucaauuccucaucucagacuguuuuuuuuuuagcagccucucagcucucccugaagcauuacauuaaaauucuuccaaggucucuucuuuuuuccaggaucauccuugcugugucuggggucaccuuuucuguccugcuugucggugacacugguuuucuugaagugucuggcaauccuuguuuggucauugccauuccuggcguuucugaaugugaugggcugugauaagaggcagguuuuaguagcagccuuucucucugaaugagaccaauggcugcaaacucuuuuauagcaguggggcauguugaccaguaggcuucauuguaggguucaagacugggaaggggugaacaggaugccccauguaaaugccaggagaugaaggccuuacucugggagaucaacgucagaucuacuccucaggcagaucacugcuugcuuuuuuuuuuuuuuuuuuugagagacaaagucuuugcucugucgcccaggcuggaguacaguggcgugaucucagcacacugcaaccucugccuccuggguuacagcgauucuccucucucagccucccgaguagcugggacuacaggcaugcgccaccaagccaggcuaauuuuuguauuuuuaguagagacaggguuucaccauguuggcuaggcuggucucgaacuccugaccucaagugauacaccugccucggccucccaaaguggugggauuacaggugugagccacccagcccggccugcuugcuuuuaagaggaucuuuuucuaggggugggaaacccagcaagcugaucuaagugaaggacuuaaaucagucacccccuguccacccugucuccaguccagaucuuagcaacugcugacugggacuauacucugugugcucucagcgcuucucccuccuccacuuucuuuccaguuugcaugcuuucagccuggcuucugucugcccaauuacgucuguaaagauggaugaauucauccugcccuccagggaucugccaaaguuuuugggccaaugauggucuuucccugauauucugugcuuauuuacauuuuuauuuauuuauuugagacagagucucacucugucacccaggcuggagugugguggcaugaucucagcucacugcaaccuccaaccucggggguucaaacgauucuccugccucagccuccagaguagcugggauuacaggcacgugccaccaugcccagcuaauuuuuguauuuuugguagagacgggguuucgccauguuggccaggcuggucucgaacuccugaccucaagugaucugcccccucuuggccucccaaagugcugggauuacaggcauuagccaccgugacuggcuauaaauauaauuagacaaauacaguuuauacuuaaauacauacaucuguguuuaugcacuuauucuauuuuguucccuauaucaugauuguaauagaauuuuaggagagaaguguguucguuuuucucaguugaaacacguauuagaguuagugguacauuauaaagauguuuggaugucauuaaaauuuuagugagcgucuuugauccacaacauacucugauaugaaugcacuuugcuuauugauuucuguauuuuuaacuguuuuuuuuucuuguuuuuaucuuuuuuguuguuguuguucauuaaaaauacaacgcagugccuuuucuugauacacaaaucuuuggcuacaucucaggacagacugaaaaaaaaaauagaguuacagggucaaagggccagaacuauuuuuuucagacuugugaugcagaauggccaaauuacuuucucugaacuguuguuucaauugcuaugaaguaucagucccauuacauucucaccaguauguuaaaaacaacuugaaaaagggcugggcaugguggcucaugccuguaaucccagcacuuugggaggacgaggugggcggaucaugaggucaggaguucgagaccagccuggccaacauggugaaacccuaucucuguuaaaaauacaaaaaauuagcugggcaugguggcaugcgccuguaaucccagcuacuucagaggcugaggcaggagaaugcuuaaaccggggaggcagagaucgugccacugcucuccagccugggugacagagcaagacuccgucucagaaaaaaacaacaaacaaaaaaacaaaacaaaacaaaaauugaaacaaaaacucucccccauugaaaaagcagauaacauggucaggcaugcuggcucaggccuguaaugcuagcacuuugggaggucgaggcaggaggaucccuugaacccaggaguuugaaaccagucugggcaacacagcaggaccucagucucucuuuuuaaaaaaaaaaaaaaaaaaaaagauaagagcaucuuuuaaaaaauuguauuucuuugguuacuugugagaucaacuguuguuuuugcauacuuuauuaauucuuugucuuuccaguuuugugaauugucugaucauacagucuuugcauucccuguuugccuauuaccuuuauuuauaucguuuauaauguuuagaaguuuguauuuuuauacuggcaaggcuauucaucuuuuccuuuguaauuucugccucuuaacuaugaaagaugaguuaaauauuuacauguauuucacucuaggcuuuucauuuuuauuuuuuaguuuuucuccucuuaaauagucucuuauuguguucaugcuuuacugcauuaaguagaauuucuaggauaguguuauuuaauaguggacauaaugggcuucuugucuuuuuccuuguuucaugguaauuucucugccugauuuucaaaggggagggcauguaaggguuuuuuuggaguauaagaauaaaaggaggaaauuauacuuuacugauuaucuacaguagagaaugacacugccgccuucaguugcccauaugcugucuggucuggugugaaguguuuaggaaaaggagagcaucucacacugggagguacugugguaccuuccagugacuugugacacaagugccugguuagggggauuguauuaguucauuuucaagcugcugauaaagacauaccagagacuggacaauuuacaaaagaaagagguuuaauugggcuuacaguucuacauggcuggggaggccucacaaucacggaggaaagcaaggaggagcaagucacgacuugacguggauggcggcaggcaaaagcagaguuugugcagggaaacuccgcaccccuccccucuuuuuuuuuuuuuuuaaaaccaucagaucucuugagacucagucacuaucacaagaacagugcaggaaagacccgcccccauaauucagucaccucccaccaggccccucccacaacauuugggaauucaagaugagauuuggcuugggaugaagccaaaccauaucagggauuuacagauuauauuaauuugcuucaacuagacuaauagauaaugggcaagaggcuuuacagaacgucuaccaagaaaccucagcuuuugaucaugcugaucuaacaggcccaaguagaccccaagacagugaccaagcugacauuuccuuugcucccaaaaggagcccuucauuaguuacucuaugaguuagagcacugaggaguucaucagauuggacagaaguuggccaaaacgauuaacagacuuccaaaagacaauuuaaaauguagaucucuauugacucucacuggccuacaucuuugagaugagauggaagauggcugcagguggcuuuugugccacaacaaagugugcgucuuauuucagggcaaaguucuuaagugaauugucaaacacaaauaagagucgcacgcuuucugucauaaacagucaaaugaucuacacuuucuggucuuuucugagauggugggauguuguuggccauacacagguaaagaugacauuuuaacaaagauugaggaaaucaccgcuucucaaaggaaccuuaugcuguggaaagaacauuuuugaaaauagauguuuuuggaaaugucucaacuauuaugugauuuuguagcuaaaaaaaauaauaagauggugagugcacuaucuacaaacucuacucuguaaaguucaaaaaucuggaaacagaacuuugucaacugugugagaaacuuccaaaugaagagaucaagggaguuucagacucauuuguuaaaaauaugaaaaugcaacugcuuucaguuugcaaaaucaucuguugacguuagggaagaugaaacuucaccagccaaaugucagcaaaaaccuuggcaugcuugucagauggaauugaagaaugaauauuaugacuucguaaauacugccaaugacauuuuucuuccauuuggaucugugucucuuacggagguguauuuuugguuauggcagacaugaaaauaaagucuggaaauaaacucaacccaaaaccaaaucuucaaauuacuguauaacaaaguguuaugucaagguuuucaauaagugugaauaauauuaaaucaucuuguuuucgcuaaaaaaauccacuuucuuuaucuugagugcaaaguuauucauuuaaccaguguuuuaaaauuuauuagucuggaguugcauguagaauucccauauuucaggauguuaucuauuuaugcuuucuauauuuguuuuaauaaaccugucagagauuuguuguuuauugguuuuguucuggagaacuagcuuuuucaaauuaucuguuuucuaauucacuuucauuauuuccuuuuuuuccuauuuucuuaauuuauuuuguuguuauuuuuuaacuaagaaguuagcauugaggacuuaguguuuuuuccucuuuaagauaaaagagaacauuuaaauaacaaaacuuuuuuucugaaugcuccuuggguacauaaugaaaugaaggcagaaauaaagauguucuuugaaaccaacgggaacaaagacacaacauaccagagucucugggacgcauucaaagcaguguguagagggaaauuuauagcacuaaaugcccacaagagaaagcaggaaagauccaaaauugacacccuaacaucacaauuaaaagaacuagaaaagcaagagcaaacacauucaaaagauccaaaauugacacccuaacaucacaauuaaaagaacuagaaaagcaagagcaaacacauucaaaagcuagcagaaggcaagaaauaacuaaaaucagaguagaacugaaggaaauagagacacaaaaaacccuucaaaaaaucaaugaauccaggagcugguuuuuugaaaggaucaacaaaauugauagaccgcuagcaagacuaauaaaaaaagagagaagaaucaaauagacacaauaaaaaaugauaaaggggauaucaccaccgaucccacagaaauacaaacuaccaucagagaauacuacaaacaccucuacgcaaauaaacuagaaaaucuagaagaaauggauaaauuccucgacacauacacucucccaagacuaaaccaggaagaaguugaaucucugaauagaccaauaacaggagcugaaauuguggcaauaaucaauaguuuaccaaccaaaaggaguccaggaccagauggauucacggccgaauucuacagagguacaaggaggaacugguaccauuccuucugaaacuauuccaaucaauagaaaaagagggaauccucccuaacucauuuuaugaggccagcaucauucugauaccaaagccgggcagagacacaaccaaaaaagagaauuuuagaccaauauccuugaugaacauugaugcaaaaauccucaauaaaauacuggcaaacugaauccagcagcacaucaaaaagcuuauccaccaugaucaagugggcuucaucccugggaugcaaggcugguucaauauacgcaaaucaguaaauguaauccagcauauaaacagagccaaagacaaaaaccacaugauuaucucaauagaugcagaaaaagccuuugacaaaauucaacaaccuucaugcuaaaaacucucaguaaauuagguauugaugggauguauuucaaaauaauaacagcuaucuaugacaaacccacagccaauaucauacugaaugggcaaaaacuggaagcauuccguuugaaaacuggcacaagacagggaugcccucucucaccacuccuauucaacauaguguuggaaguucuggccagggcaguuaggcaggagaaggaaauaaaggguauucaauuaggaaaagaggaagucaaauugucccucuuugcagacgacaugauuguauaucuagaaaaccccauugucucagcccaaaaucuccuuaagcugauaagcaacugcagcaaagucucaggauacaaaaucaauguacaaaaaucacaagcauucuuauacaccaacaacagacaaacagagagccaaaucaugagugaacucccauucacaauugcuucaaagagaauaaaauaccugggaauccaacuuacaagggaugugaaggaccucuucaaggagaacuacaaaccacugcucaaggaaauaaaagaggauacaaacaaauggaagaacacuccaugcucauggguaggaagaaucaauaucgugaaaauggccauacugcccaaggcaauuuacagauucaaugccauccccaucaagcuaccaaugccuuucuucacagaauuggaaaaaacuacuuuaaaguucauaugaaugcuccuuugcuacacucugugauuuaaaaaaaauaaguauuguuuuuguuauuuuuaaaaauaaguauuguuuccauuuucauuacuuuaaagauagcccguaauuauaacuuuaauuuaaacauugaccuaggaaauauuuaggggaauauaauaaaauuuucaauuuuggcuucuauuuuauuuuaaaaaaauuuuauuuccauagguuuuuaggaaagaggugguguuugguuacauaaauucuuuaguagugauuugugagauuugggugcacccaucaucugcccaguauacacugaaaguauugacuuucauuauugucucuacuuaaauucaacugugguagaccaacuuuuuaaauacguaugcugaaguuugcucuguggucuuauauuugauaauuugacggaucucugggggacacacacacucagaaaugcacacauuaaauuagccuucauagccuaauacccacuuuucuucauauccuuuuuguuuuuauuuuuuguccagguaauuuaucagaggcuuauagggugucuuuaaagacuucaaccauuuuuaaaaaucuguauuuauuuauuuauuuauuuauuuauuuauuacuuuuuuagagacagucuuugucgucccagcuggagugcaguggcaacauuaugcucacugcagccuugacuucuugggcucaaacgauccucccaccucagucuccgaaguagcugagacuacaggugcgcaccaccacgcuaggcuauuucuaaauuuuucauagagaugagguuucgcuguguugcccaggcuggucucaaacuccuggccucaaguuauccuccugucucaaccucccaaaguguggggauugugaguaugagccacugugcccaggcaguuuuucuuuauauuuaaauuauuuuuacuuuacagugcuaugauaugguacauagaaguuuaugacuaauaugcuaucauuuugaauuuuacccucaaacauagaaugaccuucaucaucuuucacuuggacuucacuguacuucaauguuuuuuaguuugaauuguuugaagugagaacuuuauuuucuauuacauuugacuuacaauauuuccucaugauuuacuucauaaacuucucuacuuauuuuaauuuaagugacccauucaaggcggcgggagguggagauaguguuguuuuugugguugcuucuggaggaaucuucagaagccauuauuauucugaaggaaacugaaucucauuuuguuuuuuuguggauaugcucugucgcccaggcuggagugcagugguguggucucggcucaccacagccuccaccucccagguucaagugauccuccugccucagccucccgaguagcugggauuacaggugugcaccaugaugccuggcuaauuuuuguauuuuuaaggagaggcgggguuucaccauguuggccaggcuggucucaaacuccugaucucaagugaucugccugccuuggccucccaaagugcugggauuacaggugugagccaccgugccuggccgguaaacuguauuuucuaccugaaugcucagagcauuuuuucuuauccuugaaguucaaaaauguuaccuggagaucuaccucugucaguguccuaagcuaacaugggugcuuuuucugcuaucaacauagaaaugcagaauaaaauagaaaaaaaauaccaaacgugucacuuugcuggucaucugccugcuuucuuacggauuuaucugccuuuuucuccugcuacccugcaugguagggcuugauguuugcaaacuacauuuccagauucccuggcaauaggcugcugacugauuuggccaaaaggagacaccagcaggaaaugaaaaggcgggaaaaagagagaggcugggguauuuuuccccaucucgaucugcuuuugauaauugucuccagcaguggcugucucuuuuuagugguucuugcuuugaaucuuggcagagcaaagccuuuccaucucuccuuuuaguuccuauugggcagccccuaccacggugcuagauccuuuugggaaacucaacuuugagguucugauaguaccacccucucccuacguccuuccagacuaggggugggaauacguugcugccaucucuaaucucugcuaaguaucucuguuuggcuuuuccacccuuccaacaacuuaguagauagcuguuuuaaauccucuuguugaacugccugauacaggcucuguuuuccuggcuaagcucugacgaauaaaaucaguuagaaagaaaggaaggaaggggaaacucagagcccagggagauaagcauaggagugggcgcuacugaacaacaggaaccucccugccccccagaaagcucuggugaugggguuuuaauguucaugcagagacaaaagauguggucuuggacuggcacaggcaggaaauaggaaaugagacuccgguuucccagcccccuguaauucauggacuaaauguguuucuccaaaagucauauguugaaauucuuuuuuuuuuuuuugagacagaguauuguucuguugcccaagcuggagugcaguggcgcgaucucggcucacuguaaccuucaccucccagguucaagugauucuccugccucagccucccgaguagcugggauuacaagcaugcgccaccaugccuggcuaauuuuuauauuuuuaguagagacaggauuucaccauguuggccaggcuggucucgaauuccugaccucaagugauccaccugccuuggccucccaaagugcugggauuacaggcauaagccacugcaccugacuauauguugaaauucuuauugccaaugugaugguauuagcagauauggccuuugagaggugauugggucaugauauagugacccaaucaccucucaaaggcccuaucugcuaaugagugggagguggaggccucauucacuaaugagguggaauccucacgaauguccucuuauaaggggacaaagagaccagagcgcucucugcuguccaccucauggggacacaaugagaagagggcccccuguagaccaggaagagggucuucaucaagaauuugaucaagcuggcacccugauuuuggccuuccaggcuugagaaccaugagaaauaaauguuuguuguuuaagccacauauucuguuauauuggguuggugcaagaguaauugcgauuuuugccauugaaaguaaugguuggugcaagaguaauggcaauaacugcaauuauucuuguacaaccuaguagcaacuuacuauucauggacuaaauguuuguguuuccccaaaagucauauguugaaauucuuuuuuuuuuuuuugagauggaguauuguucugucacccaggcugaagugcgguggccccuaucugcuaauaccaucacauuggcaauaagaauuucaacauauggucaggcucgguggcucaugucuguaaucccaguacuuugggaggccaaggcaggugcaucacuugagguugggaguucgagaccagccuggccaacaugaagaauccugucucuaccaaaaauacaaaaauuagccgggcauugugguacaugccugucaucccagcuacuugggaggcugaggcaggagaaucacuugaacccgggagguggagguuacaguuuucacuuacaggugggagcuagacucagucuccacacuggcccagcaaaguagcagugaugcuuauuuucuucccagaucaauggcuacaaaagagaaaggcuacagugacaaaucaaaacucuaagccaguguuccaggggaugugcaguccaaauguacacugccuguguggugcaggcuucuaaguuaaggaauuaauguaaugacugguucugaacuggugagaugcccugugugauggacggggaucucugugaacuuggaacuccagugggaaaagcgucaccuguugcaaaggcugcugggguuccuccccucaacaaaugacaggcaauacugggaaacaguuugucacugggaaagucagaguaguacaaaaagaggauuagugccuucagaaauggaaauuauaaaaugacauucugaagaaaaauaugaaauaagucagaaaugguuaaaagggcuaggcgcaguggcucacaucuguaaucccagcacuuugggaugcuaaggugggcagaucacuugaggcaggaguucgaaaccagccuggccaacauggugaaauccugucucuacugaaaauacaaaaauuagccaggcaugguggugcauaacuguaaucccagcuacuuggaaugcugaggcaggagaauugcuugaacccgggaggcagagguugcagugagcccaaauugcaccacuacacuccagccuggaugacagagugagaucucugucucaaaaaaaaaaaaaaugguuaaaaggugaaagaaaguauaggaaucauaaugaaagauugauacucagugaaaaauaagagguguguuuauaaaagaaccaaaguaaacuucuggaaauggaaaauacagucauguaaaugaaaaauucaguagacagguucaaccaccauucaguaaaaacugaaaagagaaaguacaaauuugcaaauaauuugaggagauuacuucuaagauacacagagagguaaaaaugugaacaauuaaaaagaguuuaaagaauauggacaacacuaugauguaucagugaagacuuaguucaagaaccaguaaccacucuggguauuuuaagcaggaggggauuuaguauaagggauuugaugcuugcauaacuguucaaggguugaaggaguggauuuuaggugguuguccagaaugaauuccagaauaacucaaagucaacucuccaggagaguugcuaccacugaggcugccacugcuguauauugucccugcaacauucucuugacuucccagcauuuagagaaugguccccuagagcugugaucuggggauucagaagcuguugcugccaccaccauagcugcuuugucacagccaggaaacuggagagugaacaauggaauguugcugcaggaaaaugucauguuuucaugucuucuuuucuguagaaagucaaaacauggcaaggaaacagccagugacaugcuggagcuagcucauaagcucauacuggcuugugagagcccacuuuuaaauuuuaagggauuuugugaggugacuauuaaaugcauccuuuuuuuuuuuuuuuuuuuuuuuuuuuuuuuuuuuuuuuuuuuuuuuaagacagggucucguucucuguuacccaggcuggaguacagggguuuaaucauagcucacugcagccuugaacuucugggcuuaagcgauucuccaaccucagccuccugaguagcuaagacuacaggcacauaccacuaugcccggcuaauuguuuuauuuuuuguagaaaugaggucuugcuauguugcccagcuggucuugaacuccgggcucccaccuuggcaucccaaagugcugggauuacaggugugagccaccacacucagccuaugcauucauucuuaaaaauggaauaugaacuuacaaugaaauaagugaaaaaucaagguaauaaauauuuaaaauucaucacuuccuaaucauuuugcuacauuuuacuauuauuugugauuuugugguuaauuuagccuauugugugugugugguggagauacuucauggugguaugcugguauacugcugcacaucucuuuccaaauccauguuuagugguaccauguugggagcuuggaauugguccuuguugggaauauuuucaccaugaaaauggaaaaugcuacacaucaagaguguuucuuuuugagaccaagugcuaaacauuuaccaguauaucacugccuucaccucaugucuauauugcaaauuuuguguaagagcuuuugaauauuagaacuaacuuucauccagaaccuuaguagcaagaaagucuggaaaauaguuauuggccucccagcuuccucagucagaugaacugugaauagcuuuugggugaaccagucaagagaauccagcuugaacaaagagguccaacguacaucuaauaagagcuuaccaaaaagagaauaaagagauuuggagagcaccuauaucugaaaacauaaugacuuagaauuguccagaaugaguaugaauaggugaacagcaaguauaccuauagauuucucaucagcaacaaaacauuuuuuaagugcuaaggaaaucauuaauuuauaauucucuacuagguuaaccuucauaauucaaaugaaguugaaauaaagacuuuuuaagacaaagacuuagaaagcuugccauuuauagccccuuauuuacauuuacacuucauugaaaaagaaauugaaucuggaacaaaggaguagccugcaagaaccaaugaugagcagaaaauuggcaaacuuguggaaaaguuuacauaaguaucgauuguaagaaacaauaauucugacuaauuuuuggggaaaagggguuaaaaauaagauugaaauuggacacuggacaauaacauagaaggacaaagcagugcaaaaaucauaaacaauccaauacauaaagaugaaaagcauacuuguagcagaagaaauugaaugaguaaaagccauauaaaaagaugcuuaagcuagcagugaaggaaauccaauuaaaaaugaaacagucugcuaauaccaaguuuuggcaaggcuaucggggaaauugacacacuccuagacuaaugguggaucuguaaauugucacaaucauuaagguguuuuuaaaauacaucuaaaaauuaucugauacuccauuuuucaaaagguggagucuaauuccuuucccccuaaguguuggcuguauucagugacacaguucuaaugaaaacaauguggcagaagugaugaugugugauuuccaagaccaagucauaagagccccuacccccaugucuuugaucacuugcuuggggugauccagcucccaugucauaaggacacuucagaagcccuauggagagacccacaagaaagugagaccuuuuaugaacaucucuuuccaaauccauguuuaauggcaucauguugggagccaugugagugcucccaacucacgugaacaaagcuaugugagugcaccaucuuggaaauggauccuccagccccggucaggccuucugaugaugguggccccagucagugucuugaccgcaaucagaggagacuccuugagccagaaccacccagcuuaagcagcuccugauucugacccacagaaccugagauaauaaauauuuauuuuaagccacaaaguucagggguaauuuauuauauaccaauaaauaacuauuauauaccaauaaauaacccaaucacuuuggagugcaauuucacuaaauccaauaaagguaaagauucgcauacucaauaaccagguaguauuuuaucuagauaugcaguucagagaaauuccugcaaauauauaugaagagacacacauggggguauucauugcagcacacuuuuccaucgauuguguaauuuauauacaauggaaaacuguugagcaguuaaaaauuaacuaggcugggcguaguggcucacgccuguaaucccagcacuuugggaggcugaggcagguggaucacgaggucaggagaucaagaccauccuggcuaacacggugaaaccccaucucuacuaaaaauacaaaaaauuagccgugcgucguggcgggcgccaguagucccagcuacucgggaggcugaggcaggagaauggcaugaacccaggaggcggagcuugcagugagccaagauugcgccacugcacuccagccugggugacagagccgagacucugucucaaaaaaaaaaaaaaaaaaaaaaaaaaaauuaauuugguguauguguauggauuuagauagaucucagaaauccaauauagagugaaccaugcagguugcaaaagcauauggaugguguaauaucauuuauguaaauuuaaagaucggcacagcaaugauacaauauauucuauguaguuacaucaaaaucuggacaaauuuaaaagcauggacaggaaggauaauagaguugucacuguggagggagggaagugaaagaauagaguaggugguaaggguuucaguguaauauguuauuucuuuaaaaaauaagcaaagaaggcaaaauaucauuaaaucugggugguggguacaugggugcauuaugugguaaaauuucuguuucuuugaaauacucuucauugccuuuaaugcagauuuucauucugcuacuguuuuugcauuucuccuuuguuugcaaaugcaugcaccuuuuccaaaccggcuuaccucucagcuuauugccuuuucuuuuugucuugauaucucuucuucucacucugauauuucuuuaugaauuugcauuccugugucauagacaccuuguuaaaguuuguaaaauuguccuuucuuguauuauaucauuauuggcaauaggcuuuugcuguacuucuucuugaaaguucuuccuucucuaaugaugcagaacuuuuacacagaccacuacguuaguguuuuugcuuacucauucuugucugauuugagaucuguccaaaccaaguguuugccaacuggcaugccccugcaggauuuuaacaggggaacaaaacuguuucauaagugcuuagccaaauguccagggucuagcuggccuuuguugagagcaucuuugcuggaguaagaugagaucuucuugugcccaccauguagcuguugaacagagaggaagacauauauauuucuggguuauuugaggccuucugcaguuuuuucuuaaucagaagcaaugcaugaaaaaucauaauccccauaggucauuacuccugggauccuucucaccaacaccugugccuugcagcuaauuucucaucuucaugugcaggguccacgucucagaccuuccauuccuagccaccuugcauacugggaguuaugauccaugaguagcuagaggaaaaaaaguuguugcuucacagugguggaagagaugguggugggauuugaccuuggcugcuuuaauaaagcaauuccagucagaagggugauugccugcuguuaugguuggucaucccuaagucccugaaacagaagagaauuuggguagauaacaaucucuucuuaucccuguacuaucugacucuguuauuccgucucugacuucaaggcugcaccacugauuauucaucauucuaauccuaacugcacugauuuuaugaaagcuucuuccauacucuggcauuggugguguugagaauaucauuauuuuggugugcuuucgugguuguuuuuacaggaauuuggcaaaggcugugucaggacugguuaggcucuuuaaccuuuagcaugcaagaucaauauugccccuuguaugucugguaauuggaggacacggauugcugucaagucugcaagagaugccuuguacuucucuagcacucuauagagagcucaggaaucaauugaagucuuucagcuucuuucagaaguccaucuaagacuuuuaagaaaucuuaagcucuuugaaaaaguuucagggacaaguuaagaugcauuucuccaaauguuuuucuugcuuucucugugguucauuaccagaaaucuauacaacauaaauuaaauacuuuagagcugugcuucucaaacuauuugugaggaaggaccaguuuuaauuuuuuuuaguuucggucauuuguagacugauacuuuaaaaaaguacaguaagagcugggcgcugugguucacgccuguaaucccagcacuuugggaggccgaggcgggcagaucacaaggucaggagaucgagacuauccuggccaacacggugaaaccccaucucuacuaaaaauacaaaaaauuaggcagacgugguggcaggcgccuguaaucccagcuacuugggaggcugaggcaggagaauggcaugaacccgggaggcggagcuugcaguggcugagaucgugccacugcacuccagccugggcaacagagcaagacuccaucucaaaaacaaacaaaacaaaacaaaaaccaguaagaaagaauuaccaggaaaaauaaaagaagcaaaaauauacaaaaaucaaguccacuggucaagugcuuagaaguuggggcaaugcucuaaauugcuauuucaaugcuuucucucaguucuuuuacuuaucucacugcagaccagcaacaaaugcuaugcaauuugcaguggucuauagaccacacuuugaguagcacugcuuuagaagcccugcagaacacacagggcuuugcucagaauaauaauaauacccuacugcaaugugccuggguccuugguacuguagaggaaaaaaaaggaaggugcauuaauguggguucuccaaagaaacagaaucuaucuaucuaucuaccuaccuaccuauccauccaucaucuaucauauaucucuaucuaucuaucuaucuauccuuaaucuaucuguauaacuuuaaagagauuuaucauaaggaauuagcucaugcaguuacagacucugaaaauuccacagucugcugucagcaagcugaagacccaagagaaauaaugguauaguuccagucugguuugaagaccugagaaucagauagugaaaagcuccaguccaagucugaguucaguggcagaauuaagacugauguaccagcuugaagacaguuugaagagcaaauucuuucuuaguguguucauuccauguaggccuaucauucuauucacuguuggaugagacccacccacacuggggaggagaaucugcuuuacucagacuaccaauucaaaaguuaaccuaauccagcaacacccucacagacacaucacagagaauaauguucaaccaaauaucugggcaacccauggcccagucaaguugacacauaaaacugaccaucacaaaagggcaucauuucaaguuaaugugaaugaggcucuuuaguuuauuuauuuaauuaacuuuuuagagacaaggucucccucuguugcccaggcuggagggcaguggcaagaucacaguucacugcagccucaaacuccugggcucaagugaucuuccuaccucagccuccugaguagcagggacuacagucaugcaccaccaugccugacuaaaauuuuuaaaauuuuucuguagagacacagucucaccauguugcccagacuggucuugaacuccuagccucaaguaaucuuccagcaucagccucccaaaaugcugagauuacagguguuaggcaccauacauggccucuucaguauauuacucugucaagaaauguaccaguuccuugaccccauuaacaggaaccaucccuuuugguuuuaaccucacaagaucuuuucuuugauaugacaauucagccagccucccuggcacccaggaaguggacucuucuuuggcucuggcacuuuccauucaaguagccccuucugcauacugacaccauucagcacuggaacccgcuggugcuuugcugcucacaccugaucccucagcacagugguuuacaugccagccucucccugaagcuugcccuuugucaggucucacugacccuccuuuguaauccagcauguaauccaggcaucaaucuaauucauccaugacuucuuguugccccugcauccugcuucauaugauccuuagcaaauaauuacugguguuacucacugagcagaugccuggugcuaaguacagugcuuuccauaucuuaucuuuuuagagucaagagucuugcucugucacucaggcuggaguacaguggugggaucauagcucucugaagucucaaauuacugugcucacaugauccucucacuucagccuccggaguagcuaugacuacaugugugugccaccaugcccagcuaaauuuuuuuauuuuuuggucugugugaagagacagggucuugcucuguugcccaggcuggucuggaaauccugacaucaagugauccucccuccuuggccucccaaagugcugggauuauagaugugagccaccaugccuggccguuuaucuuauuuaauauuuacaacaguacuauucucuucaguauauauuaaaacccauuuuacagaagaggagacaggcuuacagaggucaaacuacuuauuuaccuggcuaauaagggcagagguaggauucaaaucuaacacuguuuuugacuagaaagugcugauucuuuuuuuuuuuuuuuuugagauggagucucccucgaucacccaggcuggagugcaguggcacgaucucggcucauugcaacguccacucccggguucaagugauccuugugccucagccucccaaguagagcugggauuacaggcacccaccaccaugccuggcuaauauuuguauuuuuaguagagacgggguuucaccauguuguccaggcugguguccaacuccugaccuugggugaucugccugccuuaaccucucaaaguucuggguuuacaggcaugagccaccacacccagccaauucuuaaccaugaaaccacucugcuuuaguuucuacugcuguaacaaauaccuuagacuagcuaauuuauaaacaacagacauucauugccuacaguucuauggguugggaaguccaagaucgagacaccuauagauuuugugucuggugagagcugcucucugcuuccaggaugcugccuuguugcugcauuuucacaugguggaaggcagaaagacaaaagagccuugcuaguuccuuccaacccuuuuauaaggguauuaaucccaucagugagggaggagcccucauggaccuaaucagcuucuaaaggcuccaucucuuaauacuaccacauuagagucuuagauuccaguguaugaauuacugggggacacauucauucagaccauaucacugguuuacauaaaacacagaaagauuguuuucaugacagucgcuuaaauauuucacagugagugaaacugcuguugaaaauauuuauuuauuuuuguuuguugcucucuauagaaggauccaucuucaaguuuuaguuucaggacaagguuuaucuuugcuugaacuuguguauuucucuucccuuagccaaggagagaaucuuaaagcuuggguuucccuaggcagcuuggagugaaauuuaguccuuaauugcagcagcuguuuuuagcuuacuuaggauaauguucuucccuuucuugaacaugacuuuauauaucuauauggaucguuccauugcucaugguuucuuccccacuagacuuugagcuuuuugaaugcagagacuaaaugaacugaauguguaccuaauuuuguaagcugccuuuuuuuuucagaagcaaauuauguugguauaucaagugggauucaguugugaccaguuuucucugcaaaguacucaacauuuauucuguggcugaacuggggcguggguuggagaugcuugcuugaguauaacauccuuauuaugacuguaaaaauuuguguagugaauccaaagcugcagacaaccagguaaaaggugacaauaggaagauauuuauaaaaugcugagaaacuagagugaugcaugguggaauggaaggaaugcuuuuuguaccgaccuuagugggucuuguuccaggaagugaauuagauaagaacagagcaggugucuuuccaugcuugugaagacuuaaacguugguuaagguagcagcuggugaggcucaucuagugaggcuuagcuaacaaauuagauaauaucagagcaggugucuucccauguuuaugaagacuuaaacauguuaagauaacagcuggugaggcucacugugugugggacugguacugagggugaaguugaaaucacauaagaaguguuagccaggguugacaucucauuuucuggaccauggaugucucagucuguuuugugcugcuguaacagaauaccugagacuggguuguuuacaaagagccaagauuuguuucuuauaucucugcaggcugggaaguccaagggcaaggguccuacaucuuucaggggccuucuugcugugucguccuguagcagaagaggaagagagcaugaguguuagagagagaaugaaagaggcagagaagggaaaggggcugaauucaucuuuuuuuuuuuuuagacgcucuuguugcccaggcuggagagcaauggcaugguuucagcucacugcaaccucugccuccuggguucaagcaauucuucugccucaguaucccgaguagcugagauuacaggugugcacuaccauguccagcuaauuuuuuguauuuuuaguagaaaugggguuucaccauguuggccaggcuggucucgaacuccugaccucaggugauccaccugccuaggucucccaaagugcugggauuacaggugugagccaccgcacccaacugaacucauccuuuuauaaggaacucacucuugugauagguaaccuaugccugcaauaacagcauuaauucuguccucaugaccuaaucaccucuuaaaggucccaccucucaacacuguugcauuggggauuaaguuucugacacacaaaauuuuggggagacauucacauuauggcaguggguaucaguccguacucaaaugaccaugacacacagucccaagaaaucaggauuggccuuaaggaaaagauagaguaguccuaauucacacaugcgauucuuccuuuuaaagcuuuuuggucugaaaauuaacuuggagaaaaaaggagguggucauugaaguguucuucuagagaaagauucuuguauucuguuuaaauauaaggauagauuuggaaacaucucacuuguaacuagcugaagauguaccucuuauaauuggcaaaugcauauacccuuuguaaucagcauccugccauuugcaauuguucuguggauguacaugcuguuagcuauggaaagaguuaagggcgaggggauggguugcaagcugacaguuggcucuugccucagccaugugucuguuuuacuuuuuggggccccgagcauuugggagaguugucccaguuguugugaugagcgaaaagcaccuuugauagaaauagagaaaccagaaaguguagccuacuuuguaggaagauaauuaauucauuuuuagacauuuugaguuugaaaugaggguuugacauccggguggaaaugucuggcacuuagcugggucugcuuaauggaaauagcauguaggaugcuggaguucuagaacaacuucugucacuaacuggcuuugugcuccugguuaaaccuuuuaauuuucagggguuucacagguugagugcugcccaguucacuuuccagaagcuccgauacaaagauguucucuacccacuccuugugauugacuccugugcuuccugccuguuggcccuaauucugcucagagguuuauccauccucuuaguccccuuugcuagauggggaaccagaaugugaagcauucggcgucuuguucaaagucacggagagcaucauuagacaaguugggccaggagcuaugcucuuucugcuuuggagaagauaaucuucccaucugccuuuccucuuucuugucguugcucauucuuccauucucuuccauugucuuugcuguccuuuuaucucacaucucuuuuuuccguagccuggagccuccagucagccuugcauuaguggaaacuucuaagccccauugaugaccaucuggguucaggagcuuuuuucuauuggcguagaaggaugcuuuaacuuugugugagagugcuggaaguagcuucguugugggacaccugaaggcgucacuccuguuuccagcagggcaggugugauuagcauuucagaaugugugugcucacacaccacucauguaagcagcaucugcaucucaaccagguuuggcagcugcugcuugagaugcagagcauugcauguacuuacuuagagcuugggcauuuccuaccuguuuugagugcugugugagugcaaugccuauauuaucugggagaaaugagacauuuggaucucugcuugaucacagacaagacaucuagucccugggcaucccuacacuucugggauucucaguccuuccuuacaagcaucaagugagaauuuaucgggccaaggaaaggagucaaggauauugccguuugcaaagagauaguucgauggugauguggugugccaugauuaacaaggacaacaucguucaaauucauaauuaaauggggaaaaugaaguaagauguacagugaaggaaugggaaaaaccugaauuccuuuggaaauugcucaggucauugggacccuggaaauaucuugacuuucccacuagaaauauuacugcuauuuuuaaaaugacacuggccaucugaaaaucagaugguccuuuaagaaaggaaaggaagaaugaaugaugaugucuuucuuuuccccuccccuguucucucuugggcagggaaaagaugccguuccaccaugugaccgccggcuuguuguacaaggggaauuaccucaaccgaucgcucucugcuggcagugacagcgaacagcuggcuaauaucuccguggaggagcucgaugguaaggagccuacccuguuuggggggauggccccccucccagggagguguuucuggcuauugugaagcucaauugaaagcccuggacuuuggccacuccuuggcaguuguggccaaguguagccauggcauaaugggaaagaguucagagacaaaguuuugcccaagugacguguguguguguguguguguguguguguguguguguguguguacagaccugauagccugagcaaucuaugguggauauuucgguuuccuuggauagugacuggggggauagccuucaccucucuuaaaauguguuuuccauuuuccggagucuuuaucaccaauggaauugucuuguuucuguguugucacugacaauggaguccaucugcaggggagguuuaagcccuguuaauggcugucucuugacuucuggccauggugcuuugaauccuguucagaucagaaucaucuggaagcuuugucuaggugacaguggauagcaauuauuuuaauugccucuguuucuuuguaacacaguacagcccugggugcucaaggcagggguuagggauggacauaaaccugggaacgugaugacuaaauucauccuaggacugugucucauuguaucuuggauaaaccaauccucuaauuaaaaauaggaaaaacaagucccccccccccggaauagaggauuagguugauuuggccugauguuuuuaccuagguacuacaucggcugaggucaaaccagaaucaguuuucccucguguuuuugaauacuuuguuguuuguaauaauaucauuuuaaggcacaaaguuuaaauuuacuuucucaaguagagaagucaaaauuaccccaguuggcccacauauuugcuuuuaaguguaaugguucaaaucagugugcuuuguaugugcacauuagggagccucauuucucccagaaggaagauggaggacauuuggcucugagacagugaagccaaacuugcuucacaacaggcaggaagugagggaggugaagaggagaggccauugaauagcuucuccuucucucauccauuuugcuugugugcuuauuuaaaugcuugcuuauuuacaugaaugagcagggaggcagcagaggauguggccccggugggcuggguccaaagagagucugggggauguuugaagaaguggagugauuggggcagaaucaagauuccuagggauagcggcugcucacuguggucuggacaaagacugguggccugagaggagagcaggaacccuuacaucuucuggucuucaguugagcaaaaggugugcuggugcaggacacagaagcaggaaauugagcucugaccuccuccaaagugagcccauacaggcgaccacaaauucaggcuaaggcugcccuuggguggugucuuggucuguucaggcugcuguaacaaaacaccauagacuagguggcucauaaaaaacagaaauuuauuucucacaguuugggaggcuuggaagucuaagauaaagaugccagcagauuugaugucuggggagggccacuuucugauucauagaugucacuuggguggcgucuuggucuguucaggcugcuauaacaaaacaccauagacuagguggcucauaaagaacagaaauuuauuucgcacaguucaggaggcuuggaagucuaagaucaaggugccagcagauuugaugucuggggagggccacuuucugauucauagaugucacuuuucuugcuguguccucauaugguggagagagugaauaaguucuuuugugccuugaguauguaagggcacugucuuagucugcuuuguguugcuauaacaacauaguaccuucuggguaauugauauagaaaagaacuauauuuggcugaugguucugaagacugggaaguccaagugcauagcacugguaucuggugagggccuucaugcuguuucaucccaugacagaagguggaaaggcgagagaggguaagagcaagagagggcuaaacucacuuuuauaauaguccacgcucuggauaaugaacuccccccgagauaaugacauuaauccauucaugagggcagaucuuucauagucaaaucacgucuuaaccaucccaccucuuagcacugucauaaugcuaaucaaaugucaaugugagguuuggaagggacauucaaaccauagcaggcacuaaucccauucaugagggcugcucccuccuaaucaccuccugaaagaccucacuucuuaaugacaucacguuggugguuagguuuccacauaggcauuuuggggggacccaaacauucagcucauagcagguguguuugggaggugaagugaggcccaggcuuuuccuaccuaugggagucuucacugugaauagacauuagggcaggugguacauuaaugugggguggauguuugcuuguguuuauuugaguagauccuccaggcucagucaucagcaggagggacugggagucccccaugcgugcaggacccacugaguggcccuggcugagaacugggcaacacuaucuauauguuuugggcaauuauuuaagagguuaaaaaucacuaaccaaauggaguuuggaaucaucuguggcuuuccauauucuccccccuuccuccuucccaacuuugccaugaaugaucaagagaugauuucucugugacuuuucagugcaauggcuuuuuucacuguuaaauucaagcucugcuaaggcaacuguucagggcuacugugggggugcauggcuuuucaagagggcugcuggcuggauuucaacccuccucucccuacuugggugcccuggugaaaugcccuccacuuuccuggacaaacagaaaagcauauaaacuugcuauuuuaaucaggcaaaggcagcuugagaagcacugaaaugcacuuuuucaguauguagauuagcgagaguaauucuaagagcccuccaagcccaggcuggcagccugagcauuggcagccuugggguaguuuauugagugaagugggggcuuuauaaagucccgagauuggcuggugaagaugcuguguuuguccuucaggaggguaauccaggcucucagccuggggaagggccauuuauuuucugacagaagauucguucuacuuauuuauuuaguuuuugccaaggcgaacacugaguuaugacuguuccugguuuauuacaagcaucucggggcucugggcaggacagugcggauguguucugauuuuagagcaggcacgcagggucuggaaaccaacuggcuugaaucaauucagaugacuauggauugguguuggggaagccaguuuccagggcauaguuugcuugcuguucucuugggcugcugcauggcaaggugacccuaaaguucugcugguugggggcacucauuuacccucagaggacagguggugcugcacugggaguugauguguuggacacugauggacaucgcagcauccuuuguggucuggcugccuugagcauaggcauuaguugggugcuauccuuaucugcugucaagcuccccacccugcagccacugcagccuucugcuugugaauggcuacagguuuccccaccuguucguguuuaucaccaaugauggaaaaucccuuuccuccaguguaagggccaaaggugugcacuucgugaaugguuauccucugaaaacaggcaugaaaaggaccacuugccacgcaggucauuuucagcugcaauucccuucugggaagucccuauuucuucucuuuacacaaagcucaggagggaaacaugcaaagcugcuucaaaaugaucagauuaaaguugggaaucacccagccaaacucagugaagguggauugauggagacagucauucauucauucauccauuuuuauucauucauuaaacggauauuuacuagguggaggaggaaaugccuucuagguaguagaggaaaaucaaauaagcauaauauucauugccucuuuccaaggagcuuacgucuauccaggaaguuuaugcauauaccagauuuauuagcaauaucuuauacuuuuagagugcauuauauggaauucuauuagauauaugcaguaugauuguugaagaauaguuuucuuaaugcuauuuauugaauaaucucgugauacuaucuuuuuuuuuuuuuuuuugagacagucucacucucaccgaggcuggagugcaguggcgcgaucuuugcucacugcaaccuccaccucccagguucaagcuauucuccugccucagccucccaaguagcuaggauuacaggcaugugccaccacgccugacuaauuuuuguguuuucaguagagacaggguuucaccauguuggccaggcugguauugaacuccugaccuuaagugaucuacccaccuuggccucccaaagugcuggaauuacagucgugagacccugugcuuggccuuguaaugcuaucuuaaucuuaaacuaaauucaccuccaucugaaguuuaccucuuuucuuuaauauauaauguuccacuguauauaaauauaucuuaauuuauuuuccuauuuuauucucaguggauauuuggguuguuuucaguuuggagcuauuaggaaauagcuauuagcuauuuuccaguuugugaaaaucucuucuguuucuggucauaaauuauuuguauauauauucauaauaaaagucuuuuucucuacgucuuccagaugaugguaacuuucuuuugcaugaaacuuuuuuuuuguauaauuuauauugcuuuuuucuauuaugcuuuguaacucaacauuaugaaguuuuuuuguaggcucaguauuugucaguaaacaagguuuguaaggagucuaacuuuggccaggcacaguggcucaugccuauguaaucccagcacuuugggaggcugaggcaggaagaucacuugagccuaggaguuggagaccagccugggcaacauagggagacccugucucuacaaaaaauuagcuggauguguuggugcaugccuguaguccccaccacuugugaggcugaggugggaggaucgccugagcccaggaguuugaggcuacuguaagcuaugauuguacuacugcacuugcacuugagccuuggugagaaagaaagacccugucucuagggggaagaaaaaaaaaaaaaaaaaaagaaucuugccuucuucacuuuaucccaaaccugagauaauauuccccaccgcccccgcccgccgcuuuuuuuuuuuuuuugagauggagucuugcucuguugcccaggcuggagugcaguggugcaaucuuggcucacugcaacgucugccuccuggguucaagugauucuccugccucagccuccugaguagcugggauuaugggcaugcaccaccacgccuggcgaauuuuuguaauuuuaguagagacaggguagucgaggcuggucucgaacuccugaccuugugaucugcccaccuuggccucccaaaguguugggauuacaagugugagccaccgugccuggccuaagccuuuuuauccuuagacuggugagagauugauaugcaugccgucuccaguuuccagaagacauucauguagcccauggcucugggcagaggugggggucucggugguuguuccugcugucuuugcgcccuaugccacagaauucuccaucuauguuguuuguucuuccucucuccuucucuccuucccauucccaagcuacucuuguacguuuggucauccuaggaacauuuuggcuuucaccugugcuguauagauaacccaggaugggacauaccaacccauggcugcgguuaaguuguguuccccaaaugagcuuaaaaaagggugcugcugaaguggguuuggguugaggaauagauucccauggaaaacaguggcugugaaguagggagugacugcaugauuuacugucaauguauuguggugagucagucuuccuuaugugccacuguaguuccaaguguggguggaaauugugucucuccaauuucauuggcggggcaauuagcaaaaauucccagccucucacaugugugcaugucucaaaauuaauauuucuuuuucuuucuuucuuuuuuuucguggagacagagucuggcucugucgccuaggcuggagugcaguggugcgauuucggcucacugcagccuccaccuccuggguucaagugauucuccggcuuuagccucccaaguagcugggacuacaggcgugcaccaccacacccagcuaauuuuuguauuuuugguagagauggguuuuugccauguuggccagguuggucucgaacuucugaccucaggugguccaccugccucgaccucccaaagugcugaaauuauaggcaugagcgaacacaccuggccucaaaauuaauauuuauacugauauacucuucuguauaucauaggggguauuuugaguaugggaauagaauaccagacugccauccuuugaaccugggguuccauuuuaguaguugaccagugucacuuugacuauuccagagucacugcucuccugcagcucaguuuucucuaggagccccuauuugccuccucuagaugacuuuuuuuuuuuuuuuuugacagaaucuugcugugucacccaggguggagugcgguggcacgaucucagcucacugcaaccucugccuccuggguucaagcgauucuucugccucagccuccugaguagcugggauuacaggugcccaccaucacgcccgccuacauuuuguauuuuuaguagaaaugggguuucaccauguuggccaggcuagucuugaauuccugaccucaggugaucugccugccucagccuccaaagugcugggauuauaggcaugaaccaccaugacuggccuagaugacuuuuaauguuuauucaggacuuucugcagcaucuggcacuguuguucacaccuuaguuuuugcaguccaucacugccuugguacccaugucguuaccuagaucuccuccuuccucuuuucuacauauuugucaucucugcauucauuguguaccccucaucuccugccugcugaaaacuauauauauauauauauauuuuuuuuuuuuaaaaggcaggcacagugguucaugcuuauaauccuaacuacucaugaggccgaggagggaggauugcuugagcccgggaagucaaggcugcagugagcuaugauugugccauggcacucccucagaaaaaagaaaacaaaaagaaauauuauaagaaagaauggaagauagauauucaccaugcauuccuaaaccucuauagaugugaaauuuuuaaaaaagauuaaagaaguaugaggcacacucuuugucuccugggguugguuuuuguugccuucugcccgagcaucuacgugcugaugaccucaagauacguaucuccaguccugccucccucuuggauuuuagaccuaguaccuguaguccugugcaggugucucacaagucccuuaaacuccaaauaucuaaagccaaaauggauuuucuuuauucuugaaaacugccucuccucugggauuuuucccaggaaauuauauugccagucagccacagcagucaucugggaaucauccuuguuaucucuugguccuuacauacaaucuuuagucccauauaucuugaccucucuucguauucuguaagucuuccuuccucucugaccacauugguauugccuugggucaaguuuccacuuccuagacaacagcauucacuggagcugaucuuauuggguuucaucuaugauccacccacaugucaguucaguucgauaccauuggagggaugcuacucaaaugcacacuuaguuagguuauuccuuggcuuauaacuucuuuuuuuguuuauuuuuaagacagugucuugcucuguugcccaggcuggagugcaguggcacaaacauggcucacuguagcauugaccuccugaucucaagcgaugcuccugccucagccucccaaggagcugggacuacaggugugugucaccacaccugcuaaauuaaaaaaaaauuuuuuuuagagauggggugucacuauguugcccaggcuugucuugaacuccagggcucauguaauccucccaccucagucucccaaaguacugggauuacaggcaugagccaccacacccagccuuggcuuauuaaaacuuuuaucuucuuuuuuuguguauauacaaauaaaaauacauuuuaaaaaauauuucuuuagucuuaaaaaauucaaauccacagagguuuuuggaaaguaaaagugaauaucuguauauccuucauuuauuuagaauuuauuuauuuaguuuuuugaggcagggucuugcauugucacccuggugagugcaguggugccaucagaauucacuguagucuugaucuccugggcucaagugaucccccugccucagccuccuaaguaguugggauuauaggcaugauccauugugccuggcuuacuuuuuaacauuuuucagcauuuaggguuuuuuucucucucucaacacacacacacacauacauacacacacacacacacggaaacacccaaauuuuuuucagaucuagaauuuucauuugguucuuuuuuauaguucccauuucuuuggugagauacccuaucuguuuaaucauuaagacaauaguuuucuuuaauucucugauuaaucauuaagacaauaguuuucuuuaauucucugaauauacuuuucuauguuuauaauagcucuuuaaaguuguaugugcuaaauccaacaucaaggcucuaggccauccugggauugguuuuuauggacuuuuuaaaaagacuguggucagauuuucuuuuuucuuugcaugccugugaauauuugacuauagacugaacauugugaauccuauguuagagugauuauguguuaucuuucucugaagagugcugauuuuuguucuaguagguaauucaauuacuggcugaccaccuuaaauuuguguagguucguuuuuacgcucuguuggggggcaaaucaguggaaacugaccaucucuuaagagguggucuuucuagugucuuagcuggaugccuggaguacuaaugagguuuuuccacuaucugcugcuucaguuauaguauuuguuuucuguucucaaccucauagcagcugcuuccugguuaagucuuauuuaaaaucucaccuugcauguucucacucauaggugggaauugaacaaugagaacacauggauacaggaagaggaacaucacacacuggggccuguuguggagugggggcaggggggagggauagcauuaggagauauaccuaauguuaaaugacgaguuaaugggugcagcacaccaacauggcacauguauacauauguaacaaaccugcgcauugugcacauguacccuaaaacuuaaaguauaauaaaauaaaauaaaaucucaccuugcaucuggauaacauaggcuucaaccagauguucauggggaacccacacaugggcuucugauguucccucucugcauaguguucuucucucuccuguccuacccugcagauucuaguucgugcagcuacuacgugaauugugguugggaaauuguccccaggcagagagccagggcgagcauggggcuugucaugugaauuucccuucuccuugcaauuguaaucuugugcugccuguugucauuugccugaaaacaguugccucauauauuugguucaguuuuauugugccuggcuuauggcacauggugggaggguuauucuugcauaaguuucuuugucauacccagaaguauguuacaauuaguucuguguguguguguguguguguguguguguguguggcagggucuugcucuguugcccaggcuggagugcaguggugugaucucagcuuacuuuauccuccaccuucugggcugaagugauucuccugccucggccucccgaguagcuaggacuacaggugcaugucaccaugccuggauaauuuuuuguagagacaggguuugccauguugcccaugcuggucuugaacgccugggcucaagggaucugccugccucauccucccaaaguguugggauuauaggcaugagccaccaugcucauccuguuacaauuaauuuaauuuuauuuuguuucccugaauuaguuaaaauugucaaccauuauagcacuuuuaacauuuugcuucugcuuaucauucuuaaauagcucucuacagccuacagccauguuacugguaucuagacuuggugacaaaguguaugaaguccuguguggcugaaucccuucuuuuuuuuugucugcuucaacucccugcuuacccuccacacgauccccugcugccuugagcuccuuccuccuucuccgcuuuuguuuaagcuucuugggccagacauauucuuugucugccugggaaaucccuaccuauucauucaacuuuuuaguuucaauauugucacuguugucaucaucauaaucaucaucacagcuaaagcuuauugagugcuuacuaugugcuaggcacuguucaaaguguuuuauguggauuaacucauuuaaccuuuucaaucauccuauuaugcauauacuauuaauuuuuauuuauuuauuuaaaaaauuuuaaagacagacugucauucuguugccccggcuggagugcaguggcacgaucauagcucacugcagccucacacuucugggcucaagcaauccugccaucucagccucccgaguagcugaggcuacaagugcacaacaccacaccuagcuaauuuuuaaauuuuuagcaaagacgaggucuugcuguguugcccaggcugaucucaaacuccuggccucaagcaauccuccuuccucagccugccaaagugcugggauuacagaugugagucaacacacccggcccagguacuguuacuaacuacauuuuugcaaacgugaaaaauccagaaguuaaauaaccuuguccaagguuacauaaccagcaucugcuggaccugggauucaagcugccaccuggcugcacagcccaugccauucacuuucauguacugaauccugcucccugugagaugagauccugugugcuucccuuguacccgucaugucaccaucacauauaucucugccaccacugugacacaugggugagcacuuggcugauuaaucaaauuucaguggguggagagauauuuuuaaagcucugugugagcccagagugcuccuuacugagaggagaggugcccugcagcccaggaaaggcuggccaugagcaugacuuuaugccaggaggggggcugguuucugugcaguaagcucuggagggcccucuccaccugccacccaugugguccauccuacguuuucuuguaaugaaggucccccguccccuacuguuuuaucccguuuuugccgguugauuucaggaucccagaggcaaacucaacuugccuuuuuuggagacacuucucucuacaggcuuucuaagaggagguuugaaggaggcagaaacauuccuguuacaagaagacaagcucacaacucuuaucugauggcucaaaguucucuccuccagaggaagccuaaaaccuacgcaaugaaugagccacaucaucaucccaauaagagggggagugucagauauacagcucugcccugagcugggaauuagcuuuacaacauacgucuuuuaucugccuggguaccuuccuccuggaggcuugaccugcccuuugagccuugagaaagauaucuuuuguggagaguugugaggcuuuguuagcagggcagagcagggauuucucugaugguagcugcuuccaagggcccauuccuuaaagaggcacuugcuaagucuucuaguaguuucccgcauguuguucugaaaaugcauuuugauagcuguggccaagaaagaaacccgaguaccuaccuucccugccagcuucaugcuauuaauuuguaauuuauauucugccuguuuccaaaagcgaucaaggcaucauaagauaaaagaaaaaacacaacugcaaaggcugucagaauagaaauagaaaauagaaauccacacacagggaggaaggaaaaaaauaugacagccccuuaaaggaacacauuggcucggaaugugcaugacauuagcugcaaauuuccaauugguugaggcaaaaaguuaaacaccaguuaccugauuccagugauggccuuaaagugucuauuggaagaaugguuuucucaacuauauuuuaagcaggaacucuuugccccauauucaaauuaucuaauauacaaguauuuuguauuauuucagacacauugguggcuuucaaccuuaccucacuaucaaauuucuguggacuuuuucaaaacauacuucuucuaguaauaguaagcuaucaugauggugauuuucaaugaggaaagaggugcucauacuagacuuucuagaugcaaggagauggggguacauuguaguuuaguuuuuuuuuuucuuccugagauaggaucuuggucuguuguccaggcuggaaugugguggugccuucacugcucacuguagcuuuaaccucucagguucaagcgacccucccaccucagccucccaauggcacaggugcgugccauuacaccuggcuaauuuuguuuuguuuuuuauuuuuggagagauagggccucacuguguuucccaggcuggucuggaacuccuaggcucaaaugauccucccuccuuggccucccaaaaugcugggauuacagguaugagccacugcgcccagccuuuguaguuuagaaagccuucccaacaggugaucuaaauacuggcuuuagaaaaauguguccuagguucuuauuucuaagaacccugcaugagauagcaagcagagggugguaucuuguuaugcaaaagaaccugcugcaucuuaaagcaugacuuugacuugagcuauuugaggaacaggaguaaccacguguuuaucucagucauaaaaucaccuguaucuuguuccuggggaaccuuucauuuucaacagaaaugcauuguaacagaucuaguaagcuaauuaagccccaucgugcucccccagauaacuaaaugaguuaaccuguugaguagaguuguugaacauuauccaucuggaugcugaagggaguuugccaaaacccaucauuccgauguuggcuucacugacacuauuguuucuccuugcaguaauuggccagcagcagguucaacuguucccugggacuacucaagaauuugauauuagcaacauguucuagcagcaaugacucacuggucuucucucuucacaguggcauccagggcaucuaaacguugcuccacucaucgcaggugaugaguuaggacacacccauuuaaaauacaaauuugcucuaucaacauggucauuaauauuuacuucucaagaaggaagaguguugaauuuacauccagaccuguauugccauauuacuguguaacaaaugacucaaaaacuuccugguuuagcuugggcgugguggcucaugccugucaucccagcacuuugggaggugaggcaggaggauaacuggaggccagaaguucgagacaaaacccugucucuacaaauacuacaaaaauuagcagguacauggauggagcugaaggccauuauccuuagcaaacuaacgcaagaacaggaaaccaaauacugcauguucccacuuguaaucuggagcuaaaugaugagaacacauggucacauagaggggaacaauacacacuggggccuaucagaugguggaggcagguaggaggagggagaggaucaggaaaaaauaacuaauggguacuaggauuaauaccugggugacgaaauaacccuguacagcaaaccccuaugacacaaguuuaccuauggaacaaaucugcacguguaccccuaaacuuaaaaguuguuaacaacaaccacaaaaaaucagcuggguguggugcuugcacaccuguggucuuggauacucaggaggcugaggcuggagaauugcuugagccuaagaguuccagguuccaggaugcaaugagcuaugaucgcaccacugcacuccagccagggcaacagagcgagacccugucucaaaaaaaaaaaaaaauccugcuuauuauuuuugagcaggaaguguuguagcagauuaggaucuacagacagaucuauaauuuuaaaguguuggagauuuguccuuuuuugaagauauauuuuguucaaagaucuuaacuggcuuuuauaugcaguucuggaguugggcaacaccucauucuauaaagugaguguucuuaugagcugagcagagaaguuugguuuuauagacagaaaagggcugaggaaagcagaaacagaaaacaaaaaaagcagauugauuguuucagagcgacuuuuccuuguaaagguuagagcagagggacuuccuucacaugcuggcuaaaaugggcuugcuuaggguuuggcugccagcucuccgucuccugacuucucagaaggucauauaaaccaauuaguuuuggcucggucguguggaacuuuuagcaugagggacuccauuuugguuugguuuauugggccgcgugcaggagcucaguccaaaccaguggcccucaucaauuucacuuaauauuuaugcaaagcaguucagcaagguaaaaggaggggagucaacagggaaggcuggauggccuagacccuugaagccugcaggaggacauuaauuuggggggaauuuguuucauccuugaggcagugccuaaauauaucaugcuuaucccugggaacaaacacagugaaaugauaggcacauagugacugcucaaaaauacuuguugaauaaaugaacacuaguuccucugauaagagaacuuugucaaaaaaugagcucauuaggcugggcaugguggcucgugccuguaaucccaacacugugggaggcggaggagggaggauugcuugaggccagggguucaagaccagccugggcaacauagugggcaacauggcacaggcugggcaaccagccuguacaaaaaauuaaaaaguuagccaggcauggugguggguaccuauaguccaaguugcccagcaagcugagggagaaggauugugugagcccaggaauuugaggcuccagagagccacgaucaugucauugaacuccagcuuggaugacagagugagucccugguuaaaaaaaauaaaauaaaaaauaaaauaaaauaaaaaugcaugguugaagaugcauggcauuugaccuacuucaccaccccacaaguuuugauuuucucaccuguaccauguggauaauaauauauacuuuauagggauaauaagagauaauacaugcaaagugaggaauuacuauuccuauuauuguuccuaucuguugggcacuuacugcaugccaaauacacacaguaugggaacaauagcaggaauaguaauuauuguuauuguuaugaugaugaugcuuauuaugauggaacaaacccagacaaaggaccaccaccccaacacuggggcaaauaguagcucuuuagaggagaagcaaaacacuggacaggguccaaugcaauuguucugccaggacaggcccacuucacaauguaaaugccucuaacuggagaggccugucaguaaauggaagaaucuggacaacccauugugagucuuugugucuuagcucuaagcgcauaaggauaccuuuccuacucccccacuucaaccucagcacuuuguaucgcaguggcuguccucauugguuuggagguaacagacuuaaauugccagagagaggagagggaagaggaaccaauaauaguuuccaaaccuugaauuguccugagggauagaaccaggauccucuuaaagaaaacguaguacauauacaacauggaauacugugcagccauaaaaagugaaaucauguccuuugcagcagcauggaugcagcuggaggccauuauccuaagugaauuaaugcagaaacagaaaaccaaauacuccaucuuuucacuuauaagugagacauaaacauuggguacacgggaacauaauaauggaaacaauagacacugaggacuucaaaacagaggagagaggaaaagggcacguugaagaacuaccuauuugaguaguacuguguuaacuguuugggugaugguuccaucaaagcccaaaccucagcaucaugcaauauauccauguaacuaaccuguacagguuacccccgaaucuaaaaagaaaaaagaaacaaaaaagauccaggauccucuaagaccuggguuucgaugugggaaacaucugcagauggcugcauaugcaggccuuccaaguccuccgugugaugcucucaaggaucaggagggaacguguccauagaucuccuuuuaaaguuaguagauguguccuauaauacuuauuccuuggguaggagcugcgguggugaugggacauggggaggcugaaagcaaggccgguugaccagaacucacuccccuauggagggugacacuggccucucuuugaguugagcacacuggaaauauuucucugccuuccucucuaaagcgggaggugguguuugaagagcgaagcuuucugaaaaugggaagagcccaaccauccguguugcuggugguggauguuagcaugccuauuuucaggaguguuccuuuucccugauuauucucacuccucuugcgguuucccuaacgucaucugguuaacauucaaggccauuuuuguuucaguggugcuuccaaacucuacucaucaacuucaauauuaagaguuuguuuguuccacuaaaguuuuauggugauggugaaaaaaguaugugguggugguguuuuuuuccuguaaagcugcuaaaauaagcuggguguggugauucaugccuauaaucccagcacuucuggaggccgaggcaggaggauuacuugagcccaggaauuugagacuugccugggcaacauaggaagaucccaucucuacagaaaaucguugaaaaaguuauccaagcgugaugugcacaccuguagucccagcuauuugugaugcugaggcaggaggauugcuuaagcccaggacuuugaggcugcagugagcuaugaucgcacuccagccacugcacuccagccuuggcaacagagugauacucuaagaaaaaaaaaaagcuucugaaauaaaugguuucaggacugcaggugaugcuggccucaggagugugccaccauuuacaugcucauguguacggauagauuuuuuguguuuuuguucuuguuuuuguuuuuuugagacagagucucgcucugucacccaggcuggaaugcaguggcgugaucuccgcuuacugcaaccucugccucccagguucaagcaauucuccugccucagccucccgaguagcugagaucacaggugcgugccaccacaccuggcgaauuuuuguaauuuuuuguagagauggguuucacuauguuggcccagcuggucucgaacuccugaccucaggugaucuacccuccucggccucucaaagugcugggauuacaggcgagagccaccgugcccagccuacugauaguuuuuaagcuggugccaguuggugugugcuuugcugcuguuacucugcucguauccagugaaaugagccucaggguauguugcagaccucaaccaucugggugggaauuuaacaucucugaaccuagaagcaccguagggaugauagaucauaaaauuuggucugguaccccugugcaauuuguagggcacuuuggagagcuugcuucucugccaucuggugcugugguggggggaagugggaaaaggggugucauggagacaaaucugagaacuuaguguuucuuacaucuguguggggggcuccucagauagccaagugcaauggcuuagccagcacccacuggggguguaaaacuugaggguuucaggugcaugauugaucaugguuuugugcuacucccuuuaagaucccuucagaggugccacucuuucugggaaaagugcccugagcugcugccgaagccucuugccagauuuugaagauccucaguaugcaaguuaagaaaaauguuuuagauuuugaaucuccacgacugugguugaucagccuagcagcccaacucugaaguuuuuaaccuggggucugugcacccguggagcuuaacaauauuguguguguuuaugaguagugauguuuuuucuggagagaagacagaucuguaaguuuugucauauggaguucaacaaacggaguuugucaaaggaguucaacaaaaaggguaacaucaguugcuaauccaugcuucaugaacuggacuucucuuauucuuaucacugcacagggcuuuugcuuuauuuuauauuuuauuuuuuccagaaacagagucuugcucugucucccaggcugaagugcaguggugcaaucauagcucauugcagccucacacuccuggccucuagaacuacaggugugugccaucacacucagcuaauuuuuacauuuuuuguagagaugguaucucacuauguuguccagguuggucucaaauccaaggcuucaagcuguccucccacuuuggccucccaaagcacuggaguguuuugcuuuuggugggaagacuggacaagguauauugaugcuugcugaugagauccuuuuugcauuuuaaaagguugcauugguugugguuugcagaauggauuugagagaagugggccuugaggcuggggcaacaaccagaagcccuuuugcauaguuaggggagaaaggaaaagaaaggaaagggcuuagacugaggaaggagcaaugaguuggggagaaguuggcaugggaauuuaaaaauacagacccuugcuguguuuauguuauucuauuugauguuugcaauaacugggaggcauugguguccccauuauacagaugagggaaauuaaugugaaagggauuaaaagucacuuggccaagucacacaacucauaauuggugggagugggauucccgcuuagcuuaaucagacuccaaagcccauacucuuaauuaacuaccauguuaaauugucucuacuguaauucaucuugaugagauauggaugugggggugaggagugagguguguggccgcuuaacuagguaaugagguacagguggugacaaccgcugagaccagggacagggagucuggauaggguggaauggugaugagaacugaaggucaucuuacuggagauguccaguggguucuugcauauugauuucugggacucaaaguguuuaucccagauauacagauuuuggagucuucauuauacuuaagugaugauaaugagaagacagccaaagacccauccccaaggcccaguagucuuaaucaugcuugaucacaagguggucaaugguggcuggagaacugggagucacugcuucuccagcuaaguuucuucauaucuuuuuuugaugcauacauauauauauauauaaauaauauauuuuaaauugaaauggagucucgcucugucgcccaggcuggagugcagugaugugaucuuggcucacugcaaccuccgccucccagguucaagcaauucuccugccucagccuuccuaguaacuggaauuauaggugugugccaccaugccuggcuaauuuucuuucuuucuuucuuucuuuuuuuuuuuuuacuuuuuaguagagacaggguuucaccauguuggccaggcugcucucgaacuccugaccuugggugaucugcccgucucagccucccaaagugcugggauuacaggcacccaccaccacacccagcuaauuuuuguauuuuuaguagagacaggguuucaccauguuggccaggcuggucuugaacuccugaccuugggugaucugcccaccucagccucagagugcugagauuacaggcgugagccaccaccccuggcuucuucauaucuuuuggcuguguuuaacaugccaugcuuaguccccuaguuucccauaguauucugaaagccaaaaucccguaucagaaagaugaacauguugaguucaaaaagucaccuauuugugcucaauuaaucugguuuauugauugacagugcccuuggguuauugauugauggaguucuucucuuucaaacugcuuguuugaaucagaaaccggucuaaacccaguagcugucuccgauuuuaaaggaaguucacucuggcuccuggccacacaaaucucuuuuucaggguaucagaaauaugcuguaguuuccucugcuaaauggaaccauaaagagacugcaggaaaucaaagauugccugccuauaauuagggcugccccauggauaaggagcuugacuucuugccggugaaggagcaaauuccagggauugugaaaucacacugaacuugggucaaauccuggauguuuuauaucucugugcucuuaggcaaguuuuuuuuuaaaaaauucauuucaguaguuuuugagguacagguggguuuugguuacauggguaaguucuucaguggugauaucugagauuuuguugcacccaucacccaagcagagugcaccauacucaauauguagucuuuuaucccucacuccccucccacucuucccccucgaguccccagaguucauuauaucauucuuaagcauuugcauccucguagcuuagcucccacuuagaagugagaaaacacaguauuugcuuucccuuccugaguuacuucacuuagaauaauggccuccaacuccaucuaaguugcugcaaaggccauuguuucauuccuuuuuauggcugaguaguauuccguggugcacauaacauauacuacauuuucuuuauccacucguugguugaugggcauugaggucgguuccacauuuuugcaguugcgaacugugcugcuauaaacgugugugcuugugucuuuuucauagaaugacuucuuucccuuuggguaggaaccccguagugggauugcuggaucaagugguagaucuacuuuuaguucuuuaaggaaucuccacacuguuuuccauagugguuguacuaguuuacauucucaccagcagcguuggaaguguucccuuuucaccacaaccaugccaacaucuauuuuuuuuuauuuuuaaaauuguggccauucuuacaagaguaagguggcaucucauugugguuuuaauuuucauuucccuugggcaaguuuuaaacagucacacaucucaguguccucaucugucaaauggggugauaugguuuggcuguauccccacccaaaccucaucaacaauuguaauccaaauugcaauaugcacgugucuagugagggaccugguggaaggugauuggauaaugggggcggauucccccaugcuguucucaugguagugaguucucacgagauuugaugguuuuguaaguggcaguuuccccugugcacgcucucucucuugccgccauguaagaugugccuugcuucucuuucugccaugauuguaaguuucuugaggccuccccagccauauggaagugugagucaauuaaaccuauuuucuuuauaaauuaccaagucuuggguagugucuuuauagcagugugaaaaugaacuaauacaguggggaauauaaucacccaccuccugggaggaggauguggcaaggugccuggcacauggcaggguacuuggcaauagcugaguauuuaguacuauugcuuggcaugucagagggaaggaguaagggaauagggcaauaaugaauuucuuuuaucuuuucccagucuguccaauuaaaaaugaguuaacuaggucaggcauggucaugcaugccuguaaucccagcacuuuggaaggcugaggcaggaggauugcuugagcccaggaguuugaggcugcagugagcuaugauggugccauuguguuccagcgugggugacagaccaaaaccuggucucaaauuugaaagaaaaaaaaauaauugauugaacaaaacuggaaagugugaaggauauuuuaaugugaaagggaaaaaccaagucuuaucugugaauccagaauuuuggucaucuuuuuuagaaguauguguaugugugugugcaugugcuucuuuuuucuuuuuuagagauggggucuugcucuucacccaggcuggagugcaguggcaugaucauaguucacagcagccuugaacuccugggcucaagugaucuuccuaccucagccucccaaguagcugggaccacaggcccaugucacaacacccggcuaauuuuuaaaacuuuuuguagcgaugaggucuaacucuauugcucaggcuugucucagacuucugaccuccagcgacccucccacguaggccuccuaaacagcugggaucauaggugugagccacugugucaggccaggcaagaauucuucgagauggaauuucuugaaguguaggggcaaaaaagcccccaucuaauaggacacuaauaauguccccacaaguugugaaaucuugaaaagugcccaucgcuuccguauaucucuccuuaaagaauauuuauuuaggcagggcgcgguggcucacgccuguaaucccagcaccuugggaggccgaggcggguggaucacgaggucaggaguuugagaccagccugaccaacauggugaaaccucauuucuacuaaaaauacaaaaauuagccagcgugcuggugcgcaucuguaaucgcagcuacucaggaggcugaggcaggagaguggcuugaacccgggagacggagguugcagugagccgagauugcgccacugcacuccagccugggcgacagggugagacuuugucucaaaaaaaaaaaaaaaaauuauuuaagugagcuaugcugggugugguggcucacagcuguaaucccagcacuuugggaggcugaggccagugggucacuugaggucaggaguucaagaccagccuggccuauguggcaaaacccuguuucuacuaaaaauauaaaaauacuagccaagcuugguaggggcaccuguaguccuagcuacucgggaagcugaagcaugagaaucacuugaacccaggaagcagagguugcagugagccgagaucaugccacugcacuccagccugggugacaaagcgagauuccaucucaaaaaaaauaacaauaauaauaaaaaaagaaaagaaaagaaaaaaggcugggugugguggcucaccccuauaaucccagcacuuugggaggcugaggguggaucaugagaucaggaguuugagaccagcuuggcuaacguggugaaacccugucucuacuaaaaauauaaacaaacagaauuagccgggugugguggcgggcaccuguaaucccugcuacuggggaagcugaagcaugagaaucgcuugagcccaggaggcagagguugcagugaacugagaucgugccacugcacuccaggcugggugacagagagagauuccgucucaaaagaaaagaaaggccgggcaugguggcucaugccuguaauuccagcacuuugagaggccaagguggguggaucaugaggucaagaguuaaagaccagccugaccaacauggagaaaccccaucucuacuaaaaauacaaacaauaaauaauaaauaaauaaaacauaauuagcugggcgugguggugcaagccuguaaucccagcuucuugggaggcugaggcaggagaauugcuugaaccugggaggcagagguugcagugagccgagauggcaccacugcacuccagucugggcaacagggcaagcaagacucugucucagcgggggggaaagaaaaagaauauuuauguaagugagcuaagaugugaagguaagugcuaauggcuucagguugacuugugcugcauguuaugacuaagagcucauaacagauucuguccccucagcaaaaaaaaauaaaaauaaaaaaacaacggagugaggaagugcccucugagccucugaucacuguuuuugauuauaauguguuuuuugcccuaaagcauugcccucucacaguaaaacacauuugucuucauagagacaguggcucugugugugugcucgagauagcuacaagucacuugggaggcugaugaguggggacagcagacgauggauccaggcaggggacucaugcaucacguuguucuuucauggccuuaacaaauuaccaggcagagacaaaucaaguacacucaaacaaucauguucucugcauucuccccaaauuugaugcaguccugagcaaauuaugugcaacaaaaccagggcaucuguagagaaggcagcuauaaaauuguucauugccagccuaaggaaauccaacaggaaagacuucaucacaagauucuauagugcacuacacaagagagacagcgcagcaccgagaaagguuccuguguauucugugcaguaguuggucuaguuugcugacaggcagugcuacccaauagucagagccaccaagaagagcagaaauggagccucaguuugccuucugguaaaauggggauaugaggcugggcacaguugcucaugccuguaaucucagcacuuugguaggcugaggugggcagaucacuugaggccaggaguuugaggccagccuagccaacauggugaaaccccaucucuauuaaaaauauaaaaauuaaccaggugugguggcagaccccuguagucccagcuccucuggaggcggaggcaggagaauugcuugaaccugggaggcggagguugcagugagcugggaucacgcuacugcacuccagccugggcaacagagugagacuuugucuauaaaaaaagaauggggauaugguuuggcuuuguguccccacccaaaucucuucuugaauuguaauccccacauguccagggagagaccuggugggagaugauuggaucauggggguaguucccccgugcuguucuuaugacagugaguuuucaugagaucugaugguuuuauaaaugacaguuucuccugcacguucucuguuucucuugcuucgccaugguaagaugugcuuguuucccuuucaacuucagccaugauuguaaguuuucugaggcccccuuagccaugcagaacugugagucaaguaaacugcuuuccuuuauaaauuacccagucucagguaugucuuuauagcaguccuuaaaacaaacuaacacaaaugggaauuguuaucucagaaucacaccuugacucacagaagaaaguuguaaggaugaaggcaucaguuccauagagguaauaaauaaaugagaaauaaacucauaacugaauuugguacauuuucauaaaaugaucaaaaauuugcauuaguucuucaaguuuuuauugcauuucugcaauaucuaagcaguauucccagaugcugaaaaccaaaaugaucaaucagacagagguccagccucugaggacccagccaagagacuaaguccagguagaacaggguggauggaaugucagucucagaauaggagaacuucagcucucaucccuuccagagccuugaccuucucugacccucaguuuccccacuuguaaaaaugagacaauaauaaguaacuuugugaaguuuuuuaaauaccgaaggcauaauauucauugauuugcucauucauucacaaauguugauugagugccuacaauguuugaagcacaguuuuaagguccaggaugcagcaguaagcaaaguagaauucccacagagcuucugcucuuguggcagcaggcauaguauauuauauuauaaaaauuacagaaaauaaaauaagcaggaacaggaguaggaguagcauggaggcuuuguaauaauccagacgagauacggugguggcuaggacaagggugguggcccuggagguuggaaggagcagugggauucuggaucuccgucccucccucccuuccuuccucugucuuucuuuuuuuuuuuuugagacagggucuugcucugucauucaggcuggagugcaguggugugaucacagcccacugcaaccuccacccacccugggcucaagcaguccucccaccucagccuccugaguaguagcugggaccacaggcaagcaccaccacacauggcuaauuuuuuauuguauuuuuaguagagaagaggucucaccauguugcccagguuggccucaagcuccugagcucaagugaucugccugccuuggucucccuaagugcuaggaauauagaugugagucacugugccuggacagauucuggaucuauuucaaagguggacuuaccaagauuugcugauuggggugcgggguagguguagagugcaagaggaagaaagaagugagggaggacuagcaagauaguuggcucaaucaacuagaagaauagaggugagauuaacugagaggggagaaagaaaguccaggagcucaguauugaacguguugaguccaauacuuauuagcuguccagguggagauucugaauaggccauuacaaaacugagucuggacuuuggggacgcauuaagauuuacauaaguaaaauaucuuguguggugugcugcagaauugggugcugaauaaccuuaaugauugaucaauuaauuauaauucuuaaucuauauuuuuaaaauuaaacuuccuauugugagauguguguagagucacaugcaauuguaagaaauaaugcaggaaggugccucuacccuuuguccagugucccccagugguaaugucuugcaaaucuaugguacuguauuacaaccaggauauugacauugauacaguuaauauauagaaccuuuccaucaccacaacucacucauauucacguaaucuauuagaugccauaaacacuacagaaaauaagcuacggcaugguggcuuaugccuguaauccuagcacuuugggaggcugagguaggaggauuacuugagcccagaaguuugagacuagccuggacaacagagugaggccuugucuguacaaaaaauaaacaaaaugagccgggcauggugauguguacccauagucuuagcugcuuggaaggcugaugugggaggacugcuuaagcccagggagguugaggcugcagugagcuaugaucacaccacugcagucuggccugggcaacagagcaacacucuguuucaagaaaaaaggaaaaaaaaaguaguucagaggaaagagaaagaaugucccgguguaacugcucagacagaggaaggcacuugagaugggcccugaaggaugaaaacaauugggauagauaguauaauaaagggcagaaugaaaaaaauccugugauguggaaguucaguguguguuggaccuuggaggcuguugggcuuugaccagaguggaaggugagaggugggcacaucagaagcagaauugaagggcugauuaggucugagggcuuaggguaccaggucaaaagaugggacuguaguagggagguagcugggggaucuuggaaguuuucugagcuugaaagggugcagccucagcuccaagaugauuggucuggucucuaugucuuuaauggaauggagcagggggaacauuggggugaccagagagacccugcccaacagccaaggauaaaggaaagccaggcucuuaaccucacagagguuggaaaaggaugguguaugagaucauuuugcauugcuauauagggauaccugagacuggguaauuuaugaagaaaagagguuuauuuggcucaugguucugcaggcuauacgagcguggugccugcaucugcuggacuucuggugaggccucagggagcuuuuacucauggugggaagaggaaggggagugggcaucacgucgcaagagggggaguaagcgagaugccagccucuuuuaaacaaccagcucccacaugaacuaauagagcaagaacucacucauuacugcagggagggcaccaaaccauucaugagggauccgccccaugacccaaacacuucccaccagaccccaccuccaacaccagggaucacauuucaauaugaguuuuggaggggacagacaucugaacuauaugucagauggcccccaaaaugagucuguaccacaugugaaugguuaagaguacgggugcaggagccaggcuauccaugugccugacaucacucucauucaguauucacaacugcucugccagguccuaugcugucauucugauuuccagaugagaaugcuaaggcauggagagguuaagugacugccucaaggucacacagcuagcaaggcaaagccagguggcagacccaggcugucugacuuccaggcuccuuguuugaaccucucacaguucagccucuccuaaucaucuuauuuagaucccaggcuuauuuuuaaggggaggagccaguggcuagaaaagaugaacacugcauuaagauagaauuuuucagauaauuuuggggagggacuuugagaaagagugguguugggugaaggauaguaaagauuuggaaugaagacugcagggaauuauggaauugugaaagagcccaucugaguuaaaggagcggucuuagcaggaucagcaugguucacugagggucuauuucucucucucucucucucucuuuuuuuuuuuuuugguuuguuuugagauagggucucacucugucacccaggcuggagugcaguggugugaucuuggcucacugcaaccuccaccuccuggguucaagugauucuccugccucagccucccaaguagcugugauuacaggugcccaccaccacacccagcuaauuuuuguauuuuuuguagagacaggcuuuagccauguugacaaggcuggucucgaacuccugaccucaagugaucugccugcuucagccuccugaguagcugggauuacagucaccugccaccacacccagcuaauuuuuguauuuuuuguagagacaggguuuugccauguuggcagggcuggucucaaacuccugaacucaagugaucugucugccucagccucccaaaggcugugauuacaggcaugacccaccaugcccugcugaaggucuguuucuuguugaagauccuguggauagaucugggggaaaagugugccuucuugccugggcuaguccugccuccaccagccauuaaacaugugaucuugggcaaguuucuugacuuccuugagcccugacuucuugaccucacacaggagaguggaaaugcuugccuggcuuccuggugguguugcgaugaugguuucaugagcuguguaugggcaggugucuggugcuuuguacaggaagaugacaccucuguugcucacgacuggaguggagggucuggugaaucugucugauuuuuuucaucagugauacugagccaggcagggguggccugagcuuguccucacucagggcagaaugaugaaucugcaugucugugucuaaucaggucagucagaacucugcgaugucuaguugccuuuuagcacaacccaugugguuuuucaguguuucuuuaaugaagaaauucgugauccaucacugcuuaugugauuuuuuaaauuaauuugccucgcuuuccuuuugucuucuugauuaaaaauacuucuuuuaagccuuucucuuauaucuuggaacauucuaaaacuuaaaauguccuuuugaaauguuucccauagcaacaaaacaugaucgauuauagacuauccugauucucaaaaugggauugagauuauauuuuugaaaaaaaaaaucuagaucgaaauuuaauagauguugugguuggcugaacaaugucccccgaaagauguacccccaaagauaucccccuaaagaugugcguguccuaauuccugacacuugugaacauguuacuuuauauggcaaaaaguacauugcagaugugacuacauuaggauguugagauggagagauuauuugagguuaucugggugggaauaauaauguaaugauaaguguccuuauaagagggaggcuggagggucagagucagaaagccauaugaugauggaagaagagagaauggaagagagaaagaaggagaaagagagagagagauuggcuggaaguugcugcauugcugacuuugaagaugguggaaggggccaugagccaaggaaugcaggccaccucuggaagugagaaaaggcaaagaggccgggcguggugguucaugacuguaaucccagcccuuugggaggccaagguggguggaguucuagaccagccgggccuauauggugaaaucccauugcuacuaaaaauacaaaaauuagcugggugugguggcgagcacuuguaaucccagcuacuuggaaggcugaggcaggagaauugcuugaaccugugagguggaaguugcagugagccaagaucgugccauugcacuccagccugggugacaaaagcaaaacuccaucuaaaaaagaaaaaaggcaaauagauuauccacuagagccuccagaaggaauacagcccucccaauaucuugacuucaggacuucugacuuccagaacaauaagaugauacauuuguguuuuucuuuguuguuguuuaaagacagagccucacuguguugcucaggcuggagugcaguagugugauuguagcucacugcaaccuggaacucccggcucaagccauccuccugucucagccuuccaaguagcugggacuacaggcaugcauuaccuaccaugccuggcuaauuuuuaaauuuuuuguagagauggggucuugcuguauugcccaggcuggucaucuccaacuccaggccucaagcaauccuguugccuuggcuucccaaaguguugggauugcaggcaugagccuccaugccuggccacauuuguauaguucuaagccacuaacuuugugaucacuggucgcagcaaccacaggaaacaaauacagaugucuaccaggggacuauguuaccacuucuguaaagugggcaugauaaucauaauuuaucuuuaauaagaaaauggccuguugagggcgggcacgguggcucaugccuguaaucccagcacuuugggaggcugaggcgggcagaucacaagguccacaaggucaggagauugagaccauccuggcuaacauggugaaacccgucucuacuaaaaauacaaaaaauuaguugggcgugguggcgggcaccuguagucccagcuauucuggagggugaggcaggagaauggcgugaaccgggaggcggaacuugcagugagccaacgucgcgccacugcacuccagccugggugacagagugagacuccaucucaaaaaaaaaaaaaaaaaaaaaaaaaaaaaaaaaaaaaaagaaagaaaauggucuguugaaaacccuugccagaccaaggacccacgaaguucaugaaauaccuuguagcuuucuccguaacuaucuggguggggauagggugaguagaggaagguggccacagggcauacacugggcugucugugauuauauaaaaauuguucugguagggcuggccgggcacaguggcucuugccuguaaucccagcacuucgggaggccgaggcgggcagaucaccugaggucgggaguucgagacuagccugaccaacauggagaaacccugucucuacuaaaaauaugaaauuagccgggcaugguggcgcaugccuguaauuccagcgacuugggaggcugaggcaugagaacugcuugaaccugggaggcggagguugcagugagcugagauugcgccacagcaccccagucugggcaagaagagugaaacuccaucucaaaaaaaaaaaaaaaaaauuguucugguaggaaugaggaucauuggccuaacugugaggaugggguaucggauaguccuggacaaaacaagaagauggucaaaggaccguguccuuauuucuaugucuuuuuuucuccuguccacuuugaggcauuuaguaguauucuccuuuuuuucaucacuuucuuagcaaaacauucucucgaaagagaaucugguaauacugauuuauaccuuggaugaguuuugaucacggaauuauagaguuacugaaaguuagccuggcaggugacacugggggcaggacagggcagcuccuggggcuucccagggaggacaccacucuccaagggacaucaccaagccaccgugugucccuuagaccgcagagcccgagucuucugaguuggagucaguccagaggugucugcaggagcccucaccccucacaauggugucagcauuuuaaggccagucccuaauuuugaaaugagagcuuuuauccucugccaaagaaagaaaccucaguucuaucugagagaggaaaaaggggguguuucugagguaaggguuugaugauccagaggucccauugcauaaggaguugauuccuucaucccaagacccagacaggaaguggaacuggaaagauguuaucauaauaaagugucuggaaauuacuuuugucggauaagagggcacucuggaacuagagaagagagagggaaucccauagggagaaaagaaaggaggcuggguacaucuuaggucugaguuuuguuucauagugaccuuuuuucaauucaaaaauguggaggacgccuugcaguguaagcauugcugccagggcagugagaccuuguggccagcuacauuucuuugcugguggaauggaaacacaucuagaaaugguggcaccagaacacuggugcacagucgcuauugaaagaagaacuggucuuuugaguuuugcugaggcaucagccuagcaaagaaagaccaugggcuuuggagucgcagauaccuggaugaaaaucccagcauugccucuagccaauggugugaugucugggaagugaauucuaucucugaucuuguuuuacucaacuuuauuuauuuauuuauuuauuuauuuauuuauuuauuuauuuagagauggaguuucauucuuguugcccaggcuggagugcaguggugcaaucucggcucacugcaaccucugccucccaggucaagugauucucaugcuucagccuccugaguagcugggauuacaggugcccaccaccaugcccggcuaauuuugcauuuuuaguagagauggggguuucaccauguuggucaggcuggucucgaacuccugaccucaggugcuccacccgccucagccucccaaagugcugggauuauaggcgugagccacugugcccaggcccacuuuacacagcuuuaaaaugagucacaucacaguacugcacguaggguugcaggaaaagucagcacguuacuggugccuaggaauugguggcucagaugauguuguccuuaccagggcggggcugggcugccugcacagaugauucaugaaaacuugaacaguucagagggaggagggaaaacccuacauagcaccuccagcggggauuguucugucuacgucaccucauuugaauauuuuccuccaagagaacucaucaccuacgauguuuugggauggagcaaggugaugaggaugcugaauaaugguccuguucuguuuuccucaugugagauguaggaugccugaugaugucauccaucucuccacaccacgauuuagaggaguuggaauaaaagucagagggagucagaggguagggccgucuuaguauuugguacaauuuaggaaauuggaauuugcuuuuccucucucucugaaguugagcaccaaguuauguaaguuauugcuaacuguggaguugagaaagggaauagucauucuuucuauccauugguagugccauaaaaccacauuuuucugccugcaagcuacuuauaacuauauuuucucugucugggaagcccuuucugcuuguucuucaccugcugaguuccuacucaacccccauuuuaauugccacauccuuuauggaaccuucuaaaaucacccuacagcuagaugaaauucauucucuucaaccugagaaagcugauuuaaaaaaaaaaaaaggaauucauucucugugcuuuaacuugguuuauuccucauuuauaucccaauaauaaauuguggaacuuuucuguuuucuuguuuauauauuuuaguuccucuacuggauuacauccuagagagcaggaacacgcuuauuuuucaauccuguuuacagcagucuuguacguuguaggaacuuaauaugguauuuguggacuucuugaauagcuuugcauugaaauaauugaaaccaaauacccagaauucugaaauaaucagaguuugagggaucuuuacccuaucguuuuaucggaaucuaguaaagguuuccugaacaucugcuauaugccaggcacugggaaugcagugaugaaaaaguugaagucucugugccuaaaaucagagauuucuucaaaaacguaacuuuagguucuuuucuggaguuccuugcagggucagcccaugcauuguaccuucuauguguauggucuugagcaaggagauuuagcuuucagcaaggagauucagccuucagaaaaguccucauuccauucagcaggaugggagaauucaauauacagacuugacaguagcuccuggaaagaccauuguacgguagauagagguagaacagucggcauucauggugaccuugagcuagcaaauaaaaacuaaaaagaaggaauagaaguaugucauauguuucagcaguauuuccauucaaacuuacuaaguggacuuugucucuggacuuuaguuagguagagaaauucacuuagguagaaugaguucuuuccuucgggccagugaggacucacaguuaguucuauggcccacuuugcuguccacauacagaaucucauuagaucagccuagcagcuugauuggcucagaagggccagggguuuugucuaaggucacucacuccagacaggagaaaccacuaaguccugacagugaguacugggggcaggggcggaggaguggggagcgcugguucaugugcucuucccgccuucuugugccuggggcuguuucucuuaguccccaacacugcauccccggaugcagcuaagguuugcuaggucagcacuuagcaccgaaagaagcucacugauuuaaaaaacaaacaaacguuagacaguugggaguaggaaaauaaucaaaauuacuucuuaucauggucaguuugggcugcuauagaaaugccaucaguuggguggcuuaaauaacaaaaguuuguuucucauaguucuaaagggcuaggaagucuagauuaaagacggcagcugauucaguucuugagggcucucuuccugguuugcagauggcugccuucuugcuguguccucacauggagagagagagagcucaguccuuucuuuuccucauaagggcacugauaccaucacgggggcuccucccucaugaccucaucuaaaccuaauuaccucucagaggucccacuuccaaauaucaucacauugggaauuaaggcuucaagcauucacuccgcaucacuucccuuuaucuggauuacugguuagguucagaucauugagugaaauuggguuuugggaauaucuacauccauaucuauaauaucaaaugucuuugcuaacuuuaguauuauuuuucuggcaauaauuaaaagccaguuaauuuuuauuuuuuaauuuuaauuuuauuuuugaguuggauucuugcucugucacccaggcugaagugcaguguuguaauauuggcuuacugcaaucucugccucccagguugaagcaauucuccugccucagccuccugaguagcugggauuacaggcacaugccaccacgccuguauaauuuuuuuauuuuuagcagaaaugggguuucaccauguuggacaggcuggucucaaacuccugaccucaagugaucugcccaccucagccuccuaaaguguuaggauuacauguuugagccacugcgccuggccuuaauuuuaauauuucaaccauauuuagccaaugcuuuuaggagucccugaagguaugaucauuuacuuuuuuugaauuguuuaugaguagguaaaaaccugacauuuccagauccuccacuagaguggauuuuauuuucccaaccguguacaaaaaauaaugaguuguucucucuuacucccaaagguuaaaaauaauuuaagauuuuuaaacccaaacauaaaguuaccauauuauccaucaauuuaugccuauaccccaaaggauggaaagcagggacucaaacagauaugugcacaucuauguucauagcagcauuauucacaauagccaaaagguggaaagaaugugguauagccauugaauggaauauuauucagccuuaaaaaggaaggacauucugacacacacuacagcaugggugcaccuugaagauagcaugguaagugaaauaagccagacacaaaaggacaaauacuguaugauuccauuucuaugaggucccuagaauagcuaaauucauaggaaguagaagggugguugccaggggcucagaagaggaggaauaggguuguuuaacaagugcagaguuauuuaauagguagaauuucacuuugggauaaugaaaaaguccugaggauggaugguggugguugcccaauaaugaaaauauacuuaaugccacugaacuguauacucaaaagcuuaaaugacuaaaaagagagagagagggauuuuaaaugcguaaacuuucauccuaguggccuuuacuuuuuagauggcaugggcugcuuuuguuuggagacaaacuaaagaggcauggcugaguuaugguaucuguuguuuuagacaugaguguguugcaucagauauauuugaaccuuuuuuuuuuuguuuugagauggaguuucacucuuauugcccaggcuggagugcaauggcgugaucuuggcucacugcaaccucugccuccuggauucaagcgauuuuccugccucagccucccaaguagcugggauuacaggcaugcgccaccacgccuggcuaauuuuguauuuuuaguagagacaggguuucucuauguuggucaggcugcucucgaacuccugaccucaggugaucugcccgccuuggccuccaaaagugcugggauuacaggugugagccccugcacccggucugaaccuuuuuuguuuaaguaaaugugugggggggaaaacagaaugugcucguaccauucuugacuuuuaaaaauuauuaaaaacagaacaaaauaaagacaccccaaaaaugcagugcacaagucugagaaaagacacuaagaaacgacucucccuuccccuaguccauggcugguguaaguuuagugaccaauaaaugccuguugaauggugaauacuuucauugugcaaaacagacucuaacaugaaugauucucaagccaacuuacuugaacuaaaacuauucaaauucagcaaauauuaacuaagaaucuacugugugccagagaauguaguaaaggcuagauuggaauugaaaugguucaaagauaguuugauuccacuccagucuauugagaggggcagauauagacucugauaaugcggggaguaaguaaugcuuuuagaggagguggcugggagcacucaaggaagguuccagaaggccaaauaaugcuuuuaaaaaccaaauauuuguccaguguaaacaggcaugggacuggccuuccagguagagagaacagcagaaaagcaugauacacucugauuuguauaggucacuuggaaacauaauucagaccaguggaagugauggacccuacacauuagugauucuuucuccaagaacacugcccacacucagugaaugacuggauuucuuugccagcugacuauagggccuugagacauccucaggaauaaacuuaacagcaacgaauccuucucuucugaagaugaggguaguuuuagcaacagagaauggcaguuuagagucaaaucauguggagcaguugauugaucaaacuagcaguaauguuuguaugaacaugcaguaacaaguugaucuguguuuguuagacacuggcuuuggaagcuauucagcaaaucucccccagucgcagcagcucauaccuguaacaccagcgcuuugggaggccaaggcuggagaauugcuugaggucaggaguucaagaucagccuguacaacagagcaagacucgaacucuacaaaaaguuaaaaaacuagccuggcacgguggcacguccuuauagucccagauacucagaaggcugaggugggaggauagcuugagcccaggaauucaagggugcagugagcuaugaucacucuacugcgcuccagcuugggcuacaaagcaagaccccaucuuuauuuaaaaaaaaaaaaaaagaaauuuccccaaguguuucgagaacuauaggacugguggauccuaugagacuucccaaaguagcccccacacuccuggagucucucuucaaaacauuagucucaagucauuacagcuagaacuugaggcuaggauucucuccaggauuguugaguuguuuacccagcaaaaugagcugguuguaagaaugucacucauauuuaaacuuaaagcuugguuucagcauggucgaauagaaauccuuaagcccuuccacccuuggcuuguguugucucugcuggcaugcaauguacaagacuauccugcuuucaggaggggaggcacuuugacagugguucuguugguuuuaguaagggaaugcacagucgaagcugugcauuguguacuaaguggugcacauucucucuucugaacccuguugggaucgagggcacauguaggagcuaccuggcagaggcugggcauucugugucauuagaaaauccacauuuuuuuuuucuguagcaucccacguuauucuguugaguuaacuugaucuacaaacccaugcaccuuggggauuuaagaaauuaacaccuuagaaaaguuauacccagauaauuuaggaagauuuugcuguuuacauuuaaauacaggaauauacuaaacuuuuauuauauguugauauuuaugcugugucagaugugcagaauacaauagaaauaaaaaucucugcacaucaagaggguuuagaagcuaagacagcagagcgucacagaaucuuugguuuauuuauuuauuuauuuauuuauuuuuagggacaaggucuuguucuguuguccaggcuggagugcgguggugcaaucauagcuuauuauagccucacuccugagcucaagugauccuccugcuucagccuccugcguagcugagaauacaaggacgugccaccacuccuggcuaauuuauuuauuuuuuuggaaagguggggucuuggugugcuucccaggcuggucucaagcuccuggccucuagugauccuccugucuuggccucccaaauuguugggauuacaggcaugagccacuuuucccagccaucacagaauauuugaauagaaagcaccaggagguauuuuagaagucacggaguacaacaucuuacuggcuguaaaggcacagauuagugugaagagucaggcuguuuaagguggggcaagagucugagggcccucucuccugcuuccuagcuuuguccacauuagugggggaugucugaucaugagaggucugggucucugucuugucacaaucuuuucuuuuucuaugacacuguauuagccuguucucaugcugcuaauaaagacauaccugagacuggguaauuuacaaaggaaagagguuuaauugacuuacaguucuacagggcugaggaggucucaggaaacuuacaaucaugguggaaggggaagcaaacaugcccuucuucacguggcggcagcaaauagaggugcagagcaaagaggggaaaagccccuuaaaaaaccaucagaacuugugagaacucacucacuaucaugagaacaacauggagcuaacccucccugugauucaauuaccucccacugggucccucccaugacauguagggauuacaagaacuacaguucaagaugagauuuggguggggacacagucaaaccauaucagacacucauuauuccaugaauuucuagggaauaaaguguugcuagggaauaaauucauuaaauaaaaaaaucauuaaauaauaaauuauacucauuaaauaauucauucaauaaauuucuaggaaauaaauucauuauaccaugaauuucuagggaauaaagccagcagcucagucucuuugcaacucauucucauagacauuuguuucucuggauggagaagacuccaguuaaaauuuaaaaaucaaagaaaaaaauggaaauauuaaaacuuaauuuugaugugcucuuguaacuaucauagaauacugauuuccuuuugugaauuuuucauuuaagaguauuauuccugagcaacaauugcaauguuucccaaggugaacaccugcagacccuaaacaauuagcugucaccuggagcuuuggugaacccggcugucuucuguagggcuuccuuguuuugugggucauuaccuucacaagcuucugaaugccaccucuguuuuuggaguccuucaagaugcuagauuuauacauucaucaacuugccaaaacccuuguccuuuaugcauuugcugucaacagugccaggcagaaagagccaugauguugcaggcacuuccauuuuccaugguaacauuucuggggcacuccuuguuaaacaugccucauucccuugaugucugcaaucucaccuuauagauuuccucuugaguagccagagaaacucuggauuugugaaggggcuagaagaaggaaggguuucucucugucuugcuuuuguguuggucauuuuggggaacuccuaagagagggaggacucaguaagggcugaugguucuugagugaaaccagcccucccagaacucagccccaagaaccuuaaaaagccaaccugaaaugcucuaacaggcagugaagacucuccuugguuuaaugcauuuuucugcuucugucuccuggcccucgcuguggcuucugugccugucucugccucuccuggucugcugcucucucuaguccucugcucagugacaggugcagucuacuucuuuggcccugucgucucucccugucucccuuaucuggaauaaggaccucccaauuucagcuucuggccaugggggugggauucagagcagcagauguuugugauguugcaguuuagugaugccucaaauccauuugaucuucccuuaccgguauaauaagaauuccccagggccagguguaguggcucaugccuguaauccuagcacuuugggaggcugagccgggcggaucaccugaggucaggaguuugagaccagccuggcuaacuuggugaaacgccgucucuacuaaaaauagaaaauuagccaggugugguggcacaugccuguaaucucagcuacucgggaggcugaggcaggacaauugcuugaacccaggaggcagagguugcagugagcugagauugcaccauugcauuccaacuugggcaacaagagggaaacuccaucucaaaaaaaaaaaaauaaaaauagaaaaaaaaaaguucccaacuaggucagacuucaccucccacugcaggcuccuucaacacaucaauuaaauucugcagacucccaguauggggagguguccuaggacacaaaucuaucccuuggccaaagaccaugaacauugcuuaugaaauaauaauaaccaacaugucuugagucuuuuccaugugacagauagucacaaauaccuguacuauaucauuaaagcugaaaaucaaugacacauuuauuuccuccucccaacaguuagcacaguuugcucugggaugucauuugguucagauaauccaaccauuaauuaucacauauuguagggauaauuugauuuuugcgaugagccuggcguuuuccaccacgaugcaagaggaaaaaaauucugcaacccugaacuuuuucaggcaugccaaugaauggcaggacuugagguucuccuugggucuuugcugcuaucucuaugggcagguuuuucucacugauuuccugguuuaacgaacauauaugagccuccauauugacuguugucaguagaacuugcucgaugagagaccaucccauuuuauugguuucuucugcaguugauucggagggcgggugggcuugaugaguggcucugaacacugagaauuucgacuuugaguauuuuauauguucucuuucagccuuacaagccaagucaacucuuccuuaaacacuuaaugauaauacccaaccuuaaugagccuuuacguaagugagagacguugcgugaauaacaagguugggauggucacuaucccaauaauuaggugauuuuucugaggguuuucagcuuguaagaaauuggacuggaaugugaaaucagguucuuuuucuuuuuucuuucuuucuuuuuuuuuuuuuuuuguggagaaugggcucauuauauugcccaggcaggucucgaacuccugggcucaaacuauccucccuccucugccucccuaagagcugggauuacagguaugagccacugugccuggcccagaaugugaaaucagguuauuuggaccccagggcugguucuuggucagguagcaguucugugcuaccuuggagcuugggguauuuucuuugcagagggugcaaguacaaguauauaaggaugggguaccgggugggcaagaaccaaagggacagugguuguaacuuggccuuccagggcuacauggccaaggggugauggggcagagauuugauugacaggcuuaauaacaacauaagacagcagagggagagaugucauggaguccaagguuaggggggcgggggugggggaugcuggagaguuuucccacauguuuagaaaugugccagguccccggaguggaauucugagcccuuuacagucuaaucaacacgggcugcuuugacauccuucucugcugcacagcagagugugugggacucuuucugcuggggcugugaaggauuucauuugcaagccugucugugcuagcguuaaaugauuuuuacacuauggagcuauuucuuuaggaguugccuucaauguagauuucccuguagcaaauucuuuuuaaaaugcacccaggacaauacuaaugcaguauuuaaaggaauucuauaaggcguggacacacucuaauugaucugcuugaacuuuuuggaaaauuauuuauuuuucuuauuuauuuauuuauuuauuuauuuuugagacagagucucacugugucauccaggcuggagugcgguggugugaucauagcucacuguggccuccaacuccugggcucaugugauccucccaccucagccucccuaguagcugggacuacaggagcaugcuaccaugacuggcuaauuuuuaguuuuuuuggcagagacagagucucgcuauauugcucaggguggucucaaacuucugaacuuccagaagugauucucucaccuuggccucccaaagugguaggauuacaggcaugagccaccacaccaggucuguuuuauaaguuuuuaucuguuguguuucuuuaaagcaaguuuuaaucaauauguugggaaauuauagcaauagcaacuagaagcauuugcuauuauugcuucucuuccauugcuuuccacccauaauuaaguacuuaggggauaucuaccgagauccagcaucuggagaacauaccaaauuaaauuagagauggccucuguucuccacaaguuaggaagauaagacaaguggacuucauguccggacacgguggcucacgccuguagucccaccacuuuaggagaccaaggcgggcggaucacuugcagucaggaguucgagaccagccuggccaacauaguaaaaccccaucucuacuaaaauacaaaaauuagcugcgugugguggugcacaccuguaaucccagcuacuugggaggcugaggcagaagaaucacuugaaccugggaggcagagguugcagugagccgagaucgcgccauggcauuccagccucggugacagagcgagacuccaucucaaaaaaacaaaaaaacaaaacaaaacaaaaaaagacaaguggacuucagauaacaaauaacaaagccaacaauauucaggagaugucagaggccacccuaacuaauggccucauaugugcuagacugugggagguacuuugcuggcuggaggaaucuaggcagagucuaaucuuggcugggcucccggggaaguuucuugucuucucuuguugacauccaaagcagagaucgcagcuuuucucugugcucuguaggguucuaauccugcuuuaccuuguaauuaccugcaaacugccucuaucuuugugguaaaagauugaaacuguccauggcaaacucuucucaaccuuacuguuuccuuguaaacaucagugugucuuucuauuguuauguuuccucuuuguuucucuuuuucuagcuuaauuuaguuuguuuguuuguuuguuuauuuauuuauuuugagacaacaucuugcucuguugcccaggcuggaguacaauggugugaucuugacucacugcaaccucugucucccaggcucaagcgauucuccugucucagccuccugaguagcugggacuacaggugugcaccacugugccuggcugauuuuuguauuuuuaguagaaaugugguuuugcuguguugcccaggcuggucuugaacuccugaccucagauuauccgccugccucgaccuuucaaaguguugggauuacagaugugagccagcaugccuggccuaauuuaguuuuuaaaagaaagggccuugcucuguugcccaguggugugaccauagcucaccacacccuccaacuccugggcucaaacaauccuccugccucagcccuccaaguagcugacacuauaagugcucaccaccacuccuggcuaauguuucuguuuuuuuuuguagaaauggggucucacuauguugccgaugcuggucucaaacuccuggucucaagugauccuccugccuuggccuccugaguuguugggauuccaggcaugagccauuguacccagccuuuuucucucucuugaaaggaaacaucucuuugugaacacugccuucucuucuccccuuagccccuuaacucuccaucccacugagggucacaggcaacuccccgagaccgucuucuccuuuggcucuuauucuguccuugggguugcuuuuuuuccuccuuccaacccugcaguggguccuuuacucaaaugaucuccuccaugccuuucuccacagugccuucuuuuuuuuuuuuuuuccuuuuuacagaaugaucuuuauuguaucaagaagucaaacaguaaaaauagugacgaaaaacagucccuugugaccaaaauaaaggaacuaaacuuuuucaucaacaaucagagaaagaacuuaauaaagccaaagcuuuuaaacaggugcaauaaaauuauaugcauauuauugaaaacuguguuuccauguuauggaaacaugcuaaacauguuacaugcuaaacaugcuaauuuaugcuaaauuaaaaauauagcaaauuaugaagaagaaggugucacugucaucacuauacccaauauagauaguguuaaagucuguuguuuccuuccagucuuuuaaaggaauuuggcuuuuuauguuguauuaaaaaaauuucaauauaucauauguuuccuaaaccauuaacuauucuuuaaaaaauacuuuuuaagccaggugugguggcucaugccuguaaucacagcacuuugggaggccaagaugggcagaucaccugaggccaggaguucaagaccagccuggccaacauggcgaaacccugucuguacuaaaaauauaauaauuagccagcaugguggcaggugcuuguaaucccagcuguuugggaggcugaggcaggagaaucgcuuguaccugggaagcggagguuguagugagccaagauggugccacugcacuacagccugggcaacagagugagacuccgucucaaaaaauaaauuaaaaaaaaauuuuuuugaaagcuuucuacgaguccauugcaugaagugacaauaacuuauuuaaccaucucuuauuuguuggauuuuuguuucucuccaaugcuuggcuauuguaaauaguauuaucacguacaaugcaguuguucaauuaguugucuucuucccggaccuggauuacuuuuggcuuucaccucugcgaugacgguucuacaaugggaucuuuaguucugacugcaguucuaagcucuuggcccaaaucuaaaccccuugccggagcugaugcaugcuccuacauccucucugcucccccugcugaggcaguuucuucugaccccuagaauggugucacugugauucccaugagccagccuuuugucuucuuugacccuucuccuuuggccccagccuguaggggaucuccaaguugcauauguuuuaugcauccaauaucccaacacacauuucacaccugucaggcuccuucucaaugcacugucuuguccaagacaacagcgucuuuucugacacuugcugccucucuccugccccccagugcaacuuacaugcugcuaaacaaauugauuuuacaaaaaauauagcucuaguugaucacucuuuuccuuagucuacucuuacccugacagcccaggcauuccacagcaugguacaguaagggugggguuaucagcaagggaggaguuccaagacccccaguggaugccugaaaucacggauagcacugagcucuguaccuaguacaucuuuuccuauagguaccuacguaugagaaaguuucauuuauaaauuaggcacagugagagacuaacaacaauagcaauaaaauaucauucuguuacaaagauacaugcacauguauguucauugcagcacuauucacaacagcaaagacauggaaucaacccaaaugcccaucagugauagacuagauaaagaaaaugugguacauauaccauggaauacuaugaagccauaaaaaagaaugagauccuguccuuugcagagacauggauggagcuggaagccguuauccucagcagucuaaugcaguaacagaaaaccaaacacugcauguucucacuuguaaguggaagcugaacaaugagaacacauggacacaggaaagggaacaacacacacuggggccuguuggacaggggcguugggggagggagagcauuaggaaaaauagcuaaugccugcugggcuuaauaccuaagugguggguugauagaugcagcaaaccaccauggugcauguuuaccuauguaacaaaccugcacauccugugcauguacaccagaacuuaaaauaaaaauuaaaaaaaaaaagcguguacugcaacaguugaucugauagcucagucagcuacugagugacugacagacugguaguguagacaguguggcuaggcuacacaaaggcacgauucaugcccccagguggggcaguuugggaugguauaagauuucaucacgcuccuuggaauggcaugcacaugaaaacugaugaauuuuuuauuucuggaauuuuccaucugauauuuuuggaaugugguugaacucagguaacugaaacugcagaaagugacgcugugggugauggggaaacgacugugccuauauuaguuuucugugguugcuguaaccaauuaucacuaacuuagcggcuuaacagaauacgaauuuauuaucuuucaauucuggaggucggaguuuggaaugcaucuuacugggauaaaauagggauauuaucagggcuacauuccuuuggagaugcuggggcagaaucuguuuccuugcuuugucgaacuucuauagagucugccugcauuccuuagcucauaucuccucuuccaucuucaaaggcagcaguggagcaucuucagaucucucucucugacucuccuacuguccucuuccaucuuuuuuuuuuuuucucaagacagggccucacucuuuugcccaggcuggggugcagcggcgugaucaugacucacugcagccuugaccuaccugggcucaggugauccucccacuucagccucccaaguagguggaacugcagguguaugcuaccacacccagcuaauuuuuuuuuuuuuuuaguaucuauuguagagacagaguuucgccacauugcccaggcugaucuguuuuuaaaauauuuuuaaaauuuuacuuuaaguucugggauacaugugcagaacgugcagguuuguuaccuagguauacaugugccauggugguuugcugcaccuaucaaccugucaucuagguuuuguuuuuuguuuuuguuuuuguuuuuugagacggagucuugcucuguugcccaggcuggagugcaguggugcagucucggcucacugcaagcucugccuccuggguucacgccauuccccugccucagccuccugaguagcuggaacuacaggcgcccaccaccacgcccagcuaauuuuuuguauuuuuguagagacgggguuucacccuguuagccaggauggucucgaucuccugaccucaugauccgcgcggcucagccucccaaagugcugagauuacagguaugagccacugugcccggccccugucaucuagguuuuaagcccugcaaaugcauuauguauuuguccuaaugcucuccuuccccuugcuccccacccuccgacaggccccggugugugauguuccccucccuguguccauguguucucauuguucaacuuccacuuaugagugagaacaugcgguguuugguuuucuguuccuguguuaguuggcugagaaugaugguuuccagcuucaucugugucccugcaaaggacaugaacucauucuucuuuauggcugcauaguauuccaugguguauauaugccauauuuucuguuuccaguuuaucauugaugggcauuuggauugguuccaagucuuucccauuguaaauagugcugcaguaaacauacgugugcaugugucuuuauaguagaaugauuuauaaucauuuggguacacacccaguaauaggauuguugggucaaaugguaagcgauccucuugccucagccucccaagugcugggauuacaggcaugagccaccaugcucugcuuuccucuuccaucuuuuuaagagccuuugugauuacauugggcucacccagauaaaacaggauaauacccccaucucaagaucucuuuuuacaucugcaaagucucuuuguuaucugagguaacagauucacagguucuggggaccaggacauggucaucuuuggagaggcuuuuuucugccucccacagcacccagcuuuucuuccauguucguuuuucccuuuucccugauuguaucuuuagugcuggacaaauaauaauaauuaaaaaugggcugggugugguggcccauaccuguaauucuagcacuucaggaggaucacuugagcccaggaguucaagaccagccuggacaacauagugagauccccgccccccaccaccaacaucucuacaaaaaaaaaaaaaauugccaggcaugguggcaugugccuguagucccagcuacucaggaggcugaggugggaggaucauguaaacccaggagguugagguugcagugagcuaugauugcaucagugcacuccagccuggacuauagagcaagaccuugucucaauaaauaaauaaauaaauaaauaaauaaauaaauaaauauauaaauaagguagccaacacuuguggagugcuugcuguauuccaggcccugcauuaagcaccuucuuuccaucgucaccuuuacuuaaaccuugcgacuauuguacaacaucaguuauuguuguuccaguuuacagauaaggaaacugaggcucagagaguaauuugcccacagccaugcaccaaugaaugcuggaguauuuuuaaaaauaacuuuauugaggaauaguuuauauaccaucaaauuaccugcauuaaguguacaguucaaugauuuuucauaaucuuacggagcugugcacacaucacugugauucaguuuuagaacacauuuuaucaccccagagaaacccggugaggagcucucaacccaguggggaagccagacauuuaaacuaauuguuaugugauaugcuaagcucaggaguggaguuacaugcauucuaggcaagcagaggacagaauguugagugaagggaagauuaagguaagucuucuagucccuggaaacacuacauucucucuuugaccaaacuaauuagaugagagaaacacauugggaucacaggcaucucauugacaagcccaguccccguuaagcagcuguguguggauggaaguucccacgacaaagaaagaagagcuacauugauaggcacagacagcagcacuugguucaguauucccaaaccuguucagaaccguucugcuuugccgugaaccugaaauccgacauuggaggagcuuagcagaaaugagaguagggauuguggagcuggaaguugcuuggagaaggcauagguccugggacagaguacuugcuagcugguggaagaccuucgggauggugucuacaguguagcuuggggaacgcucuccuggguuucuggugccucuacuucucaucuucauaaugauucagagugcaguggugcagucucggcucacugcaacccccgccucccagguucgagugauucuccuuuuuuguaacuuuuuauuuuagauucagaggguacuugugcagauuuguugcaaggguauauugcaugaugcugaagcuugggaugugauuggaccucucacucagguagugagcauaguacccaacagauaguuuuuuaaccuuugcccaccccccacaacccaaugucuauuguuaccaccuuuuuucuuuuuucuuuuuuuucuuuuuuuuuugagacggagucuuucucugucacccaggcuggagugcgguggugccaucucggcucacugcaaucuuuaccucccagguucaagcaguucuccugccucagccucccaaguagcugggauuacaggcgcccgucaccacucccagcuaauuuuuguauuuuuaauagagacaggguuuugccauguuggccaggccggucuugaacuccugaccuuuaguuaucugcuuaccuuggccucucaaaguucugagauuacagacguaggccaccacucccggcugcccucuuuuuuuuuuuuuuuaagcuuuuaauuuuagauucagaggguacugugcagauuuguuacaaagguauauugcaugaugcugaaguuugagauacgauugaaacugucgcccagguagcgagcacaguacccaauaaguagucuuucaacccuugccguccaucccuguuuccccaaugucuauuguucccaucuuuacuuuucugucuuguuuuugagauggagucuugcucuguggcccaggcuggagugcagugguguaaucucagcucacugcagucucugucuuccggguucaagugauucuccugccuuaccucccagguagcuggaacuauagacaugcgccaucaugcguggcuaauuguuuuuuguagagaugggugucaccauguuggccaggcuggucucgaacuccugaccucaaggcaucugcucaccuuggccucccaaagugcuggaauuacaggugugagccacuguggccagacuuaugguucccauuuuccuguccaugugaacccaaugcucccaucuguaaaugagaacgugcgguauuugauuuuguuucugcaucaguuugccuaggauaaugucagcccucuuucuuaucucuacaguguaggaagauguguuuggggaucauaacuuuuauccuguccauguaacccuugaaagcacugggauagcgaaagcugaccuucagugauaugucuuagaggaaguccuaacaaugugggguguugaagcugggucaucuuaugaaguugccuacuuucuugacccuucccugcugcuuucuaggugaggaaacugaggcccaaagaggggaagagcaaggacuccuaugggcuagacuaugcauugggucauuaugucaccccugccagguaggcagaguuagccucauuuugcaguuggggaaaucaugguucagagaagcaucucgguggcaugaacaguuuuccauugcuaauucuuucuuucuuuuuuuaauuauuauuuugagacagauuuucacucuugucacccagguuggagugcaaugcugugaucuuagcucacugcaaccuccaucucccggauucaagcgauucuccugccucagccuucuuagcgugcaccaccaugcccggcuaauuuuuuuuuuuuuuuuuuggguggagucucgcucugucaccaggcuggagugcaguggcgcaaucucggcucacugcaaccccugccucccggguucaagugauucuccugccucagccucccgaguagcugggacuacaggugugugccaccacacccggcuaauuuuuguauuuuuaguagagacggaguuucaccauguuggccaggaugguuuugaucucuugaccucaugaucugccugccucggccucccaaagugcugggauuacaggccugauccacugcuauuucuuucccugcacccuuuugccuugcagaagauaugcacaguugaaauuguaagccuuagacauuguggguacucgcuaggagcucagaaacagcugaguuugauuuucucgcaaagagcacauggaagugaggaacacacaagauggcgugacauuuuaugcccuuucaguguaaauucuacaaaaucaucaagguagcgccgagggcuucgcuuuaaaauagaauacacguggaauuaucagucuucagagaccgagcugugugugaucuuuccgucuagcugcuugucuuuggcacagaaaacugaaaaugaccucuuuuccccauuggccacuccuuuugaagcuugaccaacacggcggaaagcccugcucacuucuuuguaaguggcccuuuuugggguaucguugccccucccccgugccagggaaugguaauuggcacuuaaguaucgagucaguuggaaaaagaaccgaagcagggugcuuacagaauuggggacacacaggaggacacccugcuaagguguguccugcugucucagacaggaaccuggugcucagugaaggaagcuucccugaggaagagacgugaaagccgagcccggccucuuuugguaaaaugacuuccuuccugugggccugugaagcaccacauugggccuaugagagaccaagugcagggaaaaugcuggaauaucgugcuuuuuuuuuuuugagauggagucucgcugugucacccaggcuagagugcaguggcgugaucucugcucacugcaagcuccaccuccuggguucaugcaugccguucuccugccucagccucccaaguagcugggacuacaggugcccgccaccacacccagcuaauuuuuuuuuuguguguguguauuuaguagagaccggguuucaccauguuagccaggauggccucaaucuccugaccucgugauucaccugccucgacuucccaaagugcugggauuacaggcgugagccaccgugcccggccuuauccugcucuuuuuuuuuaauuuuuugacagggucucacgguguugccuaggcuggagugcaguggcgcaaucuuggcuuauugcaaccucugccuccgggguucaagcgauucucgugucucagccucccgaguagcugggauuacaggcacuggccaccacucccagcuaauuuuguauuuuuaguaaagacagguuacaccauguugcaaggcuggucucaaacuccugaucuaaaguaauucaccugccuuggccucccaaagugcugagauuacagacgugagccaccaugucuggccauauccugcucuuuuuaaacagcacggcugggucuuccuuuaguucacggguuuuaauucugaacaugaguaacagcauuaaaagaagucacuuguuuccuuuuugacccugugauauccauccaaaaaaaauuuugccuuccauaugacuuaggaacugaaggaaugcuauuuccuugugcuggcguugcccugucuuugguauauagaugauguuuccuuugcauuuuaccuccucuagugaaugaaaaagucauuucuuccaauuuuaauucuccuagaagauuuuauuuuuuaauuuaaaaaauaauuucaacuuuuauuuuagauucaaggggguacauaugccaguuuguuacaaggguauauugugugauaaugaguauauauuacaaggguauauugugugauauugggguacgauugauccugucacccagguaaugagcauagcacccaauagguagcuuuuuaacccuugccuuccucccuacauccucccucuaguaguccccacugucuguuguucccaucuucaugucugcguguacccaauacuugagcuccauguauacaucagaacaugcaguauuugguuuucuguuuaugcaucaacuugcuuaggaugauagccuccagcugcuuccauguugcugccgaggacacgauuuccuucuuuuuuauggcugcauaguauuccauggugucuaugcaccacauuuucuuuacccaauccacuguugauuucaucugucuggauuucaugucuuugcuacugugaauaaugcugcaauaaacaugcuagugcggguggcuuuucaauagaacaauuggguagaacaauuuauuuuuuugcugggucaaaugguaguucugcuuuugguaaugacuuccuuuugugggggccugugagggaccacaucaggccuaugagagaccaaguucagggaaagugcagggaauguccugcucuuuuuaagcaguggcugcugggucauccuccaguucacuagcauugagagaagccacuugguuccuuuuuuacccuguaagccauauccaucaaaaaaugaaucaccuuccauacuaguuagaagcugaaggagcacgauuuccucaugcugguugggcccuguuuuugguuuagaaaugauguuuccuuuguauuuucccuccuccagugacuuggaagucauuccuucagacuuuaauucuccugggagauuuuauuucucccaugugcccagcuccaccucaauuucagauuaagcucagcucuguugucagaagaaugggaaccccucuucuccucugccugaccgcggcccguuaaauaaauagcaaggaaagcccaucauucugauuauguuuuguugccaccacucccuugccugugucccagugccaacugcuuuaacaggagccuguagcucacccuaagcaggggcuacccucuccuuuucuuuuuucauugauuuuuagagacaaggucuugcuuugucacccagacuggauugcaguggugcaaucauagcucacugcagccucuaacuccugggcugaagcgauccuccugccucaaccucccgaguagcugggacuacaggugcacaccaccgugccugaauaauuuguaugguuuugaucaagauaggaucucacuauguugcucaggcuugucuugaacuccugggcuuaagcaguccuugcccuuuggucuccuaaagcacugggauuacagguaugagccaccacgccuggccuucucccuuucuuuuuagcuugugauuucuggccacgggggucucugauugugucaagcaagauccugagaggugggugaaaaaccagcacugacuccuccaaaugaggcaccugauaugguuuggaucugugucccccacccaaaucucauguucaauuguaauccccaguguuggaggggggccugguaggaugugauuggaucaugggggcaaacuucuugugaaugguuuagcaccauccuccuugguacuguccuuaugacagugagugaguucucgugagaucugauaguuuaaaagugugugguaucuccccucucucuugcuccugcuuuugccaugugacauaccagcuuucccccuugccuucugccaugauugcaaguuuccugaggccuggccagaagccaagcagaugccagcaucacacuuccaguauaggcuccagaauugccagccaauuaaaccuucuuuccuuuuuucuuucuuucuuuuuuuuuuucuuuuuuugagacggagucucgcucuguuacccagacuggagcgcaggggcacagucuaagcucacugcaaucucugccucucagguuuaagcgaugcuccugccucagccucccaaguagcugggacuacaggcuugugcccccauacuuggcuaauuuuugcacuuuuaguagagacaggguuucaccauguuggccaggcuggucucaaacaccugagcccaaaugauccgcccgccuuggccucccaaagugcugggauuacaggcgugagccacugcaccuggccuaaaacucuuuucuuuauagguuacccagucucagguauuucuucuuuuuuuuuugagauggagucucucucugucacccaggcuggagugcaguggcacgaucucagcucacugcaaccuccgccucccggguuuaagcaauucucugccucaaccuccugaguugcugggauuacaggcacaugccaccaugcccagcuaauuuuuguaguuuuaguagagacuggguuucaccauguuggccaggcuggucucgaacuccugaccucaggugauccgcucuccucgccuuccagaguacugcgauuacaggcaugagccacugcguccagccucagccacucagcuuuauuuccaguuuuuccugguccuaaguaguuauguagugaacuauggaaaaacaaaucuuugcuugucuuugugauuguuuuuuaaagcugugaccuaacacaaaaaaauuagccaggcacgauggcgggugccuguaaucccaacuacucgggaggcugaggcaggagaguugcuugaauccaggaggcggagcuugcagugagccaaaaucacgccacugcacuccagccugggcaacagauagauaccccgucucaaaaaaaaaaaaaaaaaaaaaaagaagccaagacuuguguaagugaaaacacuggggcaucgcgucuccacguuuucggggcucuuauaacagauuguccaguugcuucccugauaggucaguucuguuuccacuccuacuaaccgugugaaaaauacuccccuuucaccacccuuucgccaacaucauguuuaugguuuuagaaauuguugcaaauuugcaaggauuucaugucuaaaacaccaaaagcaauggcaacaaaagccaaaauugacaaaugggaucuaauugaacuaaagagcuucugcacagcaaaagaaacuaccaucagagugaacaggcaaccuacaaaaugggagaaaauuuuugcaaccuacucaucugacaaagggcuaauacccagaaucuacaaugaacucaaacaaauuuacaagaaaaaaacaaacaaccccaucaaaaagugggcgaaggacaugaacagacacuucucagaagaagacauuuaugcagccaaaaaacacaugaaaaaaugcucaucaucacuggccaucagagaaaugcaaaucaaaaccacaaugagaugccaucucacaccaguuagaauggcaaucauuaaaaagucaggaaacaacaggugcuggagaggauguggagaaauaggaacacuuuuacacuguuggugggacuguaaacugguucaaccauuguggaagucaguguggcaauuccucagggaucuagaacuagaaaucccauuugacccagccaucccauuacuggguauauacccaaaggauuauaaaucaugcugcuauaaagacacaugcacacguauguuuauugcagcacuauucacaauagcaaagacuuggaaccaacccaaauguccaacaacaauagacuggauuaagaaaauguggcacauauacaccauggaauacuaugcagccauaaaaaaaugaugaguucguguccuuuguagggacaugggugaaacuggaaaccaucauucucagcaaacuaucgcaaggacaaaaaaccaaacaccacauguucucacucauaggugggaauugaacaaugagaacacauggacacaggaaggggaacaucacacuccagggacuguugugggguggggggaggggggagggauagcauuuggagauauaccuaaugcuaaaugacgaguuaaugggugcagcacaccagcauggcacauguauacauauguaacaaaccugcacauugugcacguguacccuaaaacuuaaaguauaauaauaauaaaacaaaaaaaauuauaaaaaaaaaauuguugccaauuugguugcuucaaauaagacuggaguuuuguuuuacuuugacuacuagugagguugaauuuuuuuuuauaggaggcuaaucaauguguuuuucugcauccuuugauaucaucgaugcaguucugguuuagaagguagcucuuguucauuccaggauuuugucucuugaacugacccuauugacaguucagccauugaaaugucuccuauuugcauaggaaauucuauuauaugcaguuuccuauucugcugccucugugugugugugugcgugcaugcuuguguguaugugugcacgugcgugugugugcauugcaugugugcauguguaugcaugugugugcaagggugugugugcgugugugugugugcgcgcauguguaucuucauggauuuuaaugggaaauuguaucaaggaguacuacauguugcaccucugauugauucugaaauucaguugacucuuaaaugaagagcaucuuaacagguacaguggcucaugccuguaaugccagcacuuugagaggcuggggcaggaggaucacuugaggccaggaguuugagaucagccugggcaacacagcaagaccccaucucuacaaaaaauaaaaagaaaaauuagccaguugugguggaaugcaccuguaguccuagcugcucauuaggcugaaguuggaggaucacuuuagcccaggauuuuaagguuacagugagauaugaucaugccacugcacuccagccuugggcaacagagcaagaccuugucucuuaagaaaaugaagaaaaaaugacgggcauuugacucaguuacagcuggcugucacuagggaagaauuuuuccucuucuaugcccguggucagaucuuagggucacuagagguaauugagaaauagaauggcugagugcuuauuuaaugaauacauauucccaaaaaaugcauguuguuaguugucagagucaagagugggguaauucagguagggugcaguuuccuguuucaggggugugcuucucauggcaucugcaguucccugcacucugucgcucuugggaguacacaauuugcaucucuccuacccagccccuuccugaacuccaugacuuuuuaccugccggccagaucagauuagaugaagauagccuaggugcuacagaauggauaaugaggcacuucuccuucagaggaaaaccgugcuuuggacauagugcuuuaccagucauuguuuuauagggucacauucauuaacguccauaagaaggucuuaaugaccaccuagucccuacucucccaggguucccauugaguggauuaaugguuuucucuucuuugaaggacaauuauguuuacuuagacauuguauacuaaagcaaagugauguuucgguuuuggaaacuucuucaagcauggcguccucuacauggucagguuagagauucucacucaauuccucaccccacacaacagaaaaagcaacaaaucacaauaacaggcuacugagcugggcacuucauuguugcuuugguuacccaaagcacaguuauuuuauuuuauuuuauuuuuugagauggagucucgcucuguugcccaggcuggagugcaguggcacgaucucaguucacugcaaccuccuccugcuggguucaagugauucuccugccuuagcuuccugaguagcuaggacuacaggugcaugccaccaugcccggauaauuuuuuguauuuuuaguagagaugggguuucaccauguuagccaggauggguucgaucuccugaccuggugauccgccugccucguccucucaaagugcuggcauugcaagcaugagccacugcgccuggccugcacaguuauuuaaaaaaaauuuuggcggagcgggguggcucacgccuguaaucccagcacuuugggaggccgaggagggcggaucacgaggucaggagaucaagaccauccuggcuaacauguugaaaccccgucucuacuaaaaguacaaaaaacuaucugggcgcaguggcaggcaccuguagucccagcuacucgggaggcugaggcaggagaauggcgugaagcugggagguggagcuugcagugagccgagauagugccacugcaguccagcccgcaugaaacagcgggacuccaucucaaaaaaaaaaaaaaaaaaaaaaaaaaaauuuauuuaauuuuuuuguagaguugggggaucucgcuauauugcccaagcugaucucgaacuucuggccucaagcaauccucccaccuaagccucccauagcauuaggauuauaggugugagccaccacacccagccccagugauauuuaaggucaccaaguuugucaguugggucuuucugguuuggacccuagagaugccugugaaaucguccuucuuccccuagaccuucucugaugacaaucucugaacucugauguagcuuucuggcccauuucuucaucuggcacgacuuagugucuucaguuuugacucuguuuugcacucucccacacuuugcucuuugaagaguaacugguugcuauagaagcggugaugucagggccagggagagcgcuuuauuggcauggaccagggcuuuauagaguuguuuucuauaaucauguuuggggcugguguuagucauacuccaagaggcaagaugcccaggcccagaccugccuccaccccgaggcuccugaguccuguuacucacugggguacagugcugugcuaccuaggacaggggaguggcuggggugugcuuggucuccaggaacccucuuguccauuuagccacguccuacagcagagacuagagcccuuagggggaguuugggugugggacaaugccugcaccuugguccguggggaagcagacccccaaaaagguacuuuucuuaauccuuucuuguauuuucucuauugccucuuaacaucuugucacauucacacauggguuuaaaaaugcugaaggccggaugugauggcucacaccuguaaucccagcacuuugggaggugagaggaucacuugagcccaggaguuugagaccagucugggcaacauagcaagaccccaucucuuaaaaaaaaucagugggugugguggcaugugccuguacucccagcuacucaggaggcugaggcaggaggaucacuucagguggagaaguugagucugcuguaagccgugauugugcuacugaacuccagccugggugacagagcaagacccugucucccccaccaaaaaacaaugcugugaaguugucucuuuuggagaaagagcucaggggaccacucagcuucacuguccccugcuuuauuuugggaucagagguguaucugguucaauaacuguucucuaugucuagaacucaggagugagaaggcaggugaaggggacagaaggugacaagagcuuagagagccacuggccccacgcugacucuucuccaccucccuagggucaggguaccuuacgcuugggaugcacccuaugauacacagaauuauggcuucuccaaagaugccaccuccuaauccccagaccuaugaaagauauauguauuuauuuaucuuuaauguuuuuuuuuaaagacauagggucuugugucauccaggcuggagugcagugguacaaucauagcucagacuucugggcuccagugauccuccugcuuaggccucccgaguaucugggacuacaggugcacaccaccacgcucaguuauguuaaauuuauuauuauuauuuuuuguagagucagagucucacuguauugcccaagcuggucucgaacuccuggccucaagcaguccucccccaucagccuccuaaugcauuaagauuauagaugugagcuaccccgcccagccccagugauauuuaaggucaacaaguuuguuaguugggucuuucuggaggcagauguugagaucaagugugcaagguuuauugguggggagggaggaaguauuauaauaauggcugugaaauugaauggccuggaaguagaacugaacaggaggagucucagauucccaugcagaucugacaaagccuugguccgacccaugcuuaccucugcagcaaagauugcccauuagaggaauccuguguuggguagaaguggccgggaccaagucccauggccagcccagucacuggcugggggcugccuggggaggacguggcuguggcucaacacugagugaaucccaaaggccucgugcagcagggaauucuuuuuugcagggagauccuagcuggguccauccacagcugcuguacgaaggcaguagcuccguguggagcugucuuuauuucaagucuuuugcaguauuacgggauugaaaugauuaaaauugggacuucacugccuuuuuucuccuuugccuuuuuuuuuuuuuuuuuugagcaggaguuucgcucuugucacccagcuagagugcaguggcgugaucucagcucacugcaaccucugcuucuuggguucaagugauucuccugccuuagccuccagaguagcugggauuacaggcaugcgccaccauaccuggcuaauuuuuguauuuuugguagagacgggguuucaccauguugaccaggcuggucucgaacuccugaccucaggugaucugcccaccucggccucccaaagugcugggauuacaggcgugagccacugccucuggccucuccuuugucuuuaauguucaacagagguggugaggcaaguuugcauuucugccugggucaggcuucuggagaggugacaugguguggugauguagccacaucugcaauccucaucuucagucaugcauugauguuagcauguagaccagugguccgcagcccuuuugccaccagggacugguuucauggaagaugcuuuuucccauggagcagugggggaugucggaugguuuugggaugauucaugugcauuccauuuauugugcacuuuauuucuauuaugauuacauuguuaauauaaugaaauaaucauacaacucaucaucauguagaaucagugggagcccugagcuuguuuuccugcaacuagauaguccuaucugggagugaugggagacggugacagaucauuaggcauuagauccucauaaggagugugcaaccuagaucccuugcaugcacaguucacaguagguuuugugcuccuaugagaaucuaaugcugcagugauuugacaggagguggagcucaggcgggaaugcgagcggcggggaguggcuguaaauacagauaugaagcuucacuucugcaccccucacucaccuccugcugugcggcucggcuccuaauaggucacugccuggugguuggggaccccugauuguagaagaccuauuuuuuuuucuuuucuugagacaagaucucgcucugucacccaggcuggagugcaguggugcaaucauagcucacugcagccucaaaguccucaaaagaccuaucuuaauaugcagauauuucuuuuuucuuucucuucuuuuucuuuuuuuuucugagauggaguccugcucugucucccaggcuggagugcaguggagcgaucuuggcucacugcagccuccaccuccugguugaagugauucuccugccucagccuccugaguagcuaggacuacaggcgugugccaccacacccagcuaauucuuauauuuuuaguagagacaggguuucaucauguuggccaggcuggugucaaacuccugaccucaggcaauccgucugccuaggccucccaaagugcugggauuacaggcgugagccacugcacccagccuaauauacaaauauuuauaaagaagguagcacauuaacuagucaauaguuauggugguaaacaccuugucaccaaacuguuugugcaucauucauugcauaguagacaggguugagcuggggaaucugcccagauuggugcacuugcugggguggagcuagcgaggccugugcuccuccuguggcugucuuguuggguacccccugccuagaccaagggcucacugcaggggucucuacuccacccucagcuugcugagcaaaugccacaacagcgccuuugccucguagcccuggucucucacuuuaagguugccccugaaaugcaagaagcuacggagcucucucugggcucaugcauaacccaauaaugcagggggaccugagcguggugggugcauccuucucccucccuguuuggagcacacagcacuggaguggagugcauugcugaguagacacagcuggucacagagccuuguggcaacacuucucagagcugccauccccucuguccccaacucaacccuauaccaucacucuugccuuucugcaaugcuauuccccaaauaaacauuagcucauacacuuuucuuuuuuucccccaacagcuuuauugaaguguaauuuauuaaguaucauuuacauaccauaaaaucuacagcaaugcgcaucccucaccgaaauccaauuugaguagauuuccaucaccccaaaaacacauccucaagcccauuugcagucauuucccguucucacucccagccccaggcaaccacuaaucuauuuucugcuucuguagaugugccuucucugacccauaaaguuuugccugaggcuucuuuguuuagggaacccagguuaagacacacagcaaauaauucagaaaauuccuugauguccaagaacugccacuuccugucuccagcuuugaggccagaguggacugucccggacaacuugcuagagcggagaacaaagauaacgucugaacaaauguuuaguuguuuuuaauuaggacacgcaaugcauuagcaauuauaagaggcaggauggaaugugucuuagugguagcaggguuacugccagaacggacccacgucuucagagugauuuucauucugagcagaaauucgucagcagguugaucacaagcccugugaaaugagggcagagcccacagcaaggaggguccugagagugaggcuuucuugagcguuucuguuuuguggacuccacaaucaaaaguuucucucaaggauuuucuccauguggaagguggcccacaagcaguuuuguguuaagguauuuugcaucaucacuacugacugguugauagacugguuauuuagaaauaccuuuucuuuauuuuuauguuuucuuaggagucagagucuugcuguguugcccaggcuggagugcagugguauaaucauaacucauugaggccuccaacucuuggguucaagugauccuccagccucagcuuccugaguagcugggacuauaggugugugccaccaggccuggcucauuuuuuauucuuuguagugauggagucucgcuuugcugccccugcuggucuugaguuccuggccucaagcaauccugucagccuccuaaagcacugggauugcaggcgugagcuacuaugccaggccuagaaauaucugaauauuaagauaggucgucuucuaugguacccccaaugcauugauugaagaugaagauauuuuggaauaguuucaaugggggcugggacucuccuuagucauaguccuucaguucuuccaugucauaucuauuggguagauucuuccccccucugguauuuuuuuuuuuuuuuuuugagacgguguguugcucuguugcccaggcuggagugcagugccacagucuccgcucacugcaguccuccaccucguggguucaggcaauuccccugccucagccucccgaguagcugggauuacaggugccugccaccacgccugguuaauuuuuuguauuuuuaguagcgauggguuucacuguuagccaggauggucuccaucuccugaccuccuuaucugcccgccuuggccucccaaagugcugggauuacaggcaugagucaccgugcccggccccucucugguauuuaacagcaaaggaaacauggauuugaauuggaaaauaaucagauaucuaggagccauaaaaaacgguuauucaucaagcaucuauuacgagucgggucuuaagucuuacaugaaacaguuuauugugcuuuuaaugugggccagaaaacgugccaagagcucucuaucaucaucuucuuuaauucucugcacaacacuaucauauuuccauuugagagauguagaaacuggcucagcuaauacguggaagaaaguuaauucaaacccaggccugaccccaucaccggcugucaccucaucugccggcaaguuagaugaauaagccauaacucaaggacuccuauuuuagcagcagggaccgucaauaggaacaagcacaugcaaugauauuuugcagcgauagcuaacauucauagaacauucgugauguaccaggccuuguuuuucgugcucuagguguguuaucuaauuuaauucuugcuacagaccuaucgagucguuucuuggaucaucaucauuuugcagauggguacccugaacuaugauaggaguaaguucauuugcccaaagucaggagacacaggagagaugcuuugcaugugaucucuccuuucuugcugaaauaaaaggcaaaauggagcuccaucugagagucagcaguauguauuuuagcugagucacacauuguuaauaggaagggaaugggcgggaaaaguguuuuaggcagaaggaagaguuacagcaaaagcaguggugugugcaacagaguaauggguuugaggaacucuaccuggcccagcuucucuggagccuggaaaggaagggaaaagaggugcagagacugaggucuggagaggugggaaagggucagguuggggccagccuggagaauuaggcuauagggagccuaaguuaguuuuguuggcaauacgaacccuuugaaugauuucauuaggagugucacaaucaaauuuucauuucaguucauuuuacuuauuuuuuuagagauagggucuugcucugucauccaggcuagagugcagugguacaaucauagcucacuacagccuugaacuccuggguuaaaggaucccccugccucagccucccaaguagcugggaccacaagcuuguaccaccaucccagcuaauuuuuuuuuuaauuuuuuucuggagaccggggcucaucaucuuucccaggcuggucuugaacuccugggcucaagggauccucccaccucagcaucugauaugguuuggcucugucccuaucccaaaucucaucuugcauuguaauccccauaaucaugacgugucaagggagagaccagguggagguauuaaauaauugaaacaugggggugguuuccuccauacuuuucuugugauagugaguucuuaugagaucugcuguuuuuuuaaguguuugguaguuccuccugaguucagucuuuuuccuaccuccuugugaauaaggugccugcucccccuucgccuucccccaugauuguaaguuuccugaggccuccccagccaugcugaaccgugaggcaaugaaaccucuuuccuuuauaaauuaccagucuugggcaguucuuuguagcaguaugaaaacgaaacaaugcagccucccaaagugcugggguuacagguuugagccaccacacccagccuaaauguucacuuuagaaagauuacucugacagcacaaaaucuuagcacaaaauaauuuauucuucacauucaccaacacucccgagggauggaguacaccauagagaagcuugauuagggugggguggggaagaacaggaaaaauggaacugcaggcaugccucaaggggaggccguucuggagaagccccagcagccugguaggaggcaggagguggauggcuggaagggggagacggaagaagaugagaaaagcaaacugugucccugcaguuguccuucuucauaggacaaaaggggauaggugaugggaagccugggaagggccuggaaggguggagaagggagaccaccgucagaaacgagggcuucgggggaugcugcuggaacacccucuuaugacuuuguuuuaauuuuuauuaucuagaacuuuugauugaaguaucccauagguacagaaaaguguaccaaggauauuguacagcucagacaauuuucaccaagugggauaaccagccccuaggucaagaaacagaaccuaagccuugaaaacaugcuugcuugagagagaauccagagacaaagggccauguaggauuccauuucucugaaaugccccgaauagacaagucuauagagacagcugguagaguaauggaugcuuagggcuggggaauaaagagcccgauagccaaaguguagagaggguuuuuuguuuucuuuuuuucugaggugaugaaaauguucuaauauugacugcagugauacacaugucugugaauauacuaaaaaccauugauuguuugcaaagagaaagagagggagagagggaggaacggagggcggagagagggagggaaggaagaaagggaagggaaaaaagcaaggaagcagggaaggaagggagaagggaagggaggaagaaaggauguaaggaaggaaggagggaaggagggaaggaaagagggaaggagggaaggaaagagggaaggaaagagggaaggagggaaggagggaaggaaagagggaaggagggaaggaaagagggaaggaaagagggaaggagggaaggagggaaggaaagagggaaggagggaaggaaagagggaaggagggaaggaaagagggaaggagggaaggaaagagggaaggaaagagggaaggagggaaggaaggagggaaggagggaaggaaagagggaaggagggaaggaagaagucaagggagaaggggggaaggaaugaaagagggagagaaggaaggaguaaaaaagagagaaaugacacaagaaaggagggaagggaaggagagaggacaggauggagggaaggagaaaaaggagagagagaaggaaggagggaaggaaggaaagagggaaggagggaaggaaggaaggaaguaggaaaaggaaggaaagggagggagggaggaagaaagaaagaaacagaacaugacuggaauuucugaguccuggaaauggugaugugugaugccuuucaaauccccagccuuccuggagagcagccacuaccuuuacuucuaacacuguguauucacuucuccugcuuuugcauuuuagguaaaaggaacaaaauggucuauugugucuggccucuuagcucaacauuacauuugugacauuccuguguaucgagcauggcuucuggcuuuuuuaaaaauaguuguuuucccauuacaaauuaauauacauccauuaaaaaaaagucccuggaaaauacggaaaagcaagaagaaggaauaaaagucuccaggcauucugccacccagguggaaccacuguugacauauugauguauuuuuuuacucuuuuuuucucugccuaugaaguguuaaacuguuguuguagcaggcauauccaugugguuuucaaaauaucauccaugcaacugcagucuuccauggacaugccugaguggcugugcaaguguuuuauucauauuuagcauuuuaaauacauucugcucuauuuagagcugugauaaaaaugauacccaaauguauuagaaaccaaacuuauuagaaaccaccagugugaaaauuuguguaucuugguuaacuugugauuguguaaacuuaaaaauaacuuuucucuuguaaguccuauucaacguaagaauaucauaaaaccaggugacuuauuaaaacuacauuugcagcuacccaucuaugugaaucaggauuuuccucaauauuaaauagcuaaauuaaaauaagugaaugccaucugaggcuuuuauuaaauaaaaacuuuccucccuauuucucaauuuaaaaugugaauuuuucauuuaaaaagccucucuguuuuauugguugauuguauaagaggcaacugucaugaucuucugaguuuaacaauacauugauaagaaaauacugccuuuaugucuguuauacuggaguuucacagagauuuuguaaaaaaguuuugcuguuaaaaacuuugaaaaccaauaccauagauaaauuuguauagauuuuuugucuuaaaaugcacuuuuuuacuauaaaaguaauauauaugcauugcaaaguaugaagaauaaagaauaauaagagaaaaauaaaagucgcccagaguuccaccugucauauauaaccauuauccacuuaacaaacaugcauugugugucuguuaauuauaugaaacuguucucaauuaugggguuauagcaauguaaagacagagaauguccuucuuacaaggcuuauauuuuuggcaggggagacauauaagaaaguaagcgggaugggugcaguggcucaugccuguaaucccagcacuaccaggaggcggaucuugcagugagccgagauugcaccacugcacuccagccucggugacagagcgagacucugucucaaauauuacuacuacuacuacuacuacuacuaaauaaacaaacuggcugaauuuagcuacuuguaagugcucucaagaaaauaaaacaggcuggcagguugggaaccgcauaggaguuggccaaugaggguguucaagggagggacauuugaagggagacuugaaaaacaagaagucauuugccaugggaagauccaggggcagagcacucccuucaacccaaaacucaagauaagaauaaguucuucccucccgccgacaaagagacagagggccggagugguuggagccuagugaaucggggagagagugggaggaugcguaaauguagaaagaccagcucaaaugagcccuugcuagucaugucaugaaaugcagauuuuaccaacauuuugaguaguucauuagcaucuuuuucuuucuggcaaauuguaauaguugauauuuuaucauugauauugauguuagagaugauauagagacuguuucaacagcuuuacagcaaagauagaggagcucagugacagauaaugucuauauuugggaagauuacuagucuuugguucuuauaaaaauacagggaccuaccucauucaaugagauucccauguugcagcugucccagcuuccagguggccaggugggaugaaucucaucaaaggauaaauccauucuuauuaaaggcugaauaagcaggaaaaaccauaucuucaauaugggauauauaaacaaaucugcaaugugaaaggagauaaacauauucuucaagaaguaaagaaagggcauaguuaaaaacagauuuuuuuuucuuugaaaacaaaaacaaauuuuagccugcaucuguucuagucuuaagggauuuuaggcaaugaaacaagaaaagaaauaaauaaaagaauaaacacaauaaagggaaacagacucuaaaacaagagcaaaauacaaaaaaagauaagcuuguaggauaaggcacugacuaagaugaaaauuaauuuggcaaaauuucaaagaguagaagcaaaucaugcaauugcaagucacauauaguauuagaagcaguaagaggcagaaguaauauuacagcgaaucuaugcagucaaaagaagaggaguuugagagaagcucuagaauguauaggaugaggacaagaaacuaaaaguuauuugagacgucauaaguacagagaacagacagcaaagauccaacagagggaccauuuauauuuucgaagaagaggccaaaacaaauccaaugacagaugcugcauuucaaauauaacaauaacaaaauuccuacugaacauuuuuuggggaaugugacaaaauguuucuaaaauucgucugaagaauaaauggcugugaagagcccauuacguuauucaaaaaacaaaaacaaaauggugagugagcccuugaucuuccagauauugaggauucacuuuaaaaacucuaauaaugaaaaguggugcugcuaugaaagcagggagaccaguaaagcacaguggagaagcuggugauauauuugaguuuauuuggcuaguauauggcaaaaguccaaaaucagcgagaaaaggauucaguaaacaugauuggggaaguguauuaauauuugggaagauaauuguuggguucuuuccuuaugcuaaagcauacaauuaauugaauuuggauuaaagaguuaaauauaaaauaugaaaucacagcuguuagagauugcacuguagguuaaauacauauaaacuugaauuugggaaugcuuuuucaaguuuaaccccaaagucauaagguauaaaggaaaaauugauaaauuugauguuacaaaacuuaaagcauuaaaaaaggaaaacguuauaaaccagccugacaaauugagauaagauauuuccaauauauauuauaaauguuucuccugaauauauauauauauauauacauauauauauauauauuuuuuuuuugcaaucaggagaaaaauacuucugacaaaaauuggggaaaggcugggugugguggcucaugccuguaaucccagcaguuugaaaggccaagguggguggaucaacuugaggucaggaguuagagaccagccugguuaacauggugaaacccugucucuacuaaaaauacaaaaaauuagccagguguggugguacaugccuguaaucccagcuacuagggaggcugaggcagaagaugcuugagccugggaggcggagguugcggugagcugagaucacacuacugcacuccaaccugggugacagagcaagacucuaucucaaaaacaaaacaaaagaaaagcaaaaauaaaaacaaaaaaacugaggaaagaaugugaacagguuuugcacaaaaugaaaaaaaaaucaaauugaucaauaagccuacagagaagaauccccaacuuuuaguaauagaaauugaaaauaaagcaacaaaaugucaauuucuauccacuauuuuagcaggguuggacagaaaaaguagauauccauuguuggcaaugcugugugaaaauggacauuuucauucuuuauuguugggauuauaaaauuguagaauuuuuugguauggaauuuagacaauauguguacagcaguuuaaaaacgugaauugccuugggacccagcaauuucauuuuuaagaauuuuauauuuaaaauaacuguauuaguuuaaaaaacuacauguagaaggaugcucauucuacacuguagcaaagaacuggaaacaagcuaaauauaugcuguuuaccauguugcagggauuguucuaaagucuuuacauguauaauucauuuaauccacacagcucugugaguuaaguacuguugugauucccauuaugcucaugaggaaacaggcacagauuguuuaauuugcccaacauugcaugacuaauaaaugguggaaaagugauuugaucucaggaaauuuuaccucgugaacuaaguuuuuaauugccacauuacauaguauauuguauaauguguaguauaguuuuuauaauguuaaaaaauucaaugaucggguugguuguguuaaucaugagucaauuauucauggacuggaaugcaauauggucauugaaaauaauauuguuggagauuuuuuuucacauggaaauuugauacauuaugaacaaaggcaacaacgaacuguguauaguugaauacaauuaacauuaaaaaagaguccucuuggcuuuggcugggugcgguggcucacaccuguaaucccagcacuuugggaggcugaggcgggagaaucacgaggucaggagauggagaccauccuggcuaacacggugaaaccccgucucuaauaaaaauacaaaaaaaaaaaaauuagccagguguggugacaggugccuguagucccagcuacuggggaggcuaaggcagaacggcguagacccgggagguggagcuugcagugagcugagauugcgccacugcacuccagccugggcgacagagugagacucugucucaaaaaaaaaaaaaaaaaaaaaaaaaaaaaagagagaggccucuuauaugaaggcuaugcaugggaaaugcugcaagaacauuaugaaagguaacaauguuuuucuuuaguaauugggauaauggguauauuuuacccccuggcuuuuguauaucuucugcauugggcuaguaugacuuuugcacuuagaaaaaaaaauguuauuaaacaauaaacagaaaauucagaccucaaauuacuuggcaacaaagacaccuuuuaaaugauguugcccuguuugggaaggaggaauaaagcucuuuguauuaauuuucguacagcauccagcaguguacauaauuuagcccuugcuaauuagagugaaauagagaagcaccagggauuguuuuaacugguuggaaaacuugguguggacuguaguagucaggaugugauccagggagcaugguuucugguuucuggaaguuggcagaaaccagggagaaggggaguuaucaagggaaguauugcagguccccagaaacauccuggcaguccuuagcccaccccaaaccugccggaguuugggaacuaaauuuuucaaggaaaacccacaaauagcaugaccuaugaccuacucauuguuucgcguaaauuuaaggugauuuuuuaauuuuuuauuuuacuuuaaguucugggauacaugugcagaaugugcagguuuguuacauagguauacauaugccauggugguuugcugcacucaucaacccaugaucuagauuuuaagccccgcaugcauuagguauuuguccuaaugcucucccuccccuugcccucaccccccgacaggcccuggugugugguguuccccucccuguguccauguguucucauuguucagcucccacuuaugagugagaacaugugguauuugguuuucuguuccuguguuaguuggcugagaaggaugguuuccaguuuuauccaugucccugcaaaagacacgaacucauucuuuuuuauggcugcauaguauuccaugguguauaugugccacauuuucuuuauccaguuuaucaucgaugggcauuuggguugguuccaagucuuugcuauuguaaauagugcugcaauaaacaugugugcaugugucuuuauaguagaaugauuuauaacccuuuggguaugcuggguaaaauaguauuucugguucuagauccuugaggaaucgccacacugucuucuauaaugguggaacuaaggugauauuuuucuuaagcugcuuauuggugauauguacucucaaagcaaaaacagccaagcauguuauuuucacagaugucagacuacacaaguguguuuucaaagucucugguuuacuccuuggguuucuaacccuuccccucaacuguguagaugguauucugguguuuuccugaacuuucuaucacagaggaaaagccagggucagucugauuuucauucaguucuaaguacuuuucucagauccagcaaugguuuaaaguuuuccagcauuucaauacauauucugccaggauaugucuaugugaggaucucuuuuuauagaacaugauuuuucuaaaggucaagaaaagauguuuucuauuucuuuuuuucauuaguuuguuguuuuuguucuacucuauucugaaaaauuuauuauauuuauauuggaguuuuaaaauuggauuucacagagcugucauucucauuacuuucauucuuuuauccuuuuccucuacauucuuggagaacuucucaaguguauucuuaauaucacugauuugauuuuccugcgguaucagucuugcugauaaauaucuccauguggauauuuaaaugcuuuuugguuucuugcaaaucuuauguuacuuguaucccuuuuuaucuccuuccauuucauuuuuccuuuaggaggcucucucacuauagauguuuacucacauuucaugaaguccacguguccuugaauuguuuugaggcuugcuccucccacugagacuuugugauaugguuuugaaaggguuuuacgcaucuccaugucaguuucccgcuuuauuucaaagcaaggucuguccggacguaguucuugccaacagauagggaguguggguugcuccaggcugcgucuucuguccucuugggugauguauggugaguuccacuucuaaggcuagaggggaguuugauguaugauguuccaaauuuagguuccagguucuagcuggcuuuugcuuacuacaguuacugcuuuuuuuuuuuuuuuuuuuaaucagauucaagguuguacauggguauguuuguuacauggauguauucaugaugcugagguuugggauacaauugaucugucacccagguagugagcauaguacccaauaaauaguuuuucuuuuucuuuuuuuucuuucuuuuuuuuuccgaaauggagucucacucugucaucccggcuggaguggcacaaucucagcucacugcagccuuugccuaccagguucaagcgauccuccugccucagccucccgaguagcugggauuauaggugcgcaccaccaugccuggcuaaguuuugcauauuuuaaauagagaugggguuucacuauuuugaccaggcuggucuugaaugucugaccucaagugauccacccaccucggccucccaaagugcugagauuacagacgugagccaccgugcccugcacaauaguuuuucaacccuucccccaaccccuccaguagucuccaguaucucuuguucccaucuuugugucugugaguaccuaauauuuaguucuuacuuauaagugagaauaugcagcauuugguuuucuguuccugaguuaauucacuuaggauaauggccuccagcugcacucauguugccugcaaaggacaugauuucauucuuuuuuacagcugcauaguaugucaugguguguauauacuacauuauccaauccacuguugaugggcaccuagguugauuccaugucuuugcuauugugaauagugcugcaauaaacaugugaguaacaggugucuuuuugguagaaugauuuauuuuccuuuggguauaucccaguaaugagauugcuggauggaaugauaauucuaauuuuagcucuuugagaaaucuccaaguugcuuuccucagggagaaacaaauucacaagcccaguguauaauauagcuacagcuuugacaugugacauccuguucuuuucccacugucugguucuuccuugcuuuaaaccaacagagcacuugaaaaacagccaucaucauuguuugcugcugccaggguugguguuuucuuugucuccauguguguuuuuuuuucauggagaccgcaucccccaggggcauagcauggugcacugguagaaccugggcuuugauggcagaucucagcucaagccccagcuccaccccaccagcuccauuaccuugagcuaguuauggagcuacucuaagucucaguuuguucauccacacaguggagcucaaagcaucuuugggaugauuaaaugaaauaauacgagacacuauuuguaaggugcuugaaaccuagaaauaauaaacugagugcucacuaugguuaagcauucuuccaaggacuucacauguuuuaaaauaugagguaggcacuauuaacauuucuaguucacagagaggaaggaggcuuggagagguuaagguauuugcccaucguugcacagcuaguaggugguaacgcugggauucaccccuggcugacugacuagagagacugggcucuucaccaucaugucaccauacaugcugucucaaaaaugugucauugccacuccccuccacuccccccaauuucauauuaauuuggcuuuuuuugaguugauuugucggggcaucaacauuuaugaagaaaggugagauauaguggagaggcgguaggauaaggggaauugcagacugccauagaagcugcaaaguccauuucuucuuugaagauugaagggggcauaguagaggucgcuugagaauucugcuaaccuugcaggcugcccgucauuguuucaugagguagaaccaggacaagccuuauaguuugggcugcaguauagggauuccaucuagaguuaggcuauaguuugaccguuggcucaguuguggauuuuguuguuguuguuuuguuuguugggacucugucucccaggcuggaguauaguggugcaaucacagcucacugcagcugugaucuugaccuccugggcuccagcgauccucccaaguagcuaggacuacagguuugcaccacuacgccuggcuaauuuuuuaaauauuuuguagagauagcuucuugcuauguugcccaggcucgaacuccugggcucaagugauucuuuugcuucagccuucugaauagcugggauuacagacgggcaccacuguggcuaacuuuuuaauuguuuguagagauguggucucacuauguugcccaagcuggucuugaacuccuugucucgaacuccuggucucgagcaaugccccccggcucagccugccaagcacugggauuacaguugugagccacugugcuuggccaguuccuucuagauuuaggcuguuugaccauuggcuuaguuuuggagagagagcugagguucuguauuuuuggauuguagccuuucaugggaaacugggagagugggcauuagaacuuauugauugauugauugauugauguguuguuugagacagggucucgcucugucauccaggcuggagugcaguggugcaaucucagcucacugcaaccuucaccucucagguucaaacaauucuccugccuccaccucccaaguaacuuggauuacaggcgcccaccaccacgcccagcuaguuuuuguauuuuuaguagagaugggcuuucaccauguuggccaagcugaucucgaacugcugaccucaagugaucuaccugccucugccucccaacgugcugggauuacaggcaugagccacugcgcccagccagaauuuaccauuuuaaaccucuacucauucuucagaugguucuggacagauccuuucuuaagggugccuuugagagcacagagguaaguacagggauuagugagagcuugaugaccuccucagugcuuuucucuggcuguagcccuuucccaguguuaaaaaucuucccaucccaaaugaaagcaagccugugguccuagggcacccaucugccuuucaguauugaucauauagugugcaaagugacacaguuggugccugagagugcuucucuuuucuggcccaguuuugaugaugaauccuuuaguaaucccuuuuucuuuuuuaggugggucccaugcuauaaaugucacaguugguagaagguagaauugcugggaguggguuauuuuaaaggguggggggugguuauagcagacgggaaagagaagggagggagggaggagaauguggcuucuauguauaauauacuuggaaauccuguuugggagaguucgaugucaggacaaagugauccuuacuugaaaaauugcacaugauuuuaggaagaagccugguauggcuugauaacagugauguuuuuaucuaaucucagguaauaaauaaagcaagguaccugcgauccuuugccaaaauucaaaugucaaauugauuauguaaagagcagaggaagccaacgucuuuuacaugaagguguauaguuuuuuauggccauucaucaugccaaaguaaaaagccuugcaaguauugaaauaucugauuacaaaugacugagcucuuucuggccuuuugaauuacucagacaaauucuuccuccucuuccuucuaagcauguugcuugcauuaaacauuuaacuauugagaaggccauucuguuuuuaaaauaauuuaagaagaaauuggaauuuccuuuuaugaaagucuuauauuuaauauaucagggagcgcuaggcacuuccccuccaaagagggaaugaaccuuuuuuuuucaggaguucugcaguuuuacaaaaccugauucuagauuagaccacgaagaaaggugucuuaaauuccucaaugcagaaacucugcaggccacguucuuuuuuacauuuauuuuuauguauuuuuaauuuguauuuuucuguuuuucagagacaggaucuuucuguauuguccaggcuagagugcaguggcaugaucauaccucacugcagugcugaacuccugggcucaagugauccuccagccucagccucccagguagcaaaaacuacaggugugcaccaucuugccuggcuaauuuuccaucuuuauuuguuuauuuauuuauuuauuuuuuuguagggacaagaacucacauuguugucuaggcuggucuugaacuccuggcuucaagccauccuuccaccucagccucccaaagugcucaauuacaggcaugagccacuauguccagccaggccacauucuucggccauaauguaacaccagccuaaagaagcaaaccagccaggugugguggcucacgccuguaaucccagcgcuuugggaggccaaggcagauggaucacgaggucaggaguucgagaccagcccgaccaacauggcaaaaccccgucucuacuaaaaauacaaaaauuagccaugcgugguggugugcgccuguaaucccagcuacucagaaggcugaggcagaagaaucacuugaaccugggaggcggagguugcagugagccagagauugcagugagcugagaucgugccacugcacuccagucugggugacagagugagacucugucucaaaaaaaaaaaaaaaaaaaaaaaagcaaaccuuccauuugacaaugaaaaucaaacaacaggaaauuaaauauaggaaaacaaauuaagcaauaagaaauuagggcaauccaaaugacuucuggccaaacucacucaaaauuacccagagguaaaauuucauaguuuuaagugcauccauucuuaaagaaaauaaacucauuucucuagagaguuuuucagacuaucccucauuuaaagaaacaaaaaaggaaaaucuuaauguacccuccaaguucauaagcaaagccaaggucaagaguguggauuuuggagcuaguugucuuggguucaagugcugguuucaugauacuaacugugggcugcugggcaaaugacccaguuuucucaucaggaauaaaaauaucuaacucaugaggaugaaauaauuacauagguaagguguuugauauaguggcaagcacauaaaaagaacuuaauauaugugaacacguauuugcauuccgauuucucccugcugccuuggauaaauguccaccaucaguugggccuaucucccagugugcuucucuagaucuuucuuuuucuucguuaaagaauuauauuugaaucuacauaugacaucuuuuucuuuuuugguaacagcuugauugagcuguucacauacuauacaauucacccacuuaauguaugaaauuccaugacuuuuuguacaaucccguagcuguguguccaucaggguaaucacuuuuagaacauuuuuguugcuccauaaagaaacugaaggccaggagcgguggcucaugccuguaauucuagcacuuugggaggccagagaggguggguugcuugagcucaggaguuugagacuagccugggcaacauggcgaaaccgcauuucuagcaaaaauacaaaaaguuacccaggcauggcgguaugcgccuguagccccagcuaccugggaggcugaggcaggagaacugcuugaguccacgaggcagaggucacagugagccgagaucucgccacugcgcuccacuggagccugggugacaaagcgagacccugucuaaaaaaaaaaaagaaaagaaaaagaaacuuaauaccccuuagcauucacuccuccaaucucgccauaucucccaacccuaggcagccacuaaucuacuuucugucucucucuguuugcuuauuuuggacauuucauauaaauggaauaauaucaaauauucuuucauugaguguaauguuuucaaguuuccuucauguuguagcauguaucaguaccucauuucuuuuuauggcugaaucauauuccauuggauagauauaccaauauuuuguuuauccauuuuucaauucguggacuaaauaaugacaccuuguaacuucuaaugacuucauuuuauuuuucaucuuucuccacugauuaauuccuucaccaaacauuuauuuagaagcuagaaaauguuaagugcuguguuagccaccaagaauggguugaugaauaagguauuguucuuggcugggcacaguggcucaugccuguaaucccagugcuuugggaggcuaaguagggaggaucgccugaggcccaggaguuagagagcagccuggacaacauagugagaccccauccuuaaaaaaauuuuuuuaaaaauuagccaggaauguuaguaccugccuauagucccagcuacucaggaggcugaagcaggaggauagcuugagcaaaggaagucaaggcugcagugagcuacuugcaucaccgcacuccagccgggguggcagagcaagaucuagucucuuaaaaaaagagagagauuguaauugacaucagaauacuuauuuuccagcugugggaaaguuaugcacuuaaauaugugccugaauuuaaauaauggaagcccauaccuguccacugguaggagaagacagugguuauucuaucuggcagggacaucaaagaaugcacagaggagcaagggcucaaaagaugagugugucugcacagauauuaggugaguggagugucuguaagacagacgcuucaggcaguggugugagucugagcugaugcaugaaggcacuuggcaaugugcugcuucacaugacgaacuguaaagugacuugaacuugcucauguugaggauugaggaugggacgagaggcaaggaauacagcuggagacaaggggaggggucaggccauaaagugucuuguauauuagaaugaggaguugaucuuaaccuaaaccauaugggaccguggaagagugagggagaauuguggaggacagaauagaggggaggaauaaaaggcaagaggcucacaccuguaaucccaguacuuugggaggccgagacagauggaucaugaggucaagagauugagaccauccuggccaacauggugaaaccccaucucuacuaaaaauacaaaaaucagcuggccgugguggcuggcaccuguaaucccagcuacuugggaggccgaggcaggagaaucgcuugaacccagggggcagagguuucagugagccaagaucgugccacugcacuccagccuggcgacagagcaagacucugucaaaaaaaaaaaaaaaaaaaagaggccaguuaggagauccccuucugcccaaaccuguuucuguuucuguuuuuguuuuuguuugagacagggucuuacucugucgcccaggcugaagugcaguggugaaauccuggcucacugcaaccucccucucccaggcuaaagugauucuccugccucagccucccgaguagcugggauuacacgcauguaccaccacaccuggcuaauuuuguauuuuuaguagacacaggguuucaccguguuggccaggcugaccucccaacuccugaacucagaugauccaccugccucggccucccgaagugcugggauuacaggcaugagcuaccacacugcacugaguuuuagccuugguuaauggcauagccaucuacccagucaaagagaugccauuguacacugcggaaugacauuuuaguuagggauggacugcauaaacaauggugauucugcaagauuauaauacuuuguauuuauuuauuucaauagauuuuuuggggaacagguggguuuugguuagaugacuaaguucuugaguggugauuucugagauuuuggugcacccaucaccugagcaguguacacuguacccaauguguagucuuaucucucacccccucccacccuuucccccaaguccucaguuuauuguauuauucuuaugccuuugcauccucauagcuuagcuuucacuuacgagugagaagauacaauguaucauuuuccaucccugagucgcuucacuuagaauaauggucuccaauuccauccagguugcugcgaaugccacuauuuuguuccuuuuuauggcugaauaguauagacaauuucuuuauccacucauugacugauagaauauuuuuacugaaccuuuuauauguuuagauauauugagauacauagaugcuuaccacugugcuacaauugccuacaguauucaauccaguagcauguugaacagguuuguaaccuaggagcaauaacauauaccgucuagcccacauguguagugggcuaggccaucuagguuucuguaaguagacuaugauauuugcaugaccacaaaauccccuaaugacacauuucucaggauguguccccaauguuaagugaugcaugucugugucuuccuacaauggcaucuggaccugauggguucccuagugaauucuuuauuauuuucaagcuuggauaauggcuuaaucuucuacagaaaugucugagucuucuacccuucucuguugcccaggcuggaguacagugguacaaucauggcucacugcaggcucgaucucccaggcuuaaacaauccucccaccucagcuucccaaguagcugggaccacaguugugcaccaccacacauggcuaauuuuuuuuuuucucuuuucuuuuuuuuugagauggagucucacucugucacccaggcuagaguguaguggcacaaucuugauucacugcaaccucugcuuccuguguucaagcgguucuccugcuucagccucccaaguagcugggacuagaggcaugugguaccacucccggcuaauuuuuguaauuuuagcagagaugggauuuugccauguuggccagacuggucucgaacuccugaccucaagugauccgccuguuucagcaucccagagugcugggauuacaggcgugagccacuguuccuggcccuggcaaaauuuuuuuaaaguuuuugguagaaaugggauuucccuaacauggacacaggaaggggaauaucacacucuggggacuguugugggguggggggaggggggagggauagcaucgggagauauaccuaaugcuagaugacgaguuagugggugcagcgcaccagcauggcacauguauacauauguaaccugcacaaugugcacauguacccuaaaacuuaaaguauaauaauaauaauaauaauaauaauaauaauaauaauaauaauaauaaaagaaaugggaucucccaauguugccuaggguauuuuagcggguccuaaaaccagucugccccugcuccaggcuguucuuugcauuccugucagaguucccuaucacaauccaucgugauaacuuuccugcauaaacaucuuucacugcucuuuauugccugcuguauaaaauccagccucuaggcagauugacagaacaaugcccgccccauccacagauucccacguccuaauucucagaacagaaccugugaauauauuacuguguuuugacaagucuucuaagaccgaggcaggaggagcagagucagagaaggaaacgugaugauggaagcagagggacacagaugcuuacuguuguguuacaguugccuacaguauucaguccaguaacacguuguacagguuuguacccuaggagcaauagcauauacuaucuagccuagacguguagugggcuagacuaucuagguuuauguaaauaaugcuguaugauguccgaccuucugcagaggucagaggaaagagaagaugcaacaugacuggcuuugaaugcggaggaaggggccguacgccaagaaauucaggugcacucuggaagcucucagauuggugcaaaaguaacugugguuuuugccguuaaagguaaucgccaucgaaguuuuuugccauuaaagguaauggcaaaaaaugcaguuacuuuugcaccagccuaauagaaaaggcaaggaaacgggugcuagccuagcggggagcgugcggcucugcugacaccuugauuucauccagcgaaacccacuucagacuucaacuucuagaaaagccagauaaugaaacccauuucagacuuugacuucuagaacagucagauaaugaacuugugugguuuuaagccacuaggucugugggaauuugugauggcagcccugggaaccuaacacauacucaaaccugugguucaaccugauuugaccagccucauguccugcuuuccuccauuccauguucucucugcacucucuuccuccuuucuuccucugccauucuuuuuuuuuuuuuuuuuuuuuuuuuugagacggagucucaccucugccuccuggguacccgcgauucuccugcuucagccucccauguaguugagauuauaggcaugugccaccacacccagcuaauuuuuguauuuuuacuacagacgggguuucacuguguuggccaggcuggucucgaacuccugaccuaaagugauccaccugcgucgcccucccaaaguguggaaauuacagucgugagccaccauggcuggccuccucugccauccuucauuucuccuuccucuuacacagucuguagcuuccgccuaaauugcuacguuguucucuguucaucuuguaggauccaaaggcuuugaaguugccaauuccucuaggcugucagucgcauucuucuugucuucccagccugcucgcaugacuuuauucuauccuucauuacagcggguuguaauuauucguuggcgcaucugucucucacacuagaccaugacuugcacaaaagcaguaacuacgucuuggccauuuuucaugccugguucuugccguacaauagucgcuuugaguuucuuggucaaugaaugaaugccaaagauauaacagaauuagaaaugggaauguguauuugacaauagcuaugaaggaaauguaaacaugaaaacauaccauugaaugccaaucagguuuugagcuuuaaauaaagacacacauuuuuuaacugaaaaaaaauaauaauaaaucgauguacagauguaggcacuugaauagggcagagcaaguugggacugagaaagaauuuacaaaauguaucugaugcuaaccucucccaggaggcaucugauaaaaugccagcuaagucuuucaaauauucaagguacaaaggacucaaaggacucuuguauuaaaaaauaauuuuucugaaacaugcacacauuaauguauuaaauuuguuuuaggcaaucaugaucuugaacucaaaccucaauaaagguauuucagaaauaagacucacuuuuguauuaacuagcauuuggaaacuggugauuugcagaauggugugcugggaaaugugaauagaugugccaggggaaagguccacagucaaauaagucugggaaaugcugcugucacuucccucaucuugaaauuuacaaugcacaucagcugguuacagcuucucaguguucaugcagcagagaccugcugaagcuuuuucuuguuauuugagacggagucuugcucugucacccaggcuggagugcagcggugcaaucucggcucggcucacugcaaccucucccuccuggguucaggcgauucuccuggcucagccuccuaaguagcuggaugugccaccgugcccagcuaauuuguauguuuuuaguagagacgggguuuugccauguuggccaggcugaucucgaacuccugaccuuaggugaucugcccaccucggccucccaaaaugcugggauuacaggcaugaaccacugcaccuggcaguuuguuuuguuuuguuuguuuguuuacccaccauuuuacuucucaaguuggagaauaaacccuuuuuuaaacauugguacaugcuaacaucuuccuggacaguaaaaaacgcugauacaggcacaaaagucuaaaauaaucuacuagcagacagaauucggcuauaugcauucaaaguauuguauccuaugccccaguaaagaagcuaggaaggaauucauuagcaugguacaucguaugacuaguuuaaggaaaagaugaaaaaucaucuccauacauaguaaauuuuuuuuuuuuuuuuuuuugagacaaagucuggcgcugucgccuaggcuagagugcaguggcaggaucuuggcucauugcagccucugccuccuggauucaagugauucuccugccucagccuccggaguagcugggauuauaggugcaggccaccaugcuaauuuuuaugucuuuaguagagacggaguuucaccacaauggccagacuggucuugaacucauggccucaagugauggaauggaauuggagacuacuagucuuggccucccaaagggcugggauuacaggcgugagccaccaugcccagccugcaguaacuugauuuaauaauguccaacacuuauuccuaacuaaagcuuuauaauucuaauauaauaaaguccucuuugacaccagagaccaaauguuuuguugcuugagaaacaaaauucuuuucuguaaaaguaggaguaaagcaaaaaaguccgcucuccaaacaauacacggauauuacuuuagaaauucggacacacagcagaaauagugcaaccacuuggcucccugacaucaaccccaaaggacagaacacccauaagcaugucaauuuccuaucaugauaauccacaacgauucucagccauggcuauguucacccuuucugaagcucacguauguuuuuaaccuggauaauuuugcggggguuaagagucucuuaauuuuggcucugauuuuggauagcagcauccaaggguccacuuugcaguuccuucugcuucucucuuuuuccucacuggaggagccaccguucugaaggcagggagaguccucguaggaggaaggcuuagucccucuuagaccaagauggggagagcuuugugugugugcgguguagggaguuggggccuggggauaccucucggguaccuggccuugcugcaucacugugguaccugagucagcuccugagaaggugggagaaagacggacacacacgcuuucagacuauauuagcuacacaacggcucuauccuaauaaaauauugcaggauggguuuucuuuuuugcuuuuuaauuuauaugaugauuauuuuuaaauuuucuauuuccauacauuuuuggggaauggaugguauuugguuacgugaguaaguucuuuaguggugaucugugggauuuuggugcacccaucaccugagcaguguacacugaacccaauuuguaauuuuuuauuccucaccccccucccacccuuucccccaaguucccagaguucauuguaucauucuuaugccuuucaauccucauagcuuagcucccacuuaugagugagaacauacgauguuugguuuuccauuccugaguuacuucacuuagacuaguagucuccaauuccauccauguugcugcaaaugcuauuaauucauuccuuuuuauggcugaguaguauuccaucauauauauauguguauauaaagaauauguauacguaaacugagauauauauacauguacauauguguguauuuauguacauguauauauaucucaguuucuuuauccaccuguugauugauggacauuugggcugguuccacauuuuuguaauugcaaaucgugcugcuguaaacaugcgugugccaguauccuuugugcaugaugauuucuuuuccuccgagcagaugugcaguagugggauugcuggaucaaaugguaguuuuacguucaguucuuuaagaaaucuccacacuguuuuccauaguggccguccuaguuuacauucccaccagcaguguagaaguguuuccuuuucaccgcauccacaccaacaucuauuguuuuuugauuuuuuugauaauggccauucuugugggaguaaggugguauuacauugugguuuugauuugcauuuccugcaggauaaguuuuugaaaaugagaaauugugacucccauacagauacaggaugaacauauaucacaaauuuuauauaaggcauucacugagagagccaguaaggugauaugacuuguuccaaggaaaagacuaagaaucacacguauacacgaaaagagcgaaugcugacauggauuuacaagugggugcaaaaugggucuaucaccuagaccagcagucuccaacccuuuuggcagcagggaccaguuucauggaagacaauuuuuccauggacuugaggcggggaugguuuugggauaaaacuauuccaccuuggaucauuaggcauuagauucucauaaggaacacgcaaccuagaucccucgcacgugcaguucacaaaagggcuuaugcuccuaugagaaucuaaugccaccacugaucuuacaggaggcagagcucaggagguaauguucccucaccuccugcuguguggcccgguuccuaacaggcuguggaccuguacccaucuuagaucaucuguccuagacaaugauugcauuccaccagaugcuacuaaucugcaucucuauggacaagaauuccuugcauucuuaguaguuuucuaccacuuacagauuauguaauaggaugaaaggcugagauaaccuggaaaaaugugucagacaagacacccaggaaucuuuuucauccauuucauccauucauccuguuuuucccacaaaaaacagaagagucauaauaauaguaaugguuacaauaauaauaaugauaauaccuuucuugcaacuuuuaacuggcuaaagcaaucauauucuuuuaccaaauuuccaucagucucagauugucaaauugguuccacuuucaucaucuucugaacuccccuacuugcccugucccuuucuggggacucauaauaucaucuuacagaacaguuuagaaaaugcugauauaacccaaaggaaaagaaaucauucuaucaaaaaaaaaaaaaaaaaaaaaaaagcucugcacucauauguuuauugcagcacuauucacaauagcaaagucagagaauuaacacagguguccaucagugguggacugcauaaagaaaaggugguacaugugcgccauagaauacuacacaacuguaaaaaaggacaaaaucauguccuucgcagccacacaaaugcaccuggaggccauuauccuaaguaacacagaaacagaaaaccaaauaguggauguucucacuuguaagugagagcuaaccauuggguacucauggacauaaagauggggacacuggagacuaccagaguggggaaggaggaaggaggcaagggcugaaaagcuaccuguugggcccuguguucacugcuuguguaagggguucaguucaccaaaucucagcaucaugcgaugucgucagguaacaaaccugcacauguacccccgaauguacaguuuaaaaaaauucaaaggaaaaugcugauacaggcacuaauuuguuugcuuugccacuuccacucuugcugucuucuccuugccuaucugagggagggcacguggauuuucucccagacuccucccuuuucccaccuguccauucgguuccuauugcugcuguaacuacagucaccauuugagcggcuuaaaauaacaggaauucauuaucuuuuaguucugaaagucagaagugauggguggggcagcagggcugcauuccuucuggaagcucuaguggagaauccuuuccuugccuuuuccugcuuuuggaggugaccagcacuccaugguucauggccaugcaucacuguggcuaugccucugcccuuaccucuccuucucucacccuccggccuuccucuuaguuagggacucuuguaaugacauugcacccacccagauaauucaggauaaucccucugcauuaguuuguuuucaugcugcugauaaagacacaccugagacugggcaauuuaaaagagaaagagauuuaauugaaauuacaguuccacauggcugugaaagccucgcaaucaugggggaaggcaaagaggagcaaaucaugucuuccaugcuuggcagcaggcaaagagagaaugaggaagacgggaaagcagaaccccuugauaaaaccaucagaucuugugagacuuauucacuaccacaagaacagcauggggaaaaccgcccccaugauucaauuaucucccacugugucccucccacaacacgugggaauuaugggaguacaauucaagaugagauuuggguggggacacagagcuaaacuauaucacucucuauaucaaaauccuuaacuugaucacaccugcaaagucccauuugucauguaaggugacauauuuauagacauggacaucuuuggagggccauuacucuacuuaccacaaccuaguuggcuggccuugaaaagggaaguucugugccuuccucugcgaaucccagggccuuguccaugaaagcuuccugcgcaaucuguguuuucaggucuaucucugguuuuucuccaccuaccuguuuguuauaagcucauucaucuuuuucuuuuccuuucuucuugagacugacuucagcaucucccagcaaaugcuccuuccuuucauggggaugcacaugggaaagagauuggaucucuuucccauguacauuuuucccauguacauuuucuacgcuuggacucuuugggugagcugauuggcccagaggaaggaccuucaagucaacugcacacaaauugcaaauuucucacacuaauucaacagagaugccuaagcugggugugguggcucaagccuguaaucccagcacuuugggaggccaaggugggaugaucgcuugagcccaggaauuugagaccagccuggacaacacagugagaccuucaucucuacaaaaaaaaauuaaaauaaaauaaaaauuagccgggcuuguugaugugcaccuguagucccagcuacucaagaggcugagaugggggaucacuugaguccaggaguucaaggcugcagcgagcuaugauugcaccacugcauuccagccugggugacagaguaaggcugucucuaaaaaaaaauaagaaaaagaaaaaaaaaagaugucuugguugggcugauuccucccuaaguaccugcagaauacucagguaauuccugaggccccuuuggagcucugaaauaaauucgaguguuuuccugcaaaauggaacauuaaaguaggaagcaguggaaaaagaaccagaaaaucacucaucacuuuuacaauaaaugcuauauguuuaccuuuccagcuacgacagaggaugcaagguaacaugauguaauacuaaucagagccaaccacuacugagugcuuccuaugugccagaacugugucaagcaccuuaacuauguuaacuccuauauugcucacaugucauaaauuauacacauaaaaauaugaacucauaaauaugaaaauacaaauucguguaucacacauagaaugcuuacaacaugagagaggguaguauuacugccugcauuuaaagauggggaaacugaggcauggaggcauuacacaauugcucaaggccacagagguaguaagggcuagagucacgauucaaacuuaggcuguccggguccacagucaauaaaugacguaaaagauaauggcuccagauaugucaacguauucgaagacgacgauugaaaaauuaaccaucaugccacgcugugccuccagggucaucccagugaaguaagaguuuagaggaaggagagauuaucauuugcugagauuggucaaggaugggaaauaaccuguacggagaacuuuagcaaagguucuuggagaaggugggaugcccccugcugguugaguaaauucaauuuucuuaacugaacugucgucauaaggucaauuuuuaaugaucauuucccccuacuccugcuuuggauccaugaagcgacuuuacuagaaaaaaaaaagucaguuuuucuuuguucgaggggacuuuaguugcuaggcaaccuauaccucaaauuugggacucaucuuugaugcuaaggacggcauccuggcauacuggacauucauaauuuacuuuccagagaacauuaacauucaaaaauggagaggcuauaaaugugaguugcccugcauguguuuuuaaaauggaaauccugaugaguuuauuucuccaagaugucuuuugcaacuugccuguuuugcuaauacacucugucauguauuaauucuuaaucaauuugcacugugauuuggcuaguuagcaaauggaauugcauuucagcgacuuccuguuuacacucagaaaccugagagucauccuucauuccucuucuucauaacuucucgcauuuuagcagucaccaaguccuguaaauuucaccugugaaaagcuuugugaaugaauuucugccuccuuuuuuucuaccuggcagauuuaagguauacuucuagacucucauaauuuuucaucuccgccacuguagauuucuaauucgucuuuuuguuuugacuuuuucucucuuuugguccaucuacccucucccccuccuugccuucuucuguuaucuuuuaaaaaacauagauuuccagccuggccaacguggugaaaccccgucucuacuaaaaauacaaaaaauuagcugggcgugguggcgcaugccuguaaucccagcuacuugggagacugaggcaugaaaaucgcuugaaccagggaggcagagguugcagugagccgagaucacaccacugcauuccagccugggugacagagugaggcucugucugaaacaaacagacaaacaacaaacaccccaaaaacaaacaaaaaagccccauagagcugaccauauuacuuuugcuugacaacuggaugguuucuucugguguugaccacacguagacuccuuuucauagcauucaaugccuuuaccaccuggucccguucgaccuuccucugcuaccucucaagcauauucugucuuccggccacacaaaaccugucacaguuguccauauaauugucacaacuuugugccuuuacagaagcuaguguuccuaucuagaacgucuuuucuauuuuuguuuguuuuuuuuuuuacaacauugguagaauuuuugucauuuuuuuuucauuuuuuguuuuguuggagacagagucucacucuguaauucaggcuggagugcaguggcacgaucucggcucacugcaaccuccaccucccagguucaagccauucucccgccucagccucccaaguagcugggacuacaggugugugccaccacgucuaacuaauuuuuguauuuuuuguagagacaggguuucaccauguugcccagguuggucucgaacuccuggccucaaguaaucugcucuucucggccuccuaaagugguuggauuauagguuugaacuacugcaucuggaaaaaugaauuucagucaucuuuuaaaagcccaacugauauuucccuuccuacagauuuuuuuucaaccacaugcucaucucuauucugauggcauugugagaacacaucccacuguguuauaguugucugguaacacauugcucuuccuagaccagcuuuuuuuuucagagcaugacacacuugaucaaugaugcacagauacaggacacacugcguugugcaaggcugagcgauccagcugcgucugcucccugguuuucugaauauugagauacacugagaccagcggcauucuagggcucaccuugaaucucuucucauuuauuucuuuaagaagccugucauuugcaauuaucccuagucuucucuaaggcaagcuauaaaugauucaugacuaacuucucaccuaacccugaagugcaggugcacuagaaugcuguguuuauaaacagcugcucgagucuguaaucccauaaucacugaacaugcuauaccugucuuuguaguccaguuacuuuggauagugcugguacauaguauggacccaguaaaugcucgugauagagauauguuggauaggcugaauacuuguguucuuauggucauuguuauguggaaguaaguuucacuuucauauaguaauagauaaaaguuaccgaagucggcugggugugguggcucaugcccguaaucccagcacuuugggaggccaagauggacggaucacgaggucaggaguucgagaccagccuggccaacauggcgaaaccaugacucuacuaaaaauacaaaaauuagccagcaugguggcucacaccuguaaucccagcuacucaggaggcugagggaggagaaucgcuugaaccugggggugaagguugcaaugagccgagaccaugccauagcacuccagccugggugacagagcaagacucucaaaaaaaaaaaaaaguuauggaaauccuuacuaugagcuaggcagugugugcuaaguccaaagacuaacagguuaucuaagaacuggaggccacugaaaggauuuccacugcccaaaauggaaugauuuaagcaguaaaaaaauaauaaaugcaauugguagcaacacauuaaaaauauauucauauaacauauauaaacauuuuacauauuuuauauauuguauauuuguaauauauacuaaaaacuauauguuuauaauauauauuuuauauauuauauauauuccaauaaguuucuaacaauacauacauauauagacuuacuuccaugguacuuuaacaugguagggguaaaagcuuauaggguaccaaaaauuuuuuuuuuuuuugggggggggggggguuaugcaguuucgcucuguugcccaggcuggagugcaguggcgugaucguggcucacugcaacuuccgccucccagauucaagugauucuccugccccagccucccaaguagcugggauuacaggcaccugcaccaugucuggauaauuuuuuguauuuuuagaagagaugggguuucacuguguuggccaggcuggucuugagugccugaucucaggugauccgcccuucuuggccucccaaagugcuuggauuauaggugugagccaccgugcuuggccagguaccaaaucuuuacuccaaagauuggcacuuaaaaagcauaaacaagcccggcgugguaggugguagccuucagcuacgugggaggcugaggcuggaggaucacuugagccugggaguuugauauugcagugagcuaugauggugccacugcacuccagcaugacccacacugugagauccugucucuaaaaaaaaaaaaaaaaagaaaaaaaagcauaaacaguauuucaaauagcccaaguaacaguaaccaaauagcccaaguugauuaaaaaaaaaaaaaaaaaggacaccuucuguaugaagaugucaaugaauaauuguggaagaaauuaauugcacuuggaaaucaccaguuugccaccaagaaugaaauacgguguuugcaucaagcaaggcucugugaugaaagaaaccaugagaugaaagguuuauggagaacuugacaaugcacauuuugggcugucacccccugaaccugcuaguugucacuauaguuggcauaucuagguaggguggggucccaauguaguacaaccugaagcucacagcaucccauaugaaguugucuucaugaaaagcugaauaugaaucuauucaaagcucuagggccaacuuccauuugcaggaaauaugagggacagaggaacaaacuaaaugauaccccgugggcuucuggaauguaggacagucuucaggacagcugacacgguuucugcgacaagucaaugacuugaaaagaaugagcagcuggggaggguggggcacauuagagauaagcaacaugugugccuuguuuguauccugaugcggacggaucauguaaaaugaccuuugugagacaauuagggaggugggaucauggaugacuaucagaugagauauuuuuaauccugagaauuauuaugucuuuuguuaauaagcaaacaguauauguccuuuguuaauaugagucaguauauaacuuuuuuacauaagaaaauguaauuuuuuuaauagaugugcauugcagugcguaggggugaaaugacaugaugucugagaagugcuuuaaaauauuuuagcaagaaagggggaaaaagaugaagcaaauguggcaaaauauugcuaauuguugaagcugaguuaugguuauauggcgauucauuuaguuaucugucauuuugagcaaguuugacaauuagguggauauaugaaguuacacauauauauguacacacaugugcuuauauucauauauauauauuuauuauuuucuucuucaguuuuaauuuucaugaugauaaguuacauagucuaccaauguauaaugagacaagauucuccauuagagaaaacuugcugguuuuggcugauggaaacuccgaugcagacauaaguguuuagugacacuugccuuaaccuguuuggucuuugggggcagauguauuugccagcgcuagccauuacucuaagucaagaugggaacagucaaaaaaauuguaugacauuuaaaaaagaacuuuuaaucucaagcauauuaguccucaugcaaaugauguuaauuacccgugaaacuuauuuagccucucagagcuguccugguuagacguauaaauagaauguuuuucuuaucuacuucguuuuguuacugaaugcccuugaaagucauaauacugaauuuaaagcaucucuaauuuagaucaacuuuucacccaauuagugugagauaugaguucaacugaaaacuugcuugcaugugagaaaauaucuaaguuuuaccuuugcuaauuuuaguccaaaaaaaucaccaguuuucauuuaauaucucgcauguuacaaaggaaaccaaauauuauuggggguuagccuuuuaaaguaagccaugaugccuaaagaccacaaauauugaaaacacggaaaacccagacuucagacuuuaucaaauaaacuugauauaaaauacaagaacaaagcauuucaaaauuugcuguuuauuuuucaauggggucuaaaucugacaaaaugacauuuguaguuccuaauugaaauagacaucuacaauaugcguaaaaauauuacccaagugaaaaauaaagcgggaguuugucaaauaaccuuuucuuucuuucuuuuuuuuuuuugacauggagucucucucugucgucugggcuggagugcauuagugcgaucucggcucacugcaaccuccgccucccgaguucaaaugauucuccugccucagucuccugaguagcugggauuacaggugcgugccaccacgccuggcuaauuuuugucuuuucaguaaagaggguuucaccauguuggucaggcuggucucgaacuccugaccucgugauucaccuaccucagccucccaaagugcugggauuacagacaugagccaccgcuccuggcccaaggaacccuuuuuuaguuagcaguuacagugauuauguaucgaaugcuacuccauucgaccucuugcacaagugcagccuuuuccaacaguuauacuucccauugccuuuucuuucucagaauuucccuuuaaugucaagcugaaauaauucuccaugcugaauuagucucaucuggauuuguggaaagaggucuuccuuccuguuucugacagcacuauuguucagaguuuuauuccuuuaugcaauacacauugggccuuauucuccuucugaauugcuuacaaauuuuuucccccauuuuucgggaugugauuugaguugaaugcaaacacaccuuccucauccuuucaaauugggacagguuagauuaaugguaauaaaaggccucagauucaacuucuaccaaaugagcuucugccuuggcucuuugagcaagagcacuuggcaaggugguuggaccagagugaguucuuuuauuguugcccuggaucagcaccggguggaggugcuaagggacgcgaacauguuacaaaggagaaugcuagaagggaaauaaggagcaaauagccugguugccauggucccuggagccuguggaaugacucuucagaagugccaaaucgccaccaaauguccuuuuuuuuuuuuuuuuuucccucugucgcccaggcuggagugaaguggugcaauuucagcucacugcagcuucugccucucagguucaagugauccuccugccucagccuuccaaguaguugggauuacagucaugcaccaccacgcccagcuaauuuuuguauuuuugguagagaugagguuucaccauguuggccaggcuggucucgaacuccugacuucaagugauccgcccuucucagccuccccaagugcugggauuacaggcaugaaccacauugccccgcccaaauguccuauuguaauauaaagcuugguguagaaaauaagaacccugagcucuuugagaauaaucaaaaauuaauuaacaaaaacccugagcugcugaucagucuuacauagacccucuggccaggccugcuuaagagucaugacauagcccgggaugucuuauuucuguuuaccuuccuuaaaucugucuccuccuccaaguguccuccucucuaagucaggguaagcacuugaaauaacaauaagaaggggcuacacaguugcagcaggggagacaguguucuggugcaucagaaugcucgugcucauugaaugaaugcacagaugaaugagugaaugagcucuuguagcucaacugguuugucaucacuuuuaaggauuacacccacgcaucccgccuccucacuguuucagcaggagacgaaggcuaugaguuagauguaauaugaggauggcuuugggagccagcacaccagaaauuacaauagguguuuccacucagccgcuacuguuugugcuaacuucagacuaauuagucauuacaggaugagguuuuggaagggagcaagccuaaaaaucauccaucuucaguguaaguguucuugggccaacagaaagaaggggaucuggcaccaaauaagacaggguggaaaauuccucuucauuuccauccugacauuugaauuuucuuuagagaaaauugucugggaaagggagacucuauugaacuuugggcuuuccuaugcuguaguaggcuguuccugcaucacuaggaagaaaggccugaaguuugguaauuuauaaagaaguuuaauuggcuuaugguucuacaggcuguacaugaagugugaugccugcaucugcuucuggugaggccucaggaagcuuccagucauggagggaaggugaugaggagccagcauguuacauggcgagagugggagaaagagaaggaggaggugccacagacuuuuuaauaaccagaucucauuaucaaggccagcacuaagacauucaugagggauccgcccccaugacccaaacaccuccaagcaggcgucaccuccaacacugggaaucauauuucaacaagagauuugaaggggacaaacauccaaacucuaucauaugccaacagcaaacagcagggaaugccuagucuugcagaauucuagcaucuucaggcuggaagaggccuuaccuuucccacaaaguucuuccaaagcccuggucugccuguaagaauuaaagaaagaggaaggaaacacgaaaaguagcuuaacagucaaagacagguuuauuuuggagaauaaaccugagaggagcgucuggccaagcuaggucaggugcucucucuuacagauuaagaguuuuuaaggguucaggguggaagagcuuaucacagacucagaauguuucugugugucuuugucuugcuuaucugggagggagaguuuugugucuguucccauacauuuuuuuugcaguugcaggcauacccucugaguuugcauuuaguuuuuuuuuuauuuuagugcacuuaaagggaaaggaauaugcuuauuagggcccacuguuuuacuggggcccauuguaugaaugugaaguuuggugguuaccuaagagacuuucccucuuccucugugccugagcuguuuuauuugugauuuacugucuguucuuucaggcugcuuguuguuagaagagaaguaauuuccuugaaaugcaugagguuagaaagggagcuggaacuuaaaguggcggcguuuguucucacaaaguuccuccaaagcccuggucugccuacuucuccaugaauaccuccaguaccaaggaauacccucuccagcguggcagccaguuuuagcaguggauuauucuuccugguuaggaaauuguucucuauccccagaugaaguuugccaucuccaaaugccaccaguauauccugguccuugcagugagguuguccagaagcugacucuuguuucugauggacaucugaggacagucaugaugcuccucaagaaucuucacucgugucucagauugcaugcuuucuuaccccacuuacuguauucugaauuugcucugguuuauucuuauuuaaaaaaugauuuggcucacucccauaaucccaacacuuugggaggccgaggcgggcagaucaugaggucaggagaucgagaccauccuggcuaacacggugaaacccugucucuacuaaaaauacaaaaaauuagcugggugugguggcgggcgccuguagucucagcuacucgggaggcugaggcaggagaauggcgugaaccugggaggcggagcuugcagugagccgagauugcgccacugcacuccagccugggugacagagugagacucugucucaaaaaaaaaaaaauugauuauauugagguauaguuuacauacaguacacugcacauauuuaaauugugcaauuuguugaguuuugacuaaguauauaccuauaauacuaccacccaauaaagagaccaaagacagagcgagacuccgucucaaaaaaaaaaaaaauugauuauauugagguauaguuuacauacaguacacugcacauauuuaaagugugcaauuuguugaauuuugacuaagcauauaccuauaauacuaccacccaauaaagagaccaaagauuuccaucacaccccaaaauuccaugaugguccuugcaauuccuuccuuccuccauguugucaccucccugucccaaacugaucugcauucuaucacuacaguucaguuuuuguuuucugaaauuuuauagaaaugugaucauacaauauauauacucuugugucuggcuucuuucucuuagcauauuauuuugagauucaucuguguuguuauguaucuguaguuuguuuuuuauuguugggugauauucuaugguguggauauuccacaauuuauccauccaccuguugauggacguuuguguuuuuuguuuagcuaguuuuugacuauuauaaguaauagucaaaaauguaauaaagcuucuuugaauguuuuuauacaaaucuuccuguggacauauguuuccauuucucuuggguaaauagcuaagaguggaguggguggguugcaugauagauggauauuugacuuuuuaagacauugccaaacuguguuucaaaguaguuguacucuuuugcacucccaccauugguguaugagaguuccaguugcucuacauccuugccaauccugauacuaugucuaauuuuaaccauucugcugaaguguggugguauauaacuguuguuucuauuugccuuuuccuaaugacuaaugauguguaccuuuuccuguguuuauuggcuauuuguauuucuucauuuuugaagccucuuuuauuuuuuagcuauauaaauucuuuauauauacuagauauaaguucuuuguuugcaugcauguugcaaauauauucucccagucugugguuugccuuuuuauuuucucaacaguggccuuuaaagaccagacauuuuuauuuuuuauaaaauuagauguaucaguauuuuguguuaugauucauacuuuuugugugcuaucuagauaaucuuuauuucaugcucacagagauuucucuugucuuuuguucccaauguuuuauaguuuuuguuuuucuauuuagaucuauuaucaauuuugaguucauuuuuacauacaagaugaaaaaaugguuguuuauuucuuucucauguggauauuuaggcauucuagcaucauuuauuaaaaacaaacaaacaaaaccaccuuucuuuugccacugaauuaccuuagcaccuuuguaaaauauccauuuauauguaucucuauuucuugacucuguauucuguucaguuaucuagaagucuguccuuuugacugggccuucagaauaagucuugagaucagcugcaguuaaguccuuuucacuuuguucuuuuaaaccauuucuuuggcuuuuuauagcauuuagccuuuauauguaaauuuuagaauccaaauugucaaugucugcauaagucugguuaaauuuugauaguaauugcauuaacucuguaaucaauuggggaaauuaaucucuuaacaauauggaauauuuuaacccauaaacaugauauauauauauauucauuuaggucuuccuuaaggcccaaauaacguuaaauuauaaccuucaacuucgagauuuuguauaacuuuugauuaguuuuauucauauguacuuuauuuuucuuuuuuuaauacuacugcagauggaauugauuuuuauagcuucauuuuuguucugcuccuauauagaaguacagcaauuguuuucauauaaaccuuguauccuaugaccuuguuaaauuuauuuauucuuuuuagaaauuguuuuguagauaucuuguacauuucuauacaaacauucaucugcaaauaagagaucauuuuacuuauuuuaagaucuucaaaaaaaaaagauauuuaucucuuuuuuuucuugccuuauugcaauggcuaagaccuaggauacaauacagugguaaauagaagugguaacaguggacauauuugcuuugugcuuuguccccaauuuuaggggggaagucuucagucuuucacuggcaaggaugaugugagauacaggucuuucauauauaacagauuuuaucagacugaggaaauuacccacuauuucuaauuugcugagagauuauaccaugaauaguuguuaaauuuugucaaguauuuuuuucuacagucauugaaauggucguaagaauuuucaacuuauucaguugaaguagugaauuaucucuuuuuaaagaaauguugaaccaggcuugcauuccuggaauaaacccuacuuagucaugauguguuauguaccuuuugauauauuucuguagaugacugguuuaauuugcuaauacuguaauaaggauuucggcaucuuuguucacuagaguuauuggucuggaguuuucuuuucuuaucauuguuuugucugcuuuuugguccauuucacucuugaacacaaagcaccagggcuaugcaagacugacuagugagccuucuggcucuaagucuucuccaucacugguugcugugaaggagguacaaauggucugaaugugacugagaagguaucaaagcacucccugguagacaucucaugcaucuuuauggcaucuucucaggcaaggaugacuucauuuuuacucucgaaaagccuugaaaaacuaagagguggacagggagucugaacaauggcuguuaaaaacucagacucuuugguucaacuuuuccacagguuccauggcucuugcuuagucacaaucaggcuggaccccaugggucuguucccugguggauuacucuuuuguugaugagccuguuugugacaauggcaaagacagauaauugcaaaacgaccagcagauagagaugcugcugggagguuuccugcuuucaucaauucucauuaugguucuggcugugcuacuugaucgcuacaugaccugugaucuuucuggaccccaguuucuuugccuuuaaaaugggauggcgacacauuacuugaaagguuguaagaaucaaagauggguguguguguggaccuguguguguguuuaaaugguaaacauuauuacuauuucaaaauuuaaaugcucugauccuuaguuuacugaucucuaaaauaaauauaauaauacguaaaaugaggaucccacaguauuauuuucaagcuaaaaauaaaugaacaggaccugguacaaagaucuucaaaaaucucuuuuuuucuccccucuccuacuucacauguuaguccuggaugugggccucuuuuuugcaggugaacaaguuuguacugagaacauacgaggcuaaauaauacagguuuucagauguuuuuccuucauugauuuauuuguucauuugucagccauuuguuacaaauuauaucagucaccaugcauuuuaggaauuuuuaauuuuuauuuuuuuaagaaaaauggggucucacuauguuggccaggcuggucucaaacuccugccucaagcaguccuccucucugagccugucaagacacuggauuuauagguguguaccaccacaccuggcuacacauuuuaggaauguauuuuaaaagacuuugauuauuuggagguguagagcucuaguuaauacccaaguccuuggcuuucaaguuggauuugauuggaagucagcuuaucuuuuaggcgugaaaaguuuaaaccagccaauaccuaauuuugacucugugaaaucuuuuuuuuguuuuguuuugagacugacucucacucugucacccaggcuggagugcaguggugcagucuggcucacugcaaccucgaacucucaagggcucaagcuauccucccaccucagccccccgagugguugggacuauaggcauacaccgccaugcccagcuaauuuuuguauauuuuguaacacagagucuugccauguugcccacgcuggucuuaaacuccuggacucaaugugauccacccgccuuggccucccaaauuguuggaauuacaggcaugagccaccaugccuggcugacucugugaaaucauauucauuguucagcauccuguuuaaaaguauccacaaguaugaguuucuagugcuuaauucaauucaucucaaaucuaugguagaauauaccaaauaacuggucucucucucugaaugacuuugcucaaaaaaucugguuucuuaguuguuuugaaacuuugauaaagacaugacaaugacagaugaccuaaauuaggcagagaaugacucaggaaccccaucuuggagcuuaggauguaggacucucuuuaugugcgugccugauguucucuguucucuggaggaagguggggcaaugccacuggcccuaacguccagguugaaauuccugcgacuuuaaccaaguuauguaaaaauggucauucacuucuuuuuugucuuuuugaagauuguuuugcaagugguugcagcugcugcucaucugguugacuuauauaggaccuugucacgaucgaagacugaauggugauugcuaaaaaugaauaggaaaugcuuucuaaaguagcaucagaguuauuaaggccauaaauagacaagagaguagaacuaaaugccagcaaaauaaagaguuagagagguagccaggcacgauggcacacaccuguagucccagccacuugaaggguugagcaggaucacaugaggcuaggagcuugagaucagccuggacaacauaguaagauccugucucuacaaaauguaaaaagaaaaaaauaauuagcugaggcauguccuaguuacuugggagggaggauugcuugagccuagguguuccaggcugcagugagcugugauuaugcaccauugcacuccagccugggugacagagugugauccugucccuaagaaaauaacaauaaaaauuggccaggugcggugucucacgcccguaaucccagcacuucgggaggccaaggcagguggaucaccugaggucaggaguucaagaccagccuggccaauauggcaacacccugucucuacuaaaaagauacaaaaacuagccggguguggugcugggcaccuguaauccuagcuacuggggaggcugaggcagggagaauugcuugaacccaggagguggaaguugcagugagccgagaucgcgcgauuguacuccagccugggugacacagugagacuuugucuugggggaaaagaaaaggaaaaaagaaaaagaaaauaacaaaaaaaauuaaagccuuagagggagaaugaggguauaagcaagaagcaaggcugcgugguggcucaagccuguaaccucagcacuuugagaggcugaggcaaaaaaaucaccugaggcuaggaguucaggaccagccugggcaacauagaaagauucuguaucugaaaaaaaaaaaaaaauaaucagcugggugugguggcaugcaccuguaguccuagcuacuugggaagcugagacaggagaaucacuugaccccaggagcucgaggcugcagugagguaugaucacaccacuguacuccagcuuggaugacagagugagacucugucuccaaaccaaaaacaaaaccauaaaaacuaacaaagcaaaaagauaaaaacaagaggcaagugagggccaaggagagugcaugaaaaauuuuacuuuuuuggagcuuuuuuuuugucuuaaguucuuuuuauguggugcagugagaguucugguccuucauucaauacuuacuuaucuccugccacaucaaguauguguaaauguagggaagaaggcgauaaagaaauaaauagggcuagaugugguggcucaugccugaagucccagcacuuugggaggccaaggcggguggaucaccugaggucaggaguucgagaccagccuggucaacaugguaaaaucccgucucuacuaaaaauacaaaaauuagcugagcguguuggggggcaccuguaaucccagcuacucgggaggcugaggcaggagaaucgcuugaaccugggaggcggagguugcaaugagccgcagugucaucacugcacuccagccugguugagaagagugaaacuccaucucaaaaaaaaaaaaaaaaauaauaauaauaauaauaagcaggcauccuugaaguguuucucagaaaggggacacaaaacuuacugccaugaaacuggcagaggaaggguaguauggcauauuguauugacagcuuauaacaaauaaaauuaugauaauagacugaauuagacuacacaggagucagaacacugucucuuuuacuuuuuuaguuacagucuauaaauccaguugugaaaauauauuggaagagacagaugggugccacgucuagcuucacacaaacauuauaaauaaaacauuucuuguaaugcuuggaauuuugcuuggugcauuuuaaaagauccacauuuuaaagcccugagcuguagauucauuagaaaauguaauuuuacuacugaugccaaacauaaauacguaugcaugcaauuuucugcaucuugaauaacuuuuuaaaaaauuuauucacagucuaguucacaaauaaucaaccuuugauucuccacccuacagauuauagaucguuggacugucuaugugaauauuucaaacucagauccucuucccaaguuauuucuuuuuuuuuuuuuuugcuuguuugcaaaaauuaaguauguguugagaaaauguaaaugaauuuuaaugcuagcuucaggggagaaauaauuuugaagggaaauuuugcuuuuggagaaaacccaaaauaagccaucacuguaucccugagucaguuaaacauaguuucuggccauuaacauagauugcauaaauuuggcaacaaauucacaucuugcccaggcaauaauuccuuuauuaaguucacagcuacuguauaagcuuguugagagugcuuaggaaguuaucuuuauuagcagaauucuaucuuccguauccugcuuugacuauuucugccaagucuuuggagcuugggauaaucaauugcuguugcucucuugacaugacugugauguuucauaaauauuccaugaauuguuacaaauccagccaaauuacuucagccaaacuaaauagguuggaaauuaggauguuugaugucaagugcauccuacaaauaauuuucuccaacgucugucuuuaagggaagaaaaaccaucucagagauauuaaaugauucuucaaauucacagagcaugugacuagcagugugaaaaguagaauguagcugcgcacgguggcuuaugccuguaaucccagcacuuugggaggcugaggaggguggaucacuugaggucaggagcucaagaccagccuggccaacauggugaaaccucaucucuacuaaaauuacgaaaauuagcugagcaugguggcgggcuccuguagucccagcuacugggaaggcugacgcaggagaauugcuugaaucugggaggcagagguuguagugagccuagaucgcaucacuguauuccaagcugggcaacagagaaagacgcugucucaaaaaaacaaaaacaaaaccaacaacaaaaaagaaacuagaauguuagucuacugauucucaaucuacuauuguuuucucauuacacaauuuggguagcagccccacguacuugguugacccaacaugccuacugguauuguuucucagcagcaucauggugcaaggguuuccaucugaauuaauaacacaaugcauguaaauuacuuagaaccuagaaagccaucaaugaauguuaacaauucuuauuuuacuucuucuccuucuuuuauuauuaacugcuuuauuuuugccuugguauuuucuuuuucuuuuucuuuuuuuuuccuugagacagggucuugcucugucgcccaggcuggagugcaguggcaugaucucggcucacuacaaccuucaccuucccaguuuaagcaauucuaauuccucagcugagacuauaggugcaugccaccaccaugccaggcuaauuuguguauuuguaguagagaugggguuucaccauguugcccaagcuggucuugaacuccuggccucaaaugauccacccaccuuggccucccaaagugcugggauuacuggcgugagccaccaccgcgccuggacuaccuugguauuuuuaugcuagagguagccaacaaguaaacucugaucuauucauagccuuugaagaaugcuugguauauuuacauaauccguuugccacuccacucuguuucccauauuuugcucuuguuuguuaggacuguuagguaggagggagguaguuguuaguuuuaucaauuaggaaugcauuuuguagcaaguaauagaaauauugaugaacaguggcuugucacaaagacaaucacugcucacuuaauaagaaauuucaccuugguguguuggcucaugccugugaucccagcacuuugagggggcugagguggaaggaucacuugagaccaggaguucaagaccagccugggcaacaccguugcaagacacagcaagaccgugauaggcaugauggcucauacuuguagucccagauacuccagaggcugaaguaggaggauugcuugagccuaggaguuagaggcugcagugagcuaugaucaugccacuguacuccagcuuggguaacagcgagaaccugucucaaaaacaaacaaacaaacaaaaaacagaaaccugaaccagggcaaaacaccuucaccuccugagacaccuuuguuugaaaauauaagcuuucuucuaauguuuuuauuagccaggacuguaauacauggcuagugcucacugcaagugaggcuggaacaguaaauguuuaguucucuagccucuguagcaaagcaugagaaaggagaaggagguucggaaaauugcugggucagccaccuaaaaaggucuauuacacaauuuggguagcagccccacauaguugguugauccuaacaugccuacuggugcaguuucuuggcaacaucacgguucaaggguuuccaucugaauugauaaaaugcagugcaaugcauauaaauuguuuaaccuggcuaccuggcauuacaaacacaauucauuuccuucuucccugcauuuuaucuaguauacacucaaccuuccucaaggagacagcccucauggcuuaaguuuuauuuauuucugggcaauuuuaaauguuaguaccauggauaaagagauuauuuaggcuccauuuuuaaaauuugauaauucuuuucccuucccauuuucgcuuuucuuuguuugcuuguuuguuuguuuguuguuguuggagacagaguuuuuggcccuguuggccaggcuggagugcaguggugugaucucaacuugcugcauacucugcguccuggguuuaagcgauccuccuggguuuaagcgauucuccugucucagccuccugaguagcuggggugcugggauuagaggcaugcaccaccaugccuggcuaauuuauuguauuuuuaguaggaacgcagucucacccuguuggccaggcuggucucaaacucaugaccucaacuugaucugcccgccucggcuucucaaagugcugagauuacagaagccagucaccaugccuggccgccacuucuaguuucuaccauccuucuuacaccuaaauguaugggcaguugccuugaagaaauuugaaacgguagguucuggguucuggugggcagauaccauggugaacuuguucuuugcuaccagggucuuuaaucuuauaucuugguaaaacaucugcuuccuuguuuacacuuuaaaauuuacaauuuagaaacagugaaaugcauagggcuuuggugcacaauuugaugaauuugguaaauguauaugccuauguaaccacuuaaaaguauauacuuggcugggugcaguggcuuaugccuguaaucccaggacuuuggaagacugaggcaggaggaucccuugaggccgggagucugaggucaguuugggcaacauagcgagacccugucucuacaaaaaacaaacaaaaacccuaaaaaauaccacccaaauuaacaaauuagccaggcauggugguacgcaccuguauuccuagcugcucaggaggcugaggugggaggagaaauucaagguuacaaugaaccaugaucaugccacugcccuccagccugggugacagagggaaacccugucucugaaacaaauacacaaaaaauguauauacucauguaaccauguuucugggcugccaucacaaaguguacuaugaacugaguggcuuaaaacagugucaguuuauuuucucacaguucuaaaggauggauguucgaaaugaaggugucagcugggcugugguuccucuaacaccugcagggagaacguucuacuuucuugccucuuucugucuucuagugguuuucagcaaucuuugccauucauuggcauauaagaguauaauuccauuuucugcccuuauuaucacauggcguucuuccuaugugucucugucuucuucuucuucuuuuuuuuuuuuuuuuuuugacggaguguugcucuugucacccaggcuggagugcaauggcgugaucuuggcucccagguucaagugauucugcugcuucagccuccagaguggcuaggauuauaggcaugugccaccaugcccggcuaauuuuuguauuuuuaguagagaugagguuuagccauguuggccaagcuggucuugaacuccucaccucagauggccugcccaccuuggccucccugagugcugggauuacaggcgugagccacugcaccugguccauauggccaucuucuuaaaaggauaccaguuguuggauuagaguccauccuacuccguuuuuucucucucuuuaauguguauagguuucuucuuucuugaucuuuuaucuccuuucuuuacauuuuuucuuucuuucuucuuucuuuuugccuuuaucuuguuugugguagucugaucauggauucaucaggaagccugggaaaucuucacuuguuauauauucaaauauuucuucuuuuauguugucuucccuuuuggauuuucauuacauguauguuaaaucucucauugucucacaggucacugaaucuccaucaauauguuucuguaucuuuuucuuucuguucuucagauuggaugauuucuauugaucugucuucaaauucguugauucuucugccaucucuaaucuucuguuaagcccauccagugaacuuuuuauuacugauaucauacuguuuaguucuagaauuuuuauucgguucauuguaauaguuuuuguuucucugcagagguucuccaucuagucaccuauuaggacauauuuuccucugagucuuugaacuucauuuuaauuccucuuuuaaaguccuuaucugccaauuucaauaucgagucaucuuggggucuguuucuauugacuguguuuuccacuaugugacauguuuuucuguuuuuuuuuuuuuuuuuuaaucuccaauaaguuuuuuucuuguaguacauuguggauaaugccuuguaaagaaucuuaauuaugcucuuuuucuugaauaauguuguuuuuauucucaaaagcaguuauuguccaaacaccuugacuuuauagaaauuuguucuuaugcucuuuuacggcauuuuucuauuuuguccuugauucuaggaugaaccccucaguuuugggacuuaguuuuuauuucaagggacuagcccuucuaguuucaauugaaauuccaaacguuuugccaaucucuguaauuugacaagauuugaaccccaaacucugucucuccagccucuauggagggcggcagcugaaaucucugcucagcacuuucagcauucuggcaauucuguccccuugugcuccugugccugagcaguucagaggucagcuguggauuugaaaggcuuugcccugugcagcucucuccuuucuggaauauuuccuuucuauuuguaacucuucuggcagccccaaacuuuguaucugacaccuugauccauuaagacuuuaaguuauccuuaaguucuaaccaccucauggcucauacugacagaggaguaucuucagaagaaaagccauauaaacauguauguguccucuuuguuuuuguuuuuuuguuuugagacagagucuuguucuguugcccaagguggaguauaguggcaugaucuuggcucacugcaaucucugccucccaggcucaagugauucucuugccucggccuccugaguagcuaggauuacaggcaugcaccaccaugccuggcuaauuuuuuuuuuguauuuuuaguagaaacuggguuucaccauguugcccaggcugaucucgaacuccuguccucaagugaucugcccaccuuggucucccaaagugccaggaccacagcuaugagccaccaugccuggcccauauauccucuuuguuuuuuaacccccaagauucugauccccuucacuuucuaucugcuuuuggccaccauccuaugccuucaaauauuuauuuuccauauuuuguuuagaauuuauugcuguuaucuguaggaggguuagucugauaagagcuacucugccauuacugaaaccaauacuuucugccaacaauuguuauauauuuaauuuagggcacagaaauuggcucuuaagacucaagguaauagauuaugugacucucagugaauuuuguuuccaaguagaaggcagagagagccucuaguagcaaagauguaauuuauucuuucugugcuauaauaucaguuaccucuauucuaaguuugucucugucuuauagaauguuguugaaaacuucuagaaggaacugacauauaccaaaauccuaauauauauauauaauauauauauaaaguauuauaucauucaguuccuagauuugccuccaugacauuacaagaaucaccaacuuuuuuucuuuuuuuguucaaguuuuguuuuaagcucagggcuacaugugcaggauaugcagguuuguuacguaggugagcauguguuauggugguuugcugcaccuagauauuaagcccagcauccaucagcuauucuuccggaugcucucccucuucccacccgccacugcccccuacaggcccccguguguguugcuccccucccugugucccugucuucucaucauucagcucccacuuacaagugagaacaugcgguacaagaaucgccaacuuucuagcucaaaauaguugagucuucuuugcccagcauucuaccuccuucaggcagagaguuccacauuuuagggucuguuuccuccagccaccauuuuagguaccaaauucuagauaauuuaggauauauuuagcuguaaguaaacaaauugagugccuuaagcaaauagaauuuuuuugccauuguuuuauaugagaaaucugggguagaaagccacuaccuuggauucaacugauuuaugacauuauuuaggccucuuuccauccuucuccaccuuauucuucuuuagaaaggagaauugacagggcugggugauuaucacugaaggugaaagagguagauauuucugaaguccaugaccaccagcucaacagguagaugauuaaucaccaugucagggaauacagaaagaaagaaagauguggacaauuuggagguucccuugagauuucccaagugaaggcagggaauccuccuuaugucauccucuuauuuauugaguuaguuaguuuacguuucuccucauggucaaaaaauggcuguugaagcuccugccauggugaccugacucuguagaagggacauggagggacccagcucugucugcccuuuucaucagaaaagcacaagauaucccagaagcucccugccagcuucuguuuaacuugguuagguuucauugaccaagauugaguuccguggucaucccuucaaacaaaggaggcugggaagugaguauuugacuucuccuagcuuucuauccgguauggaaggaagauuuugggaaugguugcagggcuagcuuggggacagugcugcagcagccauggugcugguaaccuuucuccaugcaggggcuugccaucagcggcgugccccucccaguccucagaauaucaggcuggagggagcugagauucuaagauaagcugagauaauaaguagcuccuuacuauagcagagcuuugaauucaugaacccacuguuauuuaucaggguugcaauggauccacaaauauccauguugugcaaauacuaaguguuagaggcuuacuuuaguguugcauaaaaauaaaguguucuggcugggcaugguagcucaugccuguaaucccagcacuuugaggggucgaggugggcagaucacuugaggucaagaguuugagaccagccuggccaacauggugaaaccccaucucuacuaaaacuacaaaaguuagcugggcaugguggcgcaugccuguaaucccagcuacucggguggcugaggcaggggcaucgcuugaaccugggagcuggagguugcaguggcacuagauugcacuacugcacuccagccuggguggcagaacgagacucuguuuaaaaaaaaaaaaaaaacuaaaaagaaaauaaauaguguucuuuaaugcugaugauuaugacggaugucucuuccuuccuguggccaucaugagaacucaucagggagucauauuuuauggcaaucuaaucucucccuagcaucucaguagaauaaccauguuauucucuguguuacuacguaacuuagugugcagacccacaggauaggggaauaccagauggacuuguuuggguugguugcccagacaagcccuugccuuucugucuguucucaccugccuucacuuuggaagucgcaagggaaccuccaaguuguccacaucugcucuucuuuuuguguucccugacacagugauuaauggucugucuguugggcugcuggucacagacuucagagauaucuguuucuuucaccuucaguggaaaucacucagcucugucaauucuucuuucuaaauauuuuuugcaccuacccacuuuuuauuuuauuauuauuuuuuaaaugaagucucacucugccacccaggcuggagugcaguggcgugaucuugguucacugcaaccuuugccucccagguucaagccauccuccugccucagccucccuaguaacugggaucacaggcgcccaccaccaugcguagcuaauuuuuguauuuuuaguggaggugggguuucaccauguuggccaggcgggucucaaacuccugaccucaggugauccaccugccuuggccucccaaagugcugggauuacaggcauaagccacuaugccuggcuguguuauuuuauuuuagagacagggucucgcucuguugcccaggcuggaguacaguggcguggucauaguucucugcagccucagccuucuggguucaagugauccucccugccucagccucugaaguagcuggauuacaggcacacaccacaugccuggcuaauuuuuaaaaaaugauuuugagauggggucuugcuauauugcccaggcucuaguucuuuaaaucucuaccacaaguguccuagcauugcacagcauaucacugaagccauuauugauugcaauaaacagaauacccaaccaaaagugccuucaucagugagaggcuuuuuguuuguuucuuuaaaaaucucacauaauaacagccaggcucaguggcucaugccuguaaucccagcacuuugagagguugagguggguggaaaucugaggucaggaguuugagaccagccuggccaacauggagaaaccccaucucuacuaaaaauauaaaaauuagccaggcauaguggcuuaugccuguaaucccagcuacucaggaggcugaggcaggagaauugcuugaaccugggaggcagagguugcagugagucgagaccacuguacucggaucugggcgacagagcgagacuccaucucaaaaacaaacaaacaaacaaauaaauaaauaaaucucacauaauaagagguaagagauagggcagcuacagggcugauuuagugagucaaaaauggcaucaagacucggguacuuucaaacuacucgcuccacuacccuuaaugccucaguccucagcaucacaagaugccagcaacaguucucagcacgacuugcagauacacaucaagcaaagaagagggaugugucuugcugugucaugucacucuuuacggggaaggaaagccuacccaugagggcccucuguagccuuacucucaggucucaguggccaugauugggucacuucuccacacuguagcuaaacaaggcugugaaagugaguuucuggcauuuucagcuguuggugugggaagcagguucugcuggccaggacgaagguuggauuggagagguggaguggggaaggaauauuuugggggaggcauucaauaugaucugccucaugcaaacucaucuccugccuggacuacggccagggccuccuacucuuucucuuuguuucuggucuugcuuccuuucaauccauucuccccacauugcugcugccagggggauguuuccaaaguguuuaauuauuguauuaauuuaugugcuuaguuauuuauugucagcaucucucaugauaauguaaacuacaugacggaagagaccuugucuguuuuguuccugcuuuuauccccuagagcagagccucucacaucaaagguacuuacuaaauaugucuuggcuggcugaaugagugaaauauaaaucugauucugugaaucuucucuuaaaaccuucaaaugggcugggcgcaguggcucacaccuguaaucacagcacuuugggaggccgagauggguggaucagcugaggucaggaguucaagaccagccuggccaacauugugaaacccugucucuauuaaacauaaaaaauauuagccaggcaugguggcgggugccuguaaucccagcuacucuggaggcugaggcaagagaaucgcuugaaugggggaggcacagguugcagugagccgagauugugccacugcacuccugccugggcaacaagagcaaaacucuuucaaaaacaaacaaacaaacaaacaaacuaacugacuaacuuucaaaugguuuuccuuugccccugaggugaauucauaucuucuggaaauuggaaaggucugucccuccauuuccacuucuccuuccuccucuccuccaguuuucuggaacuuucuucaguuuuucaaaaauacccuguuuuuuuuuuccccugucuuccuaaaagucuuuuuguuucucacuuuacaugauuaaauccuucucuggaagcacauuucaguggaaaugucaccuucucugggaaacuuuccggaccuuucucucacuaggcauuguuggaagccccugaguccucccguagcacagguuggucucaaacuccuggguucaagugcuccuccugucuuggccucuuaaagugcugggauuacaggugugagccacugcacccagccagcguauuuuaagguacuugucuaucuuccuagaucaggaauuuuugaggacauggaccaugucuuauucaucuuugcauaucguuguugugugcaguacuuggcaugcaacgcauucaacaaauauuugccaaauggguaagugaaugaaugaaugaaugagcucugaccaguaguucccaugucaucgaucaagaucucccacuaggacagaugggcucaaccgauugguuuguacauucugcugguauuuguuaauaaauuaguacauuguuuuauacuuccaucaauuugacuggcguuuaugucauuucaugagcaucugucucaaccauggcaaucacagcucucuguaggcagagguuaugucuugguaguaauccuggcauccucucaacacucagcaucaccacucacagagacuuacaagugcaugaagugcuuugugauuugaagucucugccucugagguuuuugcaggugggguugugauauucagccccaucauccugaagcagcuuuagaaggaacugguggcuucugugucucugucccccagagcacucccaccacgggaggugcaucccucagagugaggagauuaugauacaaacagaacacuuugccccaguagggcgcuuaugucuggaugguggugagcauggcccaauguguugggaugcccagcuugagcugcaccaagcucugccuguaggucgcuacgguggugacauggggacucauggggcccuuccccaagggauggcucugugcuggcuuccaggcacagaggcagugauggagucuugccuccaggccagucagugugagcauuagucaggcuuuguggcuuggguccuaguguugugggcccgacugccuacucuccaucaggugcccacauuugggcagaugcugccggagagugccucuuugcaccauggucugaagauacagggggcucuucacagcauucuguauucagggguccuuucugagcagcugguccuguccuauccaagcaguuuugccuauaauccuucuauugcuugguuuccuuaggaaaacaaucuuccauuauuugguaagcccaugccauuuuuuugcuuaaacauggaaguccauugcuggacccugauggccuuccagguucuccuugguuuguccucuucuagagaaucucauugggugauuuuggaccacuaguugccuauguuagcugaaugauggccccugcaaagauguucauguccuaaccuuggaaccucugaauauguuaccuucuauggcaaaagggacuuugcagaugugauuaagagauucuccuggaguaucugaguggguuuaauguaaccacaaggguccuuauaagagugaggcaggagauuagagagaggaaaaaaugcuauucagcuggcauugaagguggaggagggagccaugguuggugucugggagcuggaagaggcaaggaauggauuauuugcugagcuuccagagggaaccaucccagcuaccaccuugcuuugagccccauaagacucacuuuggaccucugacauccagagcuauaggauaacaaauuugugugguuuuaagccauagaguuaggguaauuuguuacagcagaaaugggaaacuaauauauugccccuugguuggcauuauagcccucccuaguacaaagggucucuggccaauaggaucacucacuuuuggaacuccaaaugaagcucuaugcgucugcucaggcugccauaaccaagugucacagaauggguggcuuaaacaacacacauuuucuuuuucuuuuucucucucucuuuuuuuuuuuuuugagacagagucuugcucugucgcccaggcuggagugcaguggcgugaucucggcucauugcaagcuccgccucccagguucaagccauucuccugccucagccucccgaguagcugggacuacaggcaccugccaccacgcccggcuaauuuuuuguauuuuuaguagagauaggauuucaccguguuagccaggaaggucucgaucuccugaccuuguuaaacaacacauauuuucuaacuguucuggaggcuggaagcccaagguguuggcaagauugguuucuggugaagccucucuuucugccuugcagauggucauuucucacugugcccucaaauguccuucccucugggcaugcagggagagaaagugagaucccugguguuucuuccuuuucuuuuuaaaaauuaauuaauuaucauuauuuuuuuagagacaugaucaugcccuguuguccaaacuggagugcaguggugugaucauagcucacugcagccuccgacuccugggcucaagcaauccucccaccucagccuccugaguagcugggacuaaaagcacacaccaccaugcccagcuaauuaaaaaaaaaaauuguagagacaggaucucauuauguugcucucauuauguugaguuggucuccaacuccuaggcucaaguaauccuccuuucucuucagccucccaaagcauugggauuacaggcaugagacacugggccuggcucucuuccucuucuuauuaaggacaccagccuuaucggauuaagccuuacccuaugaccuuaguuaaccccauaaccuccuuaaaagcccugcuggagguuaggacuucaacaucugaguuuuaguagagggagacacagaggcccucugugguuauaucagggcaaaaaggguaaagguuucucaggccauuuacaucucggguguucagugcccuuugcaaauaagaguguuguguagagacauugcugacacauugguauccucaagaugguacccaugugaguuuaccuucugcuuuuauaauccagagcuucagaggcuaauucgggauauuugaggacuuuucaucaagcaucuuuggccagucuuucacugacggcaaaugaauucuucugggccagucgucagacauguagauggcgagcuuugagaguuaaguucaaguucaaguuuggcuuggccaaggcauuuugcaugacgcuggacaagguguccauaaucccguaguaugccccuauuuuuuuuuuuuuaauuuuacuucccuccuuaguuaaaagaagcaguuugucuggcccuaggucauuauuuuaucuuucuaggaguugaagccauuucuauuuucccaaucccagccuucugugaucuagccugaggcuuuccugguaaaagggaugcuuccaacaccauugcagggacaucucaucaugagauccagucuuggagaccucccuccuaguguccaauucacagagaaguuacucugggccaguguccacuccacugccccgaaaugcgaauuguuagugguucaggcugccuuggaaaaaugaaagucucaugucaagagcacugggcacauuuaaaaaucauucuaaccaccaaagcccagguuagccaggaccagcucccaggcugauacuaggcagagugcuucaaagcauccuucaagugcccaguggcagaaacuacccaguggauguccugcgaugaaaggccagggcaccauacagaccuccccuuacucagagagggccuuuuucuaacaacuuucuuuuucuuuuuucuuuuuauuuuuuuagagacagguucucacucuguuggccagacuagggugcagugacgaaucauggcucacugcagccuugaacuccggcucaagugauccuucugcuucagccucccgaguagcugggacuguaggcacauaccaccauccuuggcuauuuuuuuuuuuuuuaauuuuguagagacaaggucucguuauauuacccaggcuggacuugaacuccuugccucaagcaguccucccaccucgaccucccaaagugcugggauuacaggagugagccaaugcaccuggcugacaacuuuccagaaauccaguacuggcagcagguagacaauuucugaccaagauccugccaccacgucugcccuagagguuccccaagggcagagagaggcaggaucucuccuacuggaacagugggcauauuuuuugguggagcagcccacgcguaggugugaucuugcuguaauaauguccccuggcagguaagauugcugcagccaagggguguuagaggaagauccuuaaauacucuucuuggaacagaauuugggucucuaagcaagaagugccagucuuaacauucacuguuugugacugauuuauaggaaaaguggcuugauucugguagccgggggagcccagugugaacacugagguucuagccuguucuagugguugcuuugauugauacucagccaugaaagggacauagcucagauacugacaaaacagcuuuguauuugaguguguuuguccaacuggcaaggaacagucuggggacaaacagugccuuauuuggaguuguuuauucuucucccccauggagugaccucagauaaccuuucccagcuuggaaagaccugaaucagauuuuguacagccuagaggaacaagucuguagccuggggaaugcuuccugucacguuuagaaccuaagaaaaacuaggaaaaacucuaauccucucuggugccucucucucggcugguagcugggaauugaagucugaggaccugaauuuuccuggagggcaaugugcaccagcuuuggccgggaaacaucucaaguuucugcuucuaggaccauaaccauggauuccucaguguuguuccuauugcugggcuuguggacugcugagaccugugguuccuggcagguagauagguuguaucaaacuggucacuagucaucagaugcuaauggacugaagaagcccuagaaagaucucuuucauguguugcucucucgcaccaugcaaacuccagcuaugugaagaucguagcucucuagggcucucacaggaaaucagacaccaacagaaaugggugcagaugugagagggaaggccuugaagccacagucaucuuggcauaaacagaacauccuguuuuguuuuguuuucacagagaacccuggucuccccauaggggaggcagagaccuaugaaaucucuucauagcuuuggguuuggaaagaauguauagaccagggauggcggcucacaccuguaaucccagcacuuugggaggccaaggcaggcgucucacuugaggucaggcauucaagaccagccuggccaacauggugaaaccccaucucuacuaaaauacaaaacuuagcugggcaguagugggugccuguaauccaagcuaccugggaggcugaggcaggagaaucacuugaacucaggagauggagguuacagugagccgaaaucacgccacugcacuccagccugggcgacagagcgagauucugucuugaaaaaaaaaaaaaaagaaaagaauaaaaauaaaaauaaaaaauaaaaauagccagguguggugauaugcaccuguagucccagcuacucgggaggcugagaucaaaggaucucuugagcucaggaguucaaggcugcagugagcuaugacugugcuacugaacuccagccuacaccauggagugagacccugucucuaacaacaacaacaacaacaaaaacgauaucugcugggcaggcacauggguggaagguagcugguuagucuugcaggcacauucagaacguucccuggcugagagcaggaugugggagaagguagcgcauuggaaagggucccccaagugggaggcagcacugaugauagacuccugaaugugacgugugggucuauuacgggguugaauuguguccucccaaaaaauaauauguuggcgccccaacccucaaguacaucagaauguggccucauuuagagauaggaucuuuacugagauaaucgagguaaaaugagacuauuaggauggcucuagucuaauacuaguguccuuauaaaaggggaaauugggacagagacacacacaggaagaacauuagaagauugcgugaagaugaaggcagagaucuacaagccaaggaacgcuaaagauugccagcagacuccaagaagcgagcagagggaggcauggaacagauucuugcccaaggcccuuggagggcaccaacccuacauauaaccuugauggcaaauucuagcccccagaacagugagacaauagacuucuguuguugaagccaccuggccugugguccuuuguuauggcagcccuaacaaauggauacaggaucgucuuacaggcaaugaugagcuugugagaaucuaaccagggagauagcaaggacgggaaggcagugugagggccaagggugauaauauggccagcugguagauagugccuaaggcuuuugucauugugaacagccucaugaugcaggcucaugacaacagugucaucgucaccaucaucaucaucaucaucaucaucaucaucauaucaucacagcaaauaguuauugagcaucuacucuaugcuggacaaguauacuuugcauguuuuacauuacugaguccuuaaacuuacacgauugauguuaguaacauucccauuuuacaaaugaaaaaacugagacacacagaaggaagaaacuugcccaagaguauauauggcugguagguggagaggcccaauguagccuuucucagccccucucacguucucucugcucugccaauaucaagcucacccucucaagaucuuugcauugguuguucccugccuaggcagcucugccacuccauuccacauggcuggcucccuuuucuauaugagucucagcccugauguuuaucucaagggagagccucuuacccucccggucaucucagcacacugccugcuuuaucaguguuuuuuuuaauagcacuugcugccaucugaaacauucuucuuguuuacuugugaguaaacccccuagaacauaaguuuugggagaacagggaccuugccuggcuucuucaauccucuaucccaggcacuggauccauuccuaaaacauacaaaguauuuuauaacucaguuuccuuuuuauuuauugauucaaauaauuuaggcccccucaagcaaauuggaacuugggcuccaucuugcauaugcaaaagauucgugaagaucuucugcucaacagaaggcagcuacugucuguccugguaacuucuaucuguuuuuuuuuuuuuuuuugagauggaguuuuacucuuguugccuaggcuggaguguaguguggcacgaucucggcucauugcaaccucuugccuccuggguucaacugauucuccugcccucagccuccugaguagcuuggauuauaggcaucugccaccaugccuggcuaauuuuuuuuuuucuguauuuuuaguagagacaagaauuucaccauguuggccaggcuggucucgaauuccugaccucaggugaucugcccgccuccaugucucaaagugcugggauuacaggcaugagccacggugccuggccuguccugguaacuccuauagcagugccuguuagugaccagguccuuucugcccaugugcaagaagccaaucacugugguaaugaguuuuugcaaaagagaaaagauuucacaaugcagugcugugugaggagauaggagaacaaaucucaaaucugccucccugaaaauagggaaugggaguauuaugggauagaaggcagcauggucuaaaguguggggaacggugaggggagggugggaaaggugagcuaaucaggguuucuguguguguuaaucuguuuuuguguugcuauaaagaaauaucugaggcuggguaauuuauagagaauagagggguuuuuuaauuuuaauuuuauuuauuuuggagacacagucucacucugucacccagccuggagugcaguggcgugaucucagcucacugcauccuccaccucuggguucaaaugauacuccugccucagcuucucuaguaggugggauuauaggcgacugccaccacgcccagcuaauuuuuguauuuuuaguagagacgggguuuuaccacguuggccaggcugguuugguauuccugaccucucaagugauccacccgccucggucucccaaagugcugggauuacagaugcgagccgcugugccuggccaagaauagagguuuauuuggcucaugguucugcaggcuguacaggaagcauagugucagcaucugcuucuggagaggacucagggagcuuauacuuauggcagaaggugaagggaaaccagcauaacacagagcgagagagggaacaagagaaagagcaggagaugcuaggcucauuuuaauuauuauuuccuuccuuccucccucccucccucccucccuuccuucuuuccuuccuuccuuccuucuuuuuuuucuuucuuucuuucuuuuuuuuguuuuugguggugucuuacucugucacccagccuggagugcagugguaugaucuuggcucacugcaaccuccaucucaggguuccaaugauucuccugccucagccuccugaguaacugggauuacaggugccugucaccauugcuggcuaauuuuuguauuuuuaauagagaugggguuuugccauguuggccuggcuagucucgaacaccugaccucaggugauccgccugccucagccucccaaagugcugggauuacaggcgugagccaccaugcccagccucuuuuuucuuuucuuugagacagguccucacauugucacccaggcugcaagguggagugcaguggcacaaugauggcucacuguagacccaaacuccugggcucaagcaaucuuccugccucaaccuugcaaguaguagcugggacuacaggcaccagagcuggcuauuuuuuuuucuuuuuuucuuuuuucuuuuuuuucuuuuuuuuacuuuuuuguagagauggggucuugcuauguugccuaggcuggccucgaauuccugggcucaagugauccucccaccucggccucccaaagugcugggauuacaagugagccacugcaccuggcccagacuuuuuuuuuuuuuuuuuuaaacaaccacauuugaugugaacucauuacugugggaugggcaccaauccauucacgauccaaacaucaucuaccaagccccaucucuaacacuguggaucauauuucuuuuuuuuuuuucuguuuguuuguuugguugguugguugguuguuuuuuuuuuuuauuuuuuuuuauuauacuuuaaguucuaggguacgugugcacaacaugcagguuuguuacauauguauacaugugccauguuggugugcugcaccuauuaacucgucauuuacauuaguauaucuccuaaugcuaucccuccccccuccccccacaacaggcccuggugugugaugucccccuuccuguguccaaguguugucaauguucaauucccaccugugagugagaacaugcgauguuugguuuuuuguccuugcgauaguuuacugagaaugaugguuuccagcuucauccaugucccuacaaaggacaugaacucauuauuuuuuauggcugcauaguauuccaugguguauaugugccacauuuucuuaauccagucuaucauuguuggacauuuggguugguuccaggucuuugcuauugugaauagugccacaauaaacauaugugugcaugugucuuuauaguagcaugauuuauaauccuuuggguauauacccaguaaugggauagcugggucaaaugguauuucuaguuguagaucccugaggaaucgcaacacugucuuccacaaugguugaaccaguuuacagucccaccaacaguguaacaguccucuccaacaccuguuguuuccugacuuuuuaaugaucaccauucuaacuggugugagaugguaucucauugugguuuugauuugcauuucucugauggccagugaugaugagcauuuuuuucaugugucuguuggcugcauaaaugucuucuuuugagaagugucuguucauauccuuugcccacuuguugaugggguuguguuuuucuuguaaauuuguuugaguucuuuguagauucuggauauuagcccuuugucagaugaguagauugcaaaaauuuucucccgugcuguagguugccuguucacucugaugguaguuucuuuugcugugcagaagcucuugaguuuaauuagaucccauuugucaauuuugucuuuuguugccauugcuuuugguguuuuagacaugaaguccuugccuaugccuauguccugaaugguauugccuagguuuucuucuaggguuuuuaugguuuuaggucuaacauguaagucuuuaauccaucuucaauuaauuuuuguauaagguguaaggaagggauccaguuucagcuuucuacauauggcuagccaguuuucccagcaccauuuguuaaauagggaauccuuuccccguuucuuguuuuugucagguuugucaaagaucagauaguuguagauguguggauuauuucugagggcucuguucuguuccauuggucuauagcuuuguuuugguaccaguaccaugcuguuuugguuacuguagccuuguaguauaguuugaagucagguagugugaugccuccaucuuuguucuuuugaguuaggauugacuuggcaaugugggcucuuuuuugguuccauaugaacuuuaaaguaguuuuuuuccaauucugugaagaaagucauuaguagcuugauggggauggcauugaaucuauaaauuaccuuaggcuguauggccauuuucacgauauugauucuuccuauccaugagcauggaauguucuuccauuuauuuguauccucuuuuauuucguugaguagugguuuguaguucuccuugaagaggucuucacaucccuuguaaguuggauuccuagguauuuuauucucuuugaagcaauugugaaugggaguucacucaugauuuggcucucugucuguuauugguguauaagcaugcuugugauuuuugcacauugauuuuuuauccugggacuuugcugcaguugcuuaucagcuuaaggagauuuugggcugagacaaugggguuuucuagauauacaaucaugucaucugcaaagagggacaauuugacuuccucuuuuccuaauugaauacccuuuauuucuuucuccugccugauugcccuggccagaacuuccaacgcuauguugaauaggaguggugagagagggcaucccugucuugugccaguuuucaaagggaaugcuuccaguuuuugcccauucaguaugauacuggcuguggguuugucauagauagcucuuauuauuuugagauacgucccaucaauaccuaauuuauugagaguuuuuagcacgaagggcuguugaauuuugucaaaggccuuuucugcaucuauugagauaaucaugugguuuuuguccuugauucuguuuauaugcuggauuacauuuauugauuugcauauguugaaccagccuugcaucccagggaugaagcccacuugaucaugguggauaagcuuuuugaugugcugcuggauucgguuugccaguauuuuauugaggauuuuugcaucgauguucauccgggauauuggucuaaaauucucuuuuuuuguugugucucugccaggcuuugguaucaggaugaugcuggcuucauaaaaugaguuagggaggauucccucuuuuucuauugauuggaauaguuucagaaggaaugguaccagcuccuccuuguaccucugguagaauucggcugugaaucugucugguccuggacuuuuuuugguugguaggcuauuaauuauugccucaacuucagagccuguuauuggucuauucagagauucaacuucuuccugguuuagucuugggagaguguaugugucaaggaauuuaucgauuucuucuagauuuucuaguuuauuuguguagagguguuuauaguauucucugaugguaguuuguauuucugugggaucgguggugauauccccuuuaucuuuuuuuauugugucuauuugauucuucucucuuugcuucuuuauuagucuugcuagcaaucuaucaauuuuguugaucuuuucaaaaaaccagcuccuggauucauugauuuuuugaaggguuuucuugucucugucuccuucaguucugcucugaucuuaguuauuucuugccuucugcuagcuuuugaauguguuugcucuugcuucucuaguucuuuuaauugugauguuagggugucauuuuuagaacuucccugcuuucucuugugggcauuuagugcuauaaauuucccucuacacacugcuuuaaaugugucccagagauucugguauguugugucuuuguucucguugguuucaaagaacaucuuuauuucugccuucauuccguuaugaacccaguagucauucaggagcagguuguuguuuccguguaguugagcgguuuugagugaguuucuuaauccuaaguucuaauuugauugcacuguggucugagagacaguuuguuauaauuucuguucuuuuacauuugcugaggagugcuuuacuuccaacuauguggucaauuuuggaguaagugcaguguggugcugagaagaauguauagucuguugauuuuggguggagaguucuguagauaucuauuaggucuguuuggugcagagcugaguucaauuccuggauauccuuguuaacuuucugucuuguugaucugucugauguugacaguggaguguuaaauucucccauuauuauuaugugggagucuaaucucuuuguaggucucuaaggacuugcuuuaugaaucugggugcuccuguauugggugcauauauauuuaagauaguuagcucuucuuguugaauugaucccuuuaccauuauguaauggccuucuuugucucuuuuaaucuuuguugguuuaaagucuuuuaucagagacuaggauugcaaccccugccuuuuuuuguuuuccauuugcuugguagaucuuccuccaucccuuuauuuugagccuaugugugucucugcacaugagauggguuuccugaauacagcacacugaugggucuugacucuuuauccaauuugccagucugugucuuuuaauuggagcauuuaguccauuuacauuuaaaguuaauauuguuaugugugaaucugauccugucauuaugauguuagcugguuauuuugcucguuaguugaugcaguuucuuccuagccucgauggucuuuacaguuuggcauguuuuugcaguggcuaguaccaguuguuccuuuccauguuuagugcuucauucaggagcucuuguagggcaggccugguggugauaaaaucucucagcauuugcuugucuguaaaguauuuuauuucuccuucacuuaugaagcuuaguuuggcuggauaugaaauucuggguugaaaauucuuuucuuuaagaauguugaauauugguccccacucucuucuggcuuguagaguuucugccgagagaucagcuguuagucugaugggcuucccuuuguggguaacccgaccuuucucucuggcugcccuuaacauuuuuuucuucauuucaacuuuggugaaucugacaauuaugugucuuggaguugcucuucucgaggaguaucuuuguagcguucucuguauuuccugaauuugaauguuggccugccuugcuagauuggggaaguucuccuggauaauauccugcagaguguuuuccaacuugguuccauucuccccgucacuuucagguacaccaaucagucguagauuuggucuuuucacauagucccauauuuuuuggaggcuuuguucauuucuuuuuauucuuuuuucucuaaaguucucuucuagcuucauuucauucauuugaucuuccuucacugauacccuuucuucccguugaucgaaucggcuacugaagcuugugcauucuucacguaguucucgugccaugguuuucagcuccaucagguccuuuaaggacuucucugcauugguuauucuaguaagccauucgucucaucuuuuuucaagguuuuuaacuucuuugcguuggguucaaacuuccuccuuuagcucggagaaguuugaucgucuguagccuucuucucucaacucgucaaagucauucucuguccagcuuuguucuguugcuggugaggagcugcauuccuuuggaggaggagaggcacuuugauuuuuagaauuuucaguuuuucugcucuguuuuuuccccaucuuugugguuuuaucuaccuuuggucuuugaugauggugacguacagauaggguuuugguguggauguccuuucuguuuguuaguuuuccuucugagagucaggacccucagcugcaggucaguuggaguuugcuggagguccacuccagaccuuguuugccuggguaucaguagcggaggcugcagaacagcgaauauuggugaacagcaaauguugcugccugaucguuccucuggaaguuucaucucagagggguacccagccgugugaggugucagucugccccuacuggggggugcuucccaguuaggcuacucgggggucaaggacccacuugaggaggcagucuguucauucucagaucucaagcuccgugcugggagaaccacuacucucuuccaagaugucagacuggaacauuuaagucugcagaaguuucugcugcguuuuguucggcuaugcccugcccccagagguggagucuccagaggcaggcaggcaggccuccuugagcugcagugggauccacccaguucgagcuuccuggccacuuuuuuuaccuacucaagccucagcaauggcaggugccccucccccagcucgcugccgcguuguaguucgaucucagacugcugugcuagcaaugagugaggcuccauggguguaggauccucugagccaggcacggaauauaaucuccuggugugccguuugcuaagaccgucagaaaagcacaguauuagggugggagugacccgauuuuccaggugccauuugucccuucuucccuuggcuaggaaggggaauucccugaccccuugugcuucccaggucaggcgaugccucacccugcuucggcucaugcuuggugcacugcacccacuguccugcacccacugucugacaauccccagugagaugaacccgguaccucaguuggaaaugcagaaaucaccugucuucugcgucgcucacgcugggagcuguagacuggagcuguuccuauucggccaucuuggaaccaccccugcagaucauauuucaaccugaaauguggaggggacaagcauccaaaacagaucacugugcagguguaaucaagccucauguuuugacauagggcccaucuguagaaaguggugauguuggcccggcacagugacucacaccuguaaucccagcacuuugggaggccaagaugggaggaucaccugaggucaggaguuggagaccagccugaccaacauggugaaacccugucucuacuaaaaauacaaaaauuagccaggcauggugaugcaugccuguaauccuagcuccucaggaggcugaagcaggagaaucgcuugaacccaggagacggagguugcagugaucugagaucacaccauugcauuccuaccugauugacaagauggaaacuccgucuugaaaaaaaaaauggugauguuagcaucaucugaggguggaguuuugagcccucggacacaaaagguuguuuugggacacgugcauaggccuagccgaagggucgguggucucaaagugccaucacacccagguaauuuuuguauuuuuaguacagacuggguuucaccauguugccagggcuggucucgaacucuugaccucaggugauccacuugcuucagccucccaaagugcuaggauugcaggugugagccacugcaccuggccuuuuuuucuuuuucuuuucuuuuuuuaagacaggaucaugcccugucacuuaggcuggaguacaguggugcaaucauggcucacugcaaccuccugggcucaagugaugcucccaccucagccucccaaauuucuggaauuacagguaugagcuaccgcauccagugagauuaauuuuucuauuggauaauuguugcuacuuuucucaggacgcagagaggcuggagccagugaccuuggccuuggguugagggacagcacagcaccaguucaugcuuagcccauggaguugcuauagcuugagucugccaugguccacacuaggaggcuaguaucuucuaccuuuuguuuuagagacauucacaauggggcugucuuccuccucccagguggggaaccagcugccacaggacugcagagcaaggccccagcgcccugggcuggacaggcaggcagcccugauguacuugccagcuuucccccaggacugugcaugagagaggcagugacacauucucuccuguccuggaaguugaugagcuccgauaggagguugucuugaacacucauuugguuccagggcccugccaaggccaccccaguaucuggguacaggaccagcucacaccacucaagagccaaccaggguugccucuguucauucauuuauccuaccauucaacagacauaggccacauaggcccagacuggccacacccugccugccaagguugggguguaaucccugagggggcuucugcccuugucuuccuuugauaggagggagagggaaauacuuucagcaagauuuccucugagugggucucacuguagagcugcgugugcuaaaauugucugggcagguccacaggagcagcagaaggaggugggacucugguucuggcugcuugcuuccuucauucgcuucuuccauccucccucccucccucccucccucccucccucccucccucccuuccuuccuucucccuuucucuguuccucucuuucuucucucucucucucucucucucucucucuuauuuugagacaaggucucacucugucacccaggcuggagugaaguugugcaaucaugacucacugcagccuugaacuccugggcucaagugauccucuugccucagucucccuaguagcugggacuguaaguguucagcaccacucccagcuaauuuuuaaauuuauugcagagacaggguguuacuuuguugcccaggcugguuucaaacuccuggccugaagcaauccucccaccucagucucccgaauugcugagauuacaggacacuucugagcaugcuuuccuaaccucccccaacaguggugaaauauuccaacgagauuacagaggagaggggccucuucucccucuuccuaaagagggcuuaguaggagaccugacucaguaaaucugaaagaauaaauagguguuugucauuugcaaagagagauaagggaaguagcaacauaguauauaguccugaaagugaaggccugcuccaaauacagccaucagcucuguaggguggguuaaggaggggcagagcacugagguuccuagaggguggaggugaccgaggagcuuagaagaggauggacauggcugaggagcuuagaagaggguggacauggccgaggugcuuagaagaaggugggcauggaugagaggcuuagaagaggguagacuugacugaggugcuuagaaagggguguggccgauguggguagaggagggugggcauggcugaggggguggacauggccaaggugcuuagaagagggugggcauggcugagguggguagaagagggguggguguggcugaaguugguagaagagggugggcguggcugagguggguagaagagggugggcguggcugaggugcuuagaagagggugggcguggcugagaugaguagaagacccagggugggcaugguggaggugggcagaagagguugggcguggcugagguggguagaagaggguggguguggccgaggugcuuagaagaugguaggcauggggcugaggugcuuagaagaagguguacauggcccaguucuggaagcgccugggacaucaaagaggggauggaugugaccuugccggaugcccaugggcucuggccugguguggaauagcaaccugcuuguugaauauaugagugaaugggagccagugagaaauuugaagcugaagcaaagcgugauuagacgugaugucuuugacacaccacucuggaugcuggagguaccaucaacaagaagggaaggagucaaggaugaauuuuugagauugaacgcuagaugauggcauugcaagcuuucgaaugcguucggguagaaggagcagaaugaccaaauauuuuguuuuucauugaaugugugggcaguccuggcccauuacuccagagguaaaauguguuccagcauguuuuuccauugagauaacuuccuuuuccauuauggugacaguucugaaagaaaggguaagggcggggauuguggggggacccaggggagagaggccgaccaaugguucuuucaugugcuguuuuaucaggcauauugucgugaaaccaauuuucauguugaaauggcuuuucuucccguaaacaaauugcuuuuuauguuguugaaugggauggcaggcagccucuuugaagauuagcuaacucaguucucagccggugcuaaaauacgcaccuucagagcccagcuaagggcaguccccgucuccuuugcuccucacagcugaauugguuaauacaaguaggagaaaagaguuucccgaggaaucagguguaagaacagaagcuuugaauuuugugaaacaagauuucuacucugaggcuucagauggcgucgggaaaaugcuccccagcauggagagaacacuuguauucgagccuccaguuuacucauuguugguuucauuuuguagaauaacauuuuguucuucuuaaaagagccagacaccuggagacguuuaaaaaaaaaaauccaaaauaaaaauacaugaucaucuagaauuagcaucauuugaugauaauuccaucuuuacaugucauauauuuccuuuaugucuuuuucccuuaggcacauguuuugacagguuaagccauauuacacauauaguuuuauauacugauuucuuaagaaaacauauuugcucaugucauuuacuaaaugugguuuuugaauguguguaauauuucaccacauggauauaauuaaguugccaucccauagucuauuuucauuuuacuauuuuacuuuaaauaauuucaaaaauagcagaaaguugcaugaacaguacaaagaaauccuauaugucuuucacccagauuuccugauuguagacauuggagcacauuuccguaucauucucucucucucucaaauagauaugcuauauuuauaucauuuauacuaaaauuuguucuuuuucuaaacuuuuuuacaguaagcagcaggcgugauguccuccacuguugaauaugcuagaguauauuuuucacaaagacgcuacagcauaagcauacuauaaccaucagaauaagaaaacuuaacaucauauaccaccaccuaauccacagacucuauucaaauuuccccaguuauccaaauaauuucuuuuacagcuaaaucauucaauccaggaucauacuggcauaccacauuuuauacuucacuuuauugcaccuugcagauacuguguuuuuuuguuuuguuuuguuuguuuguuuuuuacaaauuaaagguuuguggcaacccugugguugggcaagucugucaguaucauuuuucuaagagcaugugcucacuucgugccucugggucacauuuuggugauuccaacaaauauuucaaucuuuuucauuauuugcuuucauuauuauaucuguuaggaugaucugugugacagagcaggagcaucgccaucuugaacaaaacaccaccguuguaaguucucuuuaaaaaccaccuaaauccagccccaaaacaucagccuaauggcuaaugucagcauaacuagaaacaucccaacccuaagauaaaccccucucugaccagaaacauaccaacccugagauaggcuccccuccgaccagagacacuccaacccugcaauaaacuuuccuucacauagaaacauuccaaaccuaugacaagccccccuuuccaaaacccuuaaauauacuuaguguguaagagagaagggcucucugaccuaacuuggccagaagccccucucagguuuguuuucucuaaaauaaaccuguccuuaacuguugagccacauuucauguuucuuuccucuuucuuuaauucuuacaucgugaucagugaucuuugauguuacuauugugauuuuuuugaggccacaaacuacaucuauauaaaauggugaacuuaauaaauguuguguguguucugacugcuccaccaaccagcccuucccuaucugucucccucuccuuggggaucccuauucccugagauacaauaacacugaaauuaggccaauuaguaaugcuacaguggccucuaaguguucaagugaaaggaagagucucaugucucucacuuuaaaucaaaaacuggaaaugauuaagcauagugaggaaggcaugacaaaagcugagauaaacugaaagcuagccuccugagccaaagaguuagccaaguugcgaaugcaaaggaaaaguacuugaaggaaauuaaaagugccacucuaguggacacacaaaugauaagaaagcaaagcagccuuauugcugauauggagaaaguuuuagaggucuggauagaaaauuaaaccagccacaacauucccuuaagccaaaaccuaauccagagugagcaaggccccaacucuuuucaauucuaugaaggcugagagaggaaaggaagcugcagaaaaaaaguuugacgcuagcaaagguugguucaugagguuuaagaagucaucuccauaauauaaaaguacaaggugaagcaacaagugcucauguagaagcugcagcagcaaguuaucaagaaguuccaguuaagaaaauugaugaagguggcuacacucaacaacagauuuuucaaugcagaaaaaaccagcccuuuauuuauuuauuuauuuauuuauuuauuuauuuuugagacagagucuuuuucuguugcccaggcuggaaugcaguggugcaaucuuggcucacugcaaccucugcccuccuggauucaagcaauucucccugccucagccucccaaguagcugggauuacaggcaucuaccaccacgcccagcuuauuuuuguaguuuuaguagagaugggguuuuacuauguugaccaggcuggucuugaacuccugacauaaggugauccacccaccucggccucccaaagugcugggauuacaggcaugagccacugcacccagccuaaaacaaccuucuauuggaauaagaugccaucuaggacuuucauagcuggguaggagaagucaaugccuggcuucaaaacuucaaaggauagguugacucuugugaggggccaguccagcuggugacuguaagcugaagccaguguucauuuaccaucccccaaaucuuaaggaccuucagaaugauaguaaaucuauucugccuaugcucuagacaugaaacaacaaagccuggaugacagcacaucuguuuauagcaugguuuauugaauauuuuaagcucacuguugagaaauacugcucagaagaaaagacuccuuucaaaauauuccugcucauugacaaugcaccuggucacccaagagcucuaauggagauguacaaggagaugaauguuguuuucaugccuucuaacacagcauccguucugcagcccauacaucaaggaguuaaaauuuaaacuuucaagucuuaauauuuaagaaacgcauuucauaaggcgauagcugccauacguagugauuccucugauagaucugggcaauguaaauuuaaagccuucuggaaagguuucacuguucucaauaccauuaagaacauuugugauucaugggaggaggccaaaauaucaacauuuaacaggaguuuggaagaaguagauuccagccuucauggaugauguugagggguucaagacuucaguggaggaagucgcugcagaugugguggaaauagcaagagaaggggaguuaaaagcggauccuaaagauggaacugaauuucugcaaucucaugaucaaacuugaauggaugcggaguugcuucuuauggaugagcuaagaaaguaguuucuugaaauagaaucuacuccugguaaagaugcuuuguaaacauuguugaaauggcauugugaacguuguagaauauuccaucagcauauucuuuacauaauaaaacaguggcaaggcuuaaaaggauugacuccaauucugaaauaaguucuacuguggguaaaaugcugucaaacagcauugcaugcuacagauuaauuuuuuuaugaaaugaagaguccaucuaugugcggccaaauucauuguugucuuauuuuaagaaauugccacaggcaccucagacuucagcaaccaccaccuugaucagucagcagccaucagcauuuagacaagaccuucuaccaguaaaagauuaugaacugcugaaugcucagaugauuguucauauauuuuagcaauaaaauauguuuaaauaaaaguacauuuuuaaagauauaaugcuacugcacacuuaauagacaaaaguauaauguaaauuuaacuuuuauaugcacugggaaaccaagaaauuggugugacuugcuuuauuguaguaguccagaaccaaaccugcaauaucuuugaggugugucugaauuuagcauccaucugugaugucucuucuguuuucucccaucugaaaaguuuccuuagguuuuguguuuuguuuagugucucaguccuuuggagcugcuauaacaaaauaccuuggauuacuggguaauuuauaaagaacagaaauuuauuucccacaauucuggaaguugagaagucuaagaucaaggugccagcaggaauggugucuggcaagggcuguucucuccuuccaagauggcgcccuguugcugcauucucuggagggaaggaaugccauguccucauauggcagaagaacagaagagcaaaaagggccuaagcuaggucccuccagccuucucagaaggcacuaauccauucaagagggcagagcccucaucacuuaaccacuuccccaaaggccuuuuaaugccuuuuaaugccaccacaauggggauuaaauuucagcaugaauuuugaagaauuuugaagagaacauacucaaacuguagcauuuagcuuuucacuuucaccacuuggauauuuuuuaagguuacaggccaguuauuuuguaacauauuccucauuuuggauuugucugauguuccuucauaguuauauuaaguuauacagcuuuugcagaaauaucacagaaguaauaaugauguauccuuguccuggaaccuaaucaggugauauguaggggugauuugacccauuacuguucauguugacuuugauuguugaauucagguggaguccgccaggcuuuuccacucuaaaguggcucuuucccccuuuguaauuaguguucagugggaaaauacuuugaaacuauaugaauauccauaaucgucaaacuuuuacccacuagguuuagcguccauuagugauuuuugccugaaucaguuauuacuaaagugguuaccauguguaaccauaugauaaucauacaacaguuuuucuaaguccaccaucuuuucaacauuuuuuggcauuauucuguaaguaagagccuugucuuauucauucauucauaucaguauggacucuuuaauuccuauuuuauucaacagauuauaagcuacugccguuauuguuuauuuuaauauaguaguagccucuucaagcugguucuuaaauccuuuuggcauaaucucauuagucaaagugauggucacaugacucuguauuuccacuugacaauaaauuacgaacauuucucgcgucauuaggagucuauaagcauuauuuuuagucauuguguaguguccaucaaaugaacuuaaugcuugaacucgguggucuccacccuuuuuggcaccggggucuggugucauggaagaccaucuuuuccauggauaguuguggguggaugguuucaggaugaaacuguuccaccucagaucaucaagcauuagauucucauaaagagugcccaaccuagaucccuagcuuguguaguucgcaauaggguacccgcuccuaugagaauccaaugcugcugcugaucugauaggagauggagcucaggcaguaauguucacucgcccgcugcucaccuccugcucugcagcccgguuccuaacaggcuacagaccgaaauugguccguagccuggggguuggggaccccuacuuuaacuuuucugaugggcuacauugucuuggagagagccgucuugcaugcuaauacccucauuugauuagccggggacauacaauauugucagaaauggaguuaacacacuccaguagcauauaagugcagauucagcauauguugauauaauuuuuucugggcccccaccugguagacuggcugugcagcugccggcgagaaacacugccugugcaagaugcaaacauauauuuauugugguggcauucuucauauaauuuuuuuaagcaaccuauaugucaguuaacuggagauggaauguucuauaguaaugaaaaugaacuaacuucaaaugguccccaauggcuugacuuacacauuuuugacuucaugauggugugagagcgacacacacccaguagaaaccauacuucgaguacccauagaacuauucuguuuuucacuuucaguacgguauugcagaaauuacaugagauacucaacacuuuauuauaaaauuggccuuauguuagaugguuuugcccaaugguaggcugauggaaguguccuaagcauguuuaagagaggcuagacuaagggaugauguucaguagguuagguguauuaaaugcauuuuggacuugugauguuuucaacuuauaaugagcuuacugagacauaaccuuauccuaaguugagggggcaucuauagagcgauauugaucaauauguuuuuguguagauugaguuauuuguauauaucaauaaacauauauugcauauacauugagcgacuggaggacuucauuauucacugagaguuuggggauggauuugggaaaugggauugaggguuugaagaggauaaugcagaucuugaacaacaaucaugugggauggggaaagaauugugucuggccacaggaguggaaagacuccuuagaggcacagaacagauucacagagagcuaggagguaauggaguuaggguuuuggaaagagagugguuccaggcaacguaacuaguuggguugagugggaagggacaacgaaggcugacaauccagagaaaugcugaagagucaaagucuuggauuguugaugagcagauggugggaguggcaggguugggcaaauacgaggucaugggaugagacugaaauuuuagaguuaaaaauuuuagagugugaacaauguuaggucagggcaagauccagaauuugcccauguguuggguuucuugaauggaguggagguaaagcuguuagagaaucaguucggguauugaauucacuuagaacaguaaccaaaaucugggaauggagcaagauuuuuguucugauaccugguaaaaguuuaaaagcaugaagagcagcgauaaauaaauuuagcucagcuccccacuggaggaccaugcaaauuauuaggcaccguuucagugcugaaucaucaggggaggucaauucacaaauggagucagccauuuuaucauugacacuaaacagaaucaucaccauagcaucuugaauccaauuaccauucaucuuuaaggaucuuguacauccccgcugaaaaaucaguuuccucccaugaccccuucccaccucccucuucagauuucuucaguuauggauauuauaguacuuaucuccucgugcuguaauggucugcuggcuuuucugccucucucuccacucugccccuucacgagugcuuuaagggcagaaacagaucucacucagcaucauguccuuaccuacgccauccuugaugacccaugggugcuuaguacaccaagaggugugauugucaaaggaagagggcuguggcaauguccuguaacuaggaauuaguggguuacuuucuguuugcugauugagacaagcucuuugauuaagucauuuccugauuuuugccucuucaaaaauaaccuguuuauucaaauuaccuaagaaaaauaugugcuuuguggaauacugggaaaauaaaaaucacccacaaucccauccuucagcaauaaccacuguuaaugauuuaguguguacuuuuacaaucacaaauuuuacuuguguggauagauaaugcauuaaugguacaaauuucaacagguagaaaagcauauacugaaagugucccucauaacaccugucccuccuccuccuuaucaccaucaccugguuucccucugcagaggcaacccaggaauaucuguuucuuauguauuauccagacauacucuacacguuagguuggugcaaaagcaauugcgguuuuguccauacuuuuaauggcaaaaaccacaauuacuuuugcaccaaccuaauauuuacaagcacauuggaaggcagcuacgcuccccacuauaccaccgacccaucuaacaagcacguuggucuagucuuucuucuuuuuuucauaaguaaaugguaaacauuugaugcacacuguuugcaucuggcuucuucauuuaacaauacaucuugcaggucauuccacaucaggauauaaaauccgcuuagcuuacucuuuuaacagcucuuaguccauuuuguguugcuguagcaaaauaccugagacuagguagcuuauaaagaaaacagguuuauauggcucaugauucugguggcuguaaaguucaaaauugggcaucagccucuggugagagccucagguugugucaaaucagggcaagaagcagaaggggagcggaugugugcaaagagaucacauggugagagaggaagccugguggggggugggggaguguuggugccagguucuuuuuaacaaccagcuguugagagaacuaauaaagcaagaacucacucaccccugagggagggcauuaaucuauucaugaaggaucugcccucgugaccgagaccccucccaccaggccccaccuuccaauauugacacacuggggauaaaauuucaacaugagguuuggaggagacaaaucaugaaccauauucaaaccauagcaauacucuuccauuguuuggguguaucauaguuuauuuaacuuuucuauuaauggcuauuugaguugauucugagcuuuuuaauaguugagguuuuauuaugaagauuugagugucaugaaugcuaagggggccaucacuaagcuuuaacuugaaccaagcauuuuuauuuacacuccuagcuaccaacccuccuucuuccuauauuauuugagagcaaaucccagacauuauaucauuucgucuguaauuauuuuagcauauaucuccaaaaauaugaggacuuaagaaaccccacagaaccaauaucacuccuaacagguguaacaauaauuccuuaguaucauuaaauaugaucuuuaaaauucaucuaucugucuaucuauaacgcacacacacaccgcacaauauuacagccacuagccugguucauauauuauucuauguguuuguaugcuugaauaauacauuucuagagguggaaucauugaguuaaaguaugcauuuauaaccaguauaaauugccaaauugcacgucaaagaauuuauaguaacacacacucccaucacuaauguuugagagggccuguuuucacacagucuuauccacacuguguguuaucaaaccauuugaucuuuaucugccuucuaggugaaauauaaguauacaaauguacuuuuaauuugcauuucucugauuaugaguugggcugaacuugguguuauauguuuaaaagccauauguaauucuggccuugggaacugucugcucuuguucuuugaccauuuuuauuuuggcuuguuggccuuuguucuuauugaugcuauauauauaaauuuuuuaaugugagggaaauuagcuccucuuuuguaacauaaauuacaaacauguuuacuuuguuucugauuuuucacuuagcuuauccugauuuuugcccugacaaauguuuuaaguuuuauuuaucuugagacagaguuuugcucuuguugcccaggcugaagugcagcggcccgaucucagcucacugaaaccucugccuccuggguucaagugauucuccugccucagccuccugaguagcugggauuauagaugccugccaccacaccuggcuaauuuuuuguauuuuuaguagagauggggcuucgccauguugggcaggcuggucucgaacuccugaccucaggugauccgcccaccucagccuuucaaagugcugggauuacaggcaugagccacugcaccuggcccguuuuaagauuuauauagaacuuacugucuuuuauuuuauggcuuuugguucguguuuccucccuuauucacucuuaaaauuauuuaaaaauucucauguuuuuguaauaggaauuaugaguuuguuuuaauauacuuaaucuuugauuguuuugggauguauuuugguauaaauuguggagugcaguuucauucuuacuuuuuuccagguaucuacuuaguuguccccacguuauuuuuuggauucaucuuuccccauuauuugaagugucacucguuauauacuaaauuucugcaugcauacagaccaauuucuaaucuuucuacuauuuuucagcuaaauggcuucauauuauuuauuuagcuaaucgccuauugcuuguguuuuccuauuuucauuauuacaaaugaggcuguaauaaauaucuuuuaauauguaucucuucuuuuuuaggaugaauuccuacaauggaauugcuggguccagggugugcacacuuaagaaauauuuuuauuauugauauugucaaacauacccaaagacugaguuucaacaguuuucaacauuuugcugauuguauuucauugaucacuccugcccccaccauuuuuuuucauggaauauugugaagcaaaacccauaugucauaucauuucauuuauaaaauacaucagucucucucucuagcuuaaaucagcauauuucucauaauuaaauuucucuaguuaucucaaaaaugugcauuuaagauuugcucugaauaaacaaggucuguauuuuugaaggcuguuauuaguuacuguucaauuguaccaauuuacacucccacuagcacacggcaaauguugccaucacccuacaccauaccaggcacaucaucaaacaaaccuucuggauuuuucuuccaguugcuggagucagaaaccuuggagcccuccugaugucccuccuuuucuuucaucccaaaccccaguuuucagaacacccugcuggcuguaccuuaaaacccauauauacguugaccacuuuucccuccuccgcugcugucauccuuuggaccucagaagcagccucucucugcucucaggauaguccaguagccagaggcaucuuuuuaauacacaagucagaucccgugacuccucugcucuguaaccugccagagcucccaccucauucacaguaaaaacacaaaaugugcauaaucugccuucccacccauucccucuugggucuucucaccuguuuuucucucccugccugacucacuccaccccaacccagugacucaguauccuugcuguuccuccaacacaucaggcauacaucuaccuagggauuuagcacugacuguuuccucugucuggaacacucuucucuagacagcccauggcuaccacccuuaccucaagucuuugcucagauguccccucaauacccuaaccucuguauuuaaaugguaccauuccauccagcaaucugcuggauggaaugauugcuggauggaaugguaccacuuaaauacacuacuuccucuccuuuggguuuuuacccuuggaggcccaaggaacggguuacgauuuuuuaaaauuuuauuuauauauuuauuucaauaguuauuggggaacaggugguuuucgguuacauggauacauucuuuaguggugauuuaauucuuuaugggugauuucugagaucuuggugcaucugucacccaagcaguguacauuguacccaauauguauuauagucuuucaucccucaaccccucccacccucccagccauaaaagagaaugaaauaauggccuuugcagcaaauuggauggagcuggagaccauuauucuaagugaagcaacucaggaauggaaaaccaaauaucauauguucucacuucuaagugugagcuaagcuaugaggaugcaaaggcauaaacaugauauaauggacuuuggggauucaggagaaagguaggggaaaggggugagggguaaaagacuacaaacuggguacaguguacauugcucaguugacaggugcaccagaaucucagaaaucaccacuuuucuuuugggugucuauccaaaggaaaagaaguaccuacccaaaggaaaagaagucauuguaugagaaagacacaugcgcacacauguuuauagcagccaacaagccuuguggaucuuucuuccaguugcuggagucaggaacuggaagaaauuuuagcagcagaagucaaaauugcaaaauuauggaaccaaccuaaaagcccaucaaccaaugaguggauaaagaaaaugugguauguauacaccauggaauaauagccauaaaauggaaugaaauaauggccuuugaagcaacuuuuauggaguuggagaccauuauucuaagugaagcaacucaggaauggaaaaccaaacauuguauguucucacuuauaagugggagcuaagcuaugaggaugcagaggcauaagaaugauacagugagcugggcgcgguggcucacgccuguaaucccagcacuuugggaggccgaggugggcggaucaugaggucaggaguuugaggccagccuggucaacauggugaaaccucaucucuacuaaagauacaaaaaauuagcugggcgugguggcacgcgccuauaaucccuacuugggaggcugagggaggagaaucgcuugaacccgggagguggugguuugcagugagcugagaucacgccacugcacucuagccugggcgacagggcaagacuccgucucaaaaaaaaaaaaaaaaaaaagaaugauacaguggacuugggacuuggggaggacaggaaggugggggcggcagggguaaaagacuacauauugaguacaguguacacugcuugggugacagguacaccagagaucucagaaaucaccacuaaagaacuuauccauguaacaaaacccaccuguuccccaaaaacuguugaaauaaaauuuuaaaacacuguaaccuguuccuuaguccauccuauaauucuguaccgcugucuacuuuacucuuccauuuuuuuaaaaaaaauuucuguagcauuuaucacuuuucuauacaccauguuauuuacuuuacaaagugcccaucgucugucuuccccuaguggauggcaagcacgcaggccagggauccuugcuuuguucacugccauauccugcuccuagaacagugccuggcacauaggagacaaucagcaaguauuuauuggcugcauuugcaucugauagauaaaacauggugggccgggugugguggcucacgccuguaaucccagcauuuugggaggcugaggcaggcggaucacuugaggccaggaguuugagaccagccuggccaacaugaugaaaccccaucucuaccaaaaaaauacacagauuagcugggaguagucccagguauuuaggacgcugaggcacaggaaucgcuugaaccugggaggcagagguugcagugagccaagguugcaccauugcacgccagcccaggugacaaagugagacuccguuucaaaacaaaauaacaaagcaaaacaaaaaccaugguauauuauggugauauucacuugaacuagaaaauuaauaguaaaaaaauacugugaguuaaaaaaaaauaaugaguuguaauucuuuuuuuauguaauuuuugcauaucuguguuuuuccuuuuggggaaaaucuguuugucuuuugcauugcucuggugggacauucugguaaaacuuuucacauaucaaagacuauuuccuugccugcuguaggucaguucauuuguuuuuuuucuucagguugucuuuaucuucauguuuuuuuuucuuuguuucuuuuuuuuuugauaugucaaucugccuccaauucuuguuuacaaagaucuuuugucaucuaauuauauuauuauuacuauuuagagaaagguucuugcucugucucccagguuagagugcagugguagggucauaccucacugcagccucaaacuucugggcuuaagcaauccucccacuucagccucccaaguagcugggacuacaggcacgcaguuaugugccugguguaugcccaguuaauuuuuaaaauucuuuauagaaacggguucuggcuguguuacccaagcuggucucaaacuccuggccucaaagugauucucccaccuuggccucccgaagugucaucuaauuauuauuguuuuaauucccucugcuuuuuaauuuuccaaaagugaauuugggucuauggugugaugcacaguuguaacuuaauuuuuuccaaguucuuaacuguucauuguagucuauguauugaguacuuccuguuuucuccaauagauugcaguguuaccuuuaccacacuauuuaccuucagaauccccaaauccacacggacaugagccgcucagcuuccuccuggacucugagccaggucgcugucucuuuaggggaaauacggaaugauuggugugugugugcacguguguucugaaauaguuggccuacugucuuguaacuugcuuaggauuacauuucugguagauagaauuccuaaagcaauuuuuccacuuuucugagcugcccuuuugauaucagagggcugggaugaggucauucugccucagcugauuucagauuuauuuuucaagcuggagccagugugaggcuuuggagauagccuuuucaaagguguagacuuauuucgauagagaaacaguguguuaaaacaaaaugagagagucggcaauuuuaagcaaguaaauugcuuccuauugauaaugggauauuuaugcacccugcaguggagaacaauuuccuucauagucagcucuuuaucaauuaucaggaaggccaaauggacugaaaaauaaugcagcagagaacaaaugggagugcuggugugcagggauuugaugagcuacagaggggagcgguucccugggcuuccccugagcuuccgugagccagucucaauccuuuccacgauuuacccucaaguugucucgcauucucucuggcuaacuuuuuacagauagcgauuccagggccucucguauuugcaagcaaauuagaaacaagacauggcgcgguguuuacgcgugcccuugcccaugaugacaggaaggacaagguugauaugaguuaaaaugggaaaaaaaucacacaacagaagaggaguucuuguuuagauuagaaccaguuccuccaacucccaccauuuaucauuuuguuccacaccucagugccaugaguuaauugacagauggcuuuagaagaauuuuuuguuucaugggcugagcuacacaaggaaaaaguuuucugcucacuucuagcaggcagcuagaagucuuuggacccuguuguaggcaccugagcugucuugguuuaagacacuacaaaaugagugaauuaggagugagaagucaagcgaaugugugaccaucgcuguccucuuguucuaucggggucacugcaacagugguaaauagcugugacccccaguccgcucccuggcucugaauucucucuuggcuaugcaguauucagaguugagcccagucucucucccccauaacaaaaucccauugccguggucucuauagcuauugcuguggugcugauuuaaaggcugccugauugugcuuucacgaguaucauugaacaauuauuuucuuuaguacugcuuagaugucuuguugcuauuuauaccuugguuuucugggaccuggucuuagcaccuagaaugcugccugacauacaguaggugcuuaagaaacguuuguugaauugaguugaauugaaugauccgaagauaaacuuagcuuuguuuguuugcuuguuucuuagaggcagugucuugcucugucauccaggcuggagugcagcggcgugaucacaguucacugcagccucaaacuucugggcucaagugauccccccaccucagucuccccaguagcuuggacuucgggcaugugccaccaugcccgacuaauuuuuuaaauuucucauagagauaguugcccagguuagucucgaacuccuggccucaagucauccucacaccuuggccucccaaaucacugggauuacaggugugagccaccaugcccagccaaauguagcuucuugaaaggauucucaagacccugggggcaggggagguggugccaugccugagagaguugcucccuucucuccauucacuuuuucucuaguuucuuucuggaacuuggauuuuguucuucuggccugcauaucuaugcuaaauccacaaaaugauuuuguuuccucagaugccaaggagucucuaaucuccguauauuaacguuugcagcuuaggaacagugugaucuaaugacaaauuaacuguauugauuauugccauguuguucacggauacauuccacucaguuugccacuuggaggcacauccaauauugccguaugggccaaaugaugcaguuccuacuuucugucuucggcaggcauuuggucuaauuuucccugagaagaugccuguggcugugugacgaaugacuauuuuguggagggggugccaggcuucucuccugcugcuguggaguuugcuggaacaugggaaaaggucgaucuuucuguagaacaaacuauuauauauuacauguaauauaauauauauuuauauauaaaauauauauuauauauaauuuauaauuaauauauaauuauauaauagauauuauaaugauaaacagguuuauaauaaccaaccauguuuacaauaaucaaaacacauauuauaauaugcuuauuuauaauaaucauuaugauaaaaccuuuauaguaaucaaaacauuuuuauuauaauaaacauuugaugucuguaauaaucaaacauguuucuggguagauagauaauucugucuacccagaaauguaauccuaagcgaaucacaagagcaagccaacuauuccagaacacaugugcacacacgcaaaucauauuguauuuccucuaaagagacagugaccuggcucagaguccaggaggaagcugagggacucauguccguguugauuuuugauuuuuauauauuauaaauaacauaauuauauaucuauauuauauauaucuauacuauauauaauuauauaacaugauaucuauauuauacauaguacauauuauauaacaucuauauuauauaauacguaauuuauauaucauauugcauaauuauauaauauaauuuauauauuauuuaauuuauauauucacuuaauuuauaaauuauauaauuuauauauuauuauauaauauagauauauaauagauauguauuauaauauauuaauuauauaguuauauaauacauaauauggaauuauauauaauauaauacauaauauauaauuauauauaauauagauuuuauauauaauauauaauucauauauaaauuauaauagauauagauuuuauauauaauauauaauucauauauaaguuauaauauagauauauaauagauaauauguauauaauauaaagcguuccacccccaaaacaguccugguccuugaguuaggagaguagcuuucuccccacucaaaccucaccuucucccuuuucaggggagcccuuuuccccucacugaguccugguccccucaccuggauucagaugcucgugugucuuucuuggggaccuccuuugggccaggcccugugcugcaugugggguucacucaccaucccacgaucacccugcaggccuuuuucagacauaaucugaauugccuccuuuuccuugaagcguagccuuguaauccucuggaucuugaacgucaagaacuaaaaccuaagagauaguuggaugaaagguguguuuccaaggguacuauauuucugugccugaaauucaugggaagcagagggugguguaauugauacugccuuuuugagggcaacuuggcaauguguauuaagugacugaaaaguguuucugcccuuggacccagugauuguauuccuaggaagucaucuuaaggaaauggccaugaaaaugcaugacaauuuguguacaaagauuuccauugcaacauuauguaaaauugggaauuaucuaaauaucccacaauaggaguuuggugaaaucaauuuugcuauggccauaggauggaauacugaucaaccaucaaaaaugcuguuuugcagacuaguuaccaauauggaagauugaaaauugaguguguuaagugaaaaaaaugauauaaagcuauauagagagcaugauccuaguugaauuaagaacauuugcauauuaaaaaguauggaaugaaaugugcuaauauguuaguaaugguuauugcagaccagugaaauauagauaauuuuuuuuucuauauacauuuuggggacauuuuucauugaaaaauacguguuggagauaaagaugggaacaauagauacuggggacuacugggggucaagggcuggaaaauuaccuauuagacacuaugcucacuaccugggugacagcgucauucuugccccaagccucagcaucacacaauauacccauggaacgaacgugcacauguacccccugaaucuaaaguaaaaguugaaauuacuuuuaaaaaacuacauguaaucuggaaaauguagcauaucucauaugauuuggcuguguccucacccaaaucucaucuugaauuuuagcucccacaauucccacaugucaugggagggaccuggugagaaguauuugaaucauagggaugggucuuucccaugcucuucuugugguggugaacaagucucacaagauuugauggcuuuauaaaggggaguuucccuacacaaguucucucuugccugccgccaccaugcaagacaugccuuucaccuuccaccaugacuguaaggccuccccagccauguggaucugugaguccauuaaaccccuuuuucuuuauaaauuacccagucuuggguaugucuuuaucagcaguguaaaaacagacuaauacaauauccuauguaggguuagcucugguuuuuuuuuuuccuuucuuuuaccauauaaugcaagugauaugguuugguuuuguccucacucaaaucucaucuugaauuccaauguguuaugggagggacccggugggagguuaaugaaucauauggggucaggucuuuccugcgcuguucucaugauaguuaauaugccucaugagaucugacaguuuuuaaauggagaguuucccugcauaaguccucucucuucucuuuucugccaccauguaagacaugccuuucaccuucuaccaugauugugaggccuccccagccauguggaacuguaagucaauuaaaccucuuucuuuuguaaauugcucagucuuggguaugucuuuauaagcagcgugaaaauggacuaauacagcaaguuuacaauagagacuuugaaaauacccaugagcaaagaaaauaaacaucagcuguaaucucaccacacagaaaguucacuguuaauauuuugaugucuauucuuacagucuuccaaaauauauaucauuuuuauuuuacuaaaauaagaucacaacguagauacugcuugaaaucugucuuuugauuuuuaaaacccauucugaacaguuuuucaugcuuuuuuggaggagcaguugccuuguugauccucuggacuugcagcuguugaugaccuagcaguggagucuagaaccauuccagacaaauggaacugauguguuccagcaaugcgagaucccuuccuucugacuugacaucuucccagaggggucagcccugagaauuuugucauuugucauuuuguauggagacccuccagugauuaucacucucauacauauuuaaaucucauccacucauuuuccuuuuggcccugccuggagcuuucaguaucucuggccgggcugggcuuucuuuguuuguuucuguucuaauuugcuuuguucuuucacuguugaggaauuuuccauuagcuuuaaccuaccuggcaugcuaaaaucgauucagcuuaaucuguccagguguaacguuuggggacagauuaacuuuaugcucuaguucuuaaacccuuagaaaugccucuagcuuucugacuaucuugugccauucuagcuuaagaaagaaauacuuuucaugaccugaguaguagaauuucaccaccucauaaaguuaccaaaaugcucugcuuucaguaugauagcuagggaaggaguugacuuaauuuuuccauuaaagaugugauuuugaccaugaaagaaauuauuauuuuucauaaccugagauaguguuuguugguauaauuucaccacuuaauaaguuacaaaaaugcccuucuuuaagaaugauagcuagggaaggagucagauucauguuuuaauuaaaaaaugugguuuuggcuaugagguaaugagaaaggccaggaaugugacaugcagggacaucugagaugcauaguagguucauccuaucaauggcccaccagcccugagcacugggccugugcaccuuuuuccccaacacugccugcugucuguucccagggucaacagugauucuuuuuuuuuuuucuuuuuuuuuuuugagacggugucucgcacugucgcccaggcuggaguacaguggcgcaaucucggcucacugcaaccuccaccuccuggguucaagcaauucuccugccucagccuccugaguaucugggauuacaggcacccaccaccaggccuggcuaauuuuuguauuuuuaguaaagauggaguuucgccauguuggccaggcuggucucaaacuccugaccucaagugaucugcccagcuuggccucccaaagugcugagauuacaggugggagccaccgugucuggccaacagugacucauucuuaagcaauguaaaccaaaaauaaaauccuaggcccccagccaacugaacagaccccaguuugggccaaagggacccccaagcacccugaaaaacugaauucuggccaugaugggaagggaggucacacacacacaccuuguuauaucccuucccuuucagaguuuaggcauaacugaccagcauuaagauuaaaaugcagaccauaagacugaccaaacagugucuuaagguaauaacauaccaaauccagccugaccgguauagcaucacaugcucucugagggcugccaucuaugagacuucaucuacguaacaaaaaccucggcuucgacaguccccuuauuuuaacucaagcauuccuuucuucugacuucuuaagugugguaugaucauagcucacuuuagcuucaaacucuuggguucaagcaauccucccaucucagccuccuuaguagcugggacugcaggugugcaccaauacaccugguuaauuugguuuuuaauuuuuuguagagauggggucucacuauguugcccagguuagucuugaauuccuggucucaaaugauccuccugucuuggccucccaaagugcuggaauuacaggcaugagcugcugcacucagccucagaaaaucuuuuaaucccccuacgaccuguaagcaccuccacuugaagauaucuggcugaauuaauguucaccuuccauguauuaauuuaugucuucgcuuauaauuccuaucucccuaaaauguauaaaauuaaacuauaacuugacuaccucgggcacuuucucaggaccucuugagacuguaccugagccaugguuauucauauuggcucagaauaaaccucuuuaaauauuuuacagaguuuggcuccuuuggucaauagcugggugguagcuggccaaggugaaucugggcuggguaauuuacugauuuacaggaguccuguucgacacuagauucucaucuuaacagcacagaugcagugacuaguuccagauuaauacuugcagcuaacuuggagguauggcuggccgcuagugcuagcugugcccuuuugcauggcgccauccaggagaagcccaaagccccagcucaguccccuccugcuuccguacccuguugugcccucuuugaagggccucucugccaugcuuccuccaagccucagccucucucagccucuaaaucucaccucccuguauacuuccucagagauuucuauuucaucuuucucuccuccagcuccugugcauguuuuucccuuagguaaaucuuaagccuuuuuuuaaaaagacagggacagggucuugcuauguuguccaggcuagucucauuuaaguccuugaaacugccuaaaaugcuuugugaaauaagauuccauuucaacaaacaaaagcaggaagugccuucaggacugggcucggcucaggcgugccucugccaugucucacuugagccuucuuuucaagucugagccuggaguagaggcacguucaaugaguauuuauugaaauagaugcagucacaccucaaauagcaaaucaccuaaggagucacaaucccuuuuuaaaagugugcccagaaaaaauaaaaacuaggauguaguccauauacacaauggacuguuauucagccauaaaaaugaaugagauccugucauuugcaggaccauggauggaacuggaggucauuauguuaagugaaauaaguaaagcacagaaagaaaaauauugcauguuaucauucauauaugggagcuaaaaaaagaggaucucaugaaaauagagaguagguugcugguuaccagagguaaggaaggaggggagagaaggugggggauggaaauaaaaaagaauguauauggccgggcacggugacucacgccuguaauccuagcacuuugggaggcugaggcgggcagaucacaaggccaggaguuugagaccagccuggccaacguggcgaaacccggcucuacuaaaaauacaaaaauuagccaggucugguggcacauaccugugaucccagcuacuuaggagacugaggcaugagaauugcuuggacccaggagauggagguugcagugagucgagaucgcaccacugugcuccagccugggugacagucacugugucuccaaaaaaaaaaaaaaaaaaaaaaaaagaauguauauguguaauguauuuaucauuacugaacugaacacuuaacaguggcaaagaugguaaauuauauuuuugaccuuaauuaaaaauauuaaaaaauaaaauagaucuuuccaugaaaaaguaaaaaaaaaaaaauccagguggagaugauggugcuaaaaagugaguuauacaaagcagcaguguauccaccccuccaucuaaguggcuuguuccuguggcccauguuauuauuauacacuguauauuauauauaguauauauuauauauuauacauuaauauauauaauuguauaauauauacuauacaguauauaauaaugugggacauggacauuauacuauauauuuauauuauacuauauauauuauacuauauauauaguauaauguccauauauaauguaauguccauauauaauguaauguccauaaugucccacauuacuaaaaaugggaacacuucugagcuccuguugcaugcccagccuccuuuuucucuuguugcccaggcuggagugcaaugauaugaucuuggcucacugcaaccccugccucccagguucaagugauucuccugucucagccucccaaguagcugggauuacaggcaugugccacuacgcccagcacauuuuuguauuuuuaguagagacgggguuucgccauguuggcuaggcuggucuugaacuccugaccucaggugaucugcccaccucggcuucccaaaguguggggauuacaggcaugagccgccaugccuagccccagccuccuuuuucuagcacacuucccucugccuucguagcucugucccuuucaccucuauguuuccuaauuucugaagucaguugaucauuauuugcagacugauagguuguaauuaaaucagaacucauucacacuaaagcccucccugggauuaaaccagcauuuucuaugcagcgaucaucauuuuauccccauuuuccauucuugucauauuuucagcaucaccugucuccaaacucuugccaaguauuugcagcugcucgcuagaagcaaucaccaggguaucacucagacaccuauccucaguguggccaaaccucacuucccuccaagacagccugcagucccuccugaauuguuuguuguuaaugccaucacguaaacuacaguguugccuucccuucccuucccuucccuucccuucccuucccuucccuucccuucccuucccuucccuucccuucaacuuuuauuuuuacuuuuacuuuacuucuuucuuggguuuuaccauguugaccaagcuggacucaaacuccugaccucaaguguuccacccaccucagccucccaaaaugcugggauuacaggugugagccacugugcccagcccuccagcauugucuuucaaaucaucccucucccagacucugacaucugagcucuccuugagcaccauccacucuaucucugaaaagucucucaaacucuucuuuccacaguguccucugccaccaugcuggcuuagcucugaguuccucaucuuccccuuagacucugugacagccucuuaucucuugucauuccagcuguagccacccugaugccugagcucuuggucuaaaaaucucacccuuaaaaaauauauauuuuaaaaccacugggagcucccuguggccuacaugaaagggucacacacuuuaaaaagaaaaguccggaguauaaauauuuuagucuuugugggccccacaguuccugucacaauuauuccauucugcugguauagcacaaaaacaggagaaaauagacaaccaguggagacauauagaaacaaaugugcaugguuguguuccaauaaaacuuuauuugugaaagaagguggugagcuaggcuuggcuacaggccauccuuugccaaccccuggccugcgggguagagcccagauggcugugaaggcccauugcaauauugccugucauagucuguuuuguguugcuauaaaggaaaaccugaagcuagauaauuuauauagaaaauauauauuuggcucaugguuugcggacuguauaagaagcauggcaccagcaauugcuuggcugcuggugaggaccucaggaugcuucuacccguggagaaaggcaaaggggagccagugugugcaaagaucccaugguaagagaggaagcaagagagagagagggaggugccagguucuuuucuuuuaaccaacucuugcaggaacuaauugaggacucaugcaaccccuccuccuccucccagagagaguauugaucuguucaugcaggaucuggccccauggcucauaggccucccauuaggcuccaccuccaacacuggagaucaaauuucaacaugagauuuuggggaaaaaacauccaaacuauagcaucgcccuagugcaauucuccacucucaucucucaguguuucucguuucuccacccaccgggcagccagaauuguagacaugcccgugucuugccacauuuucccaccccugccuguuuacccuucucuugauagacuugagauuuaaaagauucaagcguaaccccaacagcccuuccucagaguugucccuucaacaucucgaccuccgugggauuuuguguauacuuguauuauagcacuugucauucuugcuuaugaacaucuggucaccucucugucucuucaacuguaauacagauuuauugcagccuggaaaguuucuuuugcuacuuaucuauccuggcacagccccugacauauaaguaaacagcaacucuuugcagaaugaauggcuuauuaaucaucuguaaauauucauuuuuugccuuucuuagagaaggugaaaaccuuucuaaaucucuuugucauaggcucagucccugcccaauuucuuccuuugcauaaauaacucuagguuuguaucuuacauuuuccggugcauuuccauagcuuuuaaauaacugccuugccuagccucgcugaacugcaucuuucuccaguuuugcagugucucaaugccaucuagccucacaacgcaucuucuuuguuaauaaagccaucacuuuaugcaaugaagacccacauucuuccugaagauauauuucugugaagaauaagcagauuuugcaucguacacauacugagauaggagaaauuguuguucuucauuaccaauuugagguggcaaauuaguacuguaaauuucaccugauucuucaaagcuagaacaucagccaacuaauaucgaugcuggcuggugucuggacuuuaucugaugccugagaaaugagucuccucccugcgauagcugugcuuuugcuguuguuccugccuggaauuggcugugucauuaggaagcaucauggagcugaggccugauucucagagggcacuaggucccaaugcagacuuuuuuuuaagaaaaaagagagccuggcacgguggcucaugccuguuauccuagcacuuugggaagcagagggggguggaucaccugagguuaggaguucaagaccagccuggcugacauagugaaacaccgucucuacuaaaaauacaaaaaauuagccgucgugauggugggcgccuguaaucccagcuauucaugaggcugaggcaggaaaauugcuugaaccagggaggcggagguugcagugagcugagcucaugccacugcacuccagccugggugacagagcgagacgccaucuccaacaaaaaaaaaaagaaagaaaaaagaguuaccagcucaugccuguaaucccagcacuuugggaggcugaggcagaaggacugcuugaggcuggguguuugagaccagccugggcaacauggcgagacccuguuucuacaaaaaaugaaaaauaaaaaauuagucgagcauggugguguguacucaagaggccaaggcaggaggaucucuugagcccaggagcucaaggcugcagugagcuaucauggugccacugcacuucagccugggcaacagagcaagacuaucucagaaaaaaaaaauaaguuaccagcauaaugagaaguaaaucucuugggcugaauaacaggauuauuucuuuccaaguccuugcuuggcucaagacucucugcuucccuuuagggaggaggggcucagaucccugugggaacgccaacuuugauucugggcgacuccauaugcuugcagagacuggaguccuuucagacgaugcguguugccacgugucuuuucauacuccacacaaugacaguuggacagguuccuaucaccauugcagagagcauuucuguggcccacaaagacaucuuggaggugguuaaaauuggcauacuagugucuaacgugcacguguugcaugagauggaggaguaaaguuuaauuaaagaccaaagauacagcgugcucacguagcccuggcgcaccagagacuuuaggccaaagaaggaguacguuucggugaaaagcacacaacauuacugccuguucuugaaaacuugaucuguggucccuaguucccaaggaugggaaaguggccaaagcccacucaaugcugggagccguccuccuagagccagagggauccugccuguuccaaugucuccguggguuuuacgggcauauuuuucacacccuguuuugcuauuaaaaauaaaaugaggcacacaucacaugucuuucccagacugcaagacccauuuccuucuaauaagccucgguuugccugggcuuuccuuacccuagaaacauuaacucucccgaggugccuauuauggauuucuaguuuuguauuuuuuuuccuguuucugcuauuuugaaaaaaaaaaaaaaaguuagugagguuugucugcuucugcagacagacagacacacacacucacauagacacacacacgaauucucuacgugggagccaggagcucccuaugcaaauagagaauaaagaaggacagcuuuguccuacuuaccugcaugccacagaaaauagaacccugagcugauguguggccugcgcuguccugggcuugguuggaggaggccagccuugcuacagacuacagaguaagccacaggcauucaaggcuucgaaggagcaggucccuuuagaggagggaaguucuggagugaccuccaucuauggucugacuugcuaaauccaguagccccaaagguggggcaacucggagguccaaaggcucagcuguccggguccucauuuccaggccauguucucaaacacccccagcuagggcccgcuggggugucgcccaauguaaggauguagguugaugcuuaccuguaaggucuagggcauacaggaagaccacaggaacaaaggucugucaauggaagggacccacccuguccagccauaucaguaacccagagaguucaggauugagucagaaggaaugggaaguggagaugaugccuugggaaggagccuuccggagaacuaagagcaagacuuagcuuacaacuggcuauccaguaacugcagccgcagaccuugucauccucugacacuuccuacuguugcaucguauguccuggccccaguguaaaacccugcuauagaggcuggaaggacaucacaccuaacccauuuuuucagauggggaaauugaggcugagggggaaggcugcaccagcuugcagagcagagcuggcgcuuggcgcuggcugccucaugggcugacucucacgucgggaggccuggccucugcguccucccauccuuggcaauuggggaucugagcucaggccacaugaggccauguccuccaccacaguguccuugagcacagugugccaugaccucaagcugaguaguggcuccacgcuccuuccaggccagucgggacuugguaggaaaacauauggcuguuuuagguaaccuugggcauauuucauugaugggaaaagcucaaaaugcagacaaacgccuugauucagaauuuggguuggacuaaaauuuguuucuauaccauugauggaaagaaaggggaggagguguugaacagcagauuaauaggguguguaagagaacacaggcuuccuguucuucacuuaaacacuucaacgauguccacggaugcacagaaagaagggcuggaggaccugagggauccaugcagccagcacagcucauuuuacgcaugaacaaacugaggccuccaggguuuggccguggaccuaauuagcuaauacgccuggcugggagccuaggguccuggugcacaggguggucuucucucugcuggggcccacaauucuucccagaaagaauucagcaugcuggauuaguauugauaaugaauuuacuacuaauauaugauccuuacccauucagacucaucaucccuugaacagcuaucugucuagcgccuccuacaaugugggcggggaacacacuaagaugaaagaaggguaggaggugcuuaccgcucagaaaagaagccaaugguaguauuucuagauggaguaugcuggaugucacaagaaaggaaugaaugaccugcugugaacagucagcagaaagggagauaacuuggcuauggugagcaaagacaguuuugcggaauccaugaccccugguuugguguuuugcaaugggcaaguccaugcaaacuuacucccaaaguccaaggaagcugagaggcugaaaaaagaggcugauauaucuagcuugucagaaagaaacauuuaauagggacuugggcuaugucugugucuugcggcauggugagacaagaugguggaugcccccagccaucaccuaccagacccaggacuuauauaucauagggaaggaauguauagacgauuguagggaaaggcaggagucugccuaagggcaggguguaugguaagaacaaggucuuacacaaggaacaguagauaacauagaaauuugggaggcauucccagaauuagaguuugucagaagucaacauggcagauuagcauccaagauggagucacuuuagcauccacacuugaccuugaaggauggauauaauuuugggcagggaaaagaagaagggaagauauuuuaggcagaagcacuggaugcaauaguguagcaaucucaaaaccagcccccaaagauaucaaauccuaaucucugagauuuauaaaugcuaucuuacagaaaagucuuugaagaugugaugaaguuaagaaucuugagauggggagauuaucuuggauuaucugaguggucccuaaugcaaacagaaguguccuuuaagagcaggacagagggagaauuacagacagaagaggagaagauggagauuggagugauggggcugcaagccaaggaaugcuggcagccucuggcagcuggaagagacaaauggauuuucccuuagagccuucacggggagcacagcucugcugacaucaugauugugaucuaaugaugcugauuuuggaauuuuggccuccagacugugagagaauagauuucuauugucuuaaaucaccaaguuugugguaaugaucaugccagggcauggucagauauucagugcgguaguaaguaaaugagucagaaccgaggggcuuguaugcguuugaagagugauagaagguuucugcaugcaucuuaccauccugaguggagucgagcugagugggagaaccccaaugccugguggaucauuuuuauuuuuccguauuuauuaauacugugcuucucacggaauagaaagucaauacuaguugacuuucuaucaacuagcguggcauggugaauaauggcagcugacauaucugggcuugcacuggguuuauugaugaaaagucaaagcugcucuaggucuggugugcucagaaacaauuaacgaaccuuucaucuucacacugugaccuccaauuccuuguguuauacauccaauccaggacugacagcugcaguggcucuggagaaggggacucuggguggaauuuagagcaacucugguuuaggggaagaggagagauugccugccaagugaaacagcccuugcugaccgcagagucaaguucucugcuagcccaggggcaaagugauuaaaggcaucuuuugaguuuucacgaugcucuuauugaucugagguuguuuauaucuacaaaacaccuguaaauuaggagaaugagucaaaaacagccggauacuuaacucuucuccuccuaugaggcuggaagagcuuucugcacagcuccuacagcagcagggaucugaaauaugccugcagaggggagcugcauucuccuuuccuccugaggacugcaguuaagaggcagcuuucuccucacagcugaaaccaaauccucaucuuugcucagaaaguguccuugguuaacaugauucucugcugggaccaccaucuaauugugugccuccuccagaguuggaggaugcucaggucgagcugccuccucccucccuuccuccuucuuucuuucuuuuucuuuuuuucucuuucuuucuuucuauuuuucuuucuuuccuuucuuucuuucucucuuucucccuuucuucauuucuuuuucuuuuuuuccuugucugccugcguuccuuucuucccuccuuccuuccuuuuucuuucuucuuuccuuuuuuccuuccuuccuuccuccuuccuucccuccuccuccccucccucccuuccuuccucccucccuuccuuccucccucccuuccuuccucccucccuuccuuccucccucccuuccuuccucccucccuuccuuccucccucccuuccucccucccucccuuccucccucccucccuuccucccucccuugcuuucuuccuuccuuucucccucccuccuucccuuuucccccucccucccuuccuuucuucuuucucuuuuuuccucccuucauuccucucuuccacucucccuuccaccuuccucuuuuucucucucccuuucucccuuuccuuuucuuuuucuuccucucucauuuucccuucuccuccucucccuuccauuuccuuuuuucucuuuccuuuuucuuuucuucguuucuuuucuucuguucuucuucuguccucccuuuuaucugauuaaagaguuuuaacaaaucacuguuuuuaaagcaguuaggaguucucaguaggcaaucaccaauaacugcagugcaauaaagccagccaugugaccacuggacuuucuuugcuuuuccauuguagaaauccgagaggccuuucggguucuggaccgggaugggaacggcuucaucuccaagcaggagcugggcauggccaugcgcucuuugggguacaugccaagcgagguggagcuggccaucaucaugcagcgcuuggacauggacgguaagacccggacaagcagcuucuccccugagacaugccccggucucaucagugagaccuucgguuuaugcagggccuugcacuuuuaaauccagagacuugguuuacauuugagaagcagaaacuuggacuagaacaggcuuuuucaguaacuuuccauagaguucuaggggccuguagagaugguuucagggccacuauaggauggggugaggaaagaggccuggcugguggaacaguuacagcaucuuguuuuuucccuucuuguccccucccaccuccccaucccccucuucccccucccucauccccaucccuaucccccucucccucccccuccuccuccucccucccucccuccccccuccuccuccuccuccuucuucuuccucuucucccugccccucuuccuccuccuccucuucuaaauaacagcuuuguugagauagaauucacauacucuaaaauucacacauuuaaagugcacaauucaguggugcuuaguggaugugcaggguuuuguuuguuuguuuccucuuucuuuauuggaugcuuuguagaugucacacagaucuacaaguuacauuguugagaaauuauuuaaaaauugaccaagaccagggucuugguccagagcuccagacuagaagcaaaaaggaaugggggcagugaguuggggaauguuccuccaacaucaccaaaaccccucaaacaagaauccuaagcuccuccaugggcuagagccuggccuugggcuccugggcuaacccucagugucucuggcuacaucacacucaggaaaaguucaccagcaagaggcugcagggaacagccagucaaguccagacauggacaaauauaaguggaaggaggacaugaaacagguaacugucccgcuguaguuaagagugcagcuaaggcaggugcgggggcaggggaggagccaggggagcagugcugcagcagugccgggguguagccccaguguagccagacgagagucacagauuuguaaaaccagcgccacaauggauuuuaguuggaagccacuauccucggcaaacuaacacaggagcagaacgccaagcaccacauguucucaccuuuuuuuuuuuucaugacaggucuauuuuaacauuuuuaucuuauuuucauuuaauuuuuuuaauuguauuuuauuuauuauuuauuuuagagacggagucucucucugucgcccaggcuggaguacagugaugcgaucucaacucacugcagccuccgccucccgguucaagugauucucuugccuuagccuuucagaguagcugggacuagaggcaugcaccaccacaacugacuaauuuuuguguuuuuaguagagacggaguuucgccauguuggccaggauggucucaaucuccugaucucgugaucugcccaccucggccucccaaagugcugggauuacgggugugagccagcgcgcccggccuaaauuguguauuauuuuggguuccaagauaccugugcuuuuucucacuuauaagugggaguuaaaugaugagaacacauaaacacauaguggggaacaacacacuggggccuguuggggguggggagggagagcauugggaagaauagcuaaugggugcugggcuuaauaccaaggugauggguugaucugugcagcaaaccaccauggcacauguuuaccuaucuaacaaaccugcacauccugcacauggaccccagaacuuaaaauaaaaguugaaggaaaauaaaagaacaccuucaucacuccaaaaaggaauuccacaucucuuagccaucaccucccaaucccccugucccugcaagcccuaggcaaccacuuuucuacguugucugagagacuggucaauggguagcaguuguuggucuccagacggagguccuaacccaagaccagagggcucauguguuguauguucuucuggugagcuggggauucucaucuaccagcuuggacuugagguguucccugugggccagggugucuccaggccauucauugauucucugcuucccacagacacacauuuccuaggcaaccuggaaaacaaauccuagacuuaauccuggcccagucacuguccccauucuugcccagcagacugauggaaggggauucuaaggaagaaaauggcauuaucuuccugcccuaccccacaagcccauauccugcacacugccucacuaccucuaaguuuuuugggauggucuaucccaaggacacgauaacccgcaagcuuuggagccuucuaagcuggagcuacugugucauucccauugucacuuccuucugucuggacguucccauuguccagaucuguucagaggcuucacucucagccuccuucccccccccuccauuuccaucuucuccaaagcuucagagaaaugaccugcagcuuauucuccagugacaguggcaguccccugucuaguccacgcccuucuuaguagaauccuguuuuuggauugaagaauccugggaccaguagcaaaagcacccuguuuucuacccaacucucugccccauuuggcucaacaaucccaaguugguuaacaucuccaaguagcuacugaagaaaugaaguguuucauuuaacacuuucaaaguagccccauaaguagagccguaagaucugguccuugccaccugugucuacacucugagccucuuuucuuaauucaguaagcaaguacuacgccccuucauaugccaugacugcuccacccaaccaccuagacacucucugcuguaccucacaccuggccaggaccucacuugcugaaugaguccagagucauagcugacuagcuucauaccacccucaaacucauugauggugucuuccaggauaucgauggucucaauauccaggugauuggugggcauauccaggagaggaguauguagggguucugccaggucagccaggccaggcuagauucagagauuugugcaacgcauaccacagucgauuuuagaacauuuucauugcuccaaaaagaaaccuugcacuuccuuuuuuuuuuuuuuuuuuuuuuuuuuuugacggagucucgcucugucaccaggcuggagugcaguggcacaaucucugcucacugcaaccuccgcuucccggguuuaagcaauucuccugccucagccucccaaguagcugggccuacaggugcccaccaccaugcccagcuaauuuucauauuuuuaguacagacaggguuucaccauggugggcaggauggucucgaucucuugaccuugugauccgccugccuuggccucccaaagugcuggaauuacagaugugagccaccacacccagacaaaaccuuguaccucuuagccaucaccucucaauccccauauuuccccaagcccuacacaagcacuucucuauuuucugucucuauaguugcuucugcuggacauuuucuacuaauggaaucauauaauuugccuuccuuugugaguagcuucuugcacuuacuauaguguuuccaagguucaccuguguuguagcauuuaucaugacuucauuucuuuugauggccauauuccuauuccacuguauggacauaacagcuuguuuuaugucuauuuucuauuuacugaguuucugcauacaaccucacuggaaaaaauacaacuuuguaguguuuuuaaaauuugcgacagagucucacucugucuuacgcccaggcugcagugcaguggcaugaucuuggcucacugcaaccuccaucucccagauugaagcuauucuccugccucagccuccugaguagcugggguuacagacgugcgccaccacgcccggcuaauuuuuguauuuuuaguagagaugggguuucaccauguuggccaggcuggucucgaacuccugagcucaagugauccgccugccucagccucccaaagugcugggauuacaggcaugagcuacugcacccagcccucguaauguuuaaaaagcuuugaaaaauggacugggcacaggaggcggagguugcggugagccaagaucgugccauuguacuccagccugggugacaaagagugaaacuccaucuuaaaaauaaaauaagcuuugaaaaaugacugcauuugauaaucuuuaaguuucuucccuagucuaaaacccuagguuuuaucccaaaccagcuagauccugccuuagauaaagguccaggaaggaggccucuuuguuuuguuuuguuaacacauacccuuucccucugaaaagcagcuuaauucuaggcaucgggcacgagaggacugggcuuuuggcgugcccagguugagcauuagauauacaccaagaagcaaggacagaggagaugggcaggaagucucuuuggaagaacagaccaagguuaugauaaggagauguuugcuuggccugcaggccaguugcaagagcgugguuuuagccuguuaucuugccggacuuguugggaggaugauaauaagggugaccauauggugaauggacccuagggccaaccgccaagugcagcuguagacauuuauuuucugguucaggauagagauguuuuauccaggguauucaguugugugagcgguucucagcuuguucucccaauucugauugauggugacucaccaugucuuuguaggccugauuugacguugcuuuauauuuuagagauauuucugaaaagcuggagcaaagcacaccuuuuacagcaagaucucacuuccagugacuuccaucauuauuucagagauacauuugcagggaaaaaaguuuccuccuugaaauaagaaaagucuuaaucuauacgucuguuucuggaacuaagaaggcuuugggucuuugauucugcucacacaacucuuguaauaaaaccuagucaaucgcaccuguuaucggaggccgaggcaggcggaucaucugaggucaggaguuugagaccagccucaccaacauagugaaauccugucucuacuaaaaauacaaaacaauuagccaggcaugguaccaugugccuguaaucucagcuacucgggaggcuaaggcacgagaaucacuugaacccaggaggcagagguugcaguaagcugagaucacgccacugcacuccagccugggugacaaagcaagacuccgucucaaaaaacaaacaaaacaaacaaaaauccuagucaaauggacuaaaugugaauggaauuagcaauuagcaacuucuuuacacauagguuggacucauuuuucuuguagaguguuauuccuaguuauguccagaaguuauucuuuuuuuuuuuuuuuuuuuugugagacggagucucgcucuguugcccaggcuggagugcaguggcgcgaucuuggcucacugcaagcuccgccucccagguucacgccauucuccugccucagcuucccaaguagcugggacuacaggcacccgccaccacgcccggcuaguuuucuuuguauuuucaguagagaugggguuucacuguguuagccaggauggucuugaucuccugaccucgugaucugccugucucggccucccaaaguucugggauuacaggcaugagccacugcgcccggcucagaaguuauucuuauaauugugggagaguuauuccuauaagauuuaaggaucuugcuggguaccguggcccacauuuuguaaucccagcacuucgggaggccaagguaggaugacugcuuaaggccaggaauuuaagaccggucugggcaacacagugagaacccaucucugcaaaaacagaaaaaauuagcugggcauagugguacacgucuguaaucccagcuacuugggaggcugaggcaggaggauuguugacacugauggaggaggauugcuggagcuuaggaguucaagacugcaguaagcuaugauuguaccacugcacuccagcccggguaacagagcuagacccuuaucucuaaaaaaaaaacaaaaaaacucaaaaaaauuaaaaaaaagauuuaagcgucuucggccccaaguucaugcuuguuuguauauucucucauuggaccccagcuuguggggaaauuuuuagauuauugcaaauccucccugauuucaugagagcuuggagucccuuggggcuuuaugugaugauauuguucaaagagcucaucagggcucaggcaucugguaugcgguuuaagagacuacaaguuucaccaguuuauuugcaacucaucauacucagcuaccaaugcugaaagcagaacuucugagcaaaucuugcagcgaauuucuauuuguuccuuuaacaaaaacccaagucaucaacuauuucacggugacccaucacguaaaagcacauuuauuuauuuuugaagcucagcuuccuugaaguuuuguuuuguugccuacaaaagauuuaguacaaaauccaugaaaauaacgcaucaguguaggcuacggguauugcugccacaaaaauuuauacagucccuaagugugaaaagagcuaaaugaaaaaugcccagucugagguugaagugcgugucuugaagguauuuugcaaauuucacguugccaaugaguaaacuucucagguaccagguucugguuauggauggaaugacugcauuuaauuguccuuaguggggccuuuugagcuguucuguuaagaaaaaaaaaaaaaagauucuaauuauauccuuccuuccucgcuucuguaacugggaauccuccagagauucgagccuaccuaauuaaguuucucuuugguguggaacauguggaauggcagugauguuuauuagguugaugcaaaaguaaucacaccaaacuaguauguggaugaugccaaaaaaaaaaaaaaaaaaaaggaguguuuggggcaaagcuuaggauucuucgcuguaggaugaccaugccuccugguccguacaccccaguaucugggcaggcaggauggcaguggugccuccauccgucccaucuggcugugauuagaagcaggucuggcccacacaccagucuucuuucucuggggucccugccgcuuugcccgacagugaggucauaccuucggcacgaggcccggcuggaauucgccuggguuugucugugcaacucaaguugacacaugagguuuucauuagguggcucacugggagcgggggugccuugccggcuacacauggaacagucaucucccuggauuagggaucucgccuggauuuccuggacacggauccauccagacauucccaggggacagaauggaaggcaggcaggagggucugggauugcucaccuggccuggagccaguuugcccucaguggugggacuggcugugugugugugugugugugugugugugugugugugugcgcgccaaaugggcugaacugcucagaguuauuuuauuuuauuuuauuuuuuauagaggcagggucuuacuguguuacccaagcuggagugcaguaguaugcaaucauugaucagugcagccucaaaauccugguuucaagcuauccucccaccucagccucccaaauggcugggacuacaggugugugcaaccccacccagcuaaguuuuuuuauuauucuuugcagagaugaagucucacucuauuacccagguuggucucaaguuccuggccucaagggauucuccagccuuagccucgcuaaguggugggauuacagaugugagccacugggcacagccugaacuauucagaguuaaauaaacaaaaagcccaaacuucugcccagugccuggggucuccuccuuggcucaucacugcaaaaguuauuucuuggaacuuuaacucaguucuuuguucucuuguggucacucuuccauuucucuuucaucagccucugcagcuaaagugacuuuuaccaagcaccaguuggggaccaagauucaccuuuccuggaugccuuuuuugggggccaggaucccuccaucagcccugauucuggaagccugcagcucuuuuccaccaggcuccuugagaccuuuaagcccaauucccaagguguccuuugcaugucaggaaucgacuuccauccccugcaucguauuaguucuguaucauccuuggauucguugacaaaauagucacuuaaaggccgggcgugguggcucacgccuguaaucccagcacuuugugaggccgaggcggguggaucacuugaggucaggaguuugagaccggccuggccaauauggugaaaccccaucucuaauaaaaauacaaaaauuagcugggcaugguggcaggcaccuguaaucccagcugcucagcagguugaggcaggagaauugcuugaaccugggagucagagguugcggugagccgagauugugccauugcacuccagccuggguguccuagugagacucugucucaaaaaauauauauauaaaagaaaaaaaaauagucaaaaaauugucuccaaagcuguauucuguuuaauuuuuuuuuuuuuuuuuggguagacauagggggucucacuuuguugcucaggcugucuugaacuucuggcuucaagugauucucccaccuccgcuucccaaagugcugggauuacaggcuugagccaccacacccagccacagcugaauuauagaagcagguugagaagaauggcuucuugaagucacugugggcugugcuacacccuguguguuccccuuagcucugugguccccacagcagcuguuugggugaucucagagcuuccugcaucauucacuggggaauaaaggcuugauauccucaagaccuaagggauguauuugacugauuucugcauuuucaguguucuuuuuuuuacacuuuaaguucuaggguacaugugcacaacgugcagguuuguuauguauguguacacgugccauguuggugugcugcaccuauuaauucgucauuuacauuagguauaucuccuaaugcuaucccuccccucuccccccaccccacgacaggccccggugugugauauuccccuuccuguguccagguguucucauuguucaauucccaccuaugagugagaacauacgguguuugauuuucugucguugugauaguuugcugagaaugaugguuuccagcuucauccaugucccuacgaaggauaugaacucauccuuuuuuauggcugcauaguauuccgugguguaugugugccacauguucuuaauccagucuaucauugauggacauuuggguugguuccaggucuuugcuauugugaauagugccacaauaaacauaugugugcaugugucuuuauagcagcaugauuuauaauccuuuggguauauacccaguaaugggauugcugggucaaaugguauuucugguucuagauccuugaggaaucgccacacugucuuccacaaugguugaacuaguuuacagucccaccaucaguguaaaacuuuuccuguuucuccacaaccacacuacuaggucaucuggagugaauccagcuagcuuugcaaaugcuuuccugaaacagucgaaccaggaagcguucuuggcagcucaggggcccuccucggucucccaaagggcugggauuacaggugugagccaucaugcccggccaugagccugauccuuuaacaaucacaucagguuauugugcagcaaucuguccauugacacaauugggugggggcggggggacccuugguuaaaagaaaacucuuuggcuacagagaagucauugagcuuguggauauuugcaggagcaagaaggucugaguggaagauacaugugagaugaugaggaguuuuucccuugaaaaccugaugaaggaaguaaagucuguccuuagggguucagucaccccugucugaaugcagguggcccucaaagugcuugcaugugcagagaccugguguccucucuccuccaugugugguccagggacaggcagagucagcaucacuuggaagcauguuuaagaugcuccaacucaggcccuaccccugacuugcugaaucagaauuuuccuucuaucuaucuaucuaucuuuaucuaucuaucuaucuaucuaucuaucuaucuaucuaucuaucuaucuuuuagagacaaggucucgcucuguugcccaggcuggaaugcaguggugucaucauagcucacugcagccuugcccccugggcucaagccauccgccugccucagcuucccgaguugcugggacuacaggcaugcgucgucaccaugccuggcuaauuuuuauuuuuuauuauuuguagcaaugaaguuuugcuauguugcccaggcugguguagaacuccuggccucaagcagucucccaccuuggccucccaaagugcuuggguuacuggcgugagcuaccaggcuuggcccagaauuuuccuuuuaccaagauucccagauguuucauauacacauugaaguuggagauacccuagucugaggcacacuuugacaaauggaaagcaaacccaauuauguuuccuucuuugagagucucucuagggagugaagccccucccuagucuccugcagggagcucagugccuggagauuuguaaguuuacaaacgauauaauucacaaagccacuaguguuggugaagaacaacuaaagaaaaaugucucugcaaaugccugcauuugugaauaagcauaauuagcauuaaacucuuuuguauuucacucuguguuagugaauuauggcuugugugcuuuugaucuuuacuguggcaaguuuuaacuggguaauuaaugauaaauaacacuuguguaaugcucaccaggaccccaauaauaacccuggauaacaauaauacuagcuaaugcaugcagaguuuucaucaugggccaaagacuguucuaagcacuuuauuuauuaacuuacuuaguccucacaaaagccauaggugcuaacuauuaugauucucauuuuguggaugagaaaaaugaaguaccgagguuucuagaaacuugcacaggucaugccacuaguaagagccauaugacucuaagaucuuaaccagauagcuuuuagauauaguauucuuuuugcaauuuuaguggauauaggucacugagggugacaacaggacauugaaacucugaaaaacacacacacacgccccugagucauaaauaccuugguauuucaaaccuauaugugaauguuuuggcuuccaauugcuuuccaaaauagucucuagaaacaugggguucucaugagguuaccuuugguugggcgaaagacccuagccacuccccaaaauauccuuguaugagagcagaggaugugaauugaagacagucuuuagguuucucauuguuuuggugaagggagaauucuucagacuugcuugggacauggaaugguaguggaugaucauggcaguuccucuccaacauuccuaucucccuaagcaagucugucuucuacaguaugcccaggaagguaugccaucuccaucuuauuaacacugaccguguugaauucaaguuucagccaaugacuaacuagacuauuugagucccuucuagcuauucaagccaauauauuaaaaaaaaauucugggccaggcaugguggcucacgccuguaaucccagcacuuugggaggcugaggcaggcagaucaccugaggucaggaguucgagaccagccugaccaacagggaaaaaccucaucucuacuaaaaauacagaauuagcuggguguuguggugugcgccuguauucccagcuacucgggagguggcggcaggagaaucacuugaacccaggaggcagagguugcagugagcugagauugugccauugcacucccaccugggcaacaagaguuaaaaaaaaaauucugguaugugcaccuauuucaauaagagcagccucauccaauauuacaguguaucuucuuugauuuaacaccuagaguccauuguuacaccuauuccccagauguaagcugauugcaauucucuguucauucacaucagaccuagaauguuuccucuugggauaugccaaucugauucuagccaugggcuuagagacaaaccugguagggguagaccuugaagaaauaggcauccccuaucaaggcaacugccuuaguuguguuuauuacaggccuucauggucuucaaguugaucuugucugagcuguaagagaggacguaagggagacuuugggaaucaguuuucuaaauccaccuaaaaauuccuguucugaaucucaggucccacuccuuuuccaucaggaccugaaauuucacauaagagauuugaugagucugugauuucaacugauaauucuacagagcacacaguuaaauuuggcaucuucccugcaggguuauaagaaauaagugauuauuuuagaaccaccgcagaagcaaucuaguucucugugacuugagcugagaguuuaaaggucugagcuuguuuguucuuacaaggguguucagaagcagccaucccagcuggcaguccugguagucaucaucguuaccauaaaggucaaaccuuggagccacuuaggucuuccaaagccuuacuuuaaauaauuauuguaucccaagaaaccacagaugacaguuaauuaaucauaaugcuaaugcaugcaguagauacuaguauccccuuuucagugggcaaggaggucagcacuucauuuaagguuagaggcaagcaaaccaaucucagaaucccacuugggaaguuuguuuucucccugguacgaguguacggugccaucuucaaugcagaaaccgugcuggauuccuagaagugagauucuaugugaaauauaggaaauugcuaaaauucuucaugcuaaguaacauuuucuuaggcaggguuuaccaaaaggaauguaugagaaugccugucuuagaacauuuugaccaauauuaaguauuauaauuuuuaaaaaucauaaguaacaugauggugaaaaguggcaauucauuuugcuuuaacuaguaugugagaggaagaauuuuuuaaauauauugauugguuacccauuuuuuuccccuuugcaggcugcguacuuuguuuucagagcuguuucaguaaggauaggcuaaguuaugcugcagcaauaaauauacccccaaauagcaguggcuuaaaaccacaaaauuaaagcugucacucagacugugugucaucgcgaguugguugggucuuuucucugugacauccucacucaagaguuguggcagaaagagacuccagcccgucucuccuuccauguuagcuaaggcaggggaaagagacccggggaaucacacagugauucuuaaggguuuugucacuucuauucacauuucacuggcuaaagcaagucacauggccaugauuauuaucaaaggguguugaggaguacaacccaacuauaugcccagaagggaacaaaguagaaauacuuggugaacaacacuaaugauaacuuuagaauuuuaggcuucuccuuuuuuuuuuuuuuuuuuuuuuuuuacuagaauacaauauucauugcaaaaguuuuauugcagggcaaguucuuagaaguaccaugaagaagggcgaaacacaauuauuaugggagacucuacacauuccuuuccauuugaucaaguggauaaagcaaaguaacagaauuugaaugacacggaauguguguauauauguguguguggguguguguguguguuauaaauuuuguacccuuaaaaagagaacagcuuacuuuuuaagugauucuggaacauuaaauaaaacaugacuauguauuaggcuacaaagacaaccuaauuaaaucguaaagaacaaguaauauaggcacauucuuugacuacaauacaauaaacgagaaauuaauaacaaaaguuugaauaagaaucccacccacuuggaaauuuaaaaauuaaaaaccaaaaaccuuucaaucucaugaacagauccaagcacugauucuguggaaaagaaaagcaacaaauucacaaagauagcauauuuaauuaagaaggaaagcauuaccacuaaaauaaacuagauaugaaaaguaaauaugggagauuuuuaaaaagaauacuugauacaguuucauauuaaugcacuugaauaucuacaugaaauggaaauuuuucuggaaaaauguaaauuauugaaauugguucaagcugaagucaauagucuaaaucagaaguugcauacuugcagccuaccagccaaauacagcucauagccauguuauauuuggccguacaccauuuuauaaagcagaaaaucucacauuaaaaauauacauuucuccuguuaaaauauuggagaauuuggcaagacuagaccugcauuccuucauugcaauaauuugguggaguugaguggccauccccucuggguacggcaucugccacagucuccacuguucauuaguguucuaugccugccuacugauggacuggcuuggucucuauaggcuuuagaguuugcaacccuaccuauacagaccagcaauaagggaauauuuuaccauucuauuuucauuccucauuucccuuaauuauagggaauuaauuuuucuaguuuuuaauuuuuauuuuuuauggauauaaguuauacauauuuaugggguacaugugauauuuugauacaagcauaugaugugugaugaucaaaucagggugauugagguauccaucgccuaaagugcucacaauuucuuuguguuaggaacauagcaguugcacucuuuuaguuauuuugaaauauacaauaaauuacugggguguuuguuuguuugucuguuugagacggagucucacucugucacccagacuggagugcaauggugagaucuugacucacugcuaccuuugccuaccaguuccagcgauucuccugccucagccucccaaguagcuaggauuacaggugugcaccaccaggccuggcuaauuuuuuuuguauuuuuaguagaaagggagucucaccauguuggccagucuggccucaaauuccaaaccucaggugauccgcccacccucugccucccaaaaugcugggauuacaggcaugagccaccgcgcccugccaguaaauuacuguuaauaauaaucacccuauugugcuccugaacacuaggucucauuccuucucaauaacuguauuuuuauacccauuagccaucucuucuuaccccacacccacuacccauccuugccccuauaaucaucguucuacucucuuucuccacgaguucaauauuuuuuuuaagcuaccauagaucagugagaacaugagauauuugucuuucugcacuuggcuuguuucacuuaacauagugucuuccaguucaacccaugugguugcaaguaaaaggauuuccuuccuuuuauggcuaauauuccacuguguaaaugugccacauuuuaaaaaauccauucauccauugauggacacuuggauagauuucauaucuuagcuauugugaauaaugcuguuguaaacacgaaagugcagauaagggaauugauguuuuuguggguuuuuguuguguauuuguuaccauuucuagcuacuucaauagauuacuuauuuaaauucuuuauuauuuaauaauuaaggcaacuaggaugggaaauuggacacugagaaaagucucaguaauaucucucaaauuuuaauagacgguuuugauguuuucauuauaauauuuuauuguauuuuuaaaauucccucugcuacuucauaaauuuuauagaaaaccaucuuacaauuuaauuuccgagucacugggauuuuuaaguuucuaguuuacauuuuacuuuucuccuuucuuuuucggauggagcucugucacccaggcuggagugcaguggcgcgaucucagcucacugcaaucucugccucccagguucaagcaauucuccugccucagccucccaaguggcugggacuacaggcaugcgccaccaggucuggcuaauuuuuguacuuuuuuuuaguagacaugggguuucaccauguuggccgggcuagucucgaacuccugaccuccagcgaucugcccaccuuggccucccaaagugcugggauuacaggcgugagccaauuuucuauuuucauugcauuaugcaaaguaaguauaaccugauauuugcuaagauuuuucucuguaaccaagaauaagaugaacuuucaugaagguacuggcucuaugcuacaaggcuuuuuguaugugcauagaaguuaucuucacauuacccaugugccuuguagcccuauuuuugguuguuuuguccaagauaaauuauugugauguauugauguuauguuacuuccuggauuuacuuccaacaguuuguauuuuaauuuucaaugcucuguccucauaguggauuucaccuuuuaucagugcaaauguucuuuaaaugcuuuugaguccuguugauuuuugccacauaaccuuuuugcuuguguuugcauaacauuuaucuuuaugcgcaguggucacugggaccguucacaauuauucaguuucuuuuccuuccaggaauacgguacacgaugcccuaccuuuuucugugauuuuguuaggggugaaacuuuuacccaauaugugugauuauguugucauuuuuaauuauucugagagcccuuuuauugguacacuuagccuuuuauauuuauuucacauuaaggcugagucuuaauuccgucauuuuguuuuguggggguucuccuguguaccuaguaugaaguuauuauuuugugacuacgguuguguuuuucuuuuuuauauuauccacccaacuguguggaagguagauaucuuacuuuuacccucuuuagugauggccguaaaauuuuuugugagauuaucucuaacagcuaauaucaguuacaaaugauuaauaccuuuuuuauggaagauaagaaauuaaauguuaucucuuucucuuuucuguucuuuguuaauuuuaauguaaggugguuauaaauauguuccucccauuuuuuacaacuuuuauuauuuucaauuuaaaaaauaucaguuuuauaauaauauuagaaacacuuaucuugucucuauaucugucuuuagugcuuacucucagcuauacuuaacucguuuucuguuucuuauuuuuaauuaauauauauuuguucugacauaaaguuucccaaauuucauuuuauuuuucaggaagucuacuucaagcauuaauccucuuaguauuaaaucugagaauaucuuucacacauauucauacagaucugagaauaucuuaacacacauaaacaaauggguuagauaaaaaauucuugggccguaaccuccuuccuuccuucccuuccuucucuuacuucucuuccuucucuuccuuccuucccuuccuuccuucuucuuucuucuuucuuuuuuuuuuuuuuuuucuugagauggagucucacucugucucccaggcuggagugcagugguaugaucuugguucacugcaaacuccaccuccuggguucaagugauucuugugccucagccucccgaguaggucggauuacaggcacgcgucaccaugccuggcuaauuuuuguauucuuaguacagaugggguuucaacauguuggccaggcuggucuccaacuccugaccucaggugauccaccugccugggccucucuaagugcugggauuacaggugugagccacugcgcccggcccauaacccuuuucuuuugaaggucuacgagugcuccuucauuauuguuaggguuuaauauuguuaaguuugugauaaccugcuuuuccuuccuugugaauaaucuaauuuggcuuaggauguaaucauuauccaggaaguuugaaaaugucaccaguucauauucaucuguguguucuaguagugguggugccugguguuauguuguuguugugguuccuuggaauaugauucacacucucaguuuuuagagacagggucugacucugugucccaggcuggagcgcaguggugcaaucaaagcucacuguaaccucaaacuccugggcucaagcgaucuuccugccucagccucuagaguagcugggacuacagacgcgugcaaccacaccuggcaaauuuuuucaauuucuuuuugguagaggcggggucuuacuguguuuuccaggcuguuuccaaacuccugguuucaagugauccuccugucucugcuucccaaagugcugggauuacaggcgugcaccaucacgcccagcguacacucucaauuuuuagaccgaguuuucuuucuggaaaacauuuguucaacccuuuuuuguuuuuugcuuuugcuccacauauuucaaucucucuuacuagccuuauccacagcuuagauccugggcuauggccuuccaauaccccucauagcuguucuuucucuauguuuuuccucagccuuuuauauucucauacauauauuuccugcuucacuacuuggagguuuuccagugaguagucuacugaucacuggauuucauuuuuguaacaaugcuuucuccucucuguggaauuaucucuugucgcuuuucuaaucuggcugaugugacaucuuuuaguuaguugucgaggacauaaacuagauacuuuucuaacacucuuugguggaucuguuuuagagcugggcaguugcugagucagacgauugauuggugguggcugccucagccucccaaguagcugggauuauaggagcacaccagcgugcccggcuaauuuuuguacguuuaguagagacaggguuucaccauguuggccaggcuggucucaaaccccugaccucgugauccacccgccuuggccucccaaaggcauuucuuguaguaacaaaaugcucccugagguucugggucugugcuaugagagguacuucuuauuuuucauuucuggccuauuucagugggugaaacauuuagaucaaaacaauaguaauuguuauuucagacgcucuuuuguuucugacuuuaauaguacuguuccccagaguucugaguuuaaacuugaaaauuacaucgauuguugucugagauggacauuauuuauuaugguuaggguaauaucuuacuuguaguuuacccuuuuuuucuuuuuaagucaguaacaacuuugaguaacuuuuugacgucuauugagauaaucauguaauuuuuauuauuugacuucaugaugaagucaggucuuuucauuauuugacuuuuauuauuugacccuuauuuaauugaauuuacgauaauugaaaaacugcuacaguucauggauuacuucucuuuagcugagcuucucucucuauauccuguuaaguuugacuauuuuuuuauuuuuuaauuuagguuuugcaaauauauccauaaaaauaauugggccaggugcaguggcucacgccuguguaaaaaucccagcacuuugggaggcugaggcagguggaucacuugaggucaggaguuugagacaagccugaccaacaugcugaaaccucaucucuaccaaaaaaauacaauguagccaggcaugguggcacgggccgguagucccagcuacuugggaggcagaggugggagaaucgcuugaacuccagaggcagagguugcugugagccaagaucaugccauugcacuccagccugggcaacagagcaagacuccucucuaauaauaacaauaauaauaauaauaacaacuacaauaauugauccauuucauuuucuuuccauuuucagguuuuuaauaccaggguuaggcgaaauguauaggguauuugggacuuuuccaucuuuuuugcacuggaagagauuacauaauaaccauuuucgaguauuugaacacauauuucugugaaaucacaugaaacuuaaaacaguuuaggacaguucuuuaacaauauuuaguuuaugucacguucauuaauguacacaagugaucauuuucuuuaguggauccaaugaucuauucauuucagaaaucacugauuucuuuuggauuucauauguauuaacauaaauguauacuugccauucuuuuauauuuuaauguucuuuaauucuguaaauauaucaucuuugagaucucuaacuuuauauauuuuuuuaucucuuuuuucguaaccugacuuucagaugauuuuccuuauacaucuauuuuuacccagagaauuauaucacugucuugauuaauagugguguuaggucaauuuuuggagggaagauuugcauuguggauuuuaauucugcuaggaguuauucuaguuuguuguauuuuuucuuuguuuucuucagccucuuuuucaucucagccuguaccaccugauuuuuuacuuuuuaagugagacauaauucaaauaccguaaaauguaaagcucuugaguucaguuugaugaauuuugacaauuauaaacagcaguaaaacacuuauuccaauacaaaguauaaaacauuucuauuaccccaaguagucccuugacaaauaauuuuucccacucuguggcuuacauuucaugucuuaauauaauaaccccuccuuauccaaggggcauaugcccuaugagcuucauuagaugccuuaaacugugcauaauaccaaacccuguauauacuaugcuuuuuccuauacauaaauaguuauaauaaaguuaaauuuauagaucaggugcaguaagagauuacaauaacuaaugauaaaauagaacaaucuuaacaauauacuguaaaaaaaggaugugaaugugauuucccuuucugucaacauaucuuauuauacuguacuccccuuuuuaaaauauuuuuaaaaaauuuguagagauggggucuugcaguguugcccaggcuggucugaaacuccuggucucaagcaauccuugcaccucagccucccaaaaugcugggaucacaggcuugagcugccauguucuucuugugauaaugucagaugauaaagugccuuugugaugagauggaggugaauggcgugggcauaaugacauagcguuuggcugcuauugaccuucugaccguaagucagaaagaggaucaugugcuucggugauccuggucaucauggagccaugacaaugucaaaaguagauggcagcagugacuaacgggcagguaguauagacagcuuggauaugcuggacaaaggagugauucacgucucuggcaaguuggagugggauggcaugagauuuuaucacgcuacucagaacagugugcaguugaagacuuaugaauuguuuauaucuggaauuuuccauuuaauauuuuccaaccgcaguugaccaguuaaccaagggguaacugaagccgcagaaagugaauccacaggugagggggaacuacuguaguaucuuuugaugagcagacauuugaaacuuugauuaaauccaguuuaucacuuuuuucuuucauguucaguacucuuugguuccuguugaaaaaaaucucugccugcaucaauguuacaaaaguaucguaaucccagcacauugggaggccgaggcggguggaucacaugaggucagaaguuugagaccagccuggccaacauggugaaaccccaucucuacuaaaaauacaaaaaaaugagcugggcaugguggugggugccuguaaucccagcuacuugggaggccgaggcaggagaauugcuugaacccgggaggcgcagguugcagugugagccaagaucagcccacugcaugccagaaaaaaaaaaaaaaaauuuuacuacauuuucugcuggaagauuuaugguuuuagcuuuuacuuuuaggucugugagccauuagaaauuaguuuucauauguggagugugguagaaguugagguuugguuuccccuguacaaaguuuuaguuauucuaaguguaaucuguuuuguuuuguuuuguuuugcuuuuugagauggagucuuacucuguuacccaggcuggagugcaauggcgugaucuuggcucacugcaaccucugccucccagguucaagcgauucuccugccucagccuccugaguagcugggacuacaggugcacaccaccaugcccagcuaauuuuuguauuuuuaguagagacaggguuucacuauguuagccaggcuggucuugagcuccagaccuuaagugauccacccaccuuggucucucaaaguacugggauuacaggcgugagccaccacacccagcgauuguuauguaguaugucuuucccauugacugucuuuaagguuuuuuuugcaaguuuuuggcagucugugcuguacuuagauaugguucaagcgauucuccugccucagccucccaaguagcugggacuacaggcauaugccaccaugcccagcuaauuuuuguauuuuuaguagagaggggguuucaccauguuggccaggauggucucgaucucuuaaccucgugaacugccugccucggccucccaaagugcugggauuacaggugugagccacugugccuggccuauauguauuuuuuauuccuugcauuuucauuuauuuuuauuuuuauuuuuuuuauagaugaggucuugcucagccacccaggcugaagugcaguggcaugaucauagcucgaugcagccucaagcuccugggcucaagugauccuccugucucggccuuacaaagcacuaggauuacaggcacaugccaccucaccuggcugauuuuuaaacacaauuuuuguagagaugggggucucacuauuucuuuuuaaauaauuuccauaucucugcucaaacccccaauuuguucacauuuuguauuucaccaugagaucuuuggcacauuuaucauacuuauuuuaaauucugauccuuacaacaucuggaccaucuuuuaagucugcuucugugaaauuuucucuugcauaucagucacacuuucuugcaucuuuuuuugagacagagucucugucuguuucucaggcuggagugcaguggugcgaucucggcucacugcauccuccgccucccaggcucaagcgauucucccaccucagucucccgaguagcugggauuacaggcgcccgccaccacaccuggcuaauuuuuguauuuuuaauagagacaggguuucgccaaguuggccaggcuggucucgaacuccugaccucaggugacugcccuccucagccucccaaagugcugggauuacaggcaugagccaccacaccuggccugcuuucuugcaucuucucauaauuccugauugaaugccagauacugcauguaagaaaacccugcaagucuaaaauaaauaaaaucuacgcaccaaagaauggcagaacccuccugccaggcacuggagucaggcuuucacgcaauguaauccguaguugaguuggauaggaguucuguuacagcuuuaguugaaguugguucacagcaacuucaaagauuucgaggguaacaucaggacuuucuguuuugcagagcuugugaugcgagcaaugagaaaacucugcagaugucuuuaugcuuuauaguggagcugccaagcuuucugaaccaugcugacauuuugcucacugucuuuuucuguccaguuccaccaugguuuucuggguuuucaggaggucuccuuccauucuguuucuaguccucaaagagcaggugcaggagggaccucagccauggagggagggucucagagggauuucccucagcucuccugcccuauccaaccuucaccguacuaacugccugcacccaguuaaggucuaaggacuaaaguagugguggguacagcaugcuguuccgcugcggcauuuuggaaugugacucugucacagcagcuguuaaaaguuuguuccggcggagcgagguggcucacaccuguaaucccaacacuuugggagggugaggugggcagaucaccugaggucaggaguucgagauaagccugaccaacguggugaaacccugucucuacuaaaaauacaaaaauuagccggcccgguggcacaugccuguaaucccagcuacucgggaggcugaggcuggagaaucgcuugaacccaggaggcagagguugcagugagccgagacugcaccacugcacuccagccugggcaacagagcaagacucugucucaaaagaaaaaaaaagguuuguuccagguuaggcagccuccucuugaagcccaugucuaccaugaaugaaaaccucugggagccucuucucugcuaggaaggacucaucacuuugcagaauuuaucuuuuuuagauuucuuuauuucuuagcucuuugauggauuagaaagauaaaucaggcucagcagagguaucugggguaggagagaugcccgcuccaauuaagaagccaucuggaugaguucuggcuaguccagggaggagcuaauggcuguucucaguagguuucuuagcagggcucauaccuguaaucccagcacuuuaggaggcugagacaggaggaucacgugagccuaggaauuugaaaccagccugggcaaccuggugagaccucgucucuacaaaaagauaaaaacuagcucggcaugguggugcacaccuguagucccagcuacucaggagguugaggagggaggauugcuugaucccaggaguuggaggcuguagugagcuaugauugcauuugggcaacagagcaagauucugucucaaagaaaaaaaacacacacaccaaaaacaaacacacacacacacacacccuaugauuuugcaucuuaugccaacuguucucauuguuggggugagggagauagggucuugugacuuccugcaauucuaaccguaauugaauuuccccuaguuucuuuuggcuugucuuucacaguucauguuuucuagaaguuucugcuaacauaaccuagacccuuucuacuauguuucuuuugguuucugugguacaguuugugucaagaguaugcuguuucugaagaugguuuuuuccauagcaaaauccuucacacacccugcagauagaaugcucucacugcuguacaucaguccuuaaaugaggaacaaauguccaggccugacaugaucaauugcgaaaagugagcgugggugcauuguccucagcuaucccucggaaaguucucauuugcaaaucugaaaccaauuccagauuaggcgaagggagcuuuaagaaggucacuggauugggcccggauacuagaccagcaacaaacagggacaagcugaaaaugcaccuaagugucuccaguauccuuucucuguaauacgcacacuaacacgaucucaaaccuguugagaacagccaucagcuuccccugggcuaguaaaagagugguuugcugaucuuagcaggcgucuuucccauuccagguaccucugcccaguucucugaccuaucagagcauacagggugcguggugccuuccugccuggagucuguguggaaacccaccccuccuagcacaccuuguucagcaggcacuuccucauucuugugcugacagcuuuccuuuucugucaaauaccccagggcacaguacacuagggacugucuuauccugcuucuacccucuacaccccacauucacaauuaacaaccagcuuguucauuccacagacauuaguugaacacccucuaugugccaucccaggcacuuggcauagauccacaaaugaaacaaacaaaaucccucccucuguguguuaccugccagguccgggucuguucugccugcacgcaguaaaucaaucccugugacacggguuuugcaaaagagaaaagauuuauuugcaagggcacggagugaggaggcaggagaacagcugccaaauccacuuccccaaagauaaggcuaaaggauuauuugugaguuaggcaaguggggugguuuuaaggcauagggaaaagugauuagugguggggaaaaaaaugaaguaacagguucguucugcacagguguaguuggguucauggcauuucauaggacauguuuacaguaaacguggcauuaguaugaucugaaggugggguuuuucacccacugaugucaaaaggcaaccucuugggccaggugcgguggcuuacgccuguaaucccagcacuucgggaggccgaggcgagcagaacaccugagguuaggaguucgagaccagccuggccaacauggcaaaaccccaucucuacuaaaaauacaaaaauuagcugggcaucguggcagaugccuguaaucccagcuacucgggaggcugaggcaggagaaucauuugaacccaggagguggaggcugcagugagccgagaucacgccacagcacuccagccugggcgacggagugaggccuugucuccaaaaaaaaaaaaaaaaaaaaaaaaaaggaaaaaggcaaccucuugggcauuugcacaggccuaguugaagggccagugguuucagugagucugaacuggucaggagcuggcccaaguuccuaaaaaacaacagaagcgacuacgaccauggugacccagaaauguaggaaugaccuguacaguagccagucuucacuuaaccuucauuaaguuucagcauuuauuagguuggugcgagaguaauugcgguuuuugccauuacuuucaaaauggcaaacaccaauuacucucguaccaacuuaauagcuguguggccgugagcuacguggcaaaaggaaaaguaacaaaaauaauaaaaagcaaguggccaaaagcaagcaggucaggaagaccuggucaaauuaacaccuugguuuuauauggaguuuauauucuagugggaauagacuccucuuacauaucuuaacucgauguuauccacacaguaacccuaggaaguagguucuuuuauuguucucauuuccagaugagaacacggaagcacagagaaauuaagucgauugcccgaggucucccaguaugaucugaacaaugaugucuuugcuuuacucggcuuugcauccuugaagguccucagccauugugagcuuugcauccuugaagaauucacugagcuugguucucuauuagccuagaauagagccuggcauuucguaaggaccucauuucaaaaugcgaaacugcagcagccgaguaaagcaagugcucaacaggacugacuuccaguacagacgggcagcuuccuuucucaucuuugucucccuggcuguuuuuuguuuguuuguuuguuuuguuuuuugagacggaaucucacucuaucacccaggcuguaguucaauggcgugaucacggcaaccuccaucucccagguucaggcgauucuccugccucagccucccaaguagcugggauuacaggugccugccaccacgcccaacuaauuuuuguauuuuuaguagaggugggguuucaccauguuggccaggcuggucuucaucuccugaccucagguggucugcccgccuuggugaccucccaaagugcagagauuacaggcacaagccacugcgcccgacccucccugacaguguucuuacucagaaggcggaggggcccuucucgguuccucuccugggcaguagaguugcucgacaaucugggaaucugggcuucaguguuugguugucuccaguaucaguuacuguugccaguuuuugucuguuuauggauuuucaugggcauuuuaauuaggaaucaggggaggagaagucagauacugcucaucugcugccagggacagcuugcgagucucugaggccuuacuuaagacucccaacuacccaagaggaccaaaaacccacugcuugugauaaaagugauggcugcaguuuucccagagggacccagaguacaggugggaucgucguauguguuuuugguuaauccucauucccuucucgggguagcugcagaguaaaccacucuaugaggauaccacccaaaauaaucauuucucauggggagcucugaaagcaaacauuuauucaaaaauuuuaccaaacauaugcuuuucuaacacaccacuccucgcuccccuaagcuuccaaaagggcaagcacuuggaacaacuggcaaaugaugaauagauucuucccucauuuacauaccuagucauuagccgggauugcuauggcaacuguaccuuccagacauagaccugugggccuagcacaacuucauuuuggaaacugucuagaagccuugugcuccucucucagcguuugacaggugaggagaauuucagggggcaggaggagccucgauguuuccaacagucuguaagugacaauuaucagguaccuggcauagaaaggaaggaaagcaucuugcuggaaaauagucugcaaagugauggcuuugguuugcugacugccucucuugucccugggagcacgaugaucaaaugcaagcacaauggguguggucuuauuucaccagugucauuuguccccuuggacacacaccuaucugugugagauccugguuugcaaacacauauacacacauuccuauagauuuuguccagggaaaacaagacuccuuugaagagagacagggguugggaaaaggaagagaauaaaaaagagagaaaagagcugggcacaguggcucaugccuguaaucuuagcacuuugggaggccgaggcgggcagaucacuugaggucagaaguucgagaccagccuggcuaacauggagaaacccugucucuacuaaaaauacaaaaauuagcugggcgugaugguguacgccuguaaucccagcuacucaggaggcugaggcaggagaaucgcuugaacccaggaggcagagauucaagugagccaagauugugccacugcacuccagccugggcgacagagcgagacuccgucucaaaauaaauaaaauaaaauaaaauaaauauuccuucuuugccccagcuaguguccuccuguuugauuucagaacugugaauuccaauuuuauuuuuuauggauacauaauauuugcaaauacguauggaguccuggugauguuuuguuacaugcauagaagguguaacggucagaacuaccauaccacccaccaaugccacuacuacuagguauuuauccaaaggaaagaaauuuguguaucaaagaaauacuucucccuugguuuugauucuugguuuugcuguagcaagaggcagagaaagagguaccacugcacuccagccagggugacagagcaagacucugucucaaaaaaaauaaaaaauaaaaaacaaaacaaauaaauaaaagagagagaaaggauacuggagacacuuagaacgauguguuuucaacuuguuucuguuccuugcuggucuaguauccuggcccaauccaguaaccuucucaaaguucccuucacccaaccuggaauugguuuuagauuugcaaaagaauuuuccaaaggauaggagauagucucugaggaguggcugcccacuacuguuuucauucuggagaagugggugucaacuggacagacagcaggagggcaugucuuugcuuuuuuuuuuuuuuuuuuuuuuuuuuuuuuuuuuuugcuuuuuuuuuucuagacggaguuucacucuuguuccccaggccagagugcaguggcgugaucucggcugacuguaaccuccgccucucggguucaagcgauucuccugccucagccucccaaguagcugggauuacaggcaugcgccaccacaccuggcuaauuuuguauuuuuaguagagacgggguuucuccauguuggucaggcuggucucgaacucccgaccucaagugaucugcucgccucggccucccaaagugcugagauuacaggagugagccaccgcaccuggccugcuuuuuuuuuuuaauuuuuaauuuuuuaaguuccgggguacaugugcaggaugugcagguuuguuaccuaggugaacgugugccauggugguuugcuguaccuaucaacccaugaucuagguauuaaguccagcaugcauuagcucuuuuuggcuguugcaguuucacauuuugaaaugagguccuuggccacugugagcuuugcaccccugaagauuuucacugagcuugcuucucuauuagccuaggacagagcuuggcauuucauaggugcucaagaaguauuuauggaauaaaugaauuggccucaucuguccugggcuuuauccuuccucuccuccugacacccccucucccccaugcccaugagugccuaugcccugugccccagagagacauccacucucagauccuugagaacuuuuacccuuccuccccagcacauuuguucucucugcuguuuagcuuccccugacacccagaugucucuauuuguugaaaccuaaccucccauggccugagggcuuugaagauagggcagggggccagaugcagcuaucagacaaaaggagcaaacuugacagugagaagccaccagugucacagggaaucugaauacgcuggugcagggauggagcugagcagggccaggguugggcuugagcauugucacccaggccaagacagggacaaagcuggucaacacaggcuggaagaggagcauuaauuucccacaaaguguuuacugagcacuuucucuguggccgucacccuucaggguaggcuguagaguaaggcacagguucaaccgguagacagaaaacuacaguaaacuagguaaguuccaaaauucucuaaagauagagacuuuguuucagcugaacuaaaaggugagauguuccagccuaugcauuuuaacuuucagccugauugucuuuauuccugcuugaggugguuaaucuuaugugucaacuugacugggccaccggguucccagauauuuggucaaacauuauucuagauguugcugugagggugcuuuaggaugagauuaacaguuaaauagguagacuguguaaagcagauuaucuucccacuagugggugggccucaucuuaccaguugaaguucugaacugaacaaagggcugaccguccccugacuuagagagagcuccuccugccugacugcuucagcugggaccucagucuuuucuugacuuuggacucaagcugaaaucuuggcuuuucuugggccucagcccuccugagacuuuuggacuggaaugacaccaucagcucuccugggucuccaauguggcuagaaguaaugcuuccauucuuuguuuucauaccauuuaauuaauaaguuuuugacuucuguuuauuuauagaucuuaucucaugagacuauuaacuucuucgaagugugaucuacuccgauuuauguuugguuccccagguucccagccuaaauguccuacacaugguagacaucucaugaguauuuguugauuaguggaguaagugaauguuugugggcuuggcaaguagguugucagggcacugaaucugaugccagguuuccuguaaaagggguagauuuggggccaggugcaguggcuuaagccuguaaucccaacacuuugggaggccaaggugggcggaucaucugaggucaggaguucgagaccagccuggccaacacggcaaaaccccaucucuacuaaaaauacaaaaauuagucuggagugguggugggugccuguaaucccagcuacucaggaggcugaggcaggagaaucgcuugaacgugggaggcagagguugcagugagccaagauugcaccacuguacucuagccugguugacagagcgagacccugucucaaaaaaacaagguauauuugcucaucuguuaauggcagaggggaacuggucacaaagagucauugagguggcccugagagguccugccgcuaugacuagggcacuguguuuccucugagaccuauaucagacugugucuucucucuggaaacauuuucguucauggguccaauaugauauuuuucuucucugaacccaaaacaugaucuuuuauaucuccucacugguucgcuuucucaauuaaucaaccgaaggcugguuuugacugucugaucuagaaagacuaauacaguaguuuuguucauguuuuaaccugcuauacgaugguuaguuucuucagggcagagaccugacacuugauucuccccaguucuuauccgacuccuugcaccuaauaggugcugaucaaauauuuauugaaagagggaccaggccaggcaugguggcuuuucccugcaaucccaacacucugugaggccaaggcaggaggauugcuugagcuggggaauucaagacugaccuggacaacaugguaagaccucauuucuagaaaacaauuaaaaaauuagccagucaugguggcauacacagguagucccagcuacucaggagguugaggugacaggaucacuugaguccagaaaguugaaacugcagugagccauguuugugcugcugcacuccagccugggugacagaaugagauccugucccgaaaaggaaggaaaggagaggagaggagaggagaagggaggggaggggaggggagaaggaagacaggaaggaaaaagacagagagaaagaaagaaagaaaggacuaaaugcagcccuaauuccacacagauaaacacuuuuauuauuccccuccccuuuuucuccaggcugguguuuaaucaccacacuuguagucugaaauuguagguuuuugaagccacagaaaagcaaaaggaaagcagaucuuacuggaggcacuacaacuguuuuuguuuuccauuuguuuauuguguaaaauaaacauaauauaaauuuuaccauuguaaccauuucgaaguauauaguucaguggaaauaagcaaguaaauauuguuuaauaagcaucacuacuguccaucuucauaacguuuuucuucuuggaaaauugaaacuguacucauuaagcaauaaccccauucucccuuccccccaguuccugucaaccauagacacuuucugucucuaugcauuugacuacucuguaaguaucucauauaaauggaaucaugcaauauuugucuuuuuaugaguggcuuauuucacuuaucauaaaauccucaaguuucucccauauuguagcacaugucagaauuuccuuccuuuuuuagauugacugauaaguagguaauuacuucugucauucaccuauuuguuucccaugugucuuaaagcuuuuuguccaucauuuccugaauugcugucuucuuuuguguguagugaucuuuuuguagugaaauauuuaaauuauuuucucauuucucuuuuguauauauuuuaugucuauuuucuuuguaguuaccauggggauuauauuuaacauacuaaaguuauacauucuaauuuggauuuauaccagcuuaacuccaauagcauauaaaaaaugcugcuuuauaacuucauccccacuuuuacauguugaugucacaaaauuaccucuuuauacauuauaugggcaaaacuauaaauugauaauuucuuuuaaaaaauuauuaaccucuuaaauuguguagaaaacaaaauguagaguuacaaaccaauguuacaauaauacuagauuuuauaauugcccacauaauugcaccauuuuuuugugaucuuuauuucuucauaucgcuucaaguuacugucuaguguccuuaaauuucacccugaaggacucccuuuaguaucuguugcagggcaagucuagugauaacaaacugccucagcuuuuguuuaggaaugucuuaauuucucccucacuuuugaaggacaguuuugcuggauauuggauucuugguugacaggcuuuuuuucuuauagcacauuggcuauaucagcccacugccuucuggccucuaaaguuuuuggugagaaaucugcucauacucauguuggggaauuuguguggaaauaugcuucucucucaccacuuucaagauuuucucuuugucuuuugaaaguuugacuauaguaugucuugaugugggucucuuugaguucaucuuagaugaaguucauugagcuucuuggauguugauauuaauaucuuucaucagauugggggaguuuccagccacuauaucuucagauauuccccuacccuuuucucuuucucagguuuccauaauguauauguugguccacuugaugaugucucacacauacuuuauguucuguuugcuuuucuucagucuuuuuuuccuucugcucugaagaagugauaauuuccuuuaagcuagcuucaaguucacugaucuuuuuuuccuucugccugcucaaaucacccaucuucuuuauaacauuguuuucuugacuuucucuaugucuuccuucuuugagcauguuuaagacgguuguuuuaaaguauuugucuauuaauuccaccaguaggucuuuuugaaagacaguuuuuguugauuuauuauuuuuuccuuugaauggaccauacuuuccuguuucuuuguaugucuugugacguuuuguuagaaaacuaaacauuugaagcuaauaauggaguaccucuggaaauugaauucuccccauucuccagcauuuguuguuguuuuuguuuguuuuuuaauugucauaggcugucuuugggccaacgaucaguuugagguguaaauguaaggucuucucaggucuuuucugagccugcaccuuuucauggauaugcaugauuuuuuuuucuuauuucuccuguaugugugauugcuuuuaaauaucuuagucuuugaugucugacuuccaaaagauggaaagagaaaaaugaaacgggggaaaauagugcugccucuaaauccucuggaaaucauuucagcugcagggcaggguugggggugggguggagcuuauacaaugggcagagguguagcaacaguggccccugccucuuugucugcaccucucuggucagagcacggaaccccuauauuuggaggacagggugcuuuuuugcccaaccugauuccugcuggcugcaugcaagcugcuccaggaacaugugcacaucucccugccaugggauugggaguaggggauggguagcggcuacugugcuaagagcugaaauugauggaaauuaacugcaauuuaccaaccaagccuuucccuggaaguugcaagccuucaauagccuggaauuucaaaauagucacacaggacaaauucugccagcaugauuguuguccagguggggaaacagauuccuagugcucucugcuuugccaucuucuccauccaguuuuguuuugacuuucugggugaacucaauuaagccuuugcauuggaagcucuucuauguuauuucacagcaggccucaugaaccaaauguccaauaggacuuaagaaauugaauuauagacaggggaggagaccuuauaaaaacugcaaaguuuggucccuucagacugaaguggcaaagucuaacagggggacgagauuaaaaucuauaauguuguaaguacagagcauucgcccagaaucauaugucagauuuggaaauuaauaccuuguggucccuuuugccuugaaugagaaguuuuggauacaaaauuaaauccuaauucauaaagccacaauaaagucagggaacucuucauaucccuugaagaagaacgaagugggagaaauaaauaaauucuaaaagggcccaagcagauucaugaaucaccaauaauuaugaagagcagguggaauauauuuaauauuugagguugccaucaggaaggagaaccuagcugagucucugagguuuccguaaacaacagaaugcugggccaggcagagccucauggaccugcagcaguuggacacauucucugacucaggacauaccucauauauucugccuugcuccugaggaagcaauguaaaagcgaggaccuagugcaacuuuucuuuuagugcaaguuuuuacguuuugggagagagaaagaugggaaugccauaaugauucugcauucccaaaggcauuucaccuuccucugcccucccuuuucauauguguuguuauaguugacugaccaaacuaguuuugacagagaggcuguuuucuuugcagugacaaggauuuuuccuaaagcaauuagaaaauauuagguagaauagagaauaggauggaucaaggcuagagggaguugccuggagacugucaggcucugggaaucucucucuucugugccccauagaguuuggggacagauguuguucuugggaagggacacuccuggugaggaccucaggacauccccaagaggucauaguugggcucucccucccuuuucugacugcuuuugcacucauuaugccacuuauguaacacuuuacuuuauucguaccaaauacuguugcuuaugcauaaaccauagaauccuaguaucucaagauagagggagauuggguagggguaugguaggcugaaaaauggccucccaaagauaucaagcucucccucuuugaacuuguaaauguuaccuuauuuggaaaagaggucuuugcaauccuuuuuaaguuaaggauuuggggggagauuauccuggauaaucaggguggguucuaauugccauccuguaucccucugcaagggaggcacagggagauuugacacacagagaaaagaaggccuugugaagauggagcagagauuggagugguguagccagaaaccaaaggauacuggagacaccacaagcuggaagaggcaaagaauuuaugcucccuagagccuccagagggagugcuuuagauuuggccccagugauacugauuucagacuucuggccuccagaacugugagaucauucauuuaggucauguuuuguuuuuuuaaagccaccaggugggugauacuuggcuacaacugccucaggaaacuaguccaagaugucaccucauuacacccauccaccaaggccagugucccauuagguuggugucugccugagcagcggggacccauuaccuggcugugacaucucauccugaggucagaguucugacaguugcagugguucuccugaagucugcgauuccgcacggacgucuccagccacuuugcagugucacuugcccucucugugugcacuggcaucugcuccucuggauggccauccaaauuguucuugaugggaaagcaauuuucauuguacucaaaagcaguucugaacucuccugcaacuuagaaucagucuauaucuacuuccaaguguuuucaguguaccuauuuccuccaguuuuuccaccguccucaaucaauaagauaaucacaauaauaaaaauggcauuauuuuacaucuaugugaugguuuaaccauuugggagauuuuuucuuuaaucaucuugugucagguagcuaagugaguauuauuaauccaacaaaaaauaugcaaaaugaggcccggcccagugcgguggcucaugccuguaaucccagcacuuugggaggccgaggcaggcagaucacuugaggccaggaguucgagaccagccucgcuagccuggugaaaccccaugucugcuaaaaauaauuuaaaaauuagcugggcaugguggcgggcgucuguuauccuagcuacuugagaggcugagacaggagaauugcuugaacccaugaaguggagguugcagugagcugagaucucgccacugcacuccagcuuggguaacagaguaagacuccgucucaaacaaacaaacaaaacaggaggcccaaagaggaggaaugacuugguuuaggucaauaagccaugauuacaauccaggauuuguuuaacuucaucaugguugauaccacugggauucaaaguggugugcguguaguuaaaggguugugggaaaaauccauugggguauaaaaagaaaauauuagaaccuucucguaucuauuucucaucuaaaauuaagaauagaucucuguuaauauuugaugaguaaauaguguauguauauaauuugcgaauaaaugaaugucauguauauuuuaaaaucuuuugcugguggaggugcuugcauuuaaaaaguagggaaauugcucuccccucacccugccccaucguuguucauuuuagccaagauugacuauuuaagcuuuaauugaggaugauauuuaugcauuaacacgugggcacaaauugguuggugauaaugagauugcugaauuaguuuaguuuaccucauuaucugguagccaagccagacuuguaaauaaugacuaagauacaaagcacacagaagcagauacagagggaauaacuuugaaaaauuaaaacauucugcaaaguugcaaggccguguagaaucagcugacuuuccuugccugugacuccuuccuggucuguaucugccaccaaaugcagaugaagaggacagcagaagguggucugaggucagcccuugcuggaccuggggcccaagcauaccaagugccgcugcccagguacaugagagaggcaugccauucgguggaucagcagucagcucacuggacuccuccuuagcauagcgauugguuguaacuuauugacagauuccccuauaacuuuuuauugagagauagcugauuuuuuuaaauuuuucuuuauaagauacugcuuuccagagugcucuggaggcuugagagagucauagaaaaauuauggaguggcugagagugguugcucaugccuguaauuccaacacuuccggaggcugaggcaggaggaucauuugaggccaggaguuugagaccagccugggcaacauagcaaaaccucgucuguauuaaaaauaauaauagaaaaaauuggcugggcaugguaauauagcaucuguagucccaguugcucuggaggcugaugcaggaggauagcuugagccuggaagguggaggcugcagugagccaugaucacaccacugcacuccagccugggugacagagagagaccuugugucuaagaaaagguauggagaaaccuauuuuggcucuguagaugucaggcucuaccuaaauuucugccucuauuuucccaucucugcgucacuugaccaaaacauggaagaagccuuuccuuugauuucagacccauccuacuuggggaguaaguacuuaagaauuauaguuccagcugggcgugguggcucacaccuguaaucccagcacuuugggaggccgagguggguggauugccugagcucaggaguucaaaaccacccugggcaacaugguaaaaccccaucucuacuaaaauacaaaaaaaaaaaaauuagcugggcaugguggcacgugccuguaaucccagcugcuggggaggcugaggcgagagaauaucuugagcccaggaggcagaaguugcagugagccaaggucgugccacuguauucuagcuugggcaacagagugagacucugucucaaaaaaaaaaaauaaaauaaaauagcugggccugguggugcaugccugcagucucagcuacucagaggcugaggcaggaggauuacuugagccaaggaguucaaggcugcagugagccgugauggcgccacuguacuccagccugauugacagaaagagacccugucucuuaaaaaagagucauacauauaguagcugucuacaaaggcagaucgaagcagguacgguugcauuugguuguaaagcaguaagcagaaagggacaguugguuccuggaaacauucacuuuuaucaaaaaaaaaaaguacugaaaaaaaggaaaaugagugccuuagacagagugaaucuggauuucaccaaagcauuugacaaguuuacauugacgaauuugguaugugugugguuaagauagaaaaauaugagcuggaugcuacugcaauuagguagaaguaggacugggugaauaauuaugcccaaaggaagacucccaguaacgugccccagggcucugucccccacuuuauuguguugaaaaguuuuagcagugcuucccugaagccagugccugauggaauuaagauccaaaaaggucuugacaggcugagacaauuaggccgaauccaacacgaugagauuuagcagaaacaauuguaagguccugcauuugcauccaaacaaucaacuauacaaaaacaagagaagaaaagugugacaagagcaggaccaguuuccagcacaggugcaggugacagacuugagcuuggauguggauccacagaaugaugggacuaucaauaaugcgaauuuuacuuggaggcugcacuguuagagguauugcaucauaucaaaauaaguaauuauccuccuauccuugcuguuucuuuuuuucuuuucuuuucuuuuuuugagauggaguuuugcucuuguugcccaggcuggagugcaauggugugaucuuggcucacugcaaccucugccucccagguucaagugauucuccugccucagccuccugaguagcugggauuacaggcacccgccuccacgccuggcuaauuuuuuguauuuuuaguggagaugggguuucaccacauuggccaggcuggucuugaacuccugacuuccacacagaugaagcgugggguucgguccugcuuuccucaccuugagaucccacagaggacauuuggaggcaagaaccgggaucucaaugggacuccagaauacauacuguaaugaauccgagaugggauuggggaugcuugcuuuauagagaagaauaggugaagauaugguaguugucuuuaagcaguuuagguugccacuugguauuugaaggguugucaugcaaaagaagaaugagucuguuucugggguggcucucaagacuauaacaaggaccagcuggggcaggggcaggggggcggggaggccacugcugugaaggcaagaguuugauggaaaguagaguuauguggcuacuaaaacuugcagcagucaacagauugggcuguaguaugaacaaacaguacaacuaauaguugagauugcuggccaugaugcauuguugauuuaaagguagcccauguuuuguuggauuucaaaugucuaggugauaaaggucauuaaaauauuaauauuuuaauauuaauauuuuaaaauauaaauauauuuuacauauauuaacauaaauauauuuuacauauauuaauauuaacauauaaauauauuuuacauauauuaacauauaaauauauuuuacauguauaucacuauuucagaauauuaauauauuuuacaaauagccugaugucuguuugugcccaagugcacugcagcuauguuucugcacagaagugguccuagagccacauaauaacagagcucagauuuuuuuuuuuuaaaaagaucagccuaggaucagcuuaaaugccugagcaagcaccaauacauccauaaaagcuaugcaaguugagugucccuuaucugaaaugccugggaccagaaguauuauggauuuuugaggggggauggauuuuggaauauauguauuauacuuacugguugugcaucccuaaucaaaaaauccaaaaucagaaaucuggaaggcuaggagucuugcaucauggaucaugaaagagaugaccuugaguuagaagauucuaugucaggauuuaacaaccaucccugucuauguuaaaauaauaguuguugcaaaauauaugauuuuuacugggguuauaucaggauagcuugucaggauuugcuggcuacaaaacccuuccccaccuaacuggaucaguuacccaaucuaauagagcuguuuagaauuguccaucuggcugacaaagagcaccugccaaaagugauuaguuuugccuuaccuuaauugauuuugaguaauuuucuccucagaaaguucacuugcaccuugagggggucauagaaucuucauagagaaaaacgaguuuucauuuuuauuuuuacuuauuuuuaauuaauuauuuuuuuuuuuuuugagauggagucucacucugucacccaggcuggagugcaguggcacgaucucagcucacugcaaccucugccuccuggguucaagugauucuccugccucagccuccugaguagcugggauuacaggaguguaccaccaugaccagcuaauuuuuguauuuguaguagagacguagagacgggguuucaccauguuggacaggcuggucucgaacuccuaaccucaggugaucugccugccuuggccucccaaagugcugggauuacaggcaugagccaccgugccuggccagaaaaagaaguuuuuaaauuugcuauuacaagaaggcauauguccaauucauccauaaaagcuaugcagguugaguauuccuuaucugaaauuccugggaccagaaguguuuggauuuuggauuuuauuuuggggguggggguguggauuugagaauauuuguauuauacuuacugauugggcauccacaaucccaaaauccaaaaucugaaaugccccaaugagcauuuccuuuccacgucagguugucacucaaaauguuucagauuguuuagcauuucugauuucagauuuuaggauuagggauacucaaccuguauaaaguaauucaaauagauauucaguuauacuauccaaguuuugcuuuuuucagcugccaguacauggaaugauuugguuuuguuggcucucauggcaagucuggagauaagaugagcucuuggcuggugaaugcagccacucaagaugccaggccucuaucuagcucagcaacucugcaguucucuuggcuucucccuguggauacaggauggcugcuauauauugcaucuucacaggacaauaugcaaagccagggcuguccccuuuuaagagagaggaaaacuuucccaagagacuuauggcauugcaugucauaccauuuugaaagauuauuguauggcuuugcagauguugaaacuggcuucuuaaugcaaucugagaguuauggcccuaaaacauuuuuagauuuaaaauuuaaauuuugaauuaacauacaauugacauuugaggguguaccguucugugaauuuuaacacguguaaauucauauacauguacaggucagcacauucaagauacagcucaagaacagcuugauccuuuuuuuugaucagguuuugacaccaaagaaaaccuuaugucuuugugucuaaguucaugagagguauuagacucuagguguuuuuuuguuuguuuuuucuuguaaugucuuugguuuugguaucaggacaauguuaaccuuaucaaauaaacugagauguguuccuuccucuuuuauuuucuggaagagauuguguaaaauuggcauuauuuauccauaaagaaaaaaauucuuuaaauguuuugguagaauuugccaaggaagccaucugggccucaagauuucuuuuuuggaaaguuuuaaacugugaaugcaauuucuuuaauaggacuauuuaggaugugucuuucuucguuggugaguuuuguauuaucugaagaaucaauccauuuccuuugucauucuaguuaaagguuuagauguuauaucaaccuacauugaaaaccacaugagacaauguuauaauuuuuguuuucaaccauagaacauuuuuaaagaaccaaacaggguaagaauaaucuuauauuuacccauauauuuggcauuucuuauguucuaaguucccuucugguaucauuuuauuuauuuauuuuuuuucuuuuuuuuuuuuuuuuuuugagauagagucucacucugucguccaggcuugagugcaguggcaugaucuuggcucacugcaaccuccacuucccugguucaagagauucuccugccucagccucccaaguagcugggacuacaggcauacaccaccacauccagcuaauuuucguauuuuuuaguagagaugaggcuucaccauguuggccagacuggucucaaacuccuaaccucaagugauccacccaccuuggccaaagugcugggaucacaggcgugagccacugugcccagcccugguaucauuuuauuucuuucuggagaacauccuuuaaaauuuuuuuuagagcaggugugcugacaaugaauuucuuuacuuuucuucauuggaaaaugucuucauuuugacugcauuccugaaggauguuuccacuggauguagaauucuggguugacaguuuuuuaucucuuggcucuuuaacaauguuguuccacuuccuucuggucucaguguuuuaugaugagaaaucuauagucauuggaaucauugcuuucuguugguaaugcgucauuuauuucugucugauuguaagauguuuuucuuugucuuuauucuucagcaauuugauugugauauguuugaggauguauuauuuuagguucaucccauuuggggcuuuaggggcuuggugaaucuguugguuuauuucuuuuuuuuuuuuuuuuuuuuuugagacagagucuugcucugucgcccaggccguuuuauuucuauugagaaauuuagaaaguuuuuggcuauuauuucuuuaaauauuuuuucuucucugcagccuuucucaucuccuuuuaugccucugauaguaggaacauuaaucauagaagaagaggagaaagacucacauuuuuuauugaccuaucuucaaauucacuagcucuucuaucaccuccauuucuacauugagccccucuauagagcuucuuugcuguuacuguuuuuuuuuuuuuaguucugaaauuuucauuguagucuuguuuauaucauuuauuucuuugucuagacuuucuauuuucccauuccucucgagaggauuugcaaaugagaggaguggaaagauagaaaaagauaaaaaccucucaacaaagaaauaagugauauaaauaagaacacaguguuaaugguuucauuaacaucuuuuucagauaauuccaacaacugugucuguagcgucuggugauuguguuuucuuauacaggucaaauuuuccugcuucuucauaugcugauuaauuuuguauuaucgucuggacauuuugaauauuacguuaugagaucccggcucuucuuuaaauccuccagagaauguugauauuuuuguuugagcaggcagauugaguugguuggguguaggcugaaaauucugaccagcuuucuuuggauuguggucuguucaguuuuccaaggcuuugcaacacuauucagaucuguucugcucgugcuccacccguuggccauucugggagcuguguaguauuuugucccauugaguuaguuguugcuauggaggaguuugccuugguauggagaaauaccugaaacugaguaauuuauaaagaaaacagguuuauuuggcucacaguucuguaggcuauacaagaagcgugacacccacaucugcucagcuucuggugaggccucaggaagcuuucagucauggcagaagggaaguagagcuggugugucacaaagcaugagagacgggggagaucccagacucuucuaaacagccagaucuugcgugaacucacuaccaugcaucacgguggggagagcaccaagccauuuaugaaggaucuaucaccaugauccaacaucucccacaggccccaaguucaacauuggggcucacauuccaacaugagauuugaaggggacaaauauccaaaccaucucacauguuuuccaguuuucagagucuagggcagacuguuuaggguuagacaggcaugaacaacuuacaggugagcccaggauuucauacacaaaauggcgggguagcuuugccaaccucuucacucuccaagaccuccuugguacuaccauuuauuuaggacucuauuuuucauuccuauguccagcaagcugaggcuuuauuuguccuacucuuaugcauacuuuccuuggcuguaucagcuuccugauccaagcuacaagagaagagaaagagaaaaaggcaucaggcauuuguuccuacucgagacaaugguuccacugaucagaaggaaagguucuccuucagagcauguaagcaccugcagguuaccauggguugaggcaugaagaaauggugaaaugaaaagacaggaaguauuucccccacucucucugaauguuagagacccuuuuccuaccccucaagccaaaacuagaggcuuccuggagcucucaccacccacaccaaugcccacugcccggggucuuuagcauugcaucuagcuggggguacucgaggaaaaacuguagcaaacucuuugcugguuuggugguacuuuaaauucaggucuucuccaaaucaccugcuacuacaacuuacuucucagaauccccaaauagcuguuccaugcguucucugcauguuccacagcugccagcaguggaaagaagcaggguagaguguugcuuccucuacccaucaucagaaccucucagaaauuuuucacaguuuuuuuucaaccuaagugguuaauugaauguuucaucauaaaugaggucacuauaacuaaguuaugggaaauuacaggaggacugggauuauaaaauacugagugaaugcuguaaggauucaccaaaauauagggagaucagcugucaugagucuuuugcuguggguacccugaguucacaauugacggucauuugcaaccuugaaagcuaagcucugaaaccuauuauaguucaauuucuuuuuggaaauauuaugcuucuaacaagauuucagagcaagguaauuuccaaguaguuuccuuuaaauuuagccugaaguauugacuuacuggcuuuuuuuuucagaaaacuuuugccaaggcaagaaugaggguugggaguuccuaaguaugagggauugucaggguuugcuucaaucugcccauauuuucuugacauggguuauugaagaaaucuucaucccuacuguugucauuugagcauuccuuuaauauaccaucccuaucauaccauugcuaaugaagaccagguaaguggcaggaaaaaguaaucccucugaccuacuuuuaggaggucuagaucuuggaaagauggagacagauuuugaagaccauagauggaaugacauuccuaagagugguuuguuaauuuuccuugauaaagguuucugaaacugacgauuuaaaaggaauauauucuguacaucucuugugaaucccagaaguuuucaacugcuuaauccauuucuaaaguuuuaguuuaaaaauauaaaugaaauuggauguucacaauccaggaagcauaacauuuagguuuaaguccaaguuuaaaaccuugaaucuucaacgaaacggaaacaugucaaaaugauuacacuuccuccuguugacagcuggguuuuaaagccagacagcguucuucguuuucgacuuuuguuuuuuuaaugcagaauaccauggcuucuuuugcacgucacuguccuuuugcacugcauugcaacucagcauccccagugucuaugaucuauauggggcaaaggcguauuuuucauagagagcuuugugaaguuauucuucuccacuauuucaguucagagcuuaccaucuuccaaaguccugcccccuuggcccucugcccaggguguggacagacacucuuggguguucucuaaagauuccagcuuguugaccaggcauggucgcuugugccuguaaucccagcacuuugggaggccgaggcaggcagaucaccugaggucaggaguuugagaucagccugaccaacauggugaaaccccaucucuacuaaaaauacaaaaaaauagcugagugugguggugggcaccuguaaucccagcuacuugggaggcugaggcaggagaaucucuugaacccgggagguggagguugcagugagccgagauggcgccacugcacuccagccugggcaacagugcgagacuccgucucaaaaaaaaaaaaaaaaaaaaaaaaagauuccagcuuguugcagcuuguagcaacccccagcagccacuaagagauauuuacucccacuuuuuacucaagcaaguuaauuucuggaggugaaacaauugcacuuacgaucauccagggucucaucuggauaagacuugguagcacguguagguguuuaacguggcgugauuauuuaauauaugugguauagugguggggccccagaagagcaauuuucuauacaauucuaauuuugcgugaaaugauccggauggugguuguauaacauucuggauaauaugggcuggugccaagugacauuuuaacuucugcacgacuuagaaaacugugcuacguguuccacagaggaaauuaucagcauucagcugcaguauucgcuugccagaaccauuaccccucaagaacgcuuucauguagacgcuugaagacuugaaaaagagaaacaacuuccuguuccauuacaaacauauuucaugccaauacagaaacgauaagaccacaccaaaauaggggaucaauggagaaaucuauggcuuucuguaagaugucauacaacuaauuuuauuaugaagagguuuuuuuuucccaauaagucuucuacacucauuauuguaaagaguuuuaauaacauguaaucuucacaauacaauaucaaguaaaaaggacuggaaaacauaauuuuaauuauuuuguuuauuugcuuagaagaaaaugaagaaaaaauacacguauguuacuucugggcgauggguugauuuuucauuuccuauuuauauuccuuauucuuuuccauuucucacuguuacaaauaauguuaugauaaacagcaugaugcagaaaucuaugaccaaauuucugaacacuucauugggacagauuccagaaaaggaauuacugaaucaaaaaaaaaaaaaaaaaaaaagaacauuuaaaaaggaacuuuuuaucuaaaugccauugccaaauuaguauccagaaagucuaugcucaugucuguuaccaucaguauuagugagaagacucagcaaacuguguacucugucuuuucacuuaaaaucuggccaggcuucauggcucaagcuuguaauuccagcauuuugggaggccaaacugggaggauuacuucaggccgggcguucaagacuagucugggcaacauggugagaccccaucucuacaaacuuuuuuuuuuuaaaaaacaggugggcuugguggcaugugcuuguaauccuagcuacuggggaggcugaggcaggaggggcacuugaggccagaaauuggaggcuguaaugaucuaugaucaugccgcugcacuccggccuaagcaacagagugagaccuuguuuuuaaaacaaacaaaacaacaacaacaacaaaaaugaaauaacauugcauacuggggauguggaaaaugcuagcucacuauugcuuuaauuugcauuuauuuucauauuauugaaguugaacauuuucuacauguuuaauauuuguguuugucuuuuguggauuaucuguuuuuaucuuuuaguauucaucuuuuaaugaauuucuucguauuugaagaaugcuauucuuuugccauauucauugcauagaguuuuccuagauuauugcuaaauauuuaauuuagucccugauguuuuuaacaugcagaguauguuagcaagucugugaaucucuauuuuuuuguuauuccuuuauugauuuuaagcuuagauaggauuuucuucauuuuaccuauauauuucucuaauuuuuuauccucuaauucauguucuagaguaaaaugccaagugaggaauaaaaucgauuuuuccuuucaaguucuuuaccugucuuuucagcaccauuuguuaacuaagccuccuuuuuuccauucgauuuuuuauguuuauuaucuuuauuuacuagggcuuauuucugaauugcccuguuuuguuuaucuccuacuuaaccuucaucaguacuuuuuuauugugguuuuauaauagauuuuauuacuagauauagcauuacuguccuuaauuccuuuuagagguuuucuuuccugcucauucuuccaaaugaccaauucacugggacauuuccaaaaaaauuccauagggauuuauccugaaauugcauuaaacauauccauucauuuaagaaguauaaaauuguuagaguaauccuucuaccaggaagcaugguauucuuuuauguuuucuuuuaaaggcuuuaaaaauauaucacuaaaguuguauagguuucuucauauggguccuaaaugucuuuuauuuuuuaauugagacaggaucuugcucuguugccccagcuggauuacaguggugcgaucauagcucacugcagccucagcugcugagcucaagcaauccuccugccucagccuccugaguaguugggacuaugggugugugccaccaagacuggcuaauuuuuuuuauuuuuuuguuauuuguggaaaugaggucuugcuauguugccuaggcugguuucaaacuucuagccucaagcaauccucacuccucagccccccagagcguuagcauuacagaugugagccacucagcuuggugcuaaaugucauaaacuaguaauuuuucaauaaaauuacucauuucacaaaaguuuuaaaauguauuugcuuucagcuauauaaaguacaguauuucauaauuuuuaucuccucuguauuuguugcuacauaguuuuugucuguugcaauuuuauuugaaucuuucuggguuagauuuguuaauuauucauauguuuuauaguuuucucaaagaauccucuuuuuuuugcaacgaugauuaccauaucuauuuguguauuucccaguuaacuaauucugccuuuccccuaauucuaucauuaccccuauuaccauauuuauguuuaacuuuucuaaguuuuaauuucuuugcuauuuaugucuuuauuugcauugggguuacuuuuucuauuauuuguuuaaucagccucuguuaaucuuuaccagcuugguuaaaaugauggacucuggaguuagacugccaaauucagaacccccgccucacccugccccacccagccccaggucuggcccaugcaaauugagcauaagcucuucugauuuccacuuccugauuuaggacaugaaauaguaauaauaucuaccucguuaguguggugugaggauuaaaugaguuaacucauguacuaugaugccuggcagauaaaaaaugcucuguggaugucagcgaucaugaacagcauuucucuuccauccguucuuuuguucuuucuuuggaauuccuguccucaucagguuagaccucagggaucuuagucuccaggucucucagcuuuuaccucccagucucuagcucuguguguuuuguuuuguuuuguuuuguuuuuauuuuaguuuccagagcacaugugcagguuuguuauaauagggaaacuccuaucacagggguuugucauacggauuauuuugucacccauguacuaagccuaguacccaauaauuauuugggguacugucccuccuucaccuucaaguaggccccaguaucuguuguuccccucuucgcauccauguguucucaucauuuagcucccacuucuaaguaagaacaugcaguauuugguuuucuauuccugcauuaguuugcuaaggauaacagcuuccagcuccauucauguuccugcaaaagacaugaucucauucuuuuucauggcugcauaguauuccauuauauauauauauauauguauauauauauguauguauauauguauauauauguauauauauguauauauguauauauauauguauguauauauguauauauauguauauauauguauauauauauauacguguauauauacacguauauauauauauauguacauauaugcagccaacaagcauacagaaaaagcucaguaucacugaccauuagaaaaauguaaaucaaaaccacaaugagauaucaucuuacaccaguaagaauggcuacuaugaaaaagucaaaaauaacuacacugcuggugggaauguaaacuaguacagccgcuacggaaaacaguguggagauuccuuaaagaacuaaauguagaacuaccauucaauccagcaaucccacugcuggguaucuacccagaggaaaagaagucauuauacaaaaaagguacuugcacaugcguguuuauagcagcacaauucgcaauagcaaaaucauggcaccaacccaaaugcccaucaaucaaugaguggauaaagaaauugugguauauaucuauauauacgauggaauacuacucagccaaaaaaaggaaugaauuaacagcauuugcaaugaccuggaugagauuagagacuauuauucuaagugaaguaacucaggaauggaagacuaagcaucguauguucucaccgauacguaagagcuaagcuaugaggacgcgauggcauaagaaugauacgauggacuuuggggaccuggggggaagggugggaggggggugagggauaaaagacaacaaauauggugcaguguauacugcugggugauggguacaccauguucucacaaaucucuaaaaagcuuacucguaaucaaauaccaccuguaccccaguaacuuauggaaaaauaaaauaaaaaaaauagauaaacuuugauaaagauugcgaaagaaaaccaaaguugcuacauagaucuuaaaaaaaaaaugacacaugcugguaagguuggggaguaaagggaacacucauauauguuggugggaguguaaaucaguucagcccuugcgaaaggcaguguggcgauuccucaaagagcuaaaaacagaacugccauucaacccagcacucccauuacuggguaugugcucugaguuguuguucugugcagugguuccaggcuacugucucaguuccuaucaccuaccagccgguaauuucagagugucuaugaaucugcauauuugaaaaucaugcuuuuuacuuucugggagucuuugguguacucugauuccacucuuugggagcacauauuccuuuguuuguuuguuuuuugagacagagucucgcucugucacccaggcuggagugcaguggugagaucauggcucacugcaaacuccaccuccugggcucaagcgauucuccugcuucagccucccgaguagcugggauuacaggcucccgucaccacgucuggccaauuuuuguauuuuuaguagagacuggguuucaccauauuggccaggcuggucuugaacuccuguccucaggugauccucccuccuuggccucccaaagugcuuggauuacaggcgugagccaccgcaccuggccuuggccucucaaagugcugggauuacaggcgugagccaccacaccuggccuuggccucccaaagugcuggcauuacaggcgugagccaccacaccuggccacccucuaaguucuuaccuaagucuucuuucuuuaguuguagucagugggaaccaagugcuucaaaggcucauugagucacccugucucuggucacugagacggggugaguugucauuucugagacugaagugaguugucauuucucugccuggcuguagauuuccauccgccuucucugccaagucagggcaaaggcacaccaacagguuaggggaagcccggugguuuucauguucaccugaccagaaacaagugugccuccuuccugaggucaaggaggaagcccccucucuuuaggguacaucccacccaggagcaggagacacgggcuauagagcagauuuucuucggguggucaguagucagugaggucaagaccaucacccccaagccugaauccccccagagccugcuggaguaaacaguuguggcccuuucucggggagcuuccuggggaaggggcagauccuccguaucuucucucuaccuucccuccagagaccugccuucccuggccgguguccacuccggaggcgacuugucgggacggcagaucaggaguucuugcuguuauauauucacagccccuuaacuccgcauuuacuccauuuucuaaaugguuauugcugccacacaaggaaacgauugauuuuuuaaauguuuguccaggacccagccacuguuaguaaauucccagaauuacgauggagucauuucuuuuuuucuagauagacaaucauaccaucuccugaauagugaucaucuugucucaugaauuccuuuagucaucuuucucacuuguaucucaagucauaauauuggccagaacacagaaaacaacauugaauaaaaaugauaacaagcauccuuggggcauugcuuauguuaauggaaauuccucugguguaggagaauaugcuucugccuugagauagaucacucuuacuuugucgagaaaggauuauucuuguccuuguucuaaaaaguccugaaggaaucuaguauuuuccccagcacuguuugcagcuuccauagagaccaccacacuuuuuauugugucuauugauuugauuucauacauggauugauuuuucuaguauuaaauuguacucaaguucuggaaugaucuguacuuggcuguggucagcuauguuuggagcauauuuuaaauuagauuuuccaguuccagcuuuagcguuuuugcaugugagauguguugguugguuuucuuuuguguauuuuuguaugagaguuauauuagcuuuuccacuuuuucuucauccuggaacaguuaauauaacaugaggagugucuauuucucaacaacaggaaaaaacucagauauaauuuuuccuaauuugagaagcuuuucagguauuuuuuaaaaauagguuaucaguuuuagaaaucugauuuuguugauuuucugcauuuucuuaaaucuguaauaaucuuuuuuaauaaagucaauaguuucacaaaaaauuugaaauagauuagcuuuugguuauacaaaguacaguauuucauaauuuuuaucucuucuguauuuguggcugcauagcuuuucucaguuguaauuauauuuucuucuuucuggauucgauuugucaaucauucauauauuuuauaguuuucucaaauaacucucuuuuugauacaaugcauaucauaucuauuugugaauuucccaauuaacuaauucuaccaucacccuaauuauaucauuaccccuauuaccuuuaagucuaacuuuucuaaaguuuuaaaaauguuuuauuuuuuccuuuccaaauaacaaaauauuuauuuauuuauuuauuuauuuauuuauuuauuuauuuauuuauugugguggagucuugcucugucacccaggcuggaaugcaguaguggcacaaccguggcucgcugcaaccuccaccuccuggguucaugcgauucuccugucucagccucccaaguagcugggauuauaccaugcuuggcuaauuuuuguacuuuuguaguagaaaugagguuucaccauguuagcccggcuggucucaaacuccugaccucaaaugaacuucccaccuuggccucccaaagugcugggauuacaggcgugagccaccaaacccagcccaaaauaaugaaauuauuuuaauguuaugaauuacaucugaaaacaaguuugauuaauacuuacauauuugaguuauguaauuuucucacugucauuuucuuuaaaagauacuaucuugcauuuguauucuucauugaucaggagaguguuuuccauuucggagugaucuagggcucugcuucaauguuuacuauuaauauuaaauccuaguuucuuuggguuugaguaggagaaugaggucugcuuauuucagcuuugaaaaauuaguugauuuuuugcgaucuaccauauaauccuguuuuuauaaauguuucaugaauguuuuaagagguacagccuuuuuuuccuacagcauucuguauauuaucuguuauuuucuguguguaugguuaauaaucuaguaauugcaauuguacuacugaaauuuucaucuugaaagacaacauggcauaauggaaagaauguuuuagagugaagguaaaucaggguucaaaacugaauuuuauuacaauuaguggcauaaucuuacagaggucaccuaauaucugaaccucccuuaugccuuauuaaaacagggacaucaauuaauaccuaccuucggccgggcgaggggccucacgccugaaaccccagcacuuugggaggccgaggcaggaggaucauuuguggucaggaguucaagaccagccugaccaacauggugaaaccccgucuccacuaaacauacaaaaaaaaaaaaguauagccaggagugguagugugagccccuagucccagcuacucacgagccugaggcaggagaaucacucgaacuugggaggcagagguugcagugagccgagauugcaccacugcacucuauccugggugacagagugagacugcaucucaaaaaaaaaaaaaagaaauagacuuggcccgggugcucacaccuguaaucccagcacuuuggcagaccgaggcagguggaucaccugaggucaggaguucgagaccagccugaccagcguggugaaaccccaucccuacuaaaaacacaaaaaauagccgggcgugguggcgcaugccuguaaucccagcuacucaggaggcugaggcaggagaaucgcuugaaccugggaggcagggguugcagugagccaagauggugccacugcacuccagacugggcaacaagagugaaauuucaucucuaaauaaauaaauccuaccuuauugcuaucauaaguaaaauagcuuaacaaugugccugcccuauaguucaucacagugagugauguuauuaauauuugcuuauuugaucugcuagugauugauagcacaugaaagucuucccuuucuuagcuccaaaaaaaaugucucauuacuauaccuucuaguauucucggauccuuuugucuuucucucuuguaaaguucaagucuccaauuucuguguuucauguauuaucuuucucucaucauuuuaccucuuuuuuauuuucccugucuagacuagguuggggcuguagguuauugaugugauuaucugugcuguggcuguugcuauuuauuaugcuucuggaauuguucuccccccacccaccagguaauaugauaucauauuuucuggcugggugcgguggcucacaccgauaaucccagcacuuuaggaggccaaggugggaggauugcuugaaccuggaaguucuagagcagccugaguaacauagcaagacccuguaucuacaaaaaaauaaaaguagcugggcaugguggugugcaccuguaguucuagcuacuugggaggcugaagugggaggauugcuugggccgaaaauguugagguggcugcagagagcuauaaucauggcacggcacugcacuccagccugggcaacacagugagacccugucgaaagaaagagaaggaaggaaggaaaaaaggaaggaggaagggagggaaaaaggcagggaggaaaggaaggaaggaggcagagaagaaaggaaggaaagaagagggaaaaaggaaagaagggaggaagaaggggaggcagacaaggaaggagggaagggagggaggaaaaggaaggaaauuauauuuuucagaaagcacuuauauuuaccucuauaaaauuaauauacuaauaugcuauuuuaaguaacauaacagaggaguauaugaagucuaaguguauaaguaaaaaguucauaucaugcagauuucaacuuuuccauuacacaauggcuucucuuucugcccuucccagguccuguguccuaccccuucccuguuauuucuuuaucaugucacaugcaggugcugcucuacucacacauggcggcccuuauaaugcauacccaaaaaacaaauugaaaaggaugauuaagaagagauaugggcugggugugguggcucacgccuguaaucccagcauuuuuggaggccgaggcggguggaucacuugagcucaagaguucaaguccugccuggccaacagggugaaaccuggucucuacuaaaauacaaaaauuagccgggugcgauggcauacaccuguacucccagcuacuugggagguugaggcaggggaaucgcuugaaccugggaggcggagguugcagugagccaagaucaugccacugcacuccagccugggugacugagcaagacucugucucaaaaaaaaaaaaaaaagaagaagaagaagaagcaauaugaaugaaugaagccucugaaaucugugcccacacuguguuagaugcuuaugagcaucucuuacuuugcucacaucauggagaccacugucccagacaauauccaauuucccugcauuuuccuucugcagcacuuucccguuuuuaacacacacacccuugugaguccuugguugucucuguuugcagcugcacucuuaauuuccuagagggcagugcccacaugcccccuguucacugcaguauccccaaggccgagcacgauggcugccacgucauggguuuggguaaauauuuauugacaugaguuagaaguugcaguucccugccagcgcgucccagguaggcuuugacuuugcuggugcauugucauuguucuuguuuguucuccucacugaagccaggcucauuuucuuuucuauuuuaucuuauugagacaagguuuugcuccguuacucugacugcggugcaguggugugaucauagcucagugcagucucuaaguccugggcucaagcaauccucuugccucagccucccaaguagcugggacuacaggcacucaccaccacacccagcuaauuuuuuauuuguuuuguagagauggggucuugcuauguuguccaggcuggucucaaacucccagccucucaccucgaucucccaaagugcugaaauuacagguagccacgacucucagccuccuuccguuccuguuucagccucuugucuuuucaucuucguaugucuauuuguggacaaaucuucuuuguggaaggcuuucauuggccauaucuaacacaaagcagguguuucuuaaccuuucuucugucucugauagugaauaauuuggaggaguuaauuuuguuuuuguacauuaaagggcagugcuucccuucucugcuggauuaaaccuuacguuuccccacuaguuuucauuuuuauuuauuuauuuuuuugagacaguuucacucuguuguccaggcuagaguguagcagcacaaucuuggcucacugcagccuugacuucccugggcucaggugauuuugccaccucagcuuucugaguaccugugacuauaggcacgugccaccgugcccagcuaauguuuauauuucuuguagagacaggguuuugcuagauuuuuguauuucuuguagagauaggauuuugcuagguugcccagacuggucucagacuccugggcucaugcaauucucagccucccagagugcugggauuauaggugugagcuaccgcaccuggccuuaguuuucaauccuuuuuuuuuuuuuuuuuuuuuuuuuuuuuaagagggagucucgcucuguugcccaggcuggaguacaauggcgugaucucggcucacugcaaccucugccuccuggguucaagugauacuucugccucagccuccugaguagcugagauuacaggcaccugccaacacccagcuaauuuuuguauuuuuaguagagacgggguuucaccauguuggccaugcuggucucaaacuccugaccucaggugauccaccugccucugccucccaaaguguugggauuacaggcaugagccaccacacccagccucucuacaaaaaaauuaaaaaaugaauuaggcaugguggugugugccuguagucucagcuacucaggagguugaggcaggagaauugccuuagccucggaauuggaagcugcagcugcagugagcuaugauugugccacugcacuccggccugggcaagaaaaagagaccuugucuccaaaaaaagaaggaaacuggagccugaggcuuccaccucagcuuucugaguaccugugacugucggcauguacccccaugcccagcuuauuuuuguauuucuuauagagacaggguuuugcuggguugcccaggcuggucucaaacuccugggcucaagcaauucuccugccucagccucccaaagugcugggauuauaggggugagcuccugcaccuggccuuaguucugaauccuuuuuuuuuuuuuuuuuuuugagagggagucucgcuguugcccaggcuggagugcaauggcacgaucucagcucacugcaaccucugccucccagguucgagugauucuucugccuuagccucccgaguagcaggauuacaggcaacugccaccacacccagcuaauuuuuguauuuuuaguagagacaggguuucaccauguuggccaggcugguaucaaacuccugaccucaggugauccacccaccucugccucccaaaguguugggauuacaggugugagccaccacaccuggucucucuacgaaaaaauuaaaaaaugaaucaggcaugguguugugugccuguagucccagcuacuuaggaggcugaggcaggagaauugccuuagccuuggaauuggaagcugcagucagcugugauugugucacugcacuccagccugggcaacagaaagagacccugucuccaaaaaaagaaaaggaagaaaacaggagagccuguggagggagcugccuguggcucucacucauugcauuacuugcaggugcugaaacuucuucccauguaauaugcugggguuguuccugcaauucaagaucaaaacagaggcaccaggaagggagaggaaauggauaaaagggaagggggacaagaugccagacuuccuaguaauccaagcacacauagucaggagcugguugucugggugccuggauuuugcagaccugggucucccagcuuggagcaggcagcacaugcuguucacgacucuuccuacccuuuccuggcaggugcuuucuaguagugccugcagagaccaccagcuuuauuucuccauccgcuucacuggagccauggugaguguacguuuccccagauucauucaaauggaugacuaucuucagcuucuaggaccgcugugacuuugugucuuuuucuaguugcauggagacuuccgugagaaguugagcaaaaacacaucagaaauugguaucuccuugccucuuaauccugaagucaagauuauucugcagucauugcauccauauucucaaaaugccuaacauauuucagaucagaaguuuuaggcuguagcugggugcaguggcucacgccucuaaucccauugcuuugggaggcugaggugggaggauugcuugaggccaggagguggagaucggccuggggaacauagugagaccccaucucuucgaauaacuaaauaaauaaaaaauuagccaggcaugguggcgcaccccuguaguccuggcuacucaggaaccugaagcaggagguucacuugaacccaggaguucgagccugcaaugagcugugauuguaucacugcauucuagccugggugacagagcaacacucugccucaaaaaaaaaaaaaaaaaaaaaaaaaaaaaaguuuuaagcggaaauuauucucugaagguuaaaaaauacccugcaaccgucggaguagauagaaggggagguuugaugcaauugagaggccuguuucucucuugccuggauaauuucucuuccauauggaucccugagagagguguguguauaggagaaguuggaaugggaaauaaagucccccuuuguaucugccuugcucaucccccaucuccccaugcagaaaagaagacaggggugagguggcuuggccuacuaugaggaggccggcucuggaugaaccuaccacauagaugagaaacaugaccagaaaugggcuucagcucugagcacaaacuuugagcacauccugagagccaacccaaucugauuugcuccuccuguucugcuauuuggaggagaggggagagagggggcaauagcagcacuaggaagugcaaucagccuaccccaacucucauauucaaccugaugugguuugguuguguccccacccaaaucucaucuugaauucccgcguguugugggagggacccggugggagguaauugaaucaugguggggguggggggacuuuccuaugcuguucuuguaauagugaagaagucucacaagaucugaugguuuuaaaaagagguguuccucuacacaagcccucuccuuugccugccaacauccauguaacuugcuccuccuuugccuuccgccaugauugugaggccuccccagccauguggaacuguaaguccaauuaaacuucuuucuuuuguaaauugcccagucucaugugugucuuuaucagcagcaugaaaacgaacuaauacaaccccuuuaccucuuuuuuauuugagagacagggucucacucuguugucuagaccggacaacugcagccugaaacuccugggcucaagcgauccuucugccucgaccuccagaguggcugggaccaaagcauagugacaucaugccuggccaaguuuuuuuuauuuuuuguaaagaugaggucuggcuauguuguccaagcugguuucaaacuccuggccucaagcaaucuucccagcucagccucacaacuuauugggauuauaggcaugagccaccaugccuggcuugauuuucuuacucugcuaugguuaacugauauuuuucauucuaauguaaagugugcauaaaagcauuuuuuucuauuuuuauuguucugcauuauguaauacauauacaaacuuugugcuuguuguucugcuccccugggaaaugggcuuccuggggguucuggacugcugaaggcaaugaaccucucuggguuguccagaccuuuguuuuacuuugaccagcugugugaggauaagguaguucaggaacuaggagagccugcugaauguaaaauuccaugaacagaagcaagagaaugacgagacugugcuaguucuuucagaauaacagcagcacccuugcacugcacagaguuaaacaucccagaucuggaaggacccuaccuugugucaccagcagcugcaagaucuauauuagggccucugaaccacgagaagccaugcaucuauuccugcucuaggucgaaauguuuauuucuauaaauuuuuguggccuuggcugaaugacucaggaacugagagugagagugggggugugugcagaaguguuggccuagcaagauauccuuaggauggcacauuugcaagguuggcccuuagcugguuucuggagaauuggaguuuuggaggggucccaccauuccuaaaacuuuuaagagugguucaucaaggccaaacuguuuguucaaacaauaugguuuaugcuaagcacccuuuuuccuuuugggagucuuauuuauuuauuuuuaagugguaaagucucacucuggugcccaggcuggagugcagugacacaaucagaguucacugcagccucaaucuguuggccucaagcaauccugcagccucagccucccaaagugcugggguuauacguacgugugauccacugcuccugccccuguuugagagucuugaauuugaguacaugccaggcagagagugccugcaugaccagcucccaaugaaaaccuuggacauucauucucaaaugaacuuuccuggugagcagcauuucacaucuauugccgcuacucguuguuaggggagugaagcauguccuguggaugccacugggagaggauucugaaaucuugagccugguuuccucuagauuuugccccacacucuggauccuucagaagauuguguguuguauucuuucuccaugguaaaucauagcuacacauacaacuguaugcucagucuugggaggacuuguaccaaacuauugaacaugguaaugggucuuggggguuccuccaacacauggcccacccaccuaacguggguuagguggguuacacuggacaauuuaaccuuaauuucuccaaugcauaacccaucugaaagccuucaguccccuucaaaccaaguugcuacugcuaagucccuuuuauaaaaauucuggugcugcugucaggacaagaacaugguuuuugccaccuugcuacucuguauuaguuuguucucaugcugcuaauaaagacauacccgagagacuagguaauuuauaaaggaaauagcuuuaauggacucauaguuccacauggcuggggaggccucacaaucacggcagaaggcaaggaggagcaaagccacgucuuacaugguggcaggcaaagaaggagaggccaugugcaggggaacuccccuuuaucggaucaucagaucucaugagacuuauucacuguuuugagaacagcacgagaaagacccacccccaugauccaauuaccucccacugggucccucccaugacacgugggaauuacgggagcuacaauucaagaugagauuugcgccaggugugguggcucacaccuguaaucccagcacuuugggaggcugaggugggcagaucaccugaggucaggaguuugagaccagcuuggccaacaugaugaaacgcugucucuacuaaaaauacaaaaauuagcugaguaugguggugugcaccuguuaucccagcuacuugggaggcugaggcaggagaauugcuugaacccaggaggcagagggugcagugagccgaaaucguaccacugcacucuagccugggcaacagagccagaugcugucucaaaaauaaaaaaaauaaaaaaaauuugggcggggacagggacacagccaaaauauaucacacccccauccccucacuccaguuaucagccccacagugucccuuucucagucuucauccuacuuggcccucuguggcauugaacauuacuagagacuaaccaccugcccuugauuggaggugucccuugaucucucaggcacaugccucucucuugguucucuucucagacuauuuuguucccauuguccuuugucuccugccucuuauguagagugcaacaggauaucaaaagggcacucuuuugccucaauuuuaggccauaaagcugaagaauaauacaguagaugccaaguuuuccuccuagaaguacaugcuagaccacccucaagcuaagauggcaucagcucugcugccacuaucccauuguucuucucuauggcucagugugcuugggcugcuacaccaagauaccacagaccugguggcuucaucagcagaaauuuguuuauuuuuuuguaguucugaaggcugaaagcccaaccucaagaugcugguuugguugguuucuacugaagccucucuuccugucuugcacaugaccacuuuuugcaguucugaaggcuggaagcccaaccucaagaugcugguuggguugguuucuacugaggccucucuccuugguuugcacauggccacguuuuaucagugcccucacuuggacauuuucucugcgcaugugugcauauggauuagggcuccauaguuaugagacaauuuaaccuuaauuucuuccuuaaaggccuugucuccaaauacaaccauauugggaauuaaccuaucaacuuugaugggacccaauucaguccauaacacuuuuuaaauuuaauucaacuguauuuaauuaauuuauuuuuugagacagggucuuucucuguugcccauacuggggugcaguggcaugaucauagcccacuacagccacaacuucccaggaucaagcgaucuuccugucucagccuucugaguagcugggacuaaaagcacacaccaucacagcuggcuauuuuuuuuuuuuuauuguaauuuuuguaaggaugagcucucacuauguugcccaggcaggucucaaacuccugggcucaagggauccuccugccucagccucugaaagugaugagauuacaagcaugaaccacccaugcccagccucauaacacuuuuuaagagguugacauuaaaggauuaggcaaaagaauuuccuugggaaauaguugaauuuuuuccuaaccuucucaggguggggaagggguguuuucucauucaauuugagcuaaagguguuuccuaagagccauuuguagagauugacuugugauugcugcaguauaaagcauaaaggcagcuuauguuucagccaccugcaaaaaguuuaaaggccugggcuggagcuggagcugcuguugaguuuaguaaccaagcagagcaggagagggcuggcuuuggaagagcugccaucucaaugacacauggggcaauggaggagccugcuugggggggucuucaggaccuccuagagugcuaauguugccccagaggagggagagaccuucagaagcccagagguuuggggaggacauuuucaguagccaaaagggugagaggccugggcccccuuuucccuuacuccuccuucuaagccuguccaacuaugguguggcuagaaaccacagcugcacaguggggaaggagguggacucaauaagagugguggugguggugggggagacccugaucuauuccucuuccccacucuagguuuacuagacugggucaaacccaagucaaaagaaggaagguguuuucuuucaaaggaaggaagucuguaaugugauuaguagccugcacggaaucuuuuauuaucuaaaaguuacuggaugacuuuugauuccuuaagaguuuauaacaaagcaaugggaccagcccaguacucucuccagggaaagauaugagacagggaagcucgaacagggaguugugagaaagagcaaaguguuucugcuugcauccuguggagucuagcucauccaacacgccaccuacauagcugcuccucaagcccuuugcugaguccucuucucuucccugccuugguccuuuccuuccuuugcucuugaugaguucaucuggcuagauacgaacaacugaauucacuguuuaauuuuuaaauuuuauuuacuuuuugaacagguaaaaagucauaugguucaaauauccaaaauugugaaaagauauuuaagguuaggcaggguggcucacaccuguaguucuagcucauaguguuacaggaaagggguccugauccagaccccaagagaugguucuuggaucucacuuaagaaagauuguggggugaguccauagaguaaagugaaagcaaguuuauuaggaaaguaaaggaauaaaagaacggcuacuccauaggcagagcagccaugagggcugcugguugcccauuuuuaugguuauuucuugaugauacgcuaaaccagggguggauuauuuaugccuccccuuuuuagacccuauaggguaacuucuugauguugccaugacauuuguaaacugucauggcacuggugggaguguagcagugaggaggaccagaggucacucucguugccaucuugguuuuggugggcuuuggcugguuucuuuacugcaaucuguuuuaucagcaaggucuuuaugaccuguaucuugugccgaccuccuauuucauccugugacuuagaaugccucaccaucuggaaaugcagcacagaggguuucagccuuauuuuacccagcuccuauucaagauggaguugcucugguucaaacaccucugacacuagcacucugggagacugaggugggaggguggcuugaggucaggaguucaaaguuacagugagcugugaucacaccacugcacuccagccugggugacagaacaaggcccuaucucaaaaaagaaaaaaaaaaaaauagauacuagguuggugcaaaaguaauugcaguuuuugccaugcugauguaaugggaauucuggaguccauggagaccugaaacuuccaggagaagcuuugggggugggguaaaggcagcuccccauuccccaccuacaacacuguacuuguguuccaggaagcuguguaugcauuccaggaguagcuugcacacaauuugcgagacucgguuaaauaaaaacauccuguucuccaaauaucagggacguguguucugaccacugaucagugguucugacuacagaggugcagacaaagaggcuggaagccauugguggugcaccuggcccccuauugcaagccccuuccccucugguugaaguugcuuucaggggauuuuaagguccaguauccuguuccuccaucucgccuuccccaacuucuccacuuuuauuuucccccuguggggagccagacauuaaggagugggacauucaaaagcaauugccucuacaaggaacgcuagaaagugacuacacaggcccagggaaauguacaggcacagaaaagaccugagaagacauucaguuuagucagauugaucauuggcauagagacaagauauucaggcuugggugguaaagacagcuccccauuccccacccacaacccuguacuaguguuucaggaagcuguguaugcauuccaggaguagcuugcacacaguuuccaagaacuagguuaaauaaaaacauccuguccucgaaauaucagggaucuguguucuggucacugaugauugcaguguuuccuuccucugaaccuugaugaguucaucuggcuggauacaaacaacugaauucauuguuuagucuuuacauuuuauuuauuuuuuaaacagguaauaaaugauaugguucgacuaucaaaaauuaugaaaggaggcugggugcaauagcucaugccuguaaucccagcacuuugggaggccgaggcggguggaucacaaggucaggagauggagaccauccuggcuaacacagugaaaccccaucucuacuaaaaauacaaaaaaauuagcugcggugguagcaggcaccuguggucccagcuacucgggaggcugaggcaggauaauagugcgaacccaggagguggggcuugcagugagccgagauugcgccauugcacuccagccugggugacagugcgagacugcgucucaaaaaaaaaaaauuaugaaaagauauuuaaggcuaggcaggguggcucacaccuauaguccuagcuccuagcacuuugggaggauggcuugaggccaggaguuugaguuuacagugagcugugaucacaccacugcacuccagccugggcaacaaccaaaacaguaaacaaaaacuaaaacaauacaaguaaaugaaaacaaauaaaaaaugacaaaaauaauaacaaaaaauaaauccuugggagaggggagaaucugauuuccagagauaccacuuauuacauuaacauauccaguuuucagcaaaaaaaaaaucacaaagcauaaaagaaacaagaaagaauggcccauucaaaggaaaaaaaaauaagcuguuccugaaaaagaccugauagcagaucgaauacacaaagaauaaagaaagacauugagaaagucaagaaaauaauuuugaaguaaguuuauaucaguaaagagauagaaaaccuaaaaugaaacauaagagaaauucuaaagccaaaaaguauaauaauggaaaugaaaaacucacuagaaggguucaaacaggcagaaggaacaaucaguaaacuugaagauaggacaaaggaaauuaccaagacuggggaaaugaaagaaaaaagauugaaggaacgugaacaaaaccuaaggaaucguguccaucaaguggaccaauugaccuauugugggagucccagaggaagagaagauaggggagggagcagagggaauauuugaagaaagaaugguugaacacuuccuaaauuugaugaaaaauauuaaacauucaaggagauugacaauauccagguaagaugaacucaaagagacccacagcaagacacauuaucagcuuucaaaagacaaagacaaagagaaucuuuguagccguaagagagaggugucucaucacauaugagauugucaguaagauugucagcauguuucucaccagaaacuuuggaugccagaaggcagugggcugauauguucaaaaugauaaaagaaaaaaauaccugucaaucaagaauggaauauccagcaaaacuguccuucaaaggugagggagaaauuaagacauuuuuagauaaacaaaaaucugagggaguuuguuaugacuagacuugcccugcaacagaggcuaaggagaguccuucaggcugaaauuuacggacacuagacaguaacuugaagccauaugaagcaauaaagaucacaauaaaggugcaauuaugugggcaaucauaaaagcuaauauuauuguaacauugguuuguaacucuacauuuuguuuucuacauaauuuaagacauuaaugcguuuucaaaaauuacuaguuugugguuugggccauguaauguauaaagagguaauuuugugacaucaacaauugaaaggagugggaauggaaauguaaaggaguaguauuuuuguauguuauugcaguuaagcugguauaaauccaaauuagaguguauaacuuuaguauauuaaauguaauccccaugguaacuacaaagaaaauagauauaaaauauacacaaaaaggaaaugagaaaggaauuuaaauauuucacuacaaaaagaucaacuacacacaaaagaauacagcaaugcagaaaaugaggaaccaaaagccuuaaggcauguggaaacaaauaggaaaaugacagaaguaaguuccuccuuauuagucuaaaaaaggaaggaaaugcuggcauaugcuacaacauggaugaaccuugagggacuuuaugcaugaaauaagccagacacaaaaaggacaugauucuacuugcaugagauacuuggaguagucaaaauccgagagaaaguagaaugguggucaucaggggcuggaggguagggggaaugaggagcuaugguuucauggguggggguuucaguuuugcaagaagaaaagaauucagaggauggaugguggugguaaugguuacacaacauuaugaaugcauuuaauacuagaccugcacaccuaaaaaugguugugaugguacauuuuauauuauguauauuuuacuaaaagaaaaaagaaggagcugucaugagaacaugcucuacuauuccuaugccccaccugccagacgugccaaugaauaaauugcuauuauuaguuuuucgggaguggguacaugucuggauauuuuuauauaaauacuuaugcagagaaaucagacuauauauucuccuugaccuccccauuuuuuuaaccaaauuguagcauacuaaaauacaguucuguaccuugcuucuucaacuugagaagcuaucuugaagaucuuagggaucuuccuauagauccuggagacuuuuuuuuuuuuuuuuuuuuuuuugagacagagucucacucugucauucugucgcccaggcugaagugcauuggcaugaucacagcucaccacaaucuccgccucccagguucaagcgauucucaugccuuagccuccugaguagcuggaauuacaggcaagcaccaccaugccuggcuaauuuuuguguuuuaguagaugggguuugccaucuuggccaggcuggucucgaucuccuagccucaagugaucugucugaucggccucccaaaguguugagauuacaggggugagccaccguucccgggcacauccuggagacuuucaaauccacauuuuuuuagcugucaggcacuccuugacaccauccugccugcaccuugaaaccagcauuuccccaguacguccuccuccugacuucuuuguuguuccuaguuucuuuucuuuucuuuuuuuuuuuuuuuuugagacagagucuugcucugucacccaggcuggagugcaguggcacaaucucggcucacugcaagcuccgccuccuggguucacgccauucucgugccucagccuccccaguagcugggacuacaggcgcccgccaccacgcccagcuaauuuuuuuguauuuuuaguagagacgggguuccaccguguuagccaggauggucucaaucuccugaccuugugauacgcccaccucggccucccaaagugcugggauuacaggcgugagccaccgcaccuggccuguuguuccuaauuaguuucauggucccuuuggugucgcaaaccagacaccucagcaucacucuugccuccugcccuuccagucaguugccaugucucguuaguuccaucugaaaugcccuuuucuuuuauccagacuucuccaauccccauccuccacacuggcugccuucccuauugucuuaacuaagacccuuuccccagucagcucuaccccaccaagucuaaccuucauacuguccccagauugaucuuuggugagcaaaguucuggcgcuuucauacccaagccugggcagguucuacugacucugcaucgaagaugagccccucagccugccuugaccuucugggcccagcuuguccugcucucuuccuauggggauccucuauccagcaugaaggguggucggucaccuucccuccuuccuggcauccucaccauugcucaggccacucagcuuaucucccuuugcaauucauuagaauccuucccucuuuuaaaggcucacugcaaaaucauggaaaaugaccugucuggacccugcguuccugacuuuguccugccuuaacacaaugcuuuuaggucaauuauagcacucccuucauucugccuugaguaauggauugcaagccccuggaagcuaagcugcgccuuaugcuuuggagauuucaucaacuaauuugaauggagucucagauagacauuuuuucuucuuguuacccuuugaagcccacccacuuuuccuguauauuccucuccucccuuuuauuuugcagugauuuuuuuaaggauuauuuuaccuccuuaugagaauuuuggcugguuggucuuaaugaauguuguacaguccuggcacuccugcagcuuccugcccuaguucaaguucauuacuuugacucacauagcaguggggaaaccacgagacacaguccuuggcaggcuagcuuucugugcuucuugcuaaguggaucaugauauuuggaagcuagagaagggaaaaugaggccuggucugagugaauuacauucuuucuuccugcagcuacuugcucauucaagagugauaaaagaauuuaaucaaagcuuuugcauuuaggaccuccugcauuccaugaaagguugcagaucuaggaagagacucaccauugucuuuugggggcaugugauucuguaauggcaguuugaugggacccugcagggccugaacagguuuuguucaucagaccaauucuuuucugguggaagagacuucagacgugugcaggguucucugugaacgaccuguauccccucccugggaauggagcacccauagagaauuacuaagauccugacugcagacaaagaggcgauuuaaggagcaucuguuuugacaauugccauuugcauuaaagcuccugauagcuaucucucccaauuucccacuaacuuucuuccuaaacacccagauaggaaaacauacuauaacucucaaacuuugaaaagagcuugagauccugugauccuaugccaggaccaagggcuggggucucugauaucaagggaaggcaguacaauacggggguuaauaccaggguucuugucgggugcaguggaucacgcuuguaaucccagugcuuugggaagcugaggugggaggaucacaugaggccaggaguucaagacuagccugggcaacauagugagacccugucucuacaaaaaauuuaaaaauuagccaggaguagcugggcgcgguggcucaugccuguaaucccagcacuuugggaggccaaggcgggcggaucacgaggucaggagaucgagaccacgaugaaaccccaucucugcuaaaaauacaaaaaauuagcugggcgcaguggugggcgccuguagucccagcuacucaggaggcugaggcaggagaauggcgugaacccaggaggcagagcuugcagugagcugagaucgugccacugcacuccagccugggugacagagugagacucugucucaaaaaaaaaaaaaaaaaaaaaaaagccaggagccaggugugguggcucacgccuguaaucccagcacuuugggagguggaggagggcggacggaucaccugaagucaggaguuugagaccagccuggccaacauggcaaaacccugucuuuacuaaaaauacaaaaaaugagcugggcaugguggugggugccuguaaucacagcuacuugggaggcugaggcaggagaaucacuugaacccggaaggcggagguugcgaucagccaagaucaugccauugcacuucagccuggaugacagagcgaguuucugucucaaaaaaaaaaaaaaaaaaaaaaaaauuagccaggcgugguggcacauaacugugguccuagcuacucgugaggcugaggugggaagaucacucgaacccaggaguucaaagcugcagugagcuaugauugcaccacugcacuucugggugacagagugagauccugucucuagcaaaacagaaaacaaaacaauuaagauucugagcugagcccccacucugccucaugguagcugcauggccuugauacaguuauucuuaaccucuuuuuuucuaaguuaucucauugauaagauguggaaggggagaaccuauuuauaguguuggcauggaauucaacaagggaauacauguaaagcccugagcucagugccuggcacauagcaaguguuaaauaaguaguuccuauuauuuauuauuacucucugaaaugaugaagaauggccucugguggcugaccugagaugcaagagcuagaccacagggagccauuuagauuucaguuugacucuguguaccuggucgccauagcacucgcuugguaagaaaagcugggaucaggagacagugauccagacagaccaugucagugagugaccuuuugaaaggucacaaaaagcacaggcagacugcuggggcuggaaucucagcucuacucccugcguaagcuucugcaagcuacugaaccucuuugagccucaguuuucucauuugucaaaugggcagcaggaagauguaaaugaauuaguauaugucccagcacuuugggaggcgguggcagguagauugcuugaggccagccugggcaacauagcaagaccuugucucugaaaaaauuuuaaaagauuggccaagugugauggcaugcuccuguaguuccagguacuccagaagcugaggcaggaggaucccuucagccgaggaguuuggggcugcagugagcuaugauggcaccacugcacuccagccuaggugacagagcaagacccugccucuaagaaaaaaaaaaaaauuguguggguauuuuaaaaaaccauguccaccacguugugcgugcccaguaaauguuagauauuauuaugauuaucagguuuccuggaccuugcuucagccuggcagcuugggagugguuuuuagggacuuaguguaaaaccuaccucugagauucuauuuguuuccguuccccuaagguugagggugugggggcauagggaucagaccucuggguacaaugcugauaacuuuugggggguauucccagcccuguuugucuguuaaauuaaaaucugguaaagaggucauuucuguagucuaaaucugaauguuuauguuaccaguaggguugguauagaauuguagauuagagggaagagucuucauuuacugaaggucugcagaaaaugugcuguguccuuacauacuuaggaaccagagcugagaaauaucgggagacagcuggagauaugggggaccuauccugauuguuccuccaaccaugggccuggagacaucccccuuugcucauugaguaacaaagagagugcaugagaaaagaagacuguuuucccaauacucuaacgcucaagacaaaauauaccaaaguguggguuuuucucccucaccaagaaauuccccaauuaucugcaaacacuggacuggauguccuacaauuaaauugaauuccguuacuaucuguuacuaucuaucuggaguuaacauuauuugaggagcaccuguuuagacaauuuccauuugcaucaggucccucaggucaagggcucagucccacaagauugcucccacuuaggacaccauuucaaaguccacguggccaccugugcuucugaccauaaaucagagguucccuccuuggguucauucauuuacuagagcaguucacauaacucaggaaagcacuuuacuaauuauuacccauuuguuagaaaagaauacaacucagggaaaggcagagaggcguaagguaaugggagugguacaugcagcuuccacgcccucucugagagcuccauccucccagcaucuccauguguucaccaaccugaaaacugucugaaccucauacauuagggauuuuuaugcagauuucaucaugugcgccugauugauuaugaaccuagucuucagcuccucuuuccucccuggagguuggggagauggcacugaaauuuccaagguucuaaucaugguuugguguuucuggugaucaucucccacuggaagcccaccaagaagugcuucauuagaacaaaagacauuccuaucacccagggaauuccaaaggauuuaggaguucuggccaggaaauggggucaaagaucaaauauuggccaggcacgguggcucacaccuguaaucccagcacuuugggaggcugaggugggcggaucacgaggucagaagauuggcuaaucuucacuggcuaauacagugaaaccccaucucuaccaaaaauacaaacaauucgcugggugugguggugggcuacucaggaggcugaggcaggagaauggcgugaacccgggaggcggagcuugcagugagcugagaucgugccacugcacuccagccugggcaacagagugagacucugucucaaaaagaaaaaaaaagaccaaauauuagaacaaaagaugcucuuugcaacucuauuacuuagggaauuaucaguguuuuaugagcuguguaccaggaaacagagacaaagauuucuauagcuauaucugucugucuaucuguauguauauauuugagauggagucuugcucuuucacccaggcuggaggccaauggcaucaucucagcucacugcaaccuccaccucccagacuuaagcgauucuccugccucagccuaccaaguagcugggauuacagguuuguaccaccacacccagcuaauuuuuguauuuuugguagacauaggguuucaccauguuggccaggcuggucucaaacuccugaccucaagugacccacccaucucggccucccaaaguguugggauuacagcaugagccacugcgccuggccaauaugcauuucuuauuauaaaucaaaguaucacaagcgaaaaacauacauuggccaaucuggaauuccaaacguccucuccuaaaugacuagaagcaaauauuuccaugaucuguaccucuucugccaagucacguguacuccacgccauaguuggcccugcccauaggauccugagugcccuucuccaucgcuucuucucuggccaacaauuuggaauagcaaaugagcugcucccuuugccaggaccaagauguguuucagaagcaucauuucugcuugucagcuuuuggucuguaguucccagccaagugcaccaucugugagcacugccugguacugugaugauuuggcccagagcuccauguggaccugugaaaugcaccaguuccaaacugcugcgcucccugcacccugagucgagguuucagagguggguggucuugcuccucuugcuaccuugaaggugcacuguucaaagacagccucguucuccuggugcuggcaagcauggguuuugccacaucucguaaacuaugagguucccaagugggagagaauggugcccauuauaucacggucaggagcagccuggugggcauaucuuagaucaggucucauguguuuuuuuuuuuuuuuuuuuuuuuuuuugagacggagucucgcucugucgcccaggcuggagugcaguggcgcgaucucggcucacugcaagcuccgccucccggguucacgccauucuccugccucagccucccacguagcugggacuacaggcgcccgccaccacgcccggcuaauuuuuuuguguuuuuuaguagagacgggguuucacuguguuagccaggauggucucgaucuccugaccucgugauccgcccaccucggccucccaaagugcugggauuacaggcgugagccaccgcgcccggccaggucucauguguuuuuguguguguguguguguguguguguguguguguuuguuuguuuguuuugagacagggucucacucugucaacccaggcuggagugcaguggugccaucuuagcucacugcaaccucugccucccaggcucaagugauuuuccugcuucugcgucccacguagcugggacuacaggugcccgccaccacaccuggcuaauuuuuguauuuuuaguagagaugggguuucaccauguugcccaagcuggucucaaacuccuggccuuaagugauccacccuccucggccucccaaagugcuaggauuacaggcaugagccacugcaccuggcccucaugaugucuuugcaaaaauagauucguguccuugagcuucuaagccucuaugaacaguuagaccucacugugggugcagauagugagaugaugcccacugcugauagaccgacauuccagagggaguaccugggcaaaagaaccacaguacuuggggcgucuccuaguccagugcuucuuaaccuuccucuucuuuuuuuaaauaagcaccucccaagaaccuuuucagauaugcauuuuucuaguugucccacccucuugaaauuuuguacagauacacuguguauuauguacuguagcccuagaagagccgcaagccauuguaauaucuaacauuggcuaauguuauuuuguucccuaagaagccauuuucaccccauugugggugauacugucacucuugagaauguauaguuuaguucaagacuguuuggccauccagccccaccugugacuaguggaggugauuuggggugagcagagaguuacugcacaaauguaacaagcaugucuauccaagacguggagccacguggaguuagcuuucagaggugucaaauucuagguagacugggccauucuccuuucccucuagcuuucuacuuuucacuuuuacaaauaccaguugaguaucuaucuguaggcaaauaucuuguucuauauucaagauaaauguuguuuuauuuuuucucuaaaaaugaaguuauuaaggucagguaugguggcucaugccuguaaucccagcacuuugggaggcugaggaaggaggaucacuugagcccaggagaucaagaccagccugggcaacauagcaagacccccucucuauuuuuuuuuuccccagacagagucuugcucugucgcccaggcuggagugcaguggucuuaccuuggcucacugcaaccucugccuccuggguucagcgauucuccugccucagccucccgaaucgcugggauuacaggcaccugccaccagacccagcuaauuauuguauuuuuuguagagaugggguuucaccauguuggccagacuggucucgaacuccugaccucaggugauccaccugccucggccucccaaaguguugggauuacaggugugagccaccucacccaaccccccucuauuuuguuaagugcauuguuagauccaaaggaaacagcacuuuacaggaucuugauugguacuuccugucuauaucugggacaaguacaccaggaaugcauuauagaggugaucucucuguauuucuggcagcaucgacuagugugcuuuuggaaguauuugauaauuuugaaggcaagaugguaacucguugcuugaauuagcuuucuuacgauuaccagcaagagugaaauuuuagacuuaucuuguuggaugauaagauaaaucaauuucuucuccagaggccaccgacugccccucuucauuuggugguuaaauccucccuuucccauugacuugccacgccucccuaauccuuuaggaaauuuuaccucugcugggaucuguuccuggacaaucuguuccuggacaaucuguucugaauuauuggcaucuugaugcucacaucugcuuggcauugugaaauagguuuugaaugaauauucuuugaaggugaaugcacucugagagggcauugauuuaugugugggcauuuggacaaacucuugugugcagacaccuggcugucugugcuggcugcagccaagguagggauguggugaacuuuugauggaguugcccuuuugagcaguucagagggugcagaaugcuacacugaugacuccuggaggacccaacaaugccuugaagguucgcucuugucuguugaguuggcucaaguccaccuucugauuacugucagcucuagcaugaaagauccagcagaugcugaauugaacaaagaaagaacgagcaagagacaucauucauucauuguacaaguacauacugaaugccugcuuugguguucaauauacaaagauguuucagaccaaguccuugaccuugcagaacugacaaucuuuugcuugugagauaggcaugcaaaucagugacugggauauaagguuuuauuuuauuuuauuguuuuauuauuauuauuuuuuuagauggagucuugcucuuauugcccaggcuggagugcagcagugcgaucuuggcucacugcaaccuccgccucccagauucaagcgauucuccugccucagccucccaaguagcugggauuacaggcauggacaaccacacccagcuaauuuuguacuuuuaguagagacaggguuucaccauguuggucaggcuggucaagaacuccugaccucaggucauccacccaccucggccuuccaaagugcugggauuacaggcaugagccaccgcaccuggccaggauacaugguuuuaaauucuacaguagguacacauggaguuaguaggagagagagaaaaaaaguucgaccaguucugccuaaugagaucaggaacaaaacaaaaagagaacaugacauuucagcuccgucuuagagaaagagaauucaccagauagacaagugagggaaggcaucccggacagagggauaggcauacacaugcacgcagagguguaaaggagcuuguauuuuaugcaaagguuggggacaaauugaugcaaaagagauagugaggcuugaacacuaugcugaggugguaucccuauuuucagucaaaggugcuguucaggccgggcaugguggcucacuccuguaaucccagcacuuugagaggccaaggcaggcggaucacuugaggucaggaguuugaggccagccugggcaacauggugaaacccugucucuacuaaaaauacaaaaauuagccaggcuugguggcuugcuccuguaaucccagcuacucuggaggcugaggcaugagaaucacuugaacccaggaggcagagguugcagugagccgagaucacgccauugcacuccagccugggcaacagagcaagacaccaucucaaaaacaacaaaaaaagugcuguucaaauauagaaagcaugaugagauuuggucuuggggaauuaaacucagaacugcauagaagagacugcgaagguaagaguguaaaagccgugcuacucauaacagaaucguagcuaggaacauuaauucuuagaaggauuuucucaccuucaugguugaaaagggaacuagccauugaguaaugaggaagauacagcaaccacagauacuuaagaggugaaaucaagaaggcuugaugacuacauguauaugugggugacaaggaugguggaagagauggggugaagcugccacuuccaucauguacaacugggcaauucggaguaaaaggagaagcaggggugagguauaaccauguuaagugggaagugaugguuggacauuuagcuagaaauacugucaaauguuuaggaauaugugguuuugguuguacuaauaauugccaguuucuugugguacuuucagucauugaagaacauugaacaguuuuaaguaauguuaccagcucuucuucauugauugaggucaugccaagaagaaaagcguagagguguuuauugcaucagguacgguaggucaaguucagcuuguuugcaacucauauuuacaucuucuccuugcaggggauggccagguggauuuugaugaauucaugaccauucuuggccccaaacuggugucuucagaaggucgcgaugguuuucuugggaacacgauagacagcauauucuggcaggugaguaagaauauuuuuuuucagacuaaguuugacaguaaaugugucugagacuaacuuuugacugaauucuugaacuucuauuuggcacgugaagaucucuucugggcugagcgacauauguuccagaacaaagaaucaaaacaacuacuuuuuuaggguuuggaggagugaaauaucuccccauuuuuuucuuguagcaauuuuuuuuugcauuagggaaaaaugaaauuauucuacugcacauucacaaaagucuuuuuccuggggacacuucaaaggggcacacugauauuaucugaaccgguucuguguuugaccccaguuccgggauaucuuugcugagagaauggcaugguugccugguacauuuggaucccgucaauauccuugcacuuaaugagagagaaugguuuugucuaagaauguguauucagugcuucucaauuagcuccuguuucuaucuuguaaaaucucuuaggaaauuccaaacaucuaacauuguaauuauuaaaguauaaugaaaucauuuuuauauuaguucucuacucuuaaaaugugacaauuauuuuaugauuauaaaauuuagggaguggguuaucaaucauuauuuuaaaaaauuugaaucacguaaguugucugucaaauuaaauuaaauuaccaguuagacacguaaaacgccauucagacacagcaugauuuuucuuuuuuuuaaauuucuuuuuuuuuuuuuuuuaauuuuauuuauuuuauuuuuuguuuuuucccuucaccaggagauuucucuaaccuagauaaggguugcaguuggugugucuuucuagucuuauucagguacccaucuugcauagaaccaacaaguauuuaguaagaacuuacauaugcuauaaucuaucagugcuuguggguuuuacaaaaggcauuuaagacucagaccuagcuauuucacaauuuggcuggggaagcugaauuugguggcucaugccuguaguuccagugcuuugggaggccaagacaggaggaucgcuugaggccaggaguucaagaccagucuggguaacauagcgagaucccgucucugcaaacaauuuuuaaaauuagccaaaugugauggcgcaugccuguagucccagcuacucuugaggcugagggaggaagaucgcuugagcccaggaguucaaagcugcagugagcuaugaucacaccacugcacucuagcaugggcaacagagcaagacccugucucaaacaaacaaacaaaaauaauaauuuggcuagggaaacacaauuaagagagggaaaacaaacaagugauuaauuagugugauggucacuagacuguaacuccuugaagcacagggcuucagaguuguagcucacucugugcaugcuguacacagcaagcccucaauaacuauuuguuucaauagaugaauggaagggcaagaaaggaggaaaauacagucuugaagggucagaaaagaauuuagggaaugugacacuugcuuugaaccuugaaguauggguggaauuaaaugcaaagaaagaaaagagggcauuucaguucugccaugaugagaguuugaaaagggguuggcauggggaagucauugaccaugacuaagauaccguuugaagggcaagaccucaaaacccacuggcagaauggauuuagggccugaagaaacagaagaggugaggcugauuccagaguucccaacuugcuguuauuggcaggggucagaucauggagcaacagagaagucuugugggguugaauccucaauuggacaugcugaguagaaggugagggucaagcagccaaguaaagggaggaagucuaugcacagcugaaaucaguuggggcuggaacaccggauugagauucaugagagcugguggguaaaauuauaggcaaggaugagcucaccgagggaaggugcauaaaagaggaugagcagagagaugggaccuggucccagaggacauccaggaucaggggagagugagacaggggcucgugaaucccccacugcugacaggaaaacgccaucucccugaacuguuguuaggauccagaacaucuccaggacccuacucaccaugcaaggagaauauugcagugcucauggaaccuucaguuaugacuugacacuugcaaggaccaauagguagaguccccugguggaaauaagaaaugaccccagaguucagaagaugaaggaauauuguuucccaucuggccaucuuuugacccauggagguccacucugaugaugggccuuggcgaguugcuucuccccugggcguuucuccuucuucuuucucucauucuccaucuauucuccugaaugccuuuuugcuuguuuuuuguguauuuuagagauaggguuucauuccgucaccuaggcuggaggguagugaugcaaccauagcucacugcagccuugaacuccuggacucaagugauccucccacuucagccuuccaaguggcugggaccacaggugcaagccaccauacccugcuauauuuuucuguguuuuuugguagauauggugucuugcuauguugcccaggcuggucucaaacuccuagccucaagcaaucuuccugccuuggccuccuaaagugcugaguuuacaggagugagccauggcaccugagccccugaaugcuuccuacucuuuaccuccauccuuagggccaacuaaggagaauguuccaaggccuugugaguucuaagcauucuucuuucuggcccucaucuggaugagaaggagcuauggcuacuuaaucuacacuccuacuccuccugucuuccagguucaucacaguagagcguguacacugcaaggaaauauaucucuuacaauauauggacugccuguagcuuaauucagacaugcuauaaugcucacaaagucuccauguuuuugucuuacucaagauuuucuuccccacucagggugaaaagauaggcuggagaaaggagggaaaauuccaucuugaaauauuuaaaucaaugcuggaagucacagacuuaguggcuguggcuuuccucuccugcuagugcucacccagcucagaauuuuacgacuagcaagcaagaacaaaaacauccaucaauucucaguaaucagccuccccuucuucccccugcgacugccugccccuucagagacagcgugaaaaaaugguacuuaaaacuucuacagcauuggcuuguuucuggaaaagaguucagguucccagugcuugggugguuuuucagguuuagaagaaagcugagugugugcaugugugugugugcacauauauauacauguguguuuccuuccuugaagugauugaagauaauauacaaaaaagaagcagaaagguugcuuucccaacacagugagagccugucucuaaagcagauugaaaaauuagcugggcaugguguuaugcaccuguaguccuagcugcucuggagcugaggcaggaggauugcuugaggccaggaguuugaggcugcagugagcugugauugugccacugcacuccauccuggcugacagacugagaccugucucaaaaaauaaaacaaaaauaaaaaauaggaaaaguagcuuuucaccuccagauauccaggcagaagauauugaucuuaggagguacugauauccuugaaagaagaccauccuacuuaagagacucuagcaaggcuucccaucagugacauagucaguuuuccguggaaacagaccugagacuacuucuagaaggguauauauuuguggucuuuggcugcauaauacauuacaccaaaaucuagggccagaaaacaacacuaaauauuuucuaucucacuuaguuucuguggguugggaauuugaaagcuggcugagcugggugguucuagcucagggucucuaauccaguugcagccaagaugcuggcuggagcugugaccagccuugggcuugacuggacuggaagaugugcuuccugguggcucacucaccuggcuggcaaggugacgcuggugguugacgggagcccucaggucccuacugcacagaccuugccacaaugcugcuugaguguccuccugacauggcagccaguuucccucaaagccagugauccaggacagugcuaggcaagagcaaugauaucuuuuaugcccuagcuaucaaguuggacacaaucauuucugcaauauucucuugguuacacaggucaucccuauuaagugugggagagaacagccucccggugaaugccaggaggcaggagccauuguggaucacuuuggaggcuagcuaccauaaaggguaaagauucuguaauuggacuucaacuucugaucugacauugcugccccaagccuuccauuuuccccaggcuuggguuucuuccuaccuuagaggaaaccuauaaccaaggcuauucucuguaucacugagaagcaauccuaucaagcacuaggugccuuuuccuaauaaaauccuucuuccaggccagacaggguggcuuaugccuauaaucccagcacuuagggaggccgaggugggcggaucaguugaggcggggaguuugagaccagccuggccaacauggugaaaccucaucucuacugaaaaaaaaaaauacaaaaaaaaaaaauuagcuggauauggugguaaucgccuguaaucccagcuacucaggaggcugaagcaugagaaucaucugauucugggagguggagguugcagugagcugagaucgagccacugcacuccagccugggugacagagcaagacccugucucaaaaauaaauaaauaaauaaaauaauuuuuuuccagugcuuuccuuacugguguucuagccuauagugccaaggguagaauaaaaucaaaugggauucagcaaaaacagcuauuuauugguugguacuagucgcaaaaguuaugagccccuggcucuuugcaggaaauugauuaacagugaagggggaauauaguuggcuacaaaugcggcuuccuuuccggggaggauggucugagagucaugccccagggucuccaguccucccggcauacgcucagcccucugggugugagacucuuggcagccaguucagaaccgcuuuccuaugcauaaguuguaaagcugugauuguguucuuagucuucguucaucaagcuucuguguguuuuuuuguuacugcagugguauauuugcugaggaaaugugaaacuguguauggagucagccuuaggauaugguauaugggaauggcagagaggagaggagggaaggaagggacugagcggggcugagacucaggacugggggguaggcuuccugcucaaugcugcagguuaauugcaccugccaagaagucaagcacgguccucagggucccugcuuuuccaccauuuauuuacgccacacaucaugugccuacuuguauccaagaauaagaggcuuaugauacaguagauguccccaaguggcagaggaaagagcccugcuauuuuaucaugguguuuucaugaauuuaccccagcagccuuuuucauuuucuucugcuugaccucaagccccgugcaaccguguucugccaugaguuugcagacagcaagcuauagagagcauaugugaaaggaucaugggagauuaaacaggucugccaguccugggggccagccaacacuucuguuaaccucuuuucccucugaagaaacagagaaaugagucccacacuuggugaggagagcugagcuguuugugugucuuacuuuugccaccgugagguucaagaacaccucggccagagugacgccgaaaacaucucauguagaacuggguuccuuugcucacauuuuuaaucuuauucacaaucaaaccuuauucaugaagacuucacuaauuuagacuuucuguuuuaagaaaugaaauauucacaguuugugagcaaauagaucugcucauuggauggugcuggucguguuggaaugaguccggggcuaaaggucgggagacaagaagcccauaauagcucccuggucuuuuugcaugcucaggacuuuugggcaauacucccgagcacacacgaaguccagggagccauucugcaagcuggucuuuagaauagcuuguuuaucccacagcugugugcaaugugcaagacauuguaaauuacccuagccugaaagugcauaggguacucguuccccaauuugguugggaugaaagucuguuugccacgcugacuugcuuugccucucccugguuaucaaucauaggucugcugcuguccaauccucacucaucuggugggagaauaugcagcaggugcaguaaaauaccugcaucuacuccccagaaaccuuuccggaaaggcuuuaccuuuugucucuccaucccaguucuugcuguggucucgugucuccuguggcuuuccauuucugcuuugguccuggacucuuuuuuuuuuuuuuuuuuuuuaauuuuugagacagagucucucucuguugcccaggcaggagugcaguuacaucaucucggcucacugcagccuccaucucccggguucaagugauucucaugcuucagccucccaaguagcugggacuacaggugugugccaccauacccagcuuuuuuuuuuuuuuuuuuuguauuuuuaguaaacacgggguuuugccaccuuggccaggcuggucuugagcuccuggccucaagugauccacucaccuuggccucccaaaguguugggauuacaggcaugagccaccgugcccagccuggucuaggaaucuugaucucugucucagguccucaugcaaaaccuaguucuucccagcccaggcccaggcuuuugucugggacauuuuauaagcuggucccaccgugauggcagagaugggcaggugguuugguuuuaaaauuacugacuuuaggccuggcacaguggcucauaccuauaaucccagcacuucaggaggccaaagcaggaguuuaagagcagcccaggcaaugagugacacccuuucuuuacaaaaaauucaaaaauuagcgaggcauggugguacauaccuguaguuccagcuacucgggaggcugaggcaggaggauugccugagcccaggagguugaggcugcagugagcuauaaucaugccacugcacucuugccuggucaacagagggagauucugucucaaaaaauaauaauaauaauaauaaaauaaauaaaauucuugacccauggacaguugagagcauuugcauuucaugguugugacaugugaaggaaauauuacauacaaaaagcuauaauacaaugugacugcaaaucuguuaugcauaaaaagacuggaaggaaauauauucaaucauugacagugacuuuuuuuuuuuuuuuuuuugagauggagucucacuccguugcccaggcuggagugcaggggcgcaaucucagcucacugcaaccuccaccuccuggguucaagcaauucuccugccucugccucccaaguagcugggauuacagacgcccaccaccauacccagcuaauuuuuguguuuuuguuagagacgggguuucaccguguuggccaggcuggucuggaacuccugaccucaggugaugugccggccucagccucccaaaguucugggauuacaggugugagccaccgugccuggccucucuuccauucuuaaucaucuaauggaaccuuaauaguuuucagcagugaugucuauaucaaggccugcuagacugacagcaagccuucauuccccacagggaucuuaccaaguguggaaaaauggaauaugggaagcauucauguuaacagugguucucaaagugugguuccuggaccagcagcauuaguaauaccuggaacuuguuagaaaugggaauucuggcccagcaagugacucacaccuauaaucccagcacuuuaggaggcagaggugggaggcucucuugagcacagggguucaagaccaguaugggcaacauagcaaaaccccaucucuagaaauaauaauuuaaaaaauuagccuggcgugguggcacaugccuguagucccaguuauucuggaggcugaggugaggacauugucggaauccaggcaguugaggcugcagugagccaugauugcaccaccucacuccagccugggcgacaagagugagagccugucucaaaaagagaaaaaaaaaaaaaaagaaagaaagaaaugcaaacuccugggccccaccuauuaaauugaauauucaauacugaccuguugaaucagaaacuccaggccuauggcccagcaaucuguuucuauuagcccucugggugacgucaacgcuggcuugaguuugagauccacuuaguuacaggauuuuaaugagccugacauuugggacaaggcagcgaguuaguuuuacugaucugguucugacccuugcuuccuuccaggcuugguaauuuggguuuuucuuuuaguuauccuuauucauaaguguaauugaucuuuagucuauuuaacacuauaauuuuaaacuguuuugaaaagguggagaaauuaccuaucaauauguagcuaauuucuaaguaggaaauaauuuucuaagcauuggaggcaauggaacaaucaaauaauacuaacuuauacuauuagauuauaagaauauuuaaaaagcuaacaaaggcuggacgcagugucucacgccuguaaucccagcacuuugggaggcugaggcggaggaucgcuucagcccaggaguuugagaccagccuggguaacaaagcaagauccugacucuacaaacaaauacaaaaauuagccagacauggugggacaugccuguagucccagguacuagggaggcugaggugggaggaucaauuuagccugggaggucgaggcugcagggagccaugaucaugccacugcacuccagccuagacaacagagcgagacccugucucaaaaaguaaacaaacagaaaagcuaacaaacuggcaaaaauauggcaauuuguagaauaaaacacagguacagaacauuucuaaagcuaugugaaaccucuugacaauaaaugggauaaagagcaauagacaacugauagacauuugaaauaaacauuaaaacagcucgaccucaccggaaaucuuagaaauguuaauuaaaauagggauugguuaacaguuaucuucucagaauggaaaauaaaucauguaauacucaaaguugucaggagcaagauaaaauaggcaaacucagcugguugcaguggcucacgccuguaaucccagcacuuugggaagcugaggugggcggaucaccugaggucaggaguuugagaccagccuggccaacauggugaaacccuguaucuacuaaaaauacaaaaauuagcugggcgugguggcgcacaucuguagucccagcuaccugggaggcugaggcaggggaaucaccggagcccaggggacggaggcugcagugagcugagaccaagccacuguacuccagccuaggcaauagagugaaacuccaucuaaaaaaaaaaaaaaaaaaaagagccaacucauauaacacugauagaaauguaaauagaaagaaauguauuuacaauuucuuuguagaaauguaaauuuguaaaucauacaacuuuucagaaaacuauuuggugacacuuggccauaauuuuuaaagcccuauaauuuaaaauauguucaaacccugugauuuaaaauaauuuucuacauuuaguaaucuaccauauaaaaucagucagagauguaggaaaaugcaauuauaaagauaaaauauuauauaauuguuagaaauaauauuuucacuuuauaguaaauggaaaagccaagauagagauggaauuuacaguauaauuacauuaccauccuacaucuauuaugcccauuauauuaaucuauuaugcauccauuuauagucauagaaaaaaauggaaaaaauucugauuguacuuauuuugacuggcacaaaagugaauaauuuuuucuuuauacuuguuuguauuaggcuauacggucuauucuguuauuauucaguaaaguuaacaaaaucucaaauuagucugggcaugguaucuccugucuguaauuccaacacguugggaggcuaagacaggaggaucaguugagcccaggaguuugacaggagccuaggcgacauagugagacucugucucuaccaaaaauaaaaaaauuagcuggguguggugucaugcaccuguggucccaacuacuggggagguugaggcaggaggaucacuugagccaaggagguugaggcugcagugagccaugaucacgucacugcacuccagccugggugacagccagauccugucucaaaaaaaaaaaaaaaaaaaaaaaaucucaaauuagcaaaauuacauuauccaacaauuguuuucaggggcaaaaacaaaaaggggagaagugauuggaauuuaaagcauuucuaguucacacgcccaugguuaugguaaauggagcacaaaguugauaugagaguauaaaagccggccggguacaguggcucaugccuuuaaucccagugcuuugggaggccgaggcagguggaucaccugaggucaggaguuagagaccagccugaccauuaugguaaaacccugucucuacuaaaaauacaaaaaaaucagccaagcgugguggcgugcaccuguaaucccagcaacucaggaggcugagacaggagaauugcuugaaccccggaggcggagguuacagugagccaagaucacgcccuugcacuccagccugggugacggaaggggacucugucucaaaaucaaucaauaaauaaauaaagccuaaaaucaaaauuaaugcagcugccagcugccaggaggaaaagaacucacuggagaccacugaguggcagcugucacccaaagccacuguaugacccucugcugcagaggcugcaggaggcgcaaggcaggacugucacagaugcugcucuccacauaccagccuuauguccaguuaauaugcugaaaacucauauuuugggaaaaagucugaaaugauuuuaugaucacaaaaaauaaauugauuaaauguaauuuuuguuuuguuuuguuuuuugagacggagucucacucuguugccaggcuggagugcaguggcacgaccucggcucacugcacccuccgccuccugggucaagugauucucuugccucagccuccugaguagcuggcacuacaggcacccgccaccacacccagcuaauuuuuguauuuuuaguagaaaugggauuucaccauguuggccaggauggucucaagaggaccucaugauccgccugccucggccucccaaagugcugggauuauagguuugagccaccgugcccggccgauuaaaaguaauuuuaaaaaauugcuucaaaauaaccucauggcugguacuucagccuguagcugagaugagcugaccagcggcuguagguggggagaagagaaaaaucacuggucacauuaucgggaaaguccuggcaccacugguuucauaucucuguuccauagaaccuucccaaauuauauuuaaaaguauuuuuuuuauucaaucuacuuauccucaaguguuuaacccauaggguaugaugugaacuguagacgcccaggaaggugcagaauuuucauugaaaguuaucuaaaugggcugaguauggugacucaugccuguaaucccagcacuuggagaggcugagaacuguuugaguucagaguucaagaccagugugggcaacauuuuuuugucucuacaaaaaaaaccuaaaaauuagcugggucugguggugcauaccuguggucccagcuacuugggaggcugaggugggaggaucacuaggaucgugccacugcacuccagccugggugucagagugagacucucucucaaugaagcaaacaggagagaaaggaaagaugauuaggauggaugcuaucagaaguagaaucuuggcccugaacuuguuaaacuucagaggaagcagagaaaggagcgagacaggcauggaagcugauggggaccucuuggggucagucagguaaaucccuucaaaccccaaaccagaagugaucaaaggcagguucaggagagggaacaggggucuuccugugcuucagggaugguguccuggaggagccucugaccacggcuccaaugcucuugacccacagcgcagaguucagagguucaacggugcagccaagagaccagggagguggcuacagccaccugacucucuggucagugggcccugauccccacacuccugaccuccucccagccagacacuggggagcaggcccuauacugucuuguggagguacugcugucugguuuuuuguuuuuguuuuuuuuuguuuuuuccuauauugccauggugaauaggauuuuaauuuuccuucuuucuuuuuuguuuuuuuucuuuuuuuuuugacggaaucucacucugucgccaggcuggagugcaguggcgccaucucggcucacugcaaccucugccucccggguucaagcaguucuccugccucagccucccaaguagcugggacuacaggugcgugccaacacgcccagcuaauuuuuguauuuuuagaagagacaagguuucacuguguuggccaggauggucuugaucucuugaccccaugauccgcccaccucagccucccaaagugcugggauuacaggcauuagccaccacgccuggcuaauuuuccuuuccuuuccuuuucuuuucuuuuucuuuuucuuuucuuuucuuuucuuuuuuuuuuuugagacagggucuccucuguggcuggagcgcagugacgcgaucuuggcucacugcaaucuccgccuccuggguucaagcaauuuuucuaccucagcuuccugaguagcugggauuacagacacgcgccaccacaugcuggcuaauuuuuguauuuuuaguagagauggaguuucaccauauuggucaggcuggucuugaacuccugaaugcaggugauucgcccaccucggccucccaaagugcugagauuacagaugugagccaccgcaccugauuuuaauuuuucauuaaauguuucuaaccccuuucugccaguaugauggaaaauggcuuuggaauuuugggcuucaucuggcugccuuauugaauucucucauuagcaagagucuaggugguuucggcugcaguaacuaaauacuacagaccagguagcuuauaaacaagagaaaugcauugcuuacaguucuagaagguucuggugaaggcccucucccagauugcagaauaucaacugauuuccuuggguccuuuuaucccuucaucccuugggauaaggggauuaauccuuuuuaugagucuccacuuucaggaucuaaucagcucucaaagggcccgcuuccuaauaccaucacaauggggguuaggauuucaguauaugaauuuugggaaaacacagacagcagucauggauuuuuccagugauuuucuuaggcucuuuaucccugcaaugacuuugucuacaaauugcagcaauuuuguuaccuuccuuucagcaguguauauuuuaucccauuuguguugacugacaccuauuuauuacuaauaaacaguaagggugauaguugauuuuaggaaauuaaccucuuaccuacuguauuagucuguuuucaugcugcugauaaagacauacccgagacuggguaauuuauaaaguaaaagagguuuaauggacuuacguuuccacguggcuggggaggccucacaaucauggcagaaggugaaaggcaugucuuacaugguggcagacaagagagaaugagagccaaaugaaagggaaacccguuauaaaaccaucagaucuuguaagacuuguucacuaucaugagaacaguaugggggaaaccaccccuaugauucaaugaucucccccagggauggucccucccacaacacaugggaaugaugggagcuucaauucaagaugagauuuggguggggacacagccaaaccauaucuaacuuaccaacauuuuaaaaaccaugaauauaugauagcuuuuucucaaauggccuuugaaucuauaauaauaggaucaugugauuauucuuguuuggacaagaugugauaauuaauagauuuccuauuauuaaaucauuuuuguauucuuaggguuaauauuaguugucaugguagcccauuuucuuaaugcaauuugaauuuguaguguaaguuuugaauuugauuugccauuuuuauuuuuuauucauauuuauaaauaaaagugaccuauaguuuauacaaaauuacaagugucauuguuaguucuugaaacauaguuaaccuagcaugaugaaauuaauuuguuugcuuuauauuauuuucugugauguauaauaaauucuguacaguauggaauugauuuauaacuuugacuuuaggcuugcuaguucauaaacugcuuuuuuguuuuguucucauuuuuuugaggugauuauuugauaaauauuagaaguuaauuguucuucagucuauuuugaaaacuuauauuaucuucagguuaccaauuccucaaaauuacuuaguuuauuagcauuuacuuacauauaacauuguuuaaaaauuuauuugaggccgggcacaguggcucacgccuguaauccuggcacguugggaggcggaggcggguggaucaccugaggucaguuguuugagaccagccuggccaacauggugaaaccccgucuccacuaaaaauacaaaaauuagaugggcgugguggcgggcaccuguaaucccagcuacauaggaggcugaggcaggagaaucacuugaacccgggaggcggagguugcagugagccgaaaucacacugccucaccccagccugggcaaaagcgugaaacugucucaaaaaaaaaaaaaaaaaauugaaagucuucucauaccaugguuugaauuaauuugauaugccagaugauugucuauuuuagugauuuuggggaaaaucuaugcuucuauuuaaugaauaauccuuuuuucucuguuuucauucuaguauuuucagcuuuucucuucauuucccuucucuugcuucuuguucugaucauuuauuaucauuuauaauaauaauuuguguaaauuauuuuauuuaguuuucuuuuuuauuaaugaaauaauuuagauauaaauuuucuucuucguauagcuuuaccauucuggagauuuuuauauguauugugaucacuuacuauauggucuauaauuguagauaauauuuucauucacucaauaguuauuugggagaauguuacugaauaccuuguuuaaauacuuguuauugguuuuucauuuuuuugcauaaucauagaaugucagauauauaauaucuucauacuauuuauuguauccauuuauugugucucaauauguguuugauuucugcaaacauaauaugguaauugaauagauugcuugcacaauuuauaagaaauagagcuacugauccaugaccccuuuccacuaaaaauuacauuaaaaucaugaauguccucauuuauuuuuuaucuacucacuggcuuagacugauaguguuaacauuugucucaauucuguuucugacacuuucucuuugugugugucuguguguauuugauauugccugccauuauuugauugauucauucauucauucaacagaggcuuauugaaagucuuuugagguugggcccagugacucauggcuauaaucccagcacuuugggaggcccaggcaguaggaucacuugaggccaggagcucaagacuagccuggguaacauagcaaaaccccaucucuauuguuuuuuaacaaaauaauuuuuaaaaagucucuugcauagagcgcagauguuguggugaucaauaaacaaggcucucgcacucauggaauuuacauuuuaguguaagggguaggagaaagauaggcauuaaauaaauugauaaugaauaaggaaauuucagauaauauuaaguuguuuuguucguuuuguuuuguguuuugagacagagucucgcucucuugcccaggcuagagugcaguuaugcgauccaggcucauugcaaucucugccuccuggguucaagugauucuccugcuucagccucccaaguagcugggacuacaggugcccgccaccauacccagcuaauuuuuuguauguuuaguagagacaggguuucuccauguuugccaggcuagccuugaacuccuaaccucagguaaucugcccacuucggccuaccaaagugcugggauugcaagcgcaagccacuucaccuggacacaaguucuuuaagaaguugcaagcaucacuucuacuuauguuccccggccagauguuagucacguggcugguggaagucagucacgugccauacguggcagcaagggaagcugggaaaugucgucuuuauuccgaacaguccugguccaagaauuuuaaaaauuggggauuugguugccauuaagaaagggugaauugacacgugaggaagaacugucucucaucucaucaguguguggaguuuggauaugauuucauguacaagcaguucucauuggaguguuuuaagaacuugaguggauugauuuaaucuguaugcaaaguacaucauugguugcugugugaaggaguguaggggcuagaauggaaauggggacccaguuaugaaguuauuuuaggagucugggaggcaugcggaugacucggacuaggguuggaggagcugagaugguguguaaggaacagacaugagcuuuauauuugaauuacagcuguucauuaaauuaauauauggcacuuccauuaugcauccaugauuaccauuuauaccuauaaauagccuucgugguccauccauuauuuuuuucuugaauccuccuuuucuaauauuaauacuaaccucaucucauuuucucuuuauuuguuuucacuggguauaaccucauucauccuuuuucuuuaaaaaaaaucuacuuuuuuagaugucccucucuauaaaaaucaucgugucagaauuauuuuuauaagccagucugagagaauuugucuuuuaauagagugguuuaauccauuggcaauccuguuauaacuguugcuuguucacaguucaguggccccauauuauucuuuuugcuuuuaagcuauuuuauuuuccaucuuuugcucuauugauuguuuuguauauuuuaucuccuaaauuaaauggaacaauagcucuucuuguuagaagccuuuuacugauuuucuuuaccuucaugaaauauguauuuaaaauuauauuugucugaauauuaaauucaaaggaaaaacuaaccucuuauuuuuccuggaagaaaauuuggcuuauauuuacuuuccccauuuacuucccaaugucuguuaaaucuggcacuaugcaagcuggauuuuuuuaaguuauugaaauggcuguagacucacaugcaguuguaggaaaucauucagaaagaucccauguacacuccacccaauuuucuccuaaugguaacauuuuccaaaaccauaauacaauaucauaacugagauuuugauauugauacaaacugcuaauagucuucggaguuccccaguuuugcuuguacucacaugugaaaguguguugacuuccauacaguuuuaucacauguguguagguuucugugucuaccaccacaaucaagcuauugaacaauuccaucaccccuguugcccuuuaaugacaacaucuccucauucccacccccaccccuaacucugucaacuaggucuugguuuucuaaaaagucuaaaauuuugccauugcaaaaauuguauauaaauggagucacauacuauguaauuuuggagugggcguuuuucuuccaucauaauaugcuugagauucauucaaauuguuguaucaauaauuugcucugggccaggcauggguggcucauguccauaagccuagcacuugggaggcugagguggggggauugcuugagcccaggaguuugagaccagccugggaaacauggcagaaaccccaucucuauuuaaaaaaugcauaaguuagcugggcaugguggugugugccuguagucccagcuaccugggaagcugaggugggaggguggcuucagccugggaguuccaggcuguagugagccgugaucacgccacugaacuccagccugggugaaagagcgagacccugucucaaaacagaaaaaacaguuugcuucuuuuuacugcugaguaguauuuuacaggaugaacuguuucaugguaugaaacuuauuuaacccacucacguguugauggacaccuaggcugucucaaguuuuugguuuuuaugaauaaagcugcugcgaccauuuguaugcaggcuuuuguguaaacauguuuccauuucuccaggauaaaagagcucaaaugcacuugcagguugguaucauaacugcauguuuuguuuuauaagaaacugcuauuuuuuuuccacagugaugguagcauuuuacauucucaccagcaauguaugagugauucagguuuucugauucucaccagcuuugguaugucacuauuuuauauuuuagccauucugguagguguggagugaucucucaacugcaguuuugcauuucucugauggcuaaucuuuaacagugaucauuuaccaucuguauguccucuucugugaaaugucuguugaugucuuuugcccauauucuaauugguuaguuguuuuuguguuuuguuuuguuuugcucuugaguuuugagaagucuuuauauauuuuguauacuacuccuuggccagauauguuguuugcaaauugguuaguuguuuuuguuuuguuuuguuuuguuuuguuuuguucuugaguuuugagaauucuuuauauauuuuguauacuacuccuuggucagauauguuguuugcaaaugucuucugcaaguguguaguuuaucuuuucauucucuucuuacaaccuuuggaagaacaaaagcuuuuaauuuugauguggucuagcuuuucgauuuuucccaguauggacugugauuuuagugucaagucuaagaacucugccuagcccuagauacugaagauuuucuccuauuuuuuucuucuaaaaguuuuauaguucuauguuuuacauuuaaguccaugauccagaauuuaguuaauuuuuggauaagguucacaccuuuaggucaagauucauuuucuuaccuacaaauauccacuuaccccagcaucauuuguugaaagggcuguccuuucuccauugaauuacuuugaugacuuugccaaaaaucaauugggcauauuuauguggguguauuucuggguucucuguucuguuucauugauccaugugucuguccugcugccaauucuacacuauuuugauuacuguaacuauauaguaagacuuaauaucaguuaagugauuucuuguacuuuauucuuuccugucaagauuguuuuaacucuucuaagaucuguguauuuccauguaaauuauagaauaaacuugucugugccuacuaaaauucaccaggauauugauaagaauugccuuaaaccuauaagucaacuugggagaauuggcaucuuuauuauguugagucuucuaguccaguggucuaggaauagcgucaucaccuuucuggcaccagagacugguuucguggaagacaauuuuuccauggaccaaggugggggaugguuucgggaucauucaagcacaucacauugauuaugcacuuuauuucuauuauuauuacauuguaauguauaaugaaauaauuauacaacucaccauaauguggaaucagugggaacccugagcuuguuuuccugcaacuagacagucccaucuaagggugaugggagauagugacagaucaucaggcauuagauucuccuaaggagcauacaaccuagaucccucacauguguaguucacaauaacauucacacuucuaugagaaucuaaugcuacugcugaucugacaggagguggagcucaggugguaaugcgagcgaugggaagcagcuguaaacacagaugaagcuucucucucuagccugccguucucccucugcugugcaguccaguuccuaaccaccgcucaccucuugcuaucugguaccgguccauggcccgggaguuggggacaccuguuuucauccaugaaagcaauaugucucuccuuucauuaagucacugauuucuuucacccacauuuuguaauuuuaagaauaaagauccuauacuugucuugacaaggguauaccuaaguauuucaucuucuuuggagugaauguaacauguuuauuguuaguaaauagaaaugugauuuuuuguguuaauuaauaggauuaauuuuucaaauaggcaaauaaaaauuguauagauuuauaguuacaugauguuuugauaucuguauacauuguggaauggcuaaaucaagcuaauuaacauaucaauuacuucacauacuuacugagaucauuuaaaaucuaaucucucaggaauuucaaguguacaauagacuguuagcuauagccaccauauuauauaauagaucuccugaacuuucuccuacugcauaacugaaauuguguauccuuuccucaauaucuccccaccucacaacuccucagucccugauaacuguaauuuuauucucuguuuuugugauuucaacuuuuuuagauucuacauauaagugagaucauggagugcuugccugguuuauuuuucauuuagcauaauguccuccaaguucauccauauugucagagaugacaggauuuccuucuuuuuaaaagcugaauauaauacugucuuguaaccuuacugaucucacuuaguucuaggagggauucguuuguagauuucuugggauuuucuacaucaaaguugaugucaucuucaaauaaagaccauuuaauuccuucuuuuccaaucuguauaccuuuuauuuuucuuauuuuauugagcuggcuagcacuucugguaccaacauuuccugacuuaugguuguucaacuuacaauuuuucaacuuuauaaugaugcaaaagugauauguauucacuagaaacuguacuucaauuacccauauaucugcuuugcuuuuuaacuuucaguauaguauuuaauaaauuauaugagauggucaacauuuuauuauaaaauaggcuuuguguuaggugauuuuuguccaacuguaugcuaacauaaauguucugagcauguuuaagguagguuaggcuaaacuaggauguucaguauauuagguguauuaaaugcauuuuccacuuaaccauauuugcaauuuacagugguuuuucaggaucaaaucucaucauaacucaaggagcaucuguaugauguugacuagcaguggugggaguaaauauucuuggcuccuucccaaucuuauagagaaagcauucaauuuuuucaguccuucacauuagcuguagaauuuuuguaguuguucuuuaccaaguucaguuaauucuucucuucuuuaauuucugaaaguuuuuaucaugaauggguguuguauuuugucagauguuuuuucuguuucacuugauaugguuauaugauuuucuucuuuaguuuguugauaugguggauuauguugauugacuuuuaaaauguuaaauaugacuaaauugauugauuuuuggcuguugaaccagacaugcuuaccugacaugaaucugacuuugucauguuaccaguggccaaucuguaugggucugcagcaaccacaauucuugccuucucagaagaaagaauucaaccaaggggcauaaggcagagugagagacugaggcaaauuuuaaggcaggagugaaaguuuauuaaacagcuuuagaacaggaacaaaaggaaguaaaguccacuuggaagaaggccaagugggcagugugagcuaucaagugcgugguuugaccuuugacuuaggguuuuauauguuggcauacuuccagggucuugugucccuucuccccuuauucuccccuuggggugggcuguccacaugcacaguggccugccagcaccuaggagaggccacauguguauacaguguacaguacacauggguguacuggaguugcacucaugcucucuugaguuggaugcuccuagaaggucaugcaccuguuaaacucugccacuuugccacuuagugcacauacacgagcccauucacccaacuccugagaucuuauugagaagcugaucaccaguuucagguuuuucuaccuguuuagagacugccuuucccugaugcuggcuacaaccaauuacuguuacuuagugcauauacaugaguccauucacccaacuccugagaucuuauugagaagcugaucaccaguuucagguuuuucuaccuguuuagagacugccuuucccugaugcuggcuacaaccaauuacuguuauuuagugcauauacaugaguccauucacccaacuccugagaucuuauugagaaguugaucaccugcuucagguuuuucuaccuauugggagacugccuuucccuggugcuagcuaugaccaauuacuauuuuagagagacaacuuaacaacuaccugcccaucaccugauggucuucugacauuccuggucgagagggaacccucuccggcccugcugaugucugccugacuaccuacuguaacagucaugguguaugauucuuuuuauacauuacuggauucaguuugcuaguauuuuguuaagauucuuacaucuaaguucaugagagauagggucugcaauuuuuguuuguuuguuuguuuugugcugucugguuuuguuaugaggccuuguaaaaugaauuaguaaguguuucuauuucuuuuauuuuguggggaguuguguaaaacuguuuaugggagagaugguauaaaaugguuuuuaauucauauuuaaaugguagaauuuuccaauguaacuauuuaggcuuggagauuuuuucuuuuuuucaaaaucuuuuaaauuaugaaaucaauuucuuuaaugguguagcaucauucagauuaucuauuucaucuguuuuagggguuugugguuuuccaggaauugguccaauucuucuaaguuguugaauuuaugaguauaaaauuauucauaguauuccccuauucucuucuuaaugguugcaggauauauaauaauauucccuguuucauuucugauauuggugauuuguguuuucuguggcuguuuucugucacuguugcuagaggugugucaauuuuauucuuuuuuuuugaaaaauaugcuuuuguuucaaugauuuuucucuuauuuuucuauauccaauuucauuguuuucugcucuuagcuuacuauuugcuucuuuccaccugcuuuguagcuuuuuguuuuguauuguucuuuuuuuaguuucuugagauaggaacuucgauuauugauugacauuccacgcucacuuucuuucaguucucuguauuuuuauuuacuuugagacuucuuugaaccuugaguucagcagcguguuauuaauuuuccagguauuuagagguuuuccuggugucuuucuguugcuaguuucuaguuugauuucauuauggccagguaacauauucugugugauuucaguuauuuauaucuuugugguuuguuuuauagccuuuauauuaucugucuuggugaauguuccguagucauuuaaaaaaaaugcauauggcugggcacagugucucaugccuguaaucucagcacuuugggaggcugaggcugguggaucacuugaggucagaaguuugcgaccagccuggccgacggcaaaaccugucucuacuaaaaauagaaaaauuagcaggguguggugguguaugccuguaaucccagcuacuugggaggcugaggcaggagaguaacuugggaggcagaaugcagagguugcaagugagccaagauuaugccacugcacuccagccugggugacagagugagauuccaacucaaaaaaaaaaaaugcauaugcugcuguuggauggaguguucuguguauaugagcuagauccugcugguugauucugcuauguaguucucuguauacauacugauuguucucccuaguaguucuguccuuugcugagagguggcuguucagguuuccaacuauaauugugaauuugucuguuuucccuguuaacucuguuuuugcuucauguauugugaagcuuuuugauguggccauauuuaagauugcauaucauccugguggauugauccuuugacuauuauauaaugucccucuuugcuucuauuaaauagugauuuucuuugcucugaaguugacuuuauuuguauugauguagccacugcugcuucuuaaaauuaauauuuucagguuauauaauuuuccauucugccuauguuguugaauuugaagucaguuucuuguaaacagcauaaaauuggauugugucucuguccacuuugccaaucuguuuuuuuauugguguacuuagaccauuuacauuuaaguuaauuaucuauguaagucuaccauuuuauuaauuuuuuucuguuugguuccuuggauucuuguuccucuguuuuucuuuucauguaggguacuugaacagcuuuuaggauuccaucuugauuuuuucauugcauuuuaaaguauaucucuuugggugcgguggcucacaccugcaaucccagcacuuugggagaccaaggcaggcgauugcuugaguccaggaguucaagaccagucugggcaacauggugaaaccucaucucuacuaaaaauacaaaaauuagcugggcauguugguguacgcuacuugggaggcugaggcaugauaauugcuugaacuggggagguagagguugcagugagccaagaucaugccacugcacuccagccuggggaacagagugagacugucucaaaaaaaaaaaaaaaguauaucuguucguauaguuuuuguagugguugcucugugacaucagacuuuacugguaucgacauuuugccucuucaaguggaacaugaaaaccgcauuuccuuuuagaaccauuaccuucccugcucuuaaauaucauugucuugaguacaagagguuguuaauaauuugugucucaaucauuaaauauaauuuacacaauuuagaaggaaaaggauagucuauuguauguacccagauugcuacuguuccucuuauuucuuccuccuccuugaugccccaagcuugauucucuucccauuucuuuucuguuugaagaacuucuuuuagggcaguuuuuaaggguaaaucugaucaugguaaauuuuuugguuuuucuuuauccaagaauguuuuuauuuccccucauuucuagagaauaauuuugccagauguaaaauucauagaugggcugggcaccauggcugacgacuauaaucccagcacuuugggaggcugaggcagguggaggcaccuagggaggucaggaguuucagaccagccuggccaagauggugaaacuccaucuuuacuaaaaauacaaaaauaagccaagcacaguggcgugcaccuguaauuccagcuacuugggaggcugaggcacaagagucgcuugaacccuggaggcagaguuugcagugagcugagaucacaccauugcacuccagccagggggacaagagcgaaacuccaucucaaaacuaaauaaauaauaaaauuaaauucauaaauaaaaauuauuuuuauuuuucacaacuugaagaauguugugccacuucuggccuccauaauuucagauagggacauuauugucauuugaauuuuuuuugccuauaaguaaugcaucauuucuuucuggaugcuuucuagaauuuuucugaguuuuuaguuaucaucagaaguucaauuguaacauguuuuugcauaggcuuauuuggauuuuuucuguaugagguuugaucagcuuguugcaucuuugguuuguguuuuucaccaaauuuggagauuuuuggcuauuccuucuuugaauacucuuuagcaccauuuugugucuccucuccuucugggacucugaugagcguugaauuuuuuaauugccccugaggaucuguuuauaucauuucaucuauuuucuuucugguguucauaaugagugaauuuuauugaucuguccucacaaucacugauuuugacaucugucaucuguccucuacucuccuauccaguacauuuugauuuuuuucaguuuuguaauuuccauuugguuccauuugauucuuucuuucuuucuuuuuuuuuuuagagacaggaucuugcucuguagcccaggcuggagagcaguggugcagucauaguucacugcaacccccaaauccugggcucaagccauccuccugccucagucacucgcaugaguagcugggacuaucagugcaugccaccacaaccagcuaauuuaaauuuguuuuuguagaaauaaagucucacuguguuuuccaggcuggucuugaacuccuggccucaagcaauccucccaccuuggccuccccaaaguacugggauuauagaugugcgccaccaagcccagcugguucuuuuuuauaacuccuauuuacuugcaccaccaagcccagcugguucuuuuuuauaacucuuauuuacuuguugagauuuucuuauguuucauuuguuucaguagacuuuuuaauugauuguugaaacaucauggugacuucuuuuuuuaauuuaauuuuauuuuauuuuaaggauacaugugcaggacagugcagguuuguuacauagguaaacaugugccaugguggcuauaucaacccaucauccaggguaauaagcccugcaugcauuagcuauuuauccugaugcucucccucccccuugcucuccugacagacuggauaaagaaagugguacauauacaccacggaauacuaugcagacauaaaacagaaugagaucauguccuuugcagggacauagcuggagcuggaagccauuauccucagcuaacuaacucagguacagaaaaccaaacaccacauguucucacuuauaggugggagcugaacaaugagaacacauggacacagggaggggaacaacacucacuggggcaugaugguuucuuuaaaauccuuuguggaugauuucaaugucugacucaucucaguauugaagucaguuaagugucuuuucucauucaaguugugaguuucuugguucuugaugugaugagugauuuucuauuauuaucgcagauauuucaucugguagcuucauggacucuggauucuauuuaaaucuuuucuuuuaguaggcaguuaucuuguuuagguuuagucauguuuagguuuagucaccucguuuagguuuagauucugguauacuuuugcggacuaugguugcaaugagaacuuguuugcagugccuuuauggugcucuauuagccagccugguuuauacagggcugcuggggucccagugguuccuccuggugcuucuugacggggcagaaaagauuuucuuaggcaaagauggcagguguaucucuuugcgggaggagauucuuaagcaggaacaaggaggcuuccuaagccaagugcuuuuuaugacgagauucuccucugcuguggggaacagagcauuccccaggccacgcacuugugguugaauccacuauacuguugccuccaaucucugggcaacaguauaguggauucaaccacaaggaucaggcuguuuguuuugguggagaucuaccuugcuggggcugucguguuauauuuuggugagagagggagauuucaggccugccagggaaggaaagcaccucccuuagcuuuuuacuguuagugguauuccaauagauccuccuugccugucaugugggguuugucuggggcugcucucaaacuccugaccucaggugauucacccaccucggccucucaaagugcugggauuacaggugugagccacggcagccggccuuguguuuaguuuuguaucauauuuacaacaguuaauuuugauacaggagcuagaaagaaauuacuuaggcagauagugaggcuaaaggaauucucagcaagguuucccuuuuaacaaaaagcagccccaaaauaauuucuuuucuaacaaagagcagccuaaaaacuccagcugcaaacauaaaucagcaggcuaaagcuugcacgggugaaugacagcagcugugcuaauaaaggaggaaccuggaagccaggugcguucagcacggaggcucugucuucccuucucucuucaucacguguacaguaaggaccaggcaacauggcccugggcagguagagaacccaugugcguaauaaaaaauuaggaaggggcgccaggcgcaguggcucagaccuguaaucccagcacuuugggaggccgaggcaggcggaucaugaggucaggagaucaagaccauccugacuaccacggugaaaccccgucucuacugaaaauauaaaaaauuagccaggugugguggcgggcgccuguagucccagcuacucaggaggcugaggcaggagaauggcgugaaccugggaggcggagccugcagugagcugagaucgcgccacugcacuccagccugggggacagagccagacuccgucucgaaaaaaaaaaaaaaaaaauaggaaggggcagccagguucuucgugagcuaugcagauggcacaccugguccaaccaaucuuucguccucuauguaaaucagacaccaccuccuuaagcuacucuaugaaaccuucugcauuucagcacagaacuggcaacucaucuuucuccaggaccccucucuguacagagggcucuccucuuucuuucgccuauuaaacuuuugcucuuaaccucacucugguguguugguauccuuaauuuccuuagcaugaggcaacgaaucucauguauuacuccagaugaauaacaccacuucaauuuuacuaucacuguuuuuuuuuuuuuuuuuuuuuugagaugaagucuugcucugucgcccaggguggagugcaguggcacgaucucggcucacggcaaccucugccucccagguucaaaugauucuccugccucagccucccaaguagcugggauuacagguacccaccaccaugcccagcuaauuuuuguauuuuuaguagagacggaguuuugccauguuggccaggcuggccuugaacuccugaccucaggugauccgccugccucagucucccaaagugcugggauuauaggcaugggccaccgugccuggcccaauuuuacuaucuguaaacaguuuuuauuuacauugucauuccuuuguacuuuaaauuucuuacaucugaauuguuaauuauaauuaaucucauaaaauuuuuaaaaauuuaaacauuucuuaaaaauuuuuauaguagggguuggguauuacucaagagacauauuuuucuaggccuuugcagaucugaaaauauuauuccauuaacuuuaugaauaaaauuaaaauaggacugaauauagaguuuggggucacaacauuuaaauuucagucguauaauucaacauuuuuuguaguaaaaaugcuucauaucaguucaucucuugcagguucauaauguacauuaguuuaauuaaggccuucauuugagaagguuguuuaauuuuguuuagcguaucgugucucaagugauaaaaugaugaugauggaauuuuuguguggugugcuuuuccuguuaauauuuauauccucaggcugggcacaguggcucacgccuguaaucccagcacuuugggaggcgaaggcagguggauuacuugagcccaggaguucgagaccagccugcccaacauggugaaacaccaucucuacuaaaaauacaaaaauuagcuggguguguugacacacaccuguaaucccagcuacucaggagguggaggcaggagaaucgcuugaacccgggaggcagagguugcagugagccgagauuguaccacugcacuccagccugggugacagagugagacuccaugacagacaaaaaaaaaaaaaaagccucauuguugcccaggcuggggugcagcggugcaaucauagcucacugcagccucaaacuccuuggcuugagugauccucccaccucagccucccaaguagcuaggacuacaggcacacaccauccacuaagagauauaauaagugagcacuuacuuauaucuaaaagagaacuugacaaugacuuaaauacuaaagacacagaccuaacaaaaaugggcagucaagguggcaacagaggcuggugauaugucuuccugggccucugcaccuccgucuuccacuuuacauccucagccuguaggaaguacauccucauccauguugccuucuggcuacaaaagggcugcuacagccucagacaccagaacuauauuuggaauggggugggggugguagcaaaaaaaagccuuucuucuccaaugguucucuuucuucuccaaugguucucuuucuuaugagcgaagggaacucuuucucagaaaucuccuagcagcuuuucccuguaaguuucaucagcaagaucagaaugguaugccuacucuuagcagcaagagaagcugagaaaauaggaaaagaggccagugaucgugauuggcuuagaucugcuaugauccacccuuggugcuggagucugucaaccuuaaguaacgagauuuaauaacgauauuucggcuggucucgaaaauaugauuaaguauagaguuuauugcagcccaaagguaagaauagccauucaggaaacacaaacuccagagaaauggggucagugcucucaaguuaaaaguuaaggucuuugcugggugcgauggcuuacacauauaaucccauugguuuggaaggucaaggcuggaggauugcuugaagccaggaguuugagacaaaccugggcaacauaggaagaccccaucucugcaagaaaaauuuaaaacuuagcgggcauggugaugugcaccuguagucccagcuacucaggaggcugaggugggaggauggcucaagccaaggaguuugaggcugcagugagccaugauugcaccacugcaucccagccugggcaacaaugaggcucuuucucuaagaaaaauaauaguaaaaaaaaaugugaaagucuugcuuauauaggcaguaaacaaaggaauuuaguagaauuauaacauuuucuuauacaaggcuaguuuaugagcugcagcaauuuaguuaguuacaguuuauuuucuuuucuaugcagcuuguuuucauuuccuuuccaauuuaaacaaguguauuuaacauuccaucuuagacaaugugauagucauaaugucuuuguguuagaaagguaagugggaaguuaaucuauaaugaagauaaacagugaacagagaaggggucuucccugaugugcuuucaucauuuacaauuucuaaaacaauguauuaacagguaaggaagaagaauaaucuauaaucauacaaacaaagguuauagcugccuagguuacagcugccuguuuaugugacucaguucccauaaucacaugcccuuaagggucaaaguauuuuaaaguuccaacagcuuagauuuugaauuacuuauuuuuacaacucauuauuaucaaaucaaaucaguuuuuuguuuuguuuuguuuuuuaagaaaggaagaggggaagugaguggcuucuggccauaccacaaauggcaccagccacaaccuuccucuaaguaaaauuguaggcagaaugccucacuggaacuacuuuuaaguaucugucccuuguuuucuuguucuuuguagaaaauaaguuugaacuuggcuugauuauauuccuuguagagaaucuguuuuguacaaccugccuggugcuuaugauuuuuuuuucuuauuuguuuaaaaucauguuauagauugauuggucagaaugguucaucuuuauuacuuugcuuugcacuucuaaaauguaggcacaggccuuccauccagugcaguuuucugcuauucucuuuuuuuuuuuuugagacagaaucucacucuguugcccagacugcagugcaguagcaugaucuuagcucaucgaaagcucugccuccuggguucaagugauucuccugucacagccucccgaguagcugggauuacaggcacccaccaccacaucuggcuaauuuuuguauuuuuaguagagacgggguuucaccacguuggccaagcuggucucaaacuccugacugcagaugaucugcccgccuuggccucccaaauugcugggauuacaggugugagccaacuugccuggccuauuauuuucuuuuuuaauucuugcuuaugcuuucguuuuguucuuacucagccuuaugguuuucuccugugcaacacaucgaauucuuacuucuguucucuuccuucauauuugucgacccccccccucacuguuucauaccuuuuccaucugaauucagagacauucugauguugguccucugcguuaguacuccugauuuagagagauucuaauguugguccucugcguuaguacuccuugauuucuggaguguauguugugcuguaugaaacuguuaaccagaaacgggccccaauccagaccccaaagagaugguucuuggaccucgcacaagaaagaauuuggugcgaguccuuagaguaaaguaagagcaaguuuauuaacaaaguaaaauaacguuauuaagaaaguaagggaauaggcugggcgugguggcucacaccuguaaucccaucacuuugggaggccaagacugguggaucacuugaggucaggaguuugagaccagccuggccaacauggugaaaccccaucucugcuaaaaauacaaaacuuagccgggcguggugaugcauaccuguaaucacaguuacugaggaggcugaggcaggagaauugcuugaaccugggaggcagagguuauagugagccgagauuacgccacuggacuccagccuaggugacagaauggagaaaaaaaaaaaaguaaaugaauuaaagaauggcuacaccacaggcagagcaguggcaugggcugcucgauugaguauucuuauaguuauuucuugaugauaugcuaaacgacggauggauuauucaugaguuuuccaggaaaggugugggcaauucuuggaacugaggguuccuccccuuuuuaggccauaugacauugccauggcauuuguaaacugucauggugcuggugggagugucguuuagcaugcuuaucuauuauaauuagcauaugaugagcagugaggacgaccaggggucacuuucaucgccauuuugguuuuaguggguuucggccagcuucuucauggcauccuguuuuaucagcaacaucuuugugaccuguauuuugugccaaacuccaaucucauccugugacuuagaaugacuuaaccuccugggaaugcagcccaguaggucucagccucauuuuauccagccccuauucaagauggagucacccugguuucaaagccuacacaaccuacaacguaauuuugauuuugcucuugguuuuuuauuuuccuaguaucuucuucugucuuucuugaaucccuuucggcuucauucccuuuucaauuucuucuccuccugcuucuguuccauagugugccuggauuuuuuuuaagacacuaagcuguguuaaagcaccaucuuuguuugcuaacagugauuuuuggaguuguuuuucuccucuaaucaggauaauguuuauuuuccuucauuuccuuuucaaaacuauugugcuaacuccccuccaacccucgccccggauccguauuuucccaguauccugcgauuugucgcaaagugcaaagguuaucuaucuugguuuuccaauuucuuuggggcuguuugucuucuuguggcucagagaguguacuuggugguuucuuucuacaucguuucucagacacacggcugaauuagacacauagcugaauuaguggaaauuccucccagauauuggccuugugaucaucuuuuuuuuuuuuuuuuuaauagauggaaucucacuccguugcccaggcuggaguacagugaugcgaccucugcucacugcaaaccuccgccuccuggcuucaggcaguucucuugccucagccuccugaguagcugggacuacaggcacaugccaucacgcccagcuaauuuuuguguuuuuaguagagacgggguuucaccauguuggccaggcuccucucgaacucgugaccucaggugauccacccaccucagccucccaaaguguugggaauagagguaugagccaccgugcccagccagucaucucuuaucuauaguucacaguuggcacuaucuuuuuuauuucuuuguguauucuucugggaaauuagcaaggaaaucugguuugacucugggccagcaugcaauuggcugauacuugcaaaauucccagugaggaguaauagaaaaaagcacagggcuuugaggcaaauaaacuuacucccagcugugccuccuguuugcugugggacugugagccuguuauugugccccucugagccugcuuccuuagcucucauaggaaugucugcaugacaaggucauugugaggaugaaaugagagaccacaucugagaugcuggacacacugucacucacuguguguccaguccccucccuccuauucccauguagugcucuacauggaaacagcaagcaucagauuucuugugaaccagcucugaucgauggcccgggucagcgucugugccuggaucucauucucauagcuagggcccugcuuuuagcgucucauacguggagacuucuccuaauuucccagaagaauacacacagaaauaaauuaaaaauauagucagugccaacugugaccuggagauaaaagaugaccacaggccuauaucugggaggaauuuccacuaauucagccaugugucggagaaaggauguagaaugaaaccaacaaguaugcucucugagucuauuccacaugacugugggcuuggggcaccggcuaugccuuccugagagccgccucugccgcaguuucugugccuggcaggaugcgcgcacacaccuuuggagauacgauaugguguugugguuaggcucauagaugcuggagccaacuggcugcuucugagugccagaugccccuuacaagcuguggaagcacagucaacuucuucuccuuauuuuugcuucauuuccuucaucuuuaaaguggggauaugauuuacacaccuccuaggguugauggaacugugcaaagcauuaaacacuuccugacacaugacaaguacuguaucagugucugcugugaugacgacaaugaugguggugaugaugaugaugaugaagauggccauccuugucguugucaucagacauugucucuugcugcagacuguuugcugacaccuguugucacaccugggcacucugugcccugcugccugacugacacggccucccuucccccacugcucuccagucugugucccuggacccgcuggauucgaggagugaggucucauucccuuccccaucuguccugcacugugcagucaccuucuccacucccagcuauauaugcccaacacuaaaaaagauaaaggauggagacucuagagccuguccuuagagacaauaaaaaagagacgagccugcuauccggaaagauuuagacauuuaucugccugcaggcaagagacugaacugcaugauccuucaaggucacgccucugcucaaaaucuuucaaagacuccacuucucccugaggacagugcaaauuccgaaacccuucaugaucugccuccuaagcccaguccccucucauggggguugcguaacacuuucacaagccuacccugaaaaccucccaaauuacucauggucccaacacauguccucgcaccuccacacuugcccaguggcucuucccugugcccaugggccccucccuuucugcucuccucccugaagcuaaugccugcaucaugcauucauaggcugcuuaguagucagggcuugcuggggaagcagacugccuagcccaccccugggggcccugcuccuguguccucacagcccccgcauggacuugugaaauagcacacgggccccuguccugaagccagugguuccucguguucacagacacugaauaagcacaacucgugacauaaucaaagcacaacuuuuauauuuguuuccuucuguugccccuuuaaaauguaucccaucagagaaaugucacuuugucccuaggugaaaauucuggcaggccugugacuucaguguggaggagauuuuuuuuuuuuuuugacacgaagcuucgcucugucaccgaggcuggagugcaguagcgggaucucggcucacugcaaccucugccucccagguucaagugauucuccugccuccaccucccgaguagcugggauuacaggcguauacuaccgcccggcuaauuuuuguaauuuuaauagagacgguguuuuguuauauuggccaggcuggucucaaaccccuggucucaagugaucugccugccucagucucccaaagugcugggauuacaggcaugagccaucgugccuggccccacaagacuuuuaagaacuaaauauuuuacuccuacaacaaaguacagagcaaauauaggaaacaccauguuauauaacaaaucaccuguacugaacaaauguuaaacuaugcagcauuugcuucagaauuucuaaagaggugaaauauuguagaucuguguccucuuaguuuucuucccgguuuuaaguucuucucuuuuucccacugggccacauuggcuuuuaucuuuucuaaccacauuuuucuguuuuucuauguagguguguaguguaaacaguaaugugcuuuacauaaaaggcaucaaugaaaggugaugucugcagcugaagaucaagaccuuuauucugcucagccaguuucuguucacccacacugugcguguugagaauaucuuguauaauuuuaucuaaaugguguaagacugcaaugagcuggguuuauauuuuuaagcaucaagaugcuuuuuaagauuuaucuggccaggcacaguggcucacaccuguaauccucagguuugaggccugaggcaggccuugggaggccaagucagguggaucaccugagaucaggaguucgagaccagcaugaccaacauggugaaaccccaucucuacuaaaaauacaaaaauuaguugggugugguggcacaugccuguggucccagcugcucgggaggcugacgcaggagaauugcuugaaccagggaggaggagguugcagugagcugagauagugccacugcacuccagccuaggugcagagcaagacucugucucaaaaaaaaaagagaaagauuuauccauguugaugcgugucaauauagauuauuuuaaaugcugcagaauauuucauuauaccaucaucaauacauccagucucauaccauggaucauuuagauugcuuccaaauuuuuauuauuacaagucauguugcuauugaaaucauaacuacuggccagguacaguggcucacaccuguaaucccagcacuuugggaggccaagguggguggaucaucugagaucaggaguucaagaccagccuggccaacacagagaaauccugucucuaucaaaaauacaaaaauuagcagggcauaguagugugcaccuguaaucccagcuacucaggaggcugaggcaggagaaucgcuugaaccugggaggcagggguuacagugagcugauacugagccacugcacuccagccugggcaacagagcaauacuccaucucaaaaaaaaaaaaaaaaaaaaaaagaaaacuaccuguacagcaugaguuucuuuaggacuguguuauugggaauacauaucuuuaguuccauuaagaauugguaaguuguucucucuuuguuuuuaaaguagagauggggucuugcuauguuguccaggcuggucuucaacugcugggcucauucaauccuuccaccucggcuucccaaaguacugggauuacaggcaugaacuacugcacccagccugcugcguugcuuucuaaagagcuuuguuucaaugcacaaucucaucaauaccuuaugaaagcucccacuuaccugcauccuugguaacuuaaucuuugccaauacgcagagugugaaaugauauuucauagucguuuugauuugcucugcuuuucacuucagagaggcugaacauuuccccgucuuuauuggccaguuggguucucucuuuuguagcuugccuguucaucgucuuugccagguuuuucaauuugguggugugucuuuuucuucuuuguuuugauucauuguuguacucuuacauggaguaacucagugcuccugggcaguagcaagcagagaaauaauaacucaagcuacagucugccuggacggcuccaaacucaagccaacuugcuacguccccaggagagagaaagaacuuccaucuuugccaaguagaagaaucugggcaguaaugaaugaggauaacagccaaccauguguggauacuuaauugcgugaaucugcaacuccaugguucauuuccuacauaagcuuagccagagucauucagguguguuugccauacaggguuacucuaaguguaugcuaaaguuauugcugucaggugcauuuacucugcagcuggucugggauggccuuggguggcaagacccaacuccugccaugggucucccauaucucuccagaaggguaccagccccugccaugggucuccuguaccccuccagugauguucacaugguggggcaggauugaagagggagagaauaagcaccuccacauguucaugagucacuggaggcuggaaccagucagcaugguccaaauguucucuccagugcgugggggcaaguuaacucuucuauacaugacucaaauucuucaccuggauaacaucauucuugcuauuuugguuauugugacuuugaaggaugauacacuacaucucucuucaaauuaccguuuauuucaugagaugaguagauucugauucuaaagcaaccaggaguggcuuacacaccuugcgacuuugaucaagcauuuaauucuacuuggcuggcuuccuacuacuuucuuggccuucucauuuaaauggucaaaggcucccaaucauuucacacuucugccuguuccccccucacucucucucuuccacccuccacuaugcaaagagaaagaguguuuuuuuggcucaucugugcuguuucaccugaauuaaccucgcuagcuagaaagccaucaucuuuucuuuccuccuuuguaagagaguauucuuuugauuaauuauuuacucuuaagaguuuauauauauuuuuuagauuagcuagagguccaucuauauuauuagucuuuacaaacuauuaucuuuuggcgcgguuaucaucuccucuguuuuuuucgaucauaauuuauuaaugucucuuuaauauaguuugauuauauuuauuuucagcauuucuguguguuuuuacuuggguuugucuuuguaaguagcauauagcuggauuuaaaagcauccaaucagcugggugugguggcucaugccuguaaucccagcacuuugggaggccgagguggguggaucaccugaggucaggagugcgagaccagccuggccaacauggcgaaaccccguuucuacuaaaaauacaaaaauuagccaggcaugguagcgggcaccuguaaucccagcuacucaggaggcugaggcaggagaauugcuuggaaccaggaggcagaggcugcagugagccaagaucacagcauugcacucccaccucggcaacacucgcaaaauuccgucucaaaaaaagaaaaaaaaagcauccaaucagauagucuuugccuuuaaagagaucaguuuaauccacuuccucuguguguaugugugugcacauauguggguguguguaugugugaauagagacacuguuggacucauuuguacuauccuuauuuuguguuuucuauaucauugguuagguugcauucuuuaccuguugaguagauuaacccucuucucauuuuguuuccuucugaauuggcaucauuguccgagguaaauaccugagguucaugccucaugccgaggaaaucaaggacacagacacacacaagaagugaguuuaagagugaagguuuaauaggcaaaagaaagagaaaggagaauagcuugcucuucucgagagagaagggugccugagugggacucccagcuggcagcagacugcacuggauuuuauagacaggcuugaggaggcagugcaugauuuacauagggcccacagauugguuggaccaggugugauguuuauauagugugaggggaagcuggcugccccacccuaaucuuauuaugcaaaugggcuuucacuuggccugcaccagguugucugcuccuuacugcacacgugguuggcaaagagaagggaagauggagccgccauguuggacaugccuagucccagguagccccuuuccuacugguacaacugccggcauucacccaugcaagcuucuggccugccuuucuaugucugcagcucaguuuuacaggcugcuguuuguuagaaaaggaaaugauuugggggcugcuuuccacugaaaggaagacuuuacugaggacuuccuuacccucacuaucugcccaaaucauuucuucuuaacuccuauuucacuuccuugguuuggaagcuauaaauuguauuucuguuaauuuagagguuacccuugcauuuauuuuuuauucuguuuuguuuugcgacagaguuucacuccuauggcccaggcuggagugcaauggcgugaucuugacucacugcaaccucugccuccccgguucaagugauucuccugccucagccuccagaguagcugggauuacaggcaccuacugccaugcccagcuaauuuuauauuuuuaguagagacaggguuuugccauguuggccaggguggucuugaacuccugaccucaggugauccaccugccuccgccucccaaauugcugggauuacaggcguaagccacugugcccggccgacccuugcauuuuaauaucuuuuaaaauguuuuaaugaaguucaaaauuaauuauucagcaucucuguggccaccgccaccuucauuuuuucuugauuuuuugggugacccugauaauaucacagaggcagggagacagaggggcuucacauuggcugaccagaggcaucugguacucaccuccuucacaaagaagaaccaaaacagccagucgauaaucacauacugaauagaucaccuaagagagaaagcuagaagucaacuaaaaagugagaaaacaccaaaggcaaggcgagggaagccaggcagcgugccuggcugggaugagcugggagccugcaguguuucccauugcaggaaaagagugaguguuucagaaaaacucuucagcuguguuuuuccucgacucucguaccaccaccaccacaacugucaacacagaggaagacuucugugaccagaugcgcagggguuuuccucccacaccaagcagcagacacaagccgggaguccuucaauuccauucugacacuaucuaccuagagagagguagguaguuccacccuccaggaacuuccacguguucagcuauccagaagcuccccaaacugaacccuguccucuuguuuuuuuuuuugguuuuguuuuuucauuucagacagggucucgcucugucgcucaagcuguagugcaguggugugaugucugcucacuguaaccuccuccgccucccagguucaagcgauuauugugccucauccuccugaguaguugggacuacaggugugccuggcuaauuuuuguauuuuuaguagaggcagaguuucaccaugcuggucucaaacucuugaccucaggugauccuuccgccucagccucccaaagugcugggauugcaggcaugaaccaccacccccagccccucuuggguuuuuauggaugccucacgaugucagcauuuugucccccaggguauaggggaggacccucucuggaaagggucuuaagacccacaaucagaaaggcaggggaagauuagaguccugccuuugggcagaugaaaggggggcaggggaaaaucagagagauucugucuccugagacuuguuccuaagaucuaacacacuaaauauuauaacaaaagacuauaacgagggcuaagggaguuauggaccaggaaccauggauaaaaacuaauauauaucauagcacugcggugaaugauucccgguguccacauucccacuguagacuccuguagucuuagccagggagccacgggcaguguggcgguguccuggugugugguuuuucugcuuccuguggccuucuuaagaucagcuccaugucagccccaggguuggaaagaacccuguggccucuuuuccugagucgaggagccugcucucagcaccugcuuucaaggaaugagcugagcccaggugucucauuuuguagggggcaauuuuagacaucuuuccacaggaggggaggagcaccccgcuaccucucucuguuucuguacccgaagucagcaggccuucaguuucagggcaauuuucugcauuacauuuggguuccguuuuuggccuauagaaaugauuacuuuguucuuuaaauggacagugucuuucccuuauuuauguugcagagggcguggaaguggugcucagagcaggcccuucuaucgcccacuggacugguguacugcugcuagauccugaguuacuugaggauaagaaccauuuaaaguauuucauuucuauaucccuaugaggaacacuaugccauuguaaaguggugucaagaauucugauguguuggcugggcgugguggcucacaccuguaaucccagcacuugugggaguccgagagacaggagaaucaccugagaucaggaguuugagaccagccuggccaacaugguaaaacccugucucuacuaaaaauacaaaaauuaacuggacgugguggugcacaccuguaaucccagcuacacaggaggcugaggcagaagaaucacuugaaccugggaggugaagguugcagugagcagaaauaguaccacugugcuccagccugggcaagagagugagacucugucucaaaaaaaaaaaaaaaaagaaaaagaagaggccaggcaugguggcucacgcccguaauccugcacuuugggagucugagacaagagaaucaccugaggucaagaguuugagaccagccuggccaacaugguaaaaaccugucucuucuaaaaauacaaaaacuaacuggaugugguggcacacaccuguaaucccagcuauaugggaggcugaggcagaagaaucccuugaaccugagagguaaauguugcagugagcagagauuguaccacugcacuccagcuugggcaacagagugagacucugucucaaaaaaaaaaaaaaaaaaaaaaaaaagaauccugaugugucugagauuuuauacuacuugcaugcuaaccagugaccugccaugguuuucuggaugcuagcagaagacaugagacaccuaaauuauacaaagaacuuuauuccucaagccauagcaguaggcagaguaucauuauuuuuaguugguccccugagccccaguucccauagagcagggguccccaaccccccggccguggagcaguaaugguccaugaccuguuaggaagcaggcugcacagcaagaggugagaggugggugagucagugaagauucaucuguauuuacagccucucccugucccucucauuccugccugagcucugccuccugccagaucagcggcagcguuagagucucauagaagcauaaacccuauugugaacugcgcaugugagggaucuagguugcacgcuccuuaugagaaucuaaugccugaugaucugucacugucucccaucacccccagaugagacugucuaguuacagggaaacaagcccagggcucccacugauuuuacauuaugaugagauguauaauuguuucauuauauauuacaaucuaauaauaauagaaguaaagugcacaauaaauauaaugugcuugaaucauccccaaaaccauccccucuccccaguccuaggaaaaauugucuuccaugaaaccagucccuggugccaaguuggggaccacuaccauagagugaugcucagaggacacagugucaucugcauaaaauuauaggggaggaccccuuagcuaaggggcaguaggcuugccugaccucaguccuggagggagacaucaucucuaccauacugggcaguaauuaaauuugcacuuucucuggagggagacacuguggcuucaaaggcuguucucucugcaaacauccuugaaaagacaguacugaacaaaagcauuuggugccugugcuuauaagacauacagaaauguaagagauccacagagaauugucuuccaacaaauaguugcucaauaagucuuuuccgcaguuucauuaugugcauaaauguacuacagugauaggauauagugaaagcauaauagucaccagagauggaggauggaucucuaguguugccuaugacucugggauaaacugcagucaauucagggaaguuuggucucucucuauaugcacaaugggaaguaauaggaccaggcaaaagccugucaacaauaggucucgugacaacaccuggagccacagcuggcgcugccccugcccucagugcuaaggcugcuacuguucuucggccagcaccguaaagaauucaugccuguaaucccagcacuuugggaggcugaggugggcggaucacgaggucaggagaucaagaccauccuggcuaacacggugaaaccccgucucuacuaaaaauacaaaaaaaauuagcugggcguggugggggggugccuguagucccagcuacuugggaggcugaggcaggagaauggcgugaacccaggaggcggagcuugcagugagccgagauagcgccauugcccuccagccugggugacagagcaagacucccccucaaaaaaaaaaaaaaaaaaaaaaaaaaagaauucucuagagucccugaguuuuugcaauacugacucaagauucagcaucgugauugccugcaucugguuggacgauccuuaggcauagaagcugacuuguuugaggguuuauucucagaaguggcucaaauucccaccaagacucuuaugguggggaagcucccagacguaagaaaggaaugcagaucuugagccuacacuuugcuuggacacauaucuuuggcagcugcuaagauguguguuagucugcuuuugcuucaggagcuggugggcaugaagagggaugauuuugguuuucuuugcauugcuuuuuuuuuuuuuuuuuuuaaagacagagucucacucugucucccaggcuggagugcaguggcacaaucucagcucacugcaacgucugcuucccagguucaagcgauucuccuuccucaaccucccaacuagcugggauuacagucgcccgccaccaugcacgguuaauuuuuauauuuuuaguagagaugggguuucaccauguuggccaggcuggucuugaacuccugaccucaggugauccacuggccucagucucucaaagugcugggauuacaggugugagccaccacaccuggcucuuugcauugcuuuuuguaagcacuguggagacaugugucucagguaaacucccagcagguguccauagcccaugagacagaccuguguggcugagugccaggcacuagccccucugauuguaaaaucugaugagaggaagcaggugcaacacugucuggucuaaauucucaucaaacucacguuuucauuuuuauuuauuuauuuaaaaauuuugaaacagggucuugcuguguugcccagacuggagugcaguggugccaucaaagcucacugcagccuugaacuccuuggcuuaagugauccucccaccucagccucccaaguuccugggacuauacaggugcaugccgcugugccagcugauuuuuuucuuuuucuugguagagauagggucucgcuauguugccgaggcugguuucagacucuucccuuggccucccaaagcacugagauuagagacauuguuaucaagcaaaagggugcccaaugcacuagaauugauuuugguuuuugaccaaaaucaguucuaugacaucagguuuuuuagaaaagaaaagcuuuauauggaaagucaacucauaagcagacagaagugucaagaucaaauucgucuguuugugguuggcuucaaggcaguauuuuuauuagaaaagguucggguggauuuugagauuaggugauugguggaaagaaagugcucuggaaaguccuugggcaugcgcaguuaucucuucauguuagcucacggguugcacgugcaaauugcagggggaguuagucugaaacaggcaggggaaauucagguugugacaucagcaggcuccuucugugcaaacuccagccagccaucuugguuccaaucgauuucagucaguucuuuuaucucauaagcagagggaguuucagccaguuguuucuuuuucuaucugccauccugcagacucaagaauuuccauucacuuuugguuucuuuuaacucuuugggggcacaguuucagcgugagucacugcacgcagccuuucaagcagccuauccauuuucaauaggauaaggaucaaagggaggaccucguucauuucccaucucugggaacaucucagccaucccugcgcccagcgcuccugucucuggacagaaccuaggcuaggguuccgugcaagagucuguagaggccaucuaugcuccaggacacaggcugcucccauuucugcauuuggggagggagaaucucugggagaaggagccaggcucagugcugggaauguguggcccaagaccauccccaugaccuagcuccacaaaggaagggucccuggaaggucacguccagcuaucauauuugccuuucucucugguucucaguccacccugcuuggggauguuacgugauucaucaccuuucagucauugccaugaccagauggccagccuugggaucuacccccauguguuuuacaucaguguauccucugaaguucuuugguucuugaccgaaaucauuguucaaauaaagucaaugguggacccaagaccagugaccagaaauaaauguuugucuugagaauccucucagucuggugugaaugguuggaaauugucucuuguggagaccggagucuggcauaauuagaguguacucgagaucucaaauuuuaaaagccuuaauauagcugguaauacuauuagguuggugccaaaguaauugcaguuuuugccaucaaaaguaauggcaaaagcugccauuacuuuggcaccaaccuaaccuaauguguuuuguacugaaacugguaucaugaaaagaggauggaagagcaagagagugaaaguuagugcauggagggaggauuaaggggcaugggucuucaugguuaaaaauaauuauuggugugaucucauuaaaaaacuaaauaaaaaagaggccgggugugguggcucacaccuaucaucccagcgcuuuuggaagcugagguaagaggaucacuugaggccagaaaucaagaccagccugggucacaaagcaagauccuaucucuagaaaaauaaaaauaaaaaauuagcugguugugguggugcaugucuguagucccagcuacuguggaggcugaggcaggaggauuuccugagcccaggaguuggaggcugcagugagcuaugauugcacugcugcacucuagcccgggcaacagaacaagacccccuucuuuaaaaaauauaaaaauaaaaaugaaagagcacagguauguuccaugaagcacauggaagauauuggauauggauugugccaggaaaauuaacaagggaggugguggaugggauagagacuacaaauauugauucugccauuggauuuaaacuuuauuguuuuuuaugacugaggacacagaugccacccaccagaggaaugaaugucaaauugguggaacaagaggcuagcacggggcucacaucccucccuaaaugugccucuguugcaggaccugucucugggcuuguuugcugggauggguuugcccagagaagaguaucugucccugcacagcacccuucuugcugaugagaagaaacacagccagugacuaauuggauuuggugaaagccccagcugguugggugggauuuggugacugaugugccgcccugcuguggcuuccuggcuuaaggacaggaccuucuuuccccagacagaagguuaaugagaacagagagcaaaacaucucaggggccuucaucucaucucccagaacuauugcccaaauggagccugugcuggcuuccaaccuaauugcuaauccgagcggaauugcaccaguccaaccucggagcuacagagccguaggccagguggugaccgucuuccuucccagagugccagaaaguuuguuccaacugacagcagggccaggggaaaagaacgucuguggcugcacuuuccaagucacagacaucucugcggaugguuuguuccccagaacuugccaauaccugcccacuuaaugcuugucaauucauccagaucacagauugucacuauagucuacugcuuucugcccagaaucuucaaggacagaauggucaguaagcaucguagcagaagaaaacaccucaaggggugguggaacaggcaccuagccuguguauucuuuucuaaaaaggacuagauagcaauauaagcugugugggguuuuuuuuucuuuuucuuuuuccuuuuuuuuuuuuuuuuuuuuuuuuugagauggagucuugcucugucacccaagcuggagugcaguggcaugaugucagcucccugcaacuucccccucccgaguucaagcaauucuccugccucaaucuccugaguagcugggaucacaggcacguaccaccaugccuggcuaaguuuuguaguuuuaguaaacacaggguuuugccauguuggccaggcuggucucgaacuccugaccucaggugauccaccugccucggccucccaaagugcugggauuacaggcgugaaccaccaugcccagccaagcugugucuuuauugcaaggaugauccaaguuaauaaagaucaucauuuuguuuaccauauauuugguugaauuacaucaauucagacuaugcagggaaggccagccuggacuacuuagagauaccucauuauuuagacauuuugaagaaauggggcuuuauuacagcacauccccacauuuuuguauaucgaagguaauugaaacuaacugcuacuuuuaaaaaguauuuuuaaauggaaucucugagacacauugauaauuagagcauccuuuuauacccucaauuaaaacgccaaagucucuggaaguuuucuuuuuacuuaagucacuuaaacguagcugcgucauuuuauuuacccuuuguuuggcaagggagcucauuuucagugauaauggagaugaagacuuaggcccuccccucaucaaauuaucaugcaucuuaaaugugccaaaucuaaaauucuuaaugaggguuuacaguucauaaacacgucucugguuuuaaaagccucaucuuaagcaaggagaagacacauuucugcucuugccacgcggugagauaaccauauauuggcucacagauacguaucuucuggcuuacccauuauuucuauggugcaaacaucagaagcaaggaauacucaaaccagaauucaggcugggcaagguggcucacgccucuaaucccaguacuuugggaggccgagacggauggaacaccugaggucaggaguuugagaccagccuggccaacauggcaaaaccccgucucuacuaaaaauacaaaaauuagcucggcgugauggugcgcacauguaaucccagcuacuugggaggcugaggcaggagaaucgcuugaacccgggaggcagagguugcagugagccgagauugugccacugcacuccagccagggcaacagagugagaacugugucuuaaaaaaagggaaaaaaaaaacccaaaacagaauucaauuuucagggaaugugccuguuaaguagugcaggauuauuuuuucaaaaauagagagcaccuacuuauguugcuguuaaugagaccaucaacuggaauagaucagcguuugcccucaaagaacccacccuccagugaggggauggugugagggcuuuggaggacaauucucucaccuggcuggcaauuccuggggcucaauguuuauagaacugucccucuuuucaugagugaacaucaggugacuguuccaagcugcaaaauauggggaacaaacaaaagaucgcaagagaucacacucugcccacacgccuugcaggucucaacaucagccucuccugguuacagcugagacagccuugauugcuauacaggaaucaaaugaggggagcuuaacggcccaucaaucacugccaagcacacgugugaaugaagcacgcacgaagcugaaagcugcaugguaaucaacagagaguggcucauuaaaauccauuaaauuuccuaaguuggaaauugauugcugucucucugcacaccaucuaaaucucaucugacagcuuugucugacaucauuuaucacuugcgacaaaauaccaaaggaaaagaggauacaccuuuggccaaauuaucccacuuuaggucuguucuuucugccuguguggaaguauugcacgcucucuuagcagaugaacauaaaagagaagguaaaaauauucuccuuucagauauaaacuaaaacaaaaaauggaucagaccuccaaaggaucauuucucacaaaggccgccauucuauaaccagaagucuuuuggcccacacaauuuucgagucagauauacacgaaguuucuucucccugagcgugcaacaaaaugcaaacgcccacuauugaaaaauccugugggguguucagaacgaauugaaugucaucauuaagcuuugggccuguggaccccuagaaggcugaagguuucagagagagaugcaaauuuaaacauaucaggguccagaugucuggaggguauuguguauucauuuacuugucuauucguggguacuacguccguauucaccucuuuuuaguuggguugagcuugagcaaauagcgucaacucugagugugucuuucuuucuuucuuucuuuucuuucuuuuuuucuuucuuucucuuucuuucuuucuuucuuucuuucuuucuuucuuucuuuuuuuuuuuuuuuuuuuuuuuuuugagacagggucccacucuguugcucaggcuggagugcagugguuccaguuuggagugacugugaauggagcuaugagcaaucacagcucaaugcagccucagccucccaggcucuggugauccucccaucucagccuccugaguagcugggaccagagguguaugcuaccauacuuggcuaauuuuuuacuuuuuuguagagacgggguuuuaccauguugcccgggcuguucucaaagucccaggcucaagugaucccccugcguuggccucucaaaacggugagauuacaggugugagccaucauacacggcccuguauuucuucaccuguguaaugagaauaauaauaugaccuugcuucuugcagaugugacaaucaaaugagauaaugcauauagaauacuuaguuucauacuuugcacauacaagggucucaguaaauauucgggguuuuuuguuuguuuguuuguuuguuuuugaggcagaguuucgcucuuguugcccaggcuggagugcaguggcacgaucucagcucacuucaaccucugccucccagguucaagcgauucuccugccucagccucccaaguagcugggauuacaggcaucugccaccaugcccagcuaauuuuuuguauuuuuaguagagacgggguuucaccauguuggccaggcuggucuugaacuccugacgucaggugauuugcccgccuuggccucccaaagcgcugggauuacaggcaugagccaccacgccuggccucaucuccuuucuuuggccucuuuuuauagcgugccuuccagcagacacacucauuacucccuauuuaccaguccucuuuuguggcugugugccuguaauucucagucauauugcaguauugcuuuugcucuuuccuuuacugguuccuagugucauaaucacaccuaagaugccuucaggaucuuucuugccuccgcugggaaugccgagugaaccugcacaggcuuggaaucuagguguucaagccagccugaaauuggcucucaauuuugcugaaccuaucagccucagaucccuggugcugaucaaagugguuuuuaaauuguaggucuugccauuuggcaguaacugggccuugucaaauaggaaaacgcugggauggugaugacuugagcccuuuugugaauaaggagcacuucccuucucugcuccuuauugaaaaugucacgagcuuuauugccuaaguguuaaagcgcggggacgaagugggaaaucacuuuaacuuccauucagagaauguuguauugccugccuauuucuggagggcauaaaaggguagcuggcugcaaaaaaaaaaaaaagguauauuuugcagauacaagucccaaaaagccuaguugccauuuugcauuggauuucuuaacggccaaagccuaaaaugaguauaagaaugucuucuugguauagccuuuucauugcuacuuggucaaauaugcugggauugugauauaacuuaauauaauaacguaaguugauaaguaagaaaaugaggguguuugcuuagucagaauaaguuaguuucauaucagaaggguacuguuuucucgcaggauuaaguaacuguuaagucuugggauuggaaggaagcaaucauuuaucuaaaugaaucuuuauaggagauccuucucaaaugacuauccaaccuguauauauagugauaaccacugccuagaaacucugucuuuucucggacaguacauuguaucuguucugugccccauuaggaauggguugcugggccgggcgugguggcucaugccuguaauccuagcacuuucggaggccaaggcaggaggaucaguugaguccaagaguucaggaucaguugaguccaagaguuugagaccagucuaggcaacauggugagacccucucucuaccaaaaaucaaaaaauuagcugggagugguggcaugagccuguugucucagcuacuuggaaggcugaggugggaggaucacuugagcccaggaggcagagguugcagugagccaagaucauaccacugcacuccagccugggugacagagugagacccugucucaaaaaaaaaaaaaaaugguccuacaguagccuguacccauuggccccacaccuaauucaaugggacaagucagaauuaauuuacuucccuucuaccugacaacucauaaaauauuuaaagaaagcuuuuguguuuucacugucucucuuucucuucuccgggauaaacuucccuguucccuaaguaccauccuguuuaccuuuuucugauaaugcuauguucagauccuuauuccucauacaaagaaacaucccaaauugaauaaagcaugguagauucugcaugauaguaagccuuaaugaauuauguuuuuauggcuugaauguuuauuaauaugugucaggaggagacacugucaugauuuauuuauguauguauguauucgguuauguacacuguaccuugauuaaaaaaauacuuagucucugacaaguaucuagaccacauuaagauaaaacgguuuguuagaaagaaaucaggacaaaaggcaaaugaaaguaggaaaguaagaugaugcugaggagaagguuaauaccgagaaugcaugucagacacccagugcccugcuugcuaagagccugggcaaaggguaacacuaauuaguuacaggguucacaggcugcaaaagauaaaaacaacuccaguacucaagagaagugcuguauaaccauuucuggugcugaaacguuucuucuuugacuccacaugaaggggagacugaaugaaguauuuggagauauaauuuccaaaauucauccuuuaggugugcaguucuaugauuuuuuuuuucuuuugagauagaggcucacucugucaccgagacuggaauguagugguacaaucauaguucacugcagccucaaccuccugggcucaagcaaucccccugccuuagccucccaaguagcugggacuacaggugagugccacuauaacuggcuaauuaaaaaaaaaaaaaauuguagagguguggucuugcuguguugccuaggcuggucuugaacuccuggacucaagcaauccucucaccucagccucccaaagugcugggauuacaggugugagccaccacagccagccacuucuauguauuuugauaaaacuuaugcacucaucuaacuagcacuacauuaaagauagagaauauuuccaucaccccgggucccggcacgguggcucacaccuguaaucccagcacuuugggaggcggagaugggcagaucacuugaggucaggaguucaauaccagccuggccagcauggugaaaccuguaaucccagccucuugggaaacugaggcacgagaauugcuggaacccggcaggcggagggugcaguuagccaacauugcaccauugcacuccagccugggagacagagcaagacuucaucucgaaaauaaaagagaguauuucugucacuccaaagaaggccucauguaccuuuggagucaguagcccuagucccagccccuaggaacugcuggucugaucucacuucuuguaguuuugcauuuuucaaaaugccacagaaauagaaugaaacaguauauaaccuuuuggccuggcuuuuuuucauucaguauaaugcuuucaagauucaucaguguggauguguguauuacgagucuguuucuuuuuuuuguucaggaguguacuaccauagcuuacacucugugcauuuaucccuucacuaguuaguagacauuugacuuguuuccaguuuggaguaacuaugaauagagucgcuauaaauauucauguacaggcauuugugugggcauauauuuucauuucucucaaguaaauaccuaggugugggauuacugaauaaaaugagaaauguauguuuaacuuuauacagagaugccaaaauguuuuccaaaguggugauaccauuuuuaauuccuaccagcaauauaugagaguuccaguugcuuuacaucuuugcuagcaauagauauucuuagcuucuuuuguucgcuuuuaaauuuuagccuguuuaauaagucuacaguggcaucucauugugguuuuuguuugcuuucuuuucauuuacuuuaguaaauucuuuaguaauauguaugcucaaaucuuccccuuuuuaaauuguauugauugcuuucuuauuauugaguuugaaaguucuuuauauucuuuauucugggcacagacuuuuuucuuuucuuuucuuuucuuucuuuuuuuuuuuuuuuuugaaacagggucucacucugucgcccaggcuggagugcagugacacgaucacgggucacugcagccuugacuugggcucaagcgauuuuuccaccucagccuccugaguaacugggacuacaggcaugcaccacugagcucaguuaauuuguuugauuuuuaguagagacaaggucuugcuauguuucccaggcuggucuggaacuccugaguuaaagccauccugacuugguuucccaaagcccuaggauuacagacaugagucaucacaccuagucagguuucuuuaacagguauuuguuuugugauauuuucugccauauuauaucucguguguucauuaucuuaacagugauuuuugaaaauaaaaguuuucaguuauugugaaguucaguuugcuauuucucuccuucauuauucaugcuuuaugcaucuuaucuaaaaaaucuuugccuagauaaaggcuuucucuguuuucuucuguauauuuuauaguuuuagguuuaauauuuaaguuguuuccauuuugaacuguuuauccacuacguuauuggaauaaacaagugaauggguuucaaagauauguuuccuaaacaguucucaauaaaaaccaaugacaucauggcaaagaauauuccagaaacagcuucuacuggggaagcugaacaaggacauaucuuucuguuguucugacagaauucaaugauaaauuuuagagugucuagagaaagccucuucauuuggggggauuuacaacuuacaaaguugcauguaaaauuaaucuagcuuuaaauuuucuggaagagaagaacuauaauuuucauuaggcuuucaauggggguagugaccaccacuugcuccccaaaacguuaagaaccaugguauuagucuguucuuguauugcuguaaauaccugagacuggguaauauauaaagaagagagguuuaauuggcucuugauucugcaggcuguacgggaagcaugaugcuggaaucugcugagcuucugaaaaagccucaggaaacuuacaauaauggcagaaggcaaagaggaagcaggugcaucuuacauggcaggaccaggagcaggagacagagagagaggagggaggugccacacacuuuuaaaugaccagaugucaugagaacucacuaucaagaggacaguaccagaaggaugaugcuaaaucauucauaagaaauccacccccaugauccagccaccucccaccaccccaccuccaucacugaggauuacaauugaacaugagacuuggguggggacacagauccaaaccauaucaaacauugaccuagggcaggauuccacagaccaagguucacaggccauguccagcuugccacuuauuuugcaaguaaaguuauacugcaacauagccacacuaauuuguauuguccauggcugcuugcuuuauggugacagaguugacuguagaguugaauuguugggauagaaacuacaaggagcaccagaacuauuuguuaucuggucuugcacaggagcauagacagacuguauauccuucagguuaaccugcaaaauagaaauugucucagcugauuuuucuauugaguauuguguagauugaaugcaagauuauacucccugguaguacuuggagggcagaagugugguguugaugguuuugcaaaacuccauauuucaacagugaaaagcucuaagaagcaccgcuacuguccuuuucuacaggaagaagaccaagaaagauccucuaggcuuuuaaauacuaaguuaucuuuguaaauuauuuaggaaucacucaauugagugauacuggggcaucuuuuuaugccccagaacauagcugcaauaauuuuaaauugugaaauauuuuaaguggucacuaccauaugccuaacuuugaacuuucaccaauauaucuuuugguugugcauauaccauaucaguugaaaaauggaucucuuuuaaaugaauaagguaagucccuauguaggaauuuagcuauacaccauuuaagugcauuuaauguuuguuuguuuguuuguuuguuuguuguuacuguuuuucaaauagcagcucugaagcccuucuuuguagaaugaaugagauaccuauuaaagucacuccuggcuuaugaguauaaaauuaugucaucugcaagugagaggaagcuuuuaguuuuccuuacagaagguuggcaccuucuuucuaggacucacacuaaagauugugcuuuuccaaaaguaguaucuuaguaucuaaacaauuaaagggauacuuuuuaaaaagugaggcugggcaugguggcucacaccugucaucuuaguacuuugggaggcugaggcgggaggaucaccugagcccaggaguuugagaccagccugggcaacauaacaagacucuguuucuauaaagaauaauaaaaaguuuagcuggguggggugacaugugccuguguucucagcuacuuggaagguggaggcaggaggaugacuugaacacaagagguagaggcugcagugagcuacgauggcaccacugcacucuagccugggggacagagugagaccaugucuccaaaauuaaaaaguuaaaaauaaaacgugagccagaaaacauucuuauuuuccccugaauccucaaaaacggucucuacuaacucaaagucuggcaguguuuuuaaggugcugauugugagcucagcccaagucagugaaaccaucuauuccuuacagauuucuucauggacugauagaacauuacauuggucaguauuggaagacucuuacccaaagcccaucucauucccaacauuucuugcaaagcccagacuuaucauuuauacagagggaaacaggcaugcauuuuuaaugaaguguucaauaaguuaaauauaucuauacuuuggaaugaaauaaaggguuguuccuuuuuuuguuuuguuuugguuugguuuuuuuuugagacagagucucgcucuguugccaggcuggagugcaguggcgugaucucagcgugagccacugcgcccagccgguuguucuuuugaaaaugauauuaaugaucuugcugagagcuaucuccaccacucaauaaaaccuuacacucauucuccaagcccacaugugauccaaguuuuccaguacacuagggcaagaacccaggauacagaaagcccucuguccuugcgauaagcagagggucuaauugagcucauuaacacaagcugucugcagacggcaaagcugaaagagcacacuguaacagacgcccaccaaggcuucaggagcuguaaacacucacccuuagacacugcuguggggucagagcccaaaaaugcuccccacgaccccuacaccugccugucugcaugcuuccuuaggaguuugagcagcagggcagcaaagaagagucacaacccugucgcacauccugugacgggggauaaaggaacacucccauuucaguguccauccguaggggaaugcguaagccaaaguauaugauaugacauacuuagcaacaguucagauguacauacauagcaguguggauaaaccuuaacaaugcucccuuuagucaaaaaagaaacaaugagauucauagcaggaaacauuuauguuuaaauacacggacauugaaaacaagacauauuuuggggacaguauaucagaggggauaagaauaugaauuccucagccaaacuucauagguccuaaucccagcuccacuauuuaccucuuauguuagaugaguuacuuaauuuuugugccucaguuuucccauuugcaaaauggugauaaucucauugcauugcuauccagauuugaugaguuaauguacguguagcauuuaaaauauagaauaagugcuaauaaguguaaucuauuauugcaguacauguaucaguauuacauauaaaacauauaaaguggugaccaaggggguaagggaaaaaaaguggaauuuggggaccaaggagagacgauaagaaaaaaagaagagaaaaaguuuccuaggcugggcacgguggcucauaccuguaaucccagcacuuugggaggccaaggugggcggaucauuugaggucaggaguucaagaccagccuggccaacauggcaaaacccugucucuacuaaaaauacaaacaugagcugugugggcugggcacaguggcucacaccuguaaucccagcacuuugggaggcugaggcagguggaucacgagguaaggagaucaagaccauccuggccaacauggugaaaccuugucucuacuaaaaauacaaaaauuagccgggcgugguggcgugcaccuguaaucccagcuacucuggaggcugaggcaggagaaucgcuugaaccagggagucggagguugcagugagccgagaucgcgccgccgcacuccagccugggugacagagcaagacucugucucaaaaauaauaauaauaauaaaaauaacaaaguuucuuagagcuuacuguuuaguacaggugacccuaauuuugugacacuagcaagaguaaacuuuccagguuuaccugguaacugagauuccaaaacuuaaauaccaguuacaaaucuuggauaccuauguuuaaaccuguccucuuuguaguauuugaaggccaaacugagauccuuauauaugagaauuuauuauacuugaaucuuucaagguuacuagaauuugaguaagcguugaauugaugagaucccgcugaucucuucugauuucauuuuuccuuguuacuuuguucaucucaccagggauugucuuuuuucuuuuuggccuggcaauuccugacagaucaggcacuagaaggaaaaaagacccacauuugcugugacauacuguagauaaaacugguuuaaagcuuucagcaauuuguagaaaagauguggaagagaaaucuucuccucacggcacccaaaguggaauuuuaaaagguauuagauaaugaaagguuucuaggggaauuugaaaucuucuuagucagucucacacuuucuagcccccugagcucaccagugugaaagguugagaugaggggaaauauucacucucuauauaguccagaauguccauucaaacgguagcaaaugcagagggcucaaauauggcauggcuuuugccagcaguucgcagcauggacucgguauugguauuuguuacagguaauuggcuucugcucacauuaauuaauuuauuggaggcugggucucucucuuucacccaggcugcagugcaguggugccaucauagcucacugcagccucaaacuccugggcucaagugauccuccugccucagccucucaaguagcuggaacaacaggugcaugccaccaggcaugacugauuuuuuaaacuuuuuuuuuuuuuuuuagagauggggucuugcuguguugcccaagcuggucucaaacuccuggccucaagugauccuccagccuuggccucucaaaaugcugggauugcaggugugagccauugugccuggccacaagguuauucuuauaauaacuuuccuaucuugcacuugcaucuuguuuuaugagaaaacggaauacgcagauacaaaugaagagaugauggacauaggguaggcaggugaaaggaacaaacaagauauaaugaggcucccugaggcuacaauagcuggaaauuguucccacuccaagggcugaagggaaaggguuacuggaaccucacgaggucuggaagaggugccacucagcgggaaauaggcuugugaagagacauagcuacugccagaguagcagaguuuugucagaaaguaugcaggggaggaggacccugcccucucucuucugcugcccuugaauuucuugccauugucugaauuggccuaacccaaacagaagcuagcagcaaguuugucuaggagaugcaaucuacagagaucaguuuccaagggcccagggcagagaggugcagggagggaauggcuuguggagauggcaaauggagaauugcgcacacacauuuucuuauuccuuuuuguuuguuuuaauagugagagaaagaaguuugcagauuucauguaacaguacccaugggaguacaguacacaagugaacguaaucuauuacggguuuuauggcagaaaagagauugguaauuacuggucuauggggcugacucccaagggggaaauacagguaacauuuucaucagcuagaucucaugugcuaacauuaaaacagaacuggguuuuauguauaaauacauuugguagggaaauuucuauuaggauguaaauaucugucuuuagaagaggggauguaagcucgguuugauuccuugucugucuuguuugcuauuguauacccaguaucuggcacaguuccuggcauugugaauaaaugaaugagaaguaaucuuucagauaccuuauguauuauagguauagacuaauuggacugacaaugauaguaacuuugcugauuaugugaaauucauuuaagauaaaaagucuuaugagcaguggcucaugccuguaauuccagcacuuugggaggccaaggcaaacagaucaccugaggucaggaguucaagaccagccugggaaacauggugaaaccccaucucuacuaaaaauacaaaaauuagccagguguggugucacaagccugugaucccagcuacucaggaggcugaggcacgagaaucgcuugaaccugggagguggagguugcaaugagcugagauugagccacugcacuccaccugggcaacagaguaagacucugucucaaaaaacaauuaaauuagaauaaaauaaaaagucuuaauaucacgaccagguaaugguguaggaguuugcaccugcauggagguagagaguggaagaauauaacuauuaaaaaagaucuaaaauuagaacugccauucaauccagcaaucccacuaccaggaaagaaaucauuauaucaaaaagauacuugcacugguauguuuguugcagcacuauucacaauagcaaagauauggaaucaaccuaaauaucuaucaguggaggaauggauaaagaaaaugugguacauagacaccauggaauacuacucagccauaaaaaagaaugcaaucauuaucuucugcagcaacacggauggaaguggaagcuacuauccucagugaaauagcucagaaacagaaagucaaauaccacauguucucacuuacaaaugcgagcuaaacaauggguacagauggauguacggagggaaugauagauacuggggacuccauaaagggagaggcugggacggaaguaagauuugaaaaauucccuauuggguacaguguacacuguccagaugauggguucaugaugcaauauauacauguaagaaaccugcauuuguauccucuaaauaugcuuuuauuuuauuuuuuuauuuuauuuuauuuauuuauuuauuuauuuauuuauuuauuuauuuauuuauuuauuuuugagauggagucucucucuguugcccaggcuggagugcaguggugccauccugacucacugcaaccaccaccuccuggguucaaugauucuccucccucagucucuagagcagcugggauuacaggugcccgccaccacgcccagcuaauuuuuguauuuuuaguagagaugggguuucaccauguugaccagacugaucucaaacuccugaccucaggugaucugcccgccucggccucccaaagugcugggauuacaggccugagccacugugcccggccuaaauaugcauuuuuaaaaaagaauacaacugugaagagacaucacauuugguuugcccaggaauugaaauagacuagaacuagaaauagauucuaguccuaugagcaccauggagucugaccacuguccucuugugcugauggaguugggacugggugaccaucgugucucaccuuugcugaaaguauccaccacacauacccuucccccacuuaaaaaaaaaaaaaagcuggaaagguaaaaaagucaaaacccuggaauauguagagauguccuaaacuccaagucucuucuaucuauaucauguuaaaacucaucaggagaacugguauaccccuaugcucuaugcucugggaaaggaacauagucguuuugguagauguuccugggagaaggggaagcccauuuuccuuuccucaaaaggacuugccucucacccaucuuaggaaaguuuuccaaauauauaaaaacaaccaagucuggauucuccaauccuguguuugcgaucuccaagaaagaacagaacacacuucuggacaacuuguccaaacuucagaacugaucacaauguugcuagccacauuaugugaauauuagauuucauguuagcuugucauuuaagaccaggcagaagggaagcuccuccugaaccaugagaccugacucaucacugccuaccaugacaggugcuucacugcuacuaagucuggugaaaaggagaggggcaagccauucaguuugcuuucucuccuagccuuugauagugccacagcuuccagaacauccuugcuuuaauugagcagccuaugccuaucuuuuauaacuaacaagugacccaaaauacaggcaugugaaagccugauacuccagguuucccgucauaaggaaagccacucggagaagucaggcagcauguuggaaagugaucugagggucugaucugucagucaagaaagaacucugggcaaugucuguugugaggcugggugggagacucagucuguuaagguagcagugaugggucaggucucacagugcaggaggagcugccuuucugccugauuuugaacaagcagcuaacaugaaaucuaacagaagagaccacauaauguggcuagcaccauuguggucagcucugaaggauggcaacgcaaguuguccggaaguguguccuguucuuucuuggagaucgcaaacauaggauuggagaauccagacuuugcuguuuuuauauauuuggaaaacuuuccuaagauggguggagaggcaaguccuuuugaggaaaggaaaaugagcuuccccuucucccaggaacuguauauaccacaugugccugggcaaacuugguagucuauugguacuuugugaaggaccaauaaggucuuugacagauaggaagacuacacaaaggggccucccugaguugucuguugugucuuacaaugaagacagggaacuggaggaagccaagagucucaugagacagagaauggaucaaacuaauaauaagcucauuuuaacaagaccaguaugagaauagggcaagaaaccugacaaacagaggggaacaguagauacuggggacuccauaaagggggagguugggagaggugagauuugaaaaauuaccuguuggguacaauguacgcuauuaagaugauggauccauuaaaaucucagacuucaccaugauggaauauaccauguaagagauugguaauuacugcacuuucuuuuuuuuucuuuuucuuuuuuuuucuuucuuucuuuuuuuuuuuuuuuuuugagauggaguuucacucuugucaccuaggcuggagugcaauggcacaaucugggcucacugcaacuucugccucccagguucaagagauucuccugccucagccucccaaguagcugggauuacaggugcaugccaccacgccuggcuaauuuuuguauuuuuaauagagaugggguuucaucauguuggccagguuggucucgaacuccugaccccaggugaucugccugcuucggccucccaaagugcugggauuagaagugugagccaccaugcccagcagaaaccugcacuuucuuagugcgaggugugagccacagcacccagccuaaauuuuucagucuuaaaaugagaacauuccuaguuucuucuccuucuucaaaaacaaaacaaaaaauccggagaaucaccucacuucaugccugucuaacucaccggaaaauugcauuaaucugucugagaacugaaguuacuuaagagauuugccauuuguaaguugaggaaggcauuuuagguuugcagugaucaguacaggcgacagaucguaaugggguagagaaagagugucaagguuugagaguggugucuuuuuugggguuugauuuuuugcagagugaaauauuucaucucugaguugcuuacuacgaaaagagugucuuuguuuuauuuuuuuaaaccucuuuauuuccuuuuuaggcuuuuguaucagauuucaucacguuuuugucuuuccagaaucauuaaugauaaauucuuacagucaagaaaaauauuagaucuaaccaaaaauuuaaaagucacagucccacccaccuccuaucaaucuuucugaaagaaguaaaucaaaauucucucacagaagaugaaagugaauuguccaucaaagccgagaguggcugcuugauuacuucagcauccagaccaugucuucggcugcgauagaaacaagaugauuaauuucagagcuucucucggugucucauuucgcuuucaccaccuccccaccaauucauaaagcucccgugaagggagaugaagggauugacuaucaaaaaaauaaaguauagggcugggugugguggcucacaccuguaaucccagcacuuugggaggccaagguggguggaucaccugaggucucgaguuuugagaccagacuggccaacauggugaaaccucaccuccacuaaaaauacauaaauuagccaggcgugauggugggugccuguaauuccagauucucaggaggcugagacaggagaaucgcuugaaccugggaggcagagauugcagugagcugagauugugccacugcacuccaacuuggguggcagagugaaacucugucucaaauaauaaaauaaaauaauaaaauaaaauguaaaugcuccuggcuugcugugugccugcacugcuacauacaaucaaaacuuuaaauugggacuggacacagucagccccuguaaucccagcacuuugggaggcugaggcuggaggauaacuuggggccaggaguuugagaucagccugggcaacauaacgacacccucccucuguuuaaaaaaaaaaaaaaguuaucagaacaaaaauaauaauaauuuuuaaaaaaaauacuuuaaauugaaauaaugcccaauaguaaaauuuccgggcacucuuaucugcagucuuucuguagcucccaaguccuccccuacagcauacauaugugcccucaaucauccuacucaucacaaaaggaaacaaaguuccuuucugcuauuaaaauucuagaacgggcugggcacaguggcucaugccuauaaucccagcacuuugggaggcugaggagugaggaucgcuugaggucaggaguucgagaccagccuggccaacaugaugaugcuccgucucuacuaaaaauacaaaaauuagcuggacaugguggcacaugucuguaauccuagcuacuugggaggcugaggcaggagaauugcuugaacccaggaggcagagguugcagugaaccgagauagugccauugcucuccagccugggugacagagugagacuccaucucaaaaaaaaaaaaaaauccagaacauacauggcccagucuauacuaucucgguugggggcuuucagugaaacugccggcucugagaucaccagguaccacccaggugccagacuaaauagcggcuuuucaaucuucagcccucaagcccucuuagaguacauucuacuucugacuuuccucccagaggagguugucugucugcuuggucugaaauaagugcaucauagucaggucauguuggaaucugacuccuuccaggacggaucuccugaguuccagaacaucaggggcuuauugagccagggcaugcucaaaacuuaagaucuguacccuauauuaccucuauguugaucaguuuuuuaaucuaaggaaggcaaugcaguauguucuguaauauuuuccacuuagaccaguggggaaagcguucauuuugggguucaacagaccuggauuugaaccccugcugugccauugacuuaaguguggaaucucuaaauucacugauucuugcaguucucacuuagggaguaggggucauauugaccucaaagagcauuuugagauuuaaauaaaggaacguaugcaaaaaguugaucagcuuuucaaccucuccgcugugucauucccauuagaauacugauacaguuuggcugugucuccacccaaaucucaucuugaauuguagcucccauaauugccauguguggugggagggaccuggugggagaucacugaaucacagggacgguuucuuccauacuguucucgugguagugaauacgucucacgagaucugaugguuuuaucagggguuuuccguuucgcuugguucucacucucuccugccugccgccauguacgaugucccuuugcuuuuccuucgucuucugccaugauugcgaggucuccccagccaugugggacugugaauccauuaaaccucuuuccuuuacaaauuacccagacuuggguauaucuuuauuagcaguaugagaagggacuaauacagauacaaacauacuuagacaacucucauccuaaaaaacaacauuccacgccuuguaagauguggguaaaauaaauaagaagaauaauagucaaaugaaacugucuguuccccuguagagaagaguuaaaccucacuccucuucacugcucugaaucaaccccccagguaguagucuguacucacugcugccaguucucuucucccacugacuccugaaucuacucugucuugauuuucauucuuaccauuccauaaaacaaaacagcucuaguggaggucacugaugaccaccauguugcuaaaucccacagucaauucucaauccguaucuucuuuuuaauguuugagacagggucuuacucugucacucaagcuggaguacaguggcgugaucacagcucacuggagccauggccucccaggcucgugcaguccuccugccucagccuccugagaaggugggacuacacaugcacaccacuaugcccagcuaauuuuuauuauuauuuuuaauuuuuuuuuuaauuuuaaguuuucgagauggagucucacucuguugcccaggcuggagcacaguggcacgaucucagcucacugcaaccuccaucucccugguucaaaugauuuuccugccucagccucccuagcagcugggaauacaggugugugccaccacgccuggcuaauuuuuuuguauuuuuaguagagacaggguuucaagauguuagccaggcuggucuugaacuccugaccucacaugaucagccccucggccucccaaagcgcuaugauuacaggcaugagccacagugcuuggccccauuuuaaaauuucucauagagaugaugucuugcuauguugcccacguuggccucaaauuccuagccucaagcaauccuccugccucagccucccaaagugcugggauuacaggcgugggccacugugcccagccuuuaccccugauucucuagcaauagugaauucauugcaguuguuccaguaagccagauucucagguucucuuuucuuugagagacugagaucauguuuuuuuuguccacacugccaaccaccaaccccaccuugccugccuagcucucccugucuaugaagacauuuccuagcugccucccucaccccccaggagacaggugccuccuauguuccccuguagaaacaucagcccagccccaucagagcaucugccccaugacauggaaacugguccucugcuugucagucucugcaaaguccugcuggcccuuggguccccacucccagcacaaugccuaacacauaaauggcacucaguaaauauuuauuucucaggaaacuuuaucaacaauuauucaaaacacuuuuacacacaucucaaaagagcuauuaugaagguaaaaugcuguuaauaggcgugaaagcaccuuagaaugcggaaaacaccagaaagagaauauguauauuaaagcagaaaauuggcuuuucuccaaagccuugacaguauauaaaggagaagaagaggugacuauaucuuucuccugccaaugagacagcaauucgaguggccuggaguggucauuuaagaugauaaauccauucuucuaccacaaguguguguugauacgcaucuacuuaaauagugcagggaacaaggccauauggaaaauauuaagaugaagaacaggauggaggagagaagccgugggcaccaacagauuaagauaaaguguggaggacugaggcagcugugguggcucaugcccguagucccagcuacuugggaggccaaaguggaaggcuugcuugaggccaggaguucaagaccacccugggcaacauaacgagaucccguuccugcaaaaaauuaaaaacagcagcuggguguaguggugcgugccuguagucccagcuacucaagagguugaggaaggaggauugcuugagcccaggaguuugaggcugcagugagcuguggucacaccacugcacucuaaacuggaugacagggcaagacuuuaucuccaaauaauaaauuauggaggacugagucacgaaagccaugcaaaaggcauuuaugacaagcuaaagaggaaggcacuuucuccuauuagaggaaucgaagaagacuuucuggggauuagaagaagcuggacagguauugaugagcuuugaaugugaaggcaggaaggaugcagggauccuacaggggccgagccgacaagagcaugguggggcuugguuuuagaaaaaagaauucagcagauugugcaagagggaacagcccggcaccuggggcguccguauggccguacuuguaauaguccaggaaugaguugagaucgcuagcgaucuacacuagcuuucuugggucaugaaaguaaugcagccauggcuuccuugggucacggaagugaugcagagauugagcauuuggaggaccgaucaaaucagcuuuuaugugccgcuagccucaaaaagggagcauugccgccuggccaagggacaagccuaugugggccccuuccccucacccagagccgaguccuuguggcagagcagcuccuucucugcugacaugcacgccuucccuggaccaacuguggaguuauuaucauauuaauaccaacaucuuccucaggcaaggaggugaggggggugcacuugggaaaggcagaaaugacugggagccacugagccgcuguugaggcgucaggguggagccaagaaugggaggacccuaagcaugaaaguuucaugauuuaggaagauccugccaggugaccugugguaucuucaauuuagcaguugcaggucgcauauccaauucaacagaucagugauuugauagagaugcaagaaggaagcugcugggcagacucuucauuuuucauacuucagcuagcaacuguuucucuugaagaugucccagaaagcagacucacucacauccuggggugguccugccugguucucccuccaccaucagcagccgcaucuguugguuugggcaagugauggauugguugggucugacucccaggaggggaauggaaaaaaaaaaaggcugcagcaguuugacaaacuagagcacagaaaaagugcaagacaucagaagauccaccauucugcaagucgcuugcaugauuucaaagucaaagacuuugauuucaaauccuggcucagggugagccaaccagaaccagccacugagccauagaugccagguuucuggcugugaucaguuuugucuuaguaggguaugugacaucugccaauccaaaaaguauauuuagagaugcuauagcagaccagacuccucacugaguucuugcagaagcuggaaaaacuuguuucuguuauucguuuuuuguuguuguuguuguuuuguuuuuguuuguuuguuauugagauggaguacugcucuguugcccaggcuggaaugcaguggcaugaucucgacucacugcaaccuccgccuccuggguucaagcgauucucuugccucagccucccaaguagcugggauuacgggcacgcaccaucaugcccagcuaauuuuuguauuuuuaguagagacgggguuucaccauguuggccaggcuagucuugaacuccugaccuuaggugaugcagcugccucggccucccaaagugcugggauuacaggcaugagccaugcgcccggccguuucugcuauucuuuacuguaaguaaaagcauuucuuuacugagaguguuuucuggagaguacaugguguuagagagcucuuugaucaaagucccuuaugccauauaaaaagaaaaggguguugugcccuagaggcagcuaugcugucaucuuuugacugaguaauuaaacugauauuuacuaagagccuacuauguguccagcagguuucaggcacuggccgugaaugagagagauggggcagacaggcaauaaaugaacaaacaaggaaaugucauuuauggauaaauguuaugguagaaauaaaacggggauagacgggggccuauucaggaaugccugguuagggcaggcuucucagagagggugaaauggcuaggaaaggaaugacaggguggagccggcuuuaugaagaacucugggaauggcauucugugcagaaggaacaguagauacaaaguccuaaggugggagcagcuuggcauguucccagagcauuaagaaagccagucuggcuggagcagacugagggagacuggcuggugccagaugugcagugggcugaucagguaggaguauggacgugauucccuguguggucugaagcagcuuuaaguuuaaagagguguguucugacuggauuuacaguuucaaagucugacucggguggcucuguggaucggggguguuagggacaaaagaaggacuugacuacucugggucagggaggaacucaguaugagcuguuuggggccagagugguggggagaggaucaguucgggcuaugcuugcaagucuuuaagaggaccguggugauggauuggucauaggaaugggguguugaaggaagacacagaaucaaagaugaugccuagguuuuuuggcaaguacucugcaauauccaaaaaugcgugguagugauugucggagaccuagauccuauucucaacccuuccauguaucugugggugaccuugaaugagucccucugccucaguuuccucaccuguaaaaugauggaguuggaacagauuacaugaaagaccccuuuccgcccugcccauacuugugcuguggcuaaaacaacugugagcaauucuccucccauaaggggcucacucuccagguguuaccaggggaggguguccagguucuuggcaucucgaacaaagaauuggacaaaaugcacaaaugaagcaaggaaggaaugaagcaacaaaagcagagauuuauuaaaaaucaaaguggccaggcacgguggcucacaccuguaaucccaacacuuugggaggcugaggcaggcagaucaugaggucaggagauugagaccauccuggcuaacacagugaaaccccgucucuacuaaaaauacaaaaaaauuagccaggcguaguggcaggcgccuguagucccagcuacucgggaggcugaggcaggagaauggcgugaacccgggaggcggagcuugcagugagccaagaucgugccacugcacuccagccugggcgacaaagcgagacuccaucucaaaaaaaaaagaaaguacacuccacagguugggagcaggcccaggcauaggggcucgagagcccuguuacagaauuuuuugggguuuaaauacccucuaaggcuggguuugguggcucaugccuguaagcucagcacuuugggaggccggggugggugaaucacuugaggucaggaguucgagaucacccuggccaacauggugaaaccccaucucuacuacaaacaaaaauuagccaggcacagugaugcaugccuguaaucccagcuacucaggaggcugaggcaggagaaucgcuugaaccucagggagagguugcagugagcugagaucacaccacugcacuccagucugggcaacagagugagacuccaucucaaacaaacaaacaaaaaacccucucgagguuuccauugguuacuugguauacgccuuauguaaaugaagaggaugaaguaaaguuacagucacuuacucgacguacacccuuuguaaauggagaggauaguucugucauagcugaaguguuuccauuugauuuagcucuaggaaguccuuauguucccugucuccaaacccuauucuccugccucauagccugucagggauucgcuuccuuacucugaauguccacaauauuuauggccauucuuucaguccagaccgcacugucauagugacaaacuggcagcauggaaaacaaauucuuuuuuuuuuuuuuuuuuuuuuuuuuuuaagagacagagucuugcugugugacucaggcuggagugcaguggugccaucacagcucacugcagccuggaacuccugggcucaagugauccucccaccuuagccucccaaguaacugggacuacaggcacaugcuaccaugccuggcuauuuuuuaaauuuguuuguaaagacagggucucacuauguugcccaggcugguguggaacuccuggguucaagcagucaucccaucuuggccuccaaaaacauugggauugcaugcaugagccacugcaccuggcugaaaacaaauuauuauuuuuuuuuuuuuugagacagagucucucucugucacccaggcuggagugcaguggcaugaucuuggcucacugcaaucucuaccuccuguguucaagcgauucucaugccucagccucccaaguagcuaggauuacaggcaaugcaccaccaugccuggcuaauuuuuuauuuuuaguagagacggggaucucaccguguuggccaggcuagucuggaauuccugaccucaggugauccgcccgccucagccucccaaagugcugggauuacaggcauaagccaaucgugcccggccugaaaccaaauucuaauggagcucagugucacauguaugaugacucucucuuagaaggccauggcuuccuugggucaugggaguaauagagaaacugagcauuuggaagacccaucaaaucagcuuuuauuugcugauuugauuugcugaucaaaaagggaccuuugcugccugggcaagggaagagacuaugugguccucuucccccccacucagaacagaguccuugugguggugcggcuccuucucugcugacauccacaccuuccccagaccgauugugaguccucauaauacaaacaucuuccucaggggugcuggcucaagguaccuuuucccugcaugcacuaucgcccuuucgaugagaagucuggcagauaauuaucaccugaacaaaaucugggcaucagucccccaaaaaugcacugccccucuguggaucuuccuacauaccugccucccuggaaaagagaagaaaaaagcauguccacaucuuucuuuuuuuuuuuuuugagacggagucuugcucugucgcccaggcuggagugcagugcaacuagcucacugcaaccucugccucccagguucaaguaauucuccuuccucagccucccgaguagcugggauuauaggcaccaaccaccacaacuggcuaguuuuguauuuuuaauagaggcaggguuucaccauguuggccaggcuggucucgaacuccugaccucaggugauccaccugccuggggcucucaaagugcugggauuacaggugugagccuccaugcccggcagcaauuuuuaaaaauuguaacugcauuaugagaacaguauuucaaggugacccauuuauguggagauuuuuagaagaagaaaaaaccuccaguauaauuuucuucacuuuuaagcccagugauauuuucagaaauucaagacauaccauagcauaggaaaagggugugucuagagagucucuggcuuccaugucugaucucauucucacuaucaguaucauaucuucauuguacuggauuuuaacucaaacugaaagaugcccucugauucucuguccauuucuguaaaauugccuuaguucaugaugugguugcauugccugagauaauguacauaaaacucccacuggcggggcgcaguggcucaagccuguaaucucggcaguucgggaggccgaggugggcagaucgccugaggucaggaguuugagaccagccugggcaacaugaugaaaccccgucucuacuaaaaauacaaaaauuagccaggcgugguggugggugccuguaauccuagcuacucgggaggcuguggcacgagaauggcuugaaccugggagucagagguugcauugagccgaaaucacgccacuucacuccagccuagguggcagagcgagacucugucucaaaaaaacaaacaacaacaacaacaaaaacacaacucccaccaaacguggcuucugcauggugguucaugccuauaauccuagugcuuugggucaagguaggaagauugcuugagcccaggaguucaugagaagccugggcaacacagcaacucaccuaaaguuucaggugacugaaaaacagcaguuuccuugccaucacucacggcaccgaauucaaagucaggaaauccugauuccagaccgugucagguaccauccaaugccuuacaguuuauuuuccaucucaaggaggaaaaaaggccuuuucaugcuugccucaugacagaugugggaaaaugauguauguguauguaacguucuuggcugucuaggcaugguggcucacaccuguaaucugagcauuuuuagaggcaaacgcaggaggauugcuugagcccaggaguucaagaccggccuaggcaauacagcaagacuuugucuauuaaaaagaaauuagcugagucuguuggcgugcaccuguaguccuagcuacucgagaggcugaggcaggaggaucacuugagccccggaggucaaggcugcagugagcuaugauugcaccacugcacuccacucugggugacagagcaagacccugucucaaaaaaaaaaaaaaaaaagaaagaaagaaauggaacccgcuagauguaaggcaacauaaauuuaggcuaccauuauuauugucacuauuucuauaagaauuagauuuuuuuacucagggucuugggaaacagacaaaaauagaaauguaugaagauauucugauuucccuccuuuggagaaacuuuuuuucuuguuauguucuucagcuaauuaaaacaaaaugagcccaacaucuaccauuucccuaagauccacaauuuccaaaaauccuuuuggaacuugaauugccuagcuaauccacaaagucugcauuugagcuuccaccagaugcagucccuaaagcggcccucaccccaugccucugcugagcagaauuccguucauggggaaguccuucagaagccugcccaggucgucucugcccuaacuucucugaacucuggagcagcgguccccaaccuuuuuggcaccagggaccuguuuuguggaagacaguuuuuccacagaccagugaggaaggaugguuuucagauaaugcaaccacauuacauuuauuauguacuuuauuucuauuauuauuacauuguaauauauaaugaaauaauuacacaacguguaauuacacaucauguagaaucaguggaagcccugagccuguuuuccugcagcuagacgaucuccucugggggugaugggagacagugacagaucaucaggcauuagauucucacaaggagugcacaaucuagaucccucgcgugugcaguuuacaauaggguuugagcaccuaugagaaucuaaugcugcugcugaucugacaggagguagaguucaggcggcaauguuugcucaccugccacucaccuccugcuguguagccugguuccuaacaggccacagacuggugcugguccacagccugggcgaugaggagcccugcucucgagcacuggcacucugcaaugccuauuucauucucauuggguugugccuuguguugguacuuaacugcguuguuuuguguaucuuguugacuuaaugucuuagcccauuuuguguugcuauaaaggaauacccaaaacugggucauuuagaaagaaaagagguuuacuuggcuccugguuccugcaggcuguacaagaaucauggcacccacaucugauuggcuucuggugaggccuugggaagcuuuuauucaugguggaagggaagggggagcagguacaucacauggugagagagaaagcaagagaugccaugcucuuuuaaacagccagcucuccuuugagcuaauagagugagaaccuacuuauuacuguggggagggccucaagacauucaugagggauccgccccuaugacccaugccccucccaccagaccccacuuccaguauuggggaucacauuucaaaaugagauuuggaggguacaaacauccaaacuauaucacuuagcuagauuucaguguagucaccucuagggaaagacguacauguguuuucuccugccuccuaacucuucuucaaggaugcugggagacugguaccacauugguagccaauuucuucaugagcacaaauucaaagauuagacagaggguagcaauuguuuguaaacauaacagauucuugacuucggauguauuaauucacugauuuauaauuaguaauugacucauuaagcauuuugauagcaauuaguuuuuuaaagaacagcuuagacacaauagguaaauuauuacauaaauucagaaauguuuucuuucuuuuuuuuuuuuuuuuuuuuuuugggauggaguuuuacucuuauugcccaggcuggagugcaauggcacgauuucggcucacugcaaccucugccucccagguucaagcgauucuccugccucagccucccaaguagcugggauuacaggcaugugccaccaugcccggcuaauuuugcauuuuuaguaaagacaggguuucaccauguugaccagguugguuucaaaccucugaccucagaugauccacccaccucagccucccaaagugcugggauuacaggugugagccaccacgcccagccauuguuuucuuauuuuuuuguuuuuuaaaauagagauggggucccaccauguugcccaaguugaucuugaacuccugggcucaagugauccaccuaccucggccucccagagggcucggauuacaggcuugagccacugcacccugccuagcagcauuguuuaacacuacaaaaaccauauaaccacugagcuccuucucagaaggaagauggcgaaagcucacugcucaacagugacuagauucauaaccuggggcuuuggucuguuuguuuuaggcuuaacucuugcagauuuggggaaugucagguuccaaaacuugaguucauuauuccugucaauucagggcacacccuuaccauaagcccaugaaagacaccuuguuggguuauuuuauuauuuuuucuuuaucuccaugcucacuccccauuuucauccugccuauacauagaugucuuugaaaauaaauauuauugccgacuccaauuuaauuuuccaagguccuguuccaagcacuuuuauacacauucucuucuuucauccucccaacagcacuaugagaaacauuguuuuggccuggccugguggcucacuccuguaaucccaacacuuugggaguccgaggugggugaaugaccugaguucaugaguucaagaucaaccuggccaacauggugaagcccccaucucuauuaaaaauaaaaaaaauuagcccaugugauaacacaugccuguagucucagcuacucgggaggcugaggcacgagaaugacuugaaccccagaggcagagguugccaugagcugauaucgugccacugugcuccagccugggugacagagugagauccugucucaaaaaaagaaaaauucuuuuguuguucccauuuaacagaagaggaaacagaggcauggauaugugaaguaauuuucccaagaucaugcauuuagcauauggcagcgugaggacucgaauccaggcuacauaaaaccugagcucuagcacucugcaguacuguaucuacucuauauuuuaaaauauacuguguuguuucgcguguguguuuuaaaauguauuugaauguuauugugcaacuacugugaaaccagaaaaugugagacaggucucaguuaauuuagaaaguuuauuuugccaagguugaggaugcacccgugacacagccucaggagguccuggcgacaugugcccgaggugguuggggcauagcuugcuuuuauccauuuagggagacaugagacaccaaucaauuuauguaagaaguacauugguucggucuggaaaggugagacaacuugaaucaaaggcggaagauuggaacgggggaagggacuuccaggucacagacaagugauacacaaacgguuacauucuuuugaguuucugauuagcccuuccaaaggaggcaaaucagauaugcgucuaucucagugggcagagaggggugacuuugaauagaaugggaggcagguuugcccuaagcaguucccggcuuuagguuuccuuagugauauuaguggcccaagauauuuuccuuucguacuacagauacccuucuauaucauaccuucuucauucuacauuaugcuuuuaagaucuaaucaccugcuaaagauaucacuaguugauggaucgccacagagcauuccaucacauccauccaucucagcuuacucuuucuuuuuaauuugaagcacaaaugcuuuaaaggcgcaucucaauucccguguggcgggcaaaaaauaaaauauaggagcagaucguggcacaccauucccaccagccaaguggucaaaccccacauccaagacccagugagcagccaaguucagcgcaacuuccaggccucuugcucugacuccaacagggugagcacgucccccucacacacggggccuuuuacacugcggaugcuggagcggcucguguuguccauaaauuccacgcgcaccugcgugcagugucccugagagccgguccugcccaggaccucggugacccuggccagcuugauaggcugcacguggcugguguccaugacggcggcguggcggucuggcagagucaguugacuguucuguuuuuuguuuuucguuuuugagacagagacuugcucugucucccaggcuggagugcaaugaugugaucugggcucacugcaaccuuggccuccuggguucaagcaauucuucugccucagccuccgaguagcugggacuacaggugugcaccaccacgcccggcuacuuuuuguauuuuuaguagagacaggguuucacuauguuggccaggcuggucuggaacuccugaccucagaugaucugccuaccucagccucccaaagugcugggauuacaggcgugagcuaccgggcccagcccaguugacuuuuuuaugucccuaaugaggggcagucagaaugucucccaaucccuaauccccaaacauucuaauaaacauucucacucauggccccuuacauaccugugugaauuucucuagaauauaucauuuggaaugggauugcuggcauauaaaguacacacugccuguuagauugauuucuggcaugaugaugcuaacuaacccucuucccagcagcacaaaagauucuuuuuucucuaauuucucaugaacauuuaucugacuuuauaauuuuuaccaauuugaugguugucaaguguauaccauuguugcuuuucauuugcauuucucuaagcaugaaugaaauugaaccucucuucauaaacuuggaggcuguuggguuuaccuuucugugaauuucuuauucauauauuuuguucauuuuugauacugggucugcugucuuguuaucuagguaccaucaauuuuagaggcuucaaauauugccuucucagucuuccccccgucaguuaacuucauuuaugguguccuuauugaacagaaauucuuuuuuuuuuuuuugagaugcagucucacucugucgcccaggcuggaguggaguggugugauccaggcucacugcaaccuccgccucccggguucaagcaauucucccugccucagccucccaaguagcugggauuacaggcaccugccaccacacccagcuaauuuuuguauuuuuuuuaguagagauggguuuucaccauguuggccaggcugguuuugagcucuugaccucaggugauccgcccaccuuggccucccaaagugcugggauuacagucgugagccaccaugccuggccagaaauucauaauauugauauaauuauauccacugauuuuggggggcuuuuauuaaaccuuggagucuuguuuggaaaauaauuuccuuagacaucgacuggauauaguggaguaauuuguauaaaacuaagcuucuauaacaaagaacuauaggcugggugcaguggcucacgccuguaaucucagcaccuugggaggcugaagcggguggauugccuagcucaggaguuugagaucagccugggcaccauggcaaaauccugucucuaccaaaauuacaaaaaauuaucuggacgugguggucugugucugugguuucagcuacucgggaggcugaggugggaggaucgcaggaucgcuugagcccuggagguggagguugcaaugagcugagaucaugccacuacaccaacccggccugggugacagauugaggcccccucugaaaaaacaaacaaacaaaaaacagaagaagaacuauaaaaacugaauagcaaacaacagaacagcuguuucaugguauuggaaaguaaacaagacaacuaagacuugaggguccaaaaagucagagagaagagugcauugacauaagccugauauuuuccacagcauuuuacucucaggaaauuugcuguaacaaguauaaagguggaagagaaagcaguggcauugagaucgugguacucacugggaugagucuacaggauuggaguuaauggcuaguaagucagccugaacuugaagggcuccaucccagaagaacagauugcaugaaauuucaccucaaggcauucaccaacucauaaacuguaaaauacaaguucaauacaucuuuguuucuaggugcucaaagcauaaaaaauuaaucagauuuuugucagucucacagugcugaggagaaaaaaaguggagaucagagccuggaaaaagggaggaacccugguaaacuuccagguuuccaguugagacccuugaagggauauaccuuugaagagagggaaaacugcaaaacaacaacaauaacaaagguuuaggaggggacacaguuuuugugcagccucuauaagcuggcugaaacuggcuuaagguccgcaguugcuuauguuguuuguaaggcguauccucuguccauuggaguugauauggucuggguuguaaaucagcugguaacuucccugguagcucccauuguuagggaguuuggcaagaguauggauuuccuaguagccugaggaauuuagaaaugcaccaugccagccaggcccugaccucuaccccuagguauccucuguguccuuaauguuagggucugucuuaguugauauaaagaggugucucagaucacagugugaaucccaaucccagcuccaccacuuccaagcaguguauuuaggcaaauuaccuuuguuucuugccucauuuuccugucuagggaaugugggguggagaggaugaucauaacuaccauccguaaacuuuuuuuuuuuuuuugagacaacaucuugcucuauaacccaggcugaagugcaauggcacgaucuuggcuugcugcaaccucugccucccagguucaaguaacucuccugccucagccucccaaguagcugugauuacaggugcccgccaccaugccuggccaacuuuuuuuuuuuuuuuuuuuguauuuuuaguagaggugggguuucaccauguugcccaggcuggucuggaacuccuaguaucaagugacccauccaccucggccucccaaacugcugggauuacaggcaugagccaccacgcccggccacauccauacacauuaaguguauugagacuguggucacugcuguacuuuggcacauguuaaacacggaauaaguaguauccaguaucgcaaaagauaugaccuaguauuccuaauuccugaccugauuuucccuugccuaucauuguguugcaagaagcuuaaaaugcaugcugucuuuagucugcccucuuauucuuuuauuagaacauugcugaaaagcuuugguuuccuugugucuuguuuucuuccaggacuccauuuuggauucauucauucauucauucaaucauucaaucauccugaugacugaaugcauugaauugaugaugaaggcauugacaagcauugauuuagugcagauguuuguccgucuccugcucuuucaagccucauggcccccuccugcuaucccaccauggcgcucucuguucucagugagucuguggggucugugugugguuuuuuuguucauuuguuuguuuuuucagacagaguuucguucuaucgcccaggcuggaguggcgccaucucggcucacugcaaccucugccuuccaguuucaagugauucuccugccucaggcucccgaguagcugugacuauaggugccugccaccacgcccagcuaauuuuuguauuuuuaguagagacgggguuucaccauguuggccaggcuggucucgaacuccugaccucgugaucugcccaccucagccucccaaaaugcugggauuacaggcaugagccaccgugcccggcccuguguacguuuuuauaaugcuccucucaguucuucuuucccccgccccacucucagacacacauuauggcuauaauguccuuuaugggaaucucuuggaagccccauuaacugaccuuucccugaucuuccuacugacuucacuuuauucauuuguugauuuauuuacccaauguuuuuugagcaccuucuguguuccagguaugauuucagucacuggggauagagcaccaaauaagcaaaaaaaagucugucgucauuguaucacaacuuucucacugucuuucugggcaggguaggcacagcuaugugucccuaucuggaaaugauggcuauggaaugaaauuuccaccccagggaagaaugcagcccccaucuguaugauauuuccugauuaucucugugccaaucucucugauacucuugggaacuugcccauucuuugguaaacucuuucucuuucuacaagccccaacccagauguugcguaaaacgucagucuuucccuaacccucccaagggaccucccugagugcugcauaaauaucuguguugaauaaauagugacagagauaaaaaugaugugguucuggaaaagggcagucagauuggugaaagcacaggcugcauuucacuugggugcugcgugauggaacauagauugcuuuuuuuauuuuuccuuaaacagaccagguaggaagaagguauggcuacagccuucaaauauuuaaagaguuggcaggugcaguggcucaugccuguaaucccaucaguuugggaggcugaggugggaggacugcuugagcccaguaguuugagaucagccuggcaacacagcgagacccuaucucuacaaaaacauuuuaaaauuagcuggauguaaugguacacacuuguagcccuaacagcuuaagaggcugaggugggaggaucccuugagccuaggaaugugaggcuucagugagcuaugauugcaccaccggacucccgucugguccacagggaaaguuuuauacauauauaccugcauauauacacgugaaauuauacaucuauauauauauauauuagauguauauacauauacauacauauuuauaugugucuguauauguaaauacauauauacauauuuauauguguaucuacauauauacacacauauaaauacguaugggguuuuuuuuugguguuguuuuguuuugagacaaaguuucacucuuguugcccaggcuggagugcaaugguacgaucucagcucacugcaaccucugucucccggguucaagcaauucuccuguucaagcagccucccaaggagcuggguuuacaggcaugcaccaccaugcccagcuacuuuuguauuuuuaguagagacaggguuuccuacgugugauauauagauuagaaagauagauauuuaaagagcugccuaauuguauuaguccauuuucaugcuguggauacagacauaccugagacugggaagaaaaagagguuuaauuggacuuacaguuccacauggcuggggaggccucagaaucauggcuggagaugaaaggcacuucuuauaugguggcagcaagagaaaaugagggagauacaaaagcagaaacuccugauaaaaccaucagaucucaugagacuuacucacuaccacgagaacaguaugggggaaacugccuccaugguucaaauugucucccuccaggcucuccgauaacacaugggaauuaugggagcuacaauucaagaugagauuuggguggggacacagagccagaccauaugacuaauggaguuuggaaguggggaucaaauugaaaaaagcuuucaggagaguagauaacagggguuggggaagaauaccuuagaaacaagggcaguucagcagaugagacccaaauacccaccuuccagccuuugcugcagccccauaccagacaaauggaaucuucacgcccuagagcucaguguccauguugaccucccccagaauuucccaggggccuagaagaugguuccaguaucaucaguggcccuuccagcuugguguacagugccagaggagugaagcaaggcucuacgcucaucuuuuuuuuuuuuuuuuuuuuugagacugagucucgcucagucgcccaggcgccugccacuacacccagcuaauuuuuuguauuuuuaguagagaugggguuucaccuuguuagccagcauggucucaaucuccugaccucgugauccacccgucucagccucccaaagugcugggauugcaggcgugagccaccgcgcccaguccacucaucuauuuuuaagcaguagauuuauguagccaugccgaagaggcccugagaagcuguuuauuaugaaaucaaacuugugguuucuggaaacuuuuuucuaacucagcaggugaugccauuagaguucugacauggcuucuggucaugcagagaagaacuuccaggguauuauuuuaagaacaucccaaaugcucugcacaacuucacccaggacaccugggagucucuacuacacugacaggucaacacucccuccuugccugcacugccaaaaugagguuacagaaaaagcuuuagcuaaaagcaaaagcugcagaagguacauguaaccuguagauugcauuuuguggucaagcaucccgcaaccucaagacuaccauugggcagaugggugucuucauuucacucacagcugaaagauggaaaaugaaaagcagugcccuggcaguacaggaggagggauguuuuuuguuuuuuguuucuguuuuuugagacggaguuucgcucuuguugcccaggcggagugcaagggugcgaucuccgcucaccgcaacuucuccucccggguucaagcgauucuccuuccucagccuccagaauagcuggaauuacaggcaugcgccaaccacgccuagcuaauuugguauuuuuaguagagacaggguuucaccauguuggccagccuggucucgaacuccugaccucaggugauccgcccgccucggccucccaaacugcugggauugaaacaccgcaccuggccuagagggaugccuuuuaaugaauccaucuaccacugcuaauucacucugcagacagucucauuccuggcagaaagaccucccauuuuuuccuuccuagggccagaagcacuuuuuccuucuuucacuuguuuaacccacugcuauccugcacccugcuugcugucugcucugggaagagcugaaacaacuccuuugccagauucacaccaauguuagcagccuucugucuaguucgucuucaguaaagccucaucauugccuuggccuggaccccucaagcuuuuucaucuacucuagauccuuagacaacaacaucuacaccagugcuacaguuuggauauguguccccuccaaaucucauauggaaaggugacccugauaugguuuggcuguuugcccacccaaaucucaucuugaauuauagcucccauaauuuccauguguuguuggagggaccuggugggagguaauugaaucaugggggugggucuuuacugugcuguucucguauuagugaauaagugcuacaagaucugaugguuuuauaaacaggaguucuccugcacaaguucucucucuucucugccaccauguaauaugugacuugcuccuccuugccuuccaccaugauugcgaggucuccccagccauguggaacugggaguccauuaaaccucuuuuucuuuauaaauuacccagccuuggguaugucuuuauuagcaacaugagaacagacuaauacaacccucaguguuggagguggggccuggugggagguguuugggucauagggacagaucccucaugaauggcuuggugcccuccccaugguaaugagugaguucucguucuguuaguucauucaagagcugguugcuuaaaaagagccuggcaucucucuugcucccuuucuugucacguggcacaccuguucccccuuugccuucuaccaugaguaaaagcuuccugaggucucaccagaagccaaguagauacaggcaccaugcuuguacauccugcagaaccaugagccaaguaaaccucuuuucuuuauaaauuacccagccucagguauuccuuauacaaugcaaaauagacuaagauaaucagugacuauaccagugacuucacacaucccauaaguacuaacaaucuuccacaguuuucucuauuccacuuaacagaacaccuucagauaugggaucuaagaaagaacaauucucauugaauauuaucuuucuuugagaauucacaaucuuuugaggugucgggagaacuauuuuagcuagaaguugcaugagccaguuccagccugcagcccucuuuugucuggcaaauauaagucacauuuaaaaaaauuugauaucagcauuuucaaauagggagcuucaaugcaaaaacucagauuggcuguucuguaaagagugaaccuacauucccauauggcagcccccgacugaagcugcuuccuuugcacguacauacauuugagguuuccuugaucuuugccaccccuuuuguguugcagucaucccaugucacucacucacgucaccugccuggcccugguguugauaaucccuugacccugcuaaggccaauaauuaucaauacugcuccgaaccuagcacagcaggaccgugugacuuaugauaccuuauguuaaagucucuccgcauaaaauaacuuacauucucacugggagauaagcuaagauuuauauagagaauuaauucuagaacauaaaaaccuagaaaugcacauuucguuaagcuucuacugacugccuggcaccaaggauucagaggugaguaagacaaagugccugcccacacaaaauugugacuugaugaguguuaagcaaagcaaccauuucuuuuacgauguugaagcggugugguugucuaggguaaauacccagggcucaucaucuugcgccaagaaaauuuaggacauggacacacaugaggaguuuaggagcggagguuuaauaggcaaaagaaagagaaaggagaacagcucccucucuagugagaggggcuuccgaaaggaaagaccagccggcggcggcguucaccagauuuuauaagcaggcuugaggaggcagugucuucuuuauguaggacccacagauugguuccaucaggugugacauuuacguaccacgcagggaagccuggccaccucacccuacucuuauuaugcaaauggguuucccacuuaacuggcgccaucuugucuucuuacuguacauacggcuggcaaagaggagggaagauggggccaccauuuuggacaugccuagucccagguagcuuuuuucuugauggcauucacccaugcaagcuucuagcuugcaugucuaugucuguagcucgauuuugcaggcugcucuuuguuagaauaugauuugggggcugcuuuucguuaaaaagggagaccuuaccaaggacuccuguacccucacuaucugccuaaguaguuucuucuuaacuccuacaucaaugugacaugcgcccuaucuggaauugucaaaaguagugauuaugaauggggagaagcguaucagaauaaaaaucuucccauaccccccuagauucuaacauacacuucucuuuuuuuuuuuuuuuuugagauggaguaucgcucugucacccaggcuggagugcagugaugcgaucucggcucacuguaagcuccgccucccggguucaugccauucuccugccucagccucccgaguagcuggacuacaggugcccgccaccacgcccagcuaauuuuuuuuuuguauuuuuaguagagacgggguuucaccguguuagccaggauggucuugaucuccugacguugugauccgcccgccucggccuccgaaaguucugggauuacaggcgugagccacccugcccggcacauauacuucuuauagucaaguuguagacaaaagauucaaguuaauauaguuuaaaccauuuuaccaccaggcacgauagcucaugcuuguaaccacagcacuuugggaggccgaggcaggaggaucacuucagaccaggaguucaagaccagccuagacaacauagugagaccucaucucuaugaaaaauagcugggcaugguggugugugccuguagucccagcuacucaggagguuaaggugggaagaucgcuucagcgcaagaguuggggguugcagugagcuaugaucacuguacuccagccugggugacagagaaaugacauaaauaaauaaauaaaacauuuauuaggggucuugggucacagcauuguuggaaggucuuaguuucccagaaccacucuccaaagcacacugacaaccugggacuccaaggcggcuaccuccaguggcacaacagaaaagcuggugauucagugagccguuugcugaauccagaagcuaccaccuuaauugccaguuccagaaucacaccagcagugucaucauucacacuggcaaacugcaugccaacugcccugauucucugcucaugugucucacuuccaaaucaagguuugauguaaagugugcuaggcuggcagaccccuugcugcaaagaagucuaagaaaugaguuuugggcuccucuacacuuugggaagacaaaucagaagaaugauuauugauuaagauaaucuguaauuccugccaccguaagccucccaucaucacccuccucaaagagaaucccugucuaacuauccacaguuaugacugggauugcacuguaucccucaguagcaacggcuuugaaagaaaggguuagaacuacugaccuacuaccaugucgugaaauuacaguccaucagccaaaucuaacucacuaccuguuuucguagggcccaagaaaaccaugguuuucagcugggcgcgguggcgcaugcuuguaauuccagcacuuugggaggccaaaguaggccgaucacuugagcucaggaguucaagaacagccugggcaacguggugaaaccccgucucuacuaaaaauacaaaaaucgacuggguguuguggcacaugccuguaaucccagcuacuccagaggcugaggcaaagagaaucacuugaagccaggagacggagguugcagugagccgagaucacuccacugcacucuagccugggugacagagugagacuccaucucaaacaaaaaaaaaagagaaugguuuucacagaugaacauaugcuaccaauuugaugauaggaagaacuaacuuuaaaucccaauuaagcaaaauguuauccccucuaaaaaaagaauucaguuuuucuuauucauguacccacauuucaaaaagaaaaaccucuauuauuauuuguuaauuucaucaauacaaguauuuuuggaaauuuguuuucucucuuauuaaguaccuccacaguuuccuugauuuuuccuucuggcacacaaagccuaaauauuuguaaucugucgcuuugccagaaaaaaaaguuugcagaccucugucuagaaacauguacgguguuauaaaaguaccaaaagggacaucuaaauuagacaaagaagucagagaagacuuuggcauggguuaugcugcacuugaaaagcaauuaagcauuuuaaagauggagaagagaagggaaggaguuucgagacccagaaaacagcaugugagaagcgcagaagaguuucuggaacugggacaccagaauacacacacgcgagagaaugaaguuggacugcuucauuacaccaaacacaacaauuaacucaaaauggaucaaagaccuaaauuccagaucugaaacgauaaaacucuuagaaguaaauauaggagcaaauguucauaaagcacaagggaccaaagauaaaauaggcaaauuggacuucaucaaaauuaaaaaguguauuaaaaauuuaaaaagacacuaucaagaagcuaaaaagacaacucacaccauggggugcauauauuugcaaaucauauagcuuuauaaagggcuugugucuagaauguauaaagaacucuuucaaugauagaaagacaacauacagaaaggauggacaaacgaucuaaaaaauacaguuuuccuaagaagauacacaaaaggccaguaaucacaugaaaagguguucgacauuaugucuuuaaggaaacgcaaaucaaagccauaaugagucaccacaccauccugcuaggauggcuauauugaaaaagacagauaccaguaaguacaguuggcacucuguauccguggguucugcaucuguggauucaaauaacuauaggucaaaaauagccugggaaaaaaauugugucuguccaaaacauguacagauuuuuuucuuuagucacuauucccuaaaccauacaauauaacaacuauuuacauaacauuuacauugcauucgguauuguaaguaaucuagaggugauuuaaaguauacaggaacaugugcguagguuauaugcaaauacgacaucauuuuauauaagaugcuugagcagccguggauuuugguauccaugagauguccugaaaccaauucccacagauaccgagggacagcuguacuaaaaaggauguggaaaaauuggaacccucauccauugcugcugugaaugcaaauugugcagccaauugggaagacagucuggcaucccucaaacggcugaacaauuaccauauacuccaucaauuucacuccuggguaauacugagaaauaaaaacauacauccacaaaaaccauauacaagaauauucauagcugcauuguucacaauagccaaaaaguggacauaacccaaauguccuucagcugaugaauaaacaaaaguggcauauccauacaauggaauauuauuuaucaauaaaaagaaaugauucacaauagcaaggacguggaaucaaccuacaugcccaucaaugguagacuggauaaagaaaaugugguacauauacaccauggaauacaaugcaaccauaaaaaggaaugagaucauguccuuugcagaggcauggaugaagcuggaagccauuauccucagcaaacuaaugcaagaacagaaaaccaaauaccaguacugcauguucucacuuguaagugggagcugaaugaugagaacacauggaaacaucaaggggagcaacacacacuggggccugucagaggguggggagugggaggagggagggcaucaggaagaauagcuaauggauucugggcugaauaucuaggugaugggaugaucugagguaaaccaccauggcacguguuuaacuauguaacaaaccugcacauccugcacauguacccuugaacuuaaaaguuggaaaaauaaauauuaaaaaaaugaaauucuguuacaugcuacaaugugaauaaaacauuaugcuaaguggaaguagccagacccaaaaggucacauaucauauaauuccauuuacaugacacaucaaaaaucggugaauccauugaaucagaaagcagggaagugggucccugguaggagagcagcagggguugcuggcggguuugggggugggggguaggugaaaaucaagaauauuucuuuuuuuuuuguauuuuuguauuuuuaguagaggcgggguuucgccacguuggcuggucuggagcuccugaccucaagugaucugcccaccucagccucccaaaauggugauauuauaggcaugagccacugcgccaggccuagaauauuucuuuuugcggcgauaaaaguguucuaagaucaguuguagaaucuguuguugugaugauggcauaacucugugacucuacaaaaaaccauugacuuguauacuuuaagcgaaagauaugguaugugaacuauuacauuggugcaaaaguaauugcauuuuuugacauuaaaaguaauggcauucuguauccacggguucugcauccauggauucaaauaaccguggaucaaaaauauucgggguaaaauugugucuguacaaaacacggacagaccuuuuuuuuuuuuuuuugccauuaaaaguaauggcaaaccucucagagaauugaagccccagggcaauuggguggccugaagucaauggaaagauaggcauucccaaggagagauuggacacaaccauugagucaucuaugggaaaccaaggagguagagaugccaggugccauacagugggagagaaucauucagugaaauuuuuaaacaaauuucugaagucgugggguggacuugcaugagaauauaggcuugcgcccacuuacaggguauucuccauggaccuccguugugcacucacaagaaagauuggugauggggcaggaggugagagaaagcccuccuccauauugaagacagagaggagaugagugucacuucuguggcaaagcacagauucucaccaaggucaguccucuaaggaucaaaagccuuaggaugcuggagaaggggagcaaaccuuguggucacuaggacacagguaaagaccauugcagcaaggaagcagaaagaaaagggaaaagucuuccauuccuggguguuugacccaggccauuaaagaucuccuaccacugggggaagagcaagaaacucucccguucacaagggccaccaaagauucaagacaucauuuggcugcuacagagaggaggaucagaauuacagagaaaaccugaucugcaagacuuagggacacagggccuuccuaagaccaaggcuggacuaggaaaacagagaccugucuucuccuauacaccacuacuagaccagcaggcaucaaguaacaguagcaaucuaucacugagagaagaggaagagcauaaaaaagggaccuucucugagguacagacacacagagaaagacaaaagcuaagggauaaacaggaauauuagaaacagcuuacaugcaacacauaccccauccaaagaacuagauuacauuaaaaacauuugaggcugggcacaguggcucaugcuuguaaucccagcacuuuggaaggcugaggcggguggaucaccugacgucaguaguucaagaccagccuggccaacauggugaaaccccaucuguauugaaaauagaaaaauuagccaggcaugguggugcacgccuguggucucagcuacucaggaggcugaggcaggagaaucacuugaguccaggaggcagagguugcagugagcugagauugcaccacugcacuccagccugggcaacagagugagacucugucucaaaaaaacacauacaaaaaauuugagacugguaguauacugaagguaaccauagcaacaacaaaggcuaaacccagaucaauuccaguagacucuucuuuauguuggcagaccaagcaaaaguacuguuuacuuuauucucuacuaucauaccucacaguguucaugugcaauaaaaaguuacaagacaaauaaaaaugcaagacagaacaacucacugucaagagucaaaguaaucaacagaaccagacucaaagaugacaaagacguuugaacucucgggaaauuuaaaauaccuacgauuaauauauuaaaggcucuuauggaaaaaguaggcaauaugcaugguggagaauuucaacagaaguuauaagaaagagucuaaagaaaaucuuagaaauaaaaaauacaauaacagagaugaaaaaugacuuugauggacuuaucacuggacuuaacacagccaaagaaaaaauuuaugaacuuaaaggugaaucaauagaaauugaccaaaugaaacacaaagagguaaaaagaauaaauuuuaaaaaauauagagcauccaagaucaacgggcuaauaucagauagucugaaauuuguacaauuggaaugccagaaggauuagaaagagauagggacagacaaccuacuugaagagauaauagcagaacacuaucuacaaauaauauaagacaucaaaucacagauccaagaugcucagagaacccuguaacagaaugggucuaaucagcagaacaagcauggauaggguuugcucuccaauaggccuauuggagaugguauguuccgaugacuggguaguggagaagcucauugguuugaucagaaaagaucuggucuggaguugcugggcaagcaauagguaacuuucuggagugcuggcugugaagcaguaugcagugggaaucuggaugauggcaggggcaaaggcuuucagugcugaaggagcaagcuuggguaucuggagacuugcgaaaugcucaucggggacacauggagcugugugcaggcuguggugguuaggggguuggggagaggaggaagcuugcuuagggagcccgagcauguggggaguuagcuucuguguugagagggcugcagaaagauuauugccaaacugaggcuucaaggccacagagggaccacgaucugaguugugacaguuguccucaaaacuacaccaccuuagccaggcauggcggcaggugccuguacucccagcuacucgggaagcugaggcaggagaaucauuuaaacccaggaggcagagguugcaguuagcugagauugcgccacugcacuccagccugggccgcagagagagacuccguuucaaacaacaacaaacugcaccacugaccccucuuggaugacaccaggaauugcagaaugccucuuucuccaguuuggcuucagcacccucuaccgagaaagcucaacauccugcugacuuuaaaggagaaaugcucaaagggauuccauugcuucucacacuuuauuguauugccuguauuggaagaugcauucagagcugagaggcaauaaauggauaacugaugcaaacccaaucugucaacccagaagucuauauuuuuaaaauuaaaggaaaauauuuuaaaaaugaauuauuuuuaaaauuaaaggaaaauauuuuuuaaaacuaaagacaaauaaugacuuuccagaccaaacaacaaccaaaaaaaaaaaccaaaaaaacccaaaaaauaggagggggguuuugagaacacauuagcagcagaccuuuacuauaaaaaauagugaaggacauucuuaaagcagaacaauuaugauaaugggagaaacuuaacaucuucauaaagaauaagaauuucuaggaauaguugaaaggcaaaucaauauaaaucaaucuuucuucuuucuuuucuuuucuuuucuugcuugcuugcuugcuugcuuuucuuugucucucucucucucucccccucagagucucacuguguugcccagacuguaguacaguggcacaaucucagcucacugcagccuccaccuuccagguucaagcgauccuccugcuucagcuucccgaguagcuaggauuacaagcaugugccaccaugcccagcuaauuuuuguguuuuuaguagagacaggguuucaccauguuggucaggcugcucucaaacuccugaccucaaguagucugcccaccucggccucccaaagugcugggauuaaaggcgugagccacugcacccggccaaauuuauuucauuguaaaucuaaagguugauuuuauuuuaaaucaauuucuauugauucacccuaaaaauaauugauccuuuaaagcaauuauuuaaagcaauuaauaguuuuaagacauaauguauuuguagcacaugucaaaguuaaaugauugacaacaauagaacaaaagauuggagagaaaaaaaucaggagaauacuguuuucaggcucuuauguguaaugagcauuguauuauuugaagauagacaucauagucaaaccacugaaaaccaaagguaaacagauaucaugaaggcagauagaguaaaaaaaaaauacagagaaaaacagauuaagguacagcuauuuaaaaacaaggaauuaggaacacaaaccucagauauuguuuuaucugagauagcauggauuggaaagaccccaucuauaacuucaagcguauuggguguguucugguucuucagauggauaagaauuucauagguguuuuauuuauuaugaucauugccuugaaaguaauauauaaacauucuuuuguauauauuaaguauuauauuaaaaauguaaagguuaauuuuauaccucucgccaaggaaauauauucuauaucuggaaaggcuggucugaagugcagagguggguuccaccagucacugcaaaaagaucugaaauccuaaucuuuuuuaaaaagaucugaaauccuaaucuuuuuuaaaaagaucugaaauccuaauccuaaucuuuuuuuuuuuuuuuuuuuuugagacugaguuucacucuugucgccuaggcuggagugaaauggcgcaauuucggcucacugcaaccuucgccuccuggguucaagcgauucuccugcgucagccccgcgaguagcugggauuacagguggccgccaccaugccuggcuaauuuuuguauuuuuaguucagacgggguuucaccauguuggccaggauggucuugaacuccugaccucaagugauccacccauguuggccucccaaagugcuggaauuacaagugugagccacuaugcccagcccugaaauccuaaucuuggacugcaaacuucugguugcagagccuucaaaggccaugcuaacaugggugacauuuuaaaaaucaaauguuagugggggccacagggaggggaacacuguggucuauuguggugcucuaaaaaagugcaucugugucuagcugucuccaggaaggauaugagcauccuuaggagggcacuuucugacuuuuuguaaauucugaaaauuacaugagaauguuaucccugcuccaggucauugcucuaaaucuuccuggcacccaggaaaaacaauaaacuagcucuuuauuuaaauuagguaaucacaagaaugcaccgggaaaacaggaaagugcuggcugcagauggaauugguuuaaugaaagauuuggaauaauagagugagacuccugucuggaccuugcuugaaugacauacuauugagguuaauuggaugaaucacaaauguuuucuucccccuuuaaucacaagugcauaggggagccaccauuucccaaauaaaaugcauucuuccuucaagcuagcuaguucuccuuugaagccguugauuauaucuguguuuuuauagggccuggcagaaccaaacagccaaaugaaagcaagcaucaacagagcacagaaguaaucauucugagguuggcuguaggcuuuuucugucagaaagaacaaaugagcauaaagggugccuucucuacauugcgugguguaaaguccacuuugaagcuacucacuuguuuaccaacaaagaacagcagccagggcugggccaaaaauaaauuuugaguacccaaaauuacccauuucuuaggccuggaaauuaagagguuguuuggaugugcuggcuguauaguauaguauaguauagaauaguauaguauaguauaguauaguguaguuagauagauacauagagauagauggauacauagaucuauauauguacauaucauauaucuauaagcacacauuguauaugcuuauauacaaauauauacauauauauuaauauauauguuuauauauuaauauacauuguguauauuauauauuauauauuuauauauauucuguauauuauauauuuauauauaauauauucggucuguuauauauuuauauauaauauauucgguauguuauauauuuauauauaauauauucuguauguuauauauuuauauaauauauucuguauguuauauauuuauauauaauauauucuguauguuauauauuuauauauaauauauucuguuauauauuuauauauaauauauucuguguguuauauauuuauauauaauacauucuguguguuauauauuuauauauaaucuguguguuauauauuuauauauaauauauucuguguguuauauauuguguauuuauauauuauauauuauauuaauauauauucauauuuauauguaaauauaaauaaauauaauuauauauacucacuuuaaaugaaggggacuuuaaauugucacuaacuaguugucacuguaggcuaguccuauaggucucagcuuugucguugaauucauucauucuuucguuuauucaugaggcaguuaauucuugcucaauguauacaggcacauugccaugccaaguuaugcaaaugugaaccagauauuacacucaaauccuucauagcgugccaaagagacaagauaaguaauuaaaagagaauccauuuuacuuucaauuauaacgucucuuuuauuugcucauagugcuugucuccauuugugaccauaccugacucaccuguuuaccuguuugguaugugcugccugcaucagacaguaagcucccugagggcaggcucaccucuguuuggccaacaauugcaucuccagcucccuggccauaacggccacucaguaagaacgcacucauuguugccuaauggaaaugugugcacaggaggcuaugggaaccaaagguuguuaccugccucaaccuggggagucaaggacaacuuuuugaagaaaauaauggaugaguugaguuggccaggaugugucugggaaggggguaggauggcggcgggggggauggugcagagguacagugagaaaggguuuucaaagccaaggaccaaggacagauuaugugucccaggcuagacauggaagagagcacuuccucaccuacuuuuaaaaaucugcagauucagauuucuuccacacuaaaugccauaauuuuaauccuaacgugguagauauuucuuuuuuacauaguuuauuuuucagccaguaagggacauugggguuauucugaauauuauggcaccucacuuaggaaaaucaguccauccugauaauauauguauuaaggugguuuuuugucuucuucuuucucuucucauuuauauaauugcaauauuucagggaauccuuuugugccaagguuuaaguaucaguaaauaagaaucacuggugagccauuggaaagaaauucugcuagaaugcuaaaagaggaacaaaucuauauaacuuacuuacaagguucuuuuuuuauuauuauacuuuaagucuugggguacaugugcagaacaugcagguuuguuacauagguauacacaugccauggugguuugcugcacccaucaaccugucaucuacauuagguauuucuccuaaugcucucccuucccuagacccccacucccugagaggcugcggugugugugugugauguaucucucccucuguccauauguucucauuguucaacucccauuuaugagugagaguaugugguguuuggucuucuguucuuguguugguuugcuagaacgaugguuuccagcuucauccauaucccugcaaaggacaugaacgcauccuuuuuuauggcugcauaguauuccaugguguauaugugccacauuuucuuuauccagucuaucacugauaggcauuuggauugguuccaagucuuugcuguugugaacagugccacaauaaacauacguaugcauguguauuuauuguagaaugauuuauaaucuuuuggguaaugggauugcugggucaaaugguauuucuaguuauagauccuugagaaauugccgcaagguucuuauaccuaguucagcuuauauguuugccacuaauaaugaaaagaaaauguuuaaucagguaugugucaggcauaugugcucaauaaaacuacacauggagaaaguacauauuaugcccauuuuacaacugaggaaacuguccauaaaaaaacuaauuugucggccgggugcuguggcucacgccuguaaucccaguacuuugggaggcugaggcagucggaucacgaggucaggagaucaagaccauccuggcuaacacggugaaaccccaucucuacuaaaaauacaaaaaaucagcugggcgugguggagggcaccugcagucucagcuacucgggaagcugaggcgagagaauggugugaaucugggaggcagagcuugcagugagccgagaucgcaccacuacacuccagccuaggugacagagcaagacuccaucucaaaaaaaaaaaaaaaaaaaaaaagaacuaauuuguccaaggucaaacaguaacuaagugaugcagacaagcuuuaaaaucaaguguguuuguccuugaagccugugccuucauaaacuauuuacaggccaguacaggugcaucuaaagagcagguuacagauacagaccgguguuuccaaaacucuuccuuggaucucauucugcaggaaguacauaguggcaugauacucuauagauaaacaugucugcaauccuuuaaacagcuuguuuuauugcaagacuuagcagaagcuuucauaugcuuuugaacauuguaccuucccaagaaggagaaaagcauguguuuacucugcagacauuuuaugaccacagaaugauauuuuuuucuuuccgucauggugagcuacuuacugugccucucagaaccaggcucaggaacacaucgggaaauacugucauuagauaauaaauaccacuuacagacacaagaaaucccuuuuaguuugaguucagcuucaacuagguccucgcggaccacugguaacuuuauaccagauucuuguagcaucauuguaggguuuuuguguguguguguauguguagggggcauauuauuuucucucuguuucaaaugcacucucuuuacuccaccauagugucuuccuggaaaaccagucuuccuuuuguucuucuuuuacuaacacuccccugacucccuuaggccaguuugggccccagcuuuuccauacucacagugucucuuguacauuguucuguuauagcuacuaucacuuaaaauuguaauauucucuuuacuucccgccaacucaguggaugauaacugcauugagaucagggacuaugucuuuuccuauagauaucucuaccaccuaacacaaugacuaugaaaaugacugggacauucaauccaugcugaaugaaaugcacgaaucaaugaaugaaugaagucagcccacugcuuugggaauauguggguuaaaugaguuuaaauagcuggauuggagccagcugguggacagucuuacauucaaggcuuugacguuuguaccuuaucauguaggcauugugaagccuuuaaaagauuuugagugggaaauuugaauaaggaguuuuaaaauggcauuuaaagaugaugaaucugggaggccagucugaagauaagaugccuguuaagaagcguggcagcaucgggcauuagguggugauggcaaagacagcccucauugcuuauuuauagaauuggcuuuaaaugaaugaugaggugagcauuucaaacacauuucauucaaaagcagacaucauuauggagcaguauaagggacauaaagaugaaaaauacaugcuccuugcucuccaaagucucuuaaaaagauuaagaugcccacaaauaauaaaauauggcaaaccauaaagcauguuauauaaugcaaccaaagaaaguagaacuaggaaaacaauggaaauuccaaaugaggaggucugggagugucucacaaaggaaggaagacuugaacauggcuuuaagagauggauagaauuccaaggagcugggggcuggauuaagcauuugguggacaguaggaaugaccuuucccuagugacucucagcaaauguccuuggucuaggcugcuuuagguugaccuucuuccuucugggaacgugcauuuugugccugagaagaugaagggggucuuugcuucccacacugucuucaagaauuucaggccuagugccaacauuuucucccuccagauuuucucauucuugugcuugcaggcaaaaacaaacaagcaaaaaccuuggcaugccucaguucucccaguaggaaagcagucuacauaccccaccuccuaaaucaucagaaacccuacaagggcugaguuauuguucccauuuuacaguuggaauaaguugaggcccagagcuguuagcauuuuugcugaauuucagucuuagaucagcucauuauugagaaauccugauucacacagaugcauuguuucaaaggaagcaauuuugucaguaaccugccucacgacucuucgagagucuucagguggauaaaaauggcaagagacacuuuguucucagguccucaugaaaguaauucagccaggcagcacacauguguguguacaguguuuuaauguuccuaagaauggugauaagcaaguauagcuguguguuuuacauagcacucaguugugcaugauuuaauuugauccuuaugcaauuccuaucuucuaggcaagucagggguuauuauccaaauuuuauagaugaggaaacuggaggaaaauaagaaauugaagagaaucauuuuauaaugcaugccaucgacccuaaacacauuuggucgugacucuggauuuucauaucugagguuucuuucuuuuuccaguuucacugagacauaguuaacaaauaaaaauugugcauauucaauguguacaacgugaugauugauauaugcauacuuuguguaagauaaucacaauuguaacgguuuggcucugugucccccaccuaaaucuuaccuugaauuuuaauaauccccacacgucaagggugggaccagguggagguaauugaaucauccccaugcuguucucauaaaaaugagugagucucaugaucugaugguuuuuuaagcaucuggcauuuccuccccccacuugcacucauucucuccugcugccccauggagaggugccuuccgccaugauuguaaguuuccugaggccuccccagccaugcagaacugugagucaauuaaaccucuuuuauuuauaaauuacccagucucagguauuucuuuauagcagugugagaauggacuaauacagcaaucaauuaauuagcauauucaucaccauuuauaguuaccauuucguaugcauguagggcgaggauacuuaacaaucugcucucaucaaguuucaauuauauaauagugguauuaacaauaaucgccauucuguauauuagaccucuagaacauacucaucuuccaacugaacauuuguaccuuuugaccaacaucugucuccccauuucuaccacccuuugaccucuggcaaccugccucauccuguuguuucugaaaguuccucagccuuugauggcauuuccaaauguaucaaugggccaugagacaauuccagugaaaucuccuggaagaagcagcacugugcuuuugcugcucugagcucaagguuuccacaucucagaaaagcaccuucucaacuagcucauuaccauuucuuaggcuguuaaauccauuaucuuuagaggaaauauguugguguuugucuucucugugagcuauaagguggaaaaugggaccuuuuguuccuaacucccuguggaaugcccucacagucugauaaaaaccccagcuguccucagacaacaugaugguaccacgucagaagacugucuguggcccagggaaagaaacucaguggauguucagaaccuaugcuacuuacaucgcaagaauuuuuuuuuucuugcuucuucaacuuuuauuuuaaguuccaggguacaugugcaggaugugcaguuuguuacacagguaaacaucugccauggugguuugcugcacagaucaucccagcauccauuagcuauucuuccugauguuuuuccuccucccccagcacaggugcccaguguguguuguuccccucccuguguccaaguguucuuauuauucagcucccacuuauaagugggaacaugugguauuugguuuucuguuccugcauuaguuugcugaggauaauggccuccagcuccauccauguuccuggcaaggacaugaucucauuccuuuuuaugguugcauaguauucuaugguguauguguaccacauuuucuuuauccagaaaaucauugaugccuuucuucuccucugcccacucuuugccugacucuucucuugauuaaaaaaaaucacauuuguaucaaaccuguccucugcuugguuucaggcgauugauucaccaucuucucugaggaaggagucuacauuuuaccucccaagucuucucucucuuccuggacuaagaauguuugauugacuaacagauauguuuauaucgcuaguauauacucagauccucuuucuuauacuacuauccuaggcaaccuugaugggaacaucccuuuguguuucuagaacccaccuccaaucuucgcucaagugucacaucccacauuaaaaacaaauaauccuuaccauugaugucuagggaaauucacuauuuuaagauuugcuggauuggagguggaaguggagggacaggacagggaggaagaaugcuauugucuuauugcccuguugcucuaagucauuuccagaaacgguggggcuuggguugugacauuuuagcugcuagacacauguugcugcagauuugcagcgacaguggugccucuaauccugggaguugggaggauggguuggagggauggguuuucuuucucaagaaauuguaaacuggguccacuaaagguaguuccuuauccucagggcccugcucuaccucuugggcagauuggguuuuuuuuuuguuugguugguuuuuguuuugagacggagucucgcucuguugcggggcuggagugcaaugcagcgaucuuggcucacugcaaccuccgccuccccuguucaagugauucuccugccucagccuccugaguagcgggaacuacaggcaugcaccaccaugcccaacuaauuuuuuaguauuuucaauagaggcaagguuucaccauguuggccaggauggucuccaucucuugacuuugcgaucugccugccucagccucccaaagugcugggauuacaggcaugagccacugugccuggcccagauugguauuuuaauacauaguugcuugacaucagcaggccaugucuucauuccuagacauuugguuucagagccugaugugaggaagaagugagaaagaagaaagggguugucaaaaacuuaauugguucaccucuuuucgaaagaaagucccacugagaugaccucauugcuuuucucauuucuaaggcagucauugcaagugugguugagaguuaauccucucuugggcuuuuguugcacuggagaccuuggcccccuaagggggugagauuaggccuauaauagagaauucagguugcaaaaggagaaaauuuaggcuucuugaacguugaccuggagagacccagggcaguggagagacuaaucccuuugugauguugccuuaaacaaaacacaggaaguguuuguguaccagcguccuguugccaccauuguuuaguuguaggguauauauccuucaguaagaguuaaaaccauuuugcaaacuuuauuuuuuuucuuguaaacuuguuuaaguuccuuauauauacuggauauuagacuuuuguuggaugcauaauaaaaaagugggcaaacgacaugaacagacacuuuucaagagaaggcauacaugcggccaacaaucauaggaaaaagaagcucaacaucacugaucauuagagaaaugcagaucaaaacuacaaugagacaccaucucacaccagucagaauggcuauuacuaaaaagucagaagauaacagaugcuggcaaguuuguguaguaaaagggauacuuauacucuuggugggaguauaaauuaguucaaucauugugggagacaguguggugauuccucaaagaccuaaagacagaaauaucauuugacccagcaaucccauuacuggguauauaccaaaggaauauaaaucauucuguuauaaagacacaugcacgaauauguucacugcagcacuauucacaauagccaagacacagacucaaucuaaauguucaucagugacuggauaaagaaaaugugguacaucuacaccauggaauacuaugcagccaugaaaaggaugagaucauguccuucgcaaggacaaggauggagcuggaggucauuauccuuagcaaacuaacgcaggaacagaaaaccaaauacugcauguucuuacuuauaagugggagguaaaugaugagaacacguggacacacaguggagaacaauacacacuggggccuuuuggaggguggagguuaagaggagggagaggaucaggaaaaauaauuaauguauacuaggcuuaauaucuaggugaugaaauaaucuguacaacagacccccaugacacaagcuuaccuauguaacaaaccugcacuuuuaccccggaauuuaaaaguuaaaaaacaaaaccuuugcuuuuggagaaauggugugaaagaauuucaguucugcugcuuacuagcucauaaacuuggacuggcuauuucaccucagucaaucauuucugucauccauaagccagggacaaugauuccuaacucacuccuuguacaggcuugugaugaagcucgaauggauaauguguauuaaaaccuuuuguagcaucugcagauguaccacugugaacaugacugaucuuuucugaucucagaaguuaagcagggucagaccugguuagugcauggaugggagaccaccugugaauaccaggugcuguaucucuuagcuaggugugauggugcaugccuguaguccaagcuacucaggaggcugaggcaggaggaucacuugagcccaggaguuugaggcugcagugagcuaggauugcaccucugcauuccagccuggguaacagagggagagccugucucuaaaacauuaaguacauuuuaaaaaacaauaaaaccuuuugcaacuuguauuguacuaugggagugggaaggcuuuugccaccaacauccuucuuucuuauacauagagagaagccuggcccugaauucuauaguuaguaccuacaaugagcacuguucaucuccucggcugaaauauuauccucagggguugcugccccucugaucuuuugaagaauuugccacuaaaggagguuucagaagccagcucauagaauccuaacaguggcuauaaggcuuucuguggcaaagugcagagaacucaccuaaugcacaguagaagugacuuacugcuagaauuuggaaauugaugaaggccaucuuccaugcccuggccuggccagcuccucguuucucuuuacuuuucacuuuuccucuuucuggugaaagucaucagcugcaaccagaugggacgagguaacccugaguggaucaugcacauccuggucuuguucuuuuccuauuaaaguugacgaaguagauaaacacucgcagcucaucaccugcaagugcuuauccuggaugcucuccucagccuccacuugaugggugcugcuucacaaucagcuuagcaccccaggcuucuccuccaaggaauucuggcucaaucacagcccuggcuuaguccgucaagucgguaguggcagaaacugcugagucugagaaucucauuuauggauuguuuuuacaaguggaugcccuggaacugaauacugaaaaccaaacucaguacugccagaucaauaguuuaggccauaagggaaucauuggacauggauucuugggaucuggagaauaaucccaacccccaaacccauggcauccugagucagacguguagcuucucagguugugcagucauaacuuacuuccugccaaauuccuggguucgcucucuacugccaaguucagcgggaacucaguuauaucuacugggugaguccuaccugagaaagagccaaagcuggaagcaguggauuguuuuaaaaauucccuaccuuguauuaaagacagaaaaguuacaagccacauuucugguacuaaacacaaacaugcacgaauuguguguguggccgguuucuguguuuuuaaguugcugcaagguaucacauuuguaacuguguucaacaggaaaacugcauuggaaacacuugagauccauccuagagcaacuacaccuuccaguugccaggaacuuugguuuggcagggcacugucuguuaucaucaacugggaccacugagaauuugcugaggaacugaacaagggcucuggcacagcagaaagucucagguuccauaagacauagcuugucaggaucuucugaaaucacuaggcagcuggaccuccguucuguuuggccggccacuuaagccuuucucuucucaucccacacagaagacuaacguucacugagguccgcuuuaaagugcaaguccuacuuaguuaguccuggauugaagagguccagaucuuaggauugagcccguuucacccaguuagcuuugcagagaggaaaaaauuauccacaagcagagacugcccccugaccauagccuauggaaucagugaccccugaaauuccucucaccgugguguucugggauuuggugaagccccuucauguguaugaaagacaaggaucacccaugcuccugauggaaacucaucuucgucguuacuuuaucggggcaggauauccugaaaaccuccauuuuuaucaauguaagaaugagagagaguuuauugcagccaaaggcaggaagaauaauguguacagagaggcccuucugauuuagugagucauucauaucuuagcacaucgcccuuucauucuaggcagaauuuuaaucagaggugaaacuuauucacagggaaagucaucucauuuuucaucuguacacccaccugcacagacauacuuaggauuuuucucucugcccagcuccugaaguucuaaucagagauggagagcugagguuuuauaauaauaauuuacuuuuauugauauuaguacaucacaauguucuagaaaugucagguccuucugccucucgaguacuaagcugacgggcaaauaaaggaccccaacuggucucaaacaaacuaaaggacauacuacacaguauauaggcauccaaugaguaccgagcgugguuccuugcagugaauaccagcccugcugcugagacgaauccccagggugauggcauacccucagaucaaugccaagaucucuacacauuugaaauguaaaauauaagcaauccgugauuuccuaggcuaaugugauucucagcaaauguggagacuuggcagguuauuugucaaaguguggggccugguuuggguuucaaucagcuaccaaaauacaggguuugugcuuguuucagcaaucccaaaauggcacagucauugucugcuggcgccaguaaggacuuugaagauuaacuagucccagacuuugauuuuacugaugaauuuggggguuuguugaaguucacacagcaagacaggugacagaccugagacaggaacccaauuuuccuaccucccccuacaaguucauaccuguguguauaucucagagcaccuagcaaauugcuucuguugggcguuuauuuucuuuuuggcuuuugcuuucuguuugggaaacuguuuggcacaaauaacagaaacugagucuuaauacuaagcacaaaagcaauacauugggaggguauugguagugcccagguucauaggacaguucgagaaacaagcugagaaaaaaacggugcaggaaacaaggguagcuucagggggacuggacaagaggaaauuaacugacaggauuagcaagaugaggcugcuagaaucugcuagaaugaguaagcccuuuuuuucucuguucuuacauaacucuacucaagaacaaaagucucuagagagacuuucaucucuagacucagugaguuucuugguauugcagguaaaugaacauggcuucaguggauuugauacccuggagagagggugcaguuggcccaacuugguucaucugucuguuagguguggaugcaggacagccagaacaaacaaacguuuggugcacggacauuacugguguucaccaauauuuccugaucuccucgccuucuggcacguaagaggaauguccuccccaacccuuggaaguuagauguggauguauggcuugauuuggcuaaugaaacuugggcagaagugauguggguugguuuggggauggaagccuuuaagagcugcugugugguucuccauaucuuuccccaccauggcaaacucucaggucuggcguugauauggcagcaucauaagaugauagaaucucugucuuccugggugauacaguuuggcuguguccccauccaaaucucaccuugaauuguaguaauucccaugugucaaggguggggccagcuggagauaacugacucauacuguuauugugauagugaauaagucucuugagaucugaugguuuuauaaauggaaguucccuugcaaagcucucuugccugcugccuuguaagaugugccuuugcuucuccuuuaccuuacaccaugauugggaggccuccccagccaugcugaacugugaguccauuaaacuucuuuucuuuauaaauuacccagucuuagguaguaucuuugcagcaaugugagaacugacuaauacacugggucucuaagggguuaucaucaccugagacuucaggguaguuagaaccaauggcauaacucaacaguccugacaaaugcauccccuuuggacaguguucuauagaguauucagagaauggaaaccaagugauaccaaacguccccuguguaacuuggggagaaaucugccuugcaacuugaaacaccacaaauaugacaaaaagguauggaagccugucauuguacaccagaccuguucagaugagugucugccuaauuucauucucucaaucugagaugcccagacuuagaauauuauuauuggauaauaacaaucuaauauuccaaggcucauuggcuuccaauccauuggaauccaugugaaguacagaaagccuuuauuagcagucugcuuuuuuuuuuuaaccaguaaguguuuguauaaggaggaauaaauggugugcuugcaugagaaacauaugugaauccuugcauaccugauuuuaucgcaaggaaauacauucgacaaauaaagauggcuugccgcaaugagaaacucaaaauuaaacaucauacaggcugggcacaguggcucacgccuguaauaccagcacuuccggaggccagaaguucaaggccaaccugggcaacacagcaagacccuaucucuaaaaaauaaaaaucagcugggcguguuggugccugccuauugucccagcuacucaggaggcugaggugggaagaucgcuugagccuaggagguugaggcugcagucagcuaugacugcaccacugcacuccagccugggcaacagagcaagaccuugucugcccgucagucaaucaaucaaucaauaaaaugucacggagaagucauuaagguuauauuuccagacaugaaacaugaacaaacauugaagugcucaauaagacguugcuggaucccugaaaggacgucccuggaucccugaaaggacaucccuggauagaagauuaagaacacccugauuugcccugaaucaauggaccaaguugacucauuggaacuggggguggacacauugacuuggcuuuguccagcuuaagcuguuagugaguugaccacuguaggaggcucuaccucaguucccuuucacaauaaggaggacacuucaguccuugccuguccuuacuuuuuggaggauaugguagagauaccaugucaggcacaggagagaggguguugaauuaaaacagcuaguuaugcaucguuguguuuauuuuuuuuggugcauuuccguguccuuuuaagauaucuacuuuucucgugaaucagugaacuuuggaaauuaaagaaaggaauuuuuaucuucuauucccagccagacuuccagggucaccuuuagguuugaucuuucuccaggcuucucagaaaccuuucgacguuaacuuugugauuuauguucugucuucacuucgcauugaaaguagcuuuccuugaccaaacuccagguuuugcaauugagccuaaauuggaagaaaaauaauuccaaauuuuuuuuaaagcccaugauuuuaaaaagaauuauauaguguaagcauaggggaaaauucaaguuuugcaauaccaggaguucagauuuuugggagaugaggaccaaaaauugguugacuuuggguggaggccugcaacaaagggggccaccaaaggguucaggaggucagacagagaaaagaggauuugaucugagcucacuggaggugugaagugagaagccuagaagaaaaucauuugucugaaggguaacagaaccaaguaaaaaugauuggagcaauaacccgaaagcuagaccuaaaauccacaauaaucugguauaggaaacauuucugauucaaaagagcaguuguuucaacguugcccccauguccacgcgcacacacgcauaugcauacacauuuuuuauuaauccuuugucccuggggacaggauaucaucaaaucuaacaccuuugaauacaaaauaagcgcaugacaagucauuuuguagaccaauggaagaacuagaagugugugcucugcacauuacaaauaccagcugcguaaugggaauugaauuguuuucaucuccuaaggauaucuacaucugagaauucacagauagggcacuaugcauuguuccuggaacauaauaagugcugcauacagguuggcaacuaucguuauuauaaagucauuuaauucucagcaagaccuagcaaaguagguauuaucgcuuuuaaaccaugaagagacuucagggcccagaaguuaaauaguuugcuccaaaaucacauaggggaaggacugaaauuggaauccaggucuuuuucuagcuccaaacccgguucugacucacagcuuuauucugcugaugcugaggugcuguguggugugcuucauaguugaugcauggagaaucacugaccuuugcaaacgagaaaaauaaugcggcugugcacauggcccccaauuuguccuucugguuugcagcccaggaaucuguaauauugacuucacagggagagcagugcagcauucuggagacgcuugcgauggaacacaucaagccuuccuuaaguuguguguguguguguguguguguguguguuuaaaccucauuucuguuuaaaaguaaauugauuuagcaauuugcacagugccucccuggaccauacuuuaugaaguggaacaaucacuuaaauguucaauuauccaaagcugaaaaggccagaggaagcacacacaaaccacaugcagagaauggcucccccauguucagucagcuuuaccuggcccaggguggaugcaagcaagcugcaaaaaggcaggauggcaccaggcccugcccccugccucugucaccugaaccggguggggaaaccuccucaucuagaugcccagaugcguaaaacagagcugcagaccugaacauuacaugcagccuuuuuguuuuugauuuugcaaaaacagacaucgugaaccuauuugccaccugggcaacccaacugcaaaacccuuggcugcugccagucuuacuccucgcuuucuguuuuguucuggaaaugagggucccugcccuaacucugucuggaugccagaucuauuuccuucaucauucucaugaaaacuugcauuauuuugaaguuugcucauuugcuugguuuuuaaaaucugguuguccaauuugccccgcuacaguguaagcuuguuggugcuugacuacaucaagcuugucaccaucaguaacaagugguaccaccaucggugauacccagugccuggucugucaugccugcuccauuuuugucaaugaaugagcccguccaagcuuucugccuggcuccuaaccaagguuucugaccugacuuuuaccugucccuauugcccuggauuuugcaacucuagugacuacuauauuucucccuaaauuaugaauuccaucugcaucuccccacccauucggagucucuggaucaauaucuaagcuccuccucacugccugcuggcucauggcccgggaaauacguggucuaccucuaaauugcacuucccaaagccuggaaaauggaaaguuccgcccggcugcugccagauuccacaaugucucacauuuauaggaaugaucaccagagcgugccagaaagauggcaccaagcacacugcuuccagcaaugauagggaguguccauuuauuauaugguuaggcuugugucccuacccaaaucucaucuugaauuguaauccccagauauugagggaggaacuuggugggaggugacucaaucauggggucaguuucccccaugcuguucuugugguagugaguucauucucaugagauugaaugguuuuauaaguguuuggcaaguuccucuuuugcuuccucuucucucuccugccaccaugugaagaaggugcuugcuucuucaccuucuuccauaauuguaaguuuccugaggccuccucagccauguggaacugugagucaauuaaaccucuuuccuuuauaaauuacccagucuuggguaguaucuuuauggcagugugagaacagacuaauacaauuucacaguguuaaacccuagauuuuuuuuauaaugaugcauuuuucacuuuagaggacauauuccagguaccucuggugacuggauuccuaaacauuuuacugacaugucaggcccuagaaucuuuauagaguuuaucucccacucuauggagugcguaugucuugccaaggucuccagaggacuaauccauuucuugcuuauccagcucaguaagcuuagcaugcuacugauguagaggaucaaugagauguuccguaggauguccaaaaagcccugaucuuuuuggacuacauuaugacagaaggcagaaaaguuaauauaauccugaguugagugauauaauggacuuuagagacuuuagaggguaggaggggggauagagauaaaaaaaaaaaaaacuacacauuagguacaauguacacuacucaggugauggguacacugaagucucagaauucaccacuguauaauucauccauauaacaaaaagccacuuguaccccaaaagcuauugaaauauaauuuuaaaaaauaaauaaauaggccaggcacgauggcucacaccuguaauccuagcacuuugggaaccugaggcaggcggaucacccaaagucgggaguucaagaccagcccggccaacauguuaaaaccccgucucuacugaaaauacaaaaauuaguugggcauggucacagacaccuguaauuccagcuacucaggaggcugaggcaggagaauugcuugaaccugggaggcagagguugcagugagcugagaucacgccacugcacuccagccugggagaaaaagcaagaccccgucucaauaaauaaaucaaauaaagaaauuaagaacaaaaacaacaaaauauaauucuaagccaaaaccauaaauguauauuguuacacauuccacagaaauaugaacucuucucauuuuuacauuuaaaaaaaagugacagguaacauuguauguauuuaccaugugcaacauaauguuuugaaguauacguacauugugggauaaauuaaauguagcuaauuagcaaaugcgugaccucaaauaguuaucauuuuuguggagaaugcauuuguccacucagcauuuuuuuagaauacuaucgucacugacuauagucagcuugcuguacgauagagcucuugaguuuauuucuccuuucaaacuguaauuauguguucuuucaccaguaucuccccaucuccuucuccccacuacccaccccagucucugauaaccaccauucuauucucaacuucuaugagauaaacauuuuuagauuucacauguaagugagauuauuugguauuugucuuucuaugccuggcuuauuucccuuaacaauguccucuaguuccauccauguuguugcaaauaacaagauuuuauucuuuuucauggcugaauaguauuccauugggaauauauacuacauuuucuuuacccauucauccuuugauagacagauuaauuccauauuuuggcaauugugaauacugcuguaacaaacaagggagugcagauucucuucaguguacugauuucauuuccucuggacauguacccaguagugggauugcugggucuuagggcagauguauuuuuaguuuuuugaggaaccuccauaauguuugccauaauggcugcacuaauguacauucccacaaacaguuuauaaggguuuccuuuuuuuccccaucuuccaaacauuuguuaucuuuuguccuuuugaucauagccauucuaacuggggugagaugauaucucauuacaguuuugauuugcaugucccugaugauaagggauguugagcauuuuuucauauaccuauuggcuauucauaugucuuauuuugaaaaaaucaucuauucaggucuuuugccuauuuuugaauccaguuuuuuguuuucuuccaauggaguuaaauuccuuauauguuuugggauauuaaccccuuaucagaugcauaguuugcaaauauuuuccuccauucuguagguugucuugucacucuguuguuuccuuuccuguauaaaacuuuuuaguuugauauaauccuauuugucuguuuuugcuuuugcugccugugcuuuugaggucuuacccaaaagagucuuugcccagaccaaugucaugaagcuuuucauuuauguuuucauauaguaaauucauaguuuugggucuuacauuuaagucucuaauccauuuugaguugauuuuuguauaagaugugagauaaaguucuaauuucggucuucugcauuuagauauccaguuuucccaacaccauucauugaagagacuauucuuuccccauuguguguucuuggcacccuugucaaaaaucaguuggcuguaaauauguggauuuauuucugggcuuuuuauucuguuccuugggucuaugugucuauuuuuaugccaauaacauacugcuuuguuuacuauagcuucauaguauuuuuuugaaguuagguaaugugaugccugcaacuuuaaacacuagaauuuauuuuaaaucuugccaauugggugauuucaaaaaaugguuucucauuuaaguuagcccuuuuuaaauauuuuauuauagaucuagaggguaaaagugcaguuuuauuguauaguggugaagucugagcuuuuuaauguagcaaucugaagagaguauauuguacccguuaaguaauuuuuuuacuuuuuuuaaaaaaaaguaaaaauuuuuuuuaaauuuuuacuuaaaaaauuuuuaaguaauuuuucaucccucaccuuccucucacccuccuacccuuccaagcuuccaaugucuacuauucuacucucuauguccauguguauacacuguuuagcucuuauaaauuagaacauguaguauuugacuuucugaguuauuucacuuaggauaauggccuccaguuccacccauauggcugucaaagacauuauuucauucuuuuauauggcugaguaguauuccguaauauauauacagcacauuuuccuuaugcaauacuucuuuaugaauugcacaucuuugcuauugugaauagugcugcaauaaacauacaagaauauaacuuauacauauaguuugguauaaugauuuauuuuccuucggguagauacccaguaguaggauugcuggauugaaugguaguucuauuuuuaguuauuugauaaaucuccauacuguuuuccauaaaaguuguaugaauuuagauucccaccaacagucaaagcucaguugacuuuagguauguugcuuuauuuuuggguucucuauucuguuccauuggucuauccaucuauuugcuuuucuucacauccucuccaauaccuguuauuuuuuacuguuauuuauuacuaauaauaguuacucugacugguguaagauaguaucucauuguaguuauaauuugcauuucucugaugauuagugauguugaacauuuuuuccauaagaguuuuggccauuuauauguuuuuuuuuuuugauugguugguugguugguugguugguugguugguugguugguuuugagacggagucucgcauugucacccaggcuggagugcaguggcuccaucucagcucacugcaagcuccgccucccagguucacaccauucuccagccucagccuguucauguccuuugcucacuuuuuaaugggguuacuuguuaucuucuuguugaauuguuugaguucccuguagauucuggauaucaggccuuuguuggaugcagaguuuguagauauuuucucccauucuucaggcugccuguucacucuguuaauuauuucuuuugcuguguaaaagcucuuuaguaauaauuaagucccauugucccguuuguugguuuuuguuuuuguugcauuugaggucuuagucaugaauucuuugccaaagucaacauccagaugagguuuuugaagguuuucuucuaguauuuaaauaguuuugggucuuauauuuaagucuuuaaucgaucuugaguuaacuuuuguauauggugagagagagggucauuucauuuuucugcauauggcucuccaguuuuuccagaaccauuuauugaauagggugucccuuccccaguauauguuuuuguugacuuugucaaaaaucaguuggcuuuagguauguuacuuuauuuccagguucucuauucuguuccauuggucuguguaucuauuuuuauacuaguaccauucuguuuugguuacugcagccuuguaguauaauuugaaguuagguaauguugaugccuccagcuuuguuccuuuuacuuagaauugcuuuggcuauucuggcucuauuuuuuuuuuuuuuuugguuccauaugaauuauaggauuguuuuuuauuaauucugugaaaaaugauauuaguacuuugauagggauuguauugaaucuguggauugcuuugggcagcauuccaaugauacagauucuuuugauccaugagcauggaauauuuuucuauuuguucauguuaucuaaaauuucuuuuauuaguguuuuucuuguaaggaucuuccauguccuuuguuaaaugcauuucuagguauuuuauuguuauuauuuugguaauuauaguguuuucagaggacugguucagggucuugacuucaccacccaaaauaauuugagagcaaguccaaaguaagaguaggcaaagaaguuuaucgcaaagcaaaaguacacucggauagcuggguccggugggcugcucaagaaugagacagugcugacuggcauuggggaaacuccuuuuaugugagucuuacaugauuauucaugaaagggcuggaaugggcauuguugcucagcauguuguggauggucucuugggcccacgugcacaguuacuguacaugcuacuacauaugucggaugucucauuagcauuuuaaaucuccacccagugguguguuuuuuacuauuaaaaugagcaaaguucagcauaacgacacaguccuuugccaguaugccugcucagccuuugggacuuucccuccaacagucauuccuccuucagcaaggaaguugccaaccacaggugaccacagacaucugcccuagcccccuucuggaacaucuguuacugacugggguccuugugcuaaccuguuuggccccauuuguguugcucuuagccaccugcaaguaauugugccccauuccuucacuaacugccugccuuaauggaauaacuucuugauuugguucucagcuugauuguuagugguguauagaacugcuacuaauucuucuacauugacuuuguauccugaaaccuuacugaauucauuuaucaaaucuaggagucuuuuggcagagucuuuaggguuuucuagguauaagaucauaucaucagcaaacagagauaauuugacuuugucuuuuccaauuugagugucuuucuuucucuugauagauagcucuggcuaagacuuccaguacccucuugaauaggaguggugaaaauggacaucuuugucuuaaauuagccauuuaaaaaaauaaccauaguuauuugcauuuucuuuuucuaugaccuuaacugcuuuucuuauugaucuauaaaagccguaauauucaggauguuaaaaauuugucugucacaauuauggaagcuauuuugcaaguuuuccuuuguauuuucaucuucguucuccuauuuuugacaugauaaaguuuaaaaaauuuaaaguagacaagucuagcaaguuuuuauuuuauuuacuccguggguuuuaugauuuaaaagguuuugcccuuauagugaugaguuaaauaguugccuaaauuuuauggcuuauaguuugauuuaguaacauuaaauucuucaguccuucuagagcuuacauuuauuuaugugaugagaauuucaccucauuuuuuuuccagagaaucaaacgucuuaaugugccuaauauacguacggacauauucuaugccaugcauccauauggugacauuuuguuguuacgacaugguaucaguuauucugaaguauguuauaugcuuuaauaccuggagaccuggcccucucacauuauucuuuccuguuuauuuguucauaugaacuuuagagugauuuuuuuucuaauuccaaaauaaauaucaucaagauguuuauuaaauuacuuuaaggaccuuuaagauauaggcuuuugccauucaggaacaugaaaucccugucuaaauauuuauuuuuccuuuauaaauuucaguggugaugcuuacuguuuuucauaagcaucccauaaauuucuuguuagcauuucuuggcauuuuauagaaggugucucagccgggcgugguggcucacgucuguaaucccagcacuuugggaggccaaggugggcauaucaccugaggucggcaguucgagaccagccugaccaacauggagaaacuccaucucuacuaaaaauacaaaauucgccaggcacgguggcacaugccuguaaucccagcugcuggggaggcugcggcaggagaaucgcuugaacccaggagguggagguugcagugagccgagaucgcgccauuacacuccagccugggcgacgagugaaacuccgucucaaaaaaaaaaaaaaaaagaugucucugcaggggccugggagggagagugagagagagagagaaguuguguauuuguggugaauggaauuuuucuuuauauuuuaguauuuuggcuuacagaagucauuggguuuugcugaauuuuauucacccuauugaaccuuagucucuuagcuucuauggauauaugauucuauacaguucaauaacuguaauuuugucuucuaauuucuaaguuaugccccuuauuucuggaauaaauuucuaagcaagcagucacuuucucauucaaaugagauuauauuauuccagugucuucuuguauccauuguuguugagaugagucuucucuaucuggaugcuauuucuugagggcaaucugucagccaucagucucucuauugcuucuuuaagaguaacuucuuauuuuuucuguggccucuuuggagguuuuugcuaugucuuugcauuuuucaaguuuuacuaugacguguccaguuguggauuucauuuuaugugucuuccuugggcuuuguugggcuucuucaaaccauggcuuguauauuuuagccuuuaagcccccacauauugcuucugccucauucucuaucuccucuccuugugaaacucuggaauaaaccuuaugucagaucuucucacaguaugcuuuaugucucuuguauucucuguccucuaccgguaucauucaggaguauucauuuugaccuacauuucaguuccuaaauccuuuuaucagccauguccaaucugcuguuacacccaacuauugaguuuuaaauuuugggauauuuucuuuucuuucuuucuuuuuuuagauggagucucacucuguugcccaagcuggagugcaguagugcaaucucggcucacugcaaccucugccuccuggguucaagcgauucuacugucucaggcuccugaguagcugggacuacaggcaagugccaccaugcccagcuaauuuuuguauuuuuaguagagacgggguuucaccauguuggccaggcuggucucgaacuccugaccucaggugauccaacuauuuuucuuuauuugcaaugucuguguucuuucugauaguuuccaauugauugccaacauucucucucucucucucucucucccccccccucccucccucucucucucuuuuuuuuuuuuuuuuuuuuguuuuuuguuuuuuuccaacacuacuccuuggcuagauugacaacauucucaagcuugguuuuuucuuccaugaacauuguaaaccacauugcuuuacagucugugucugauagccucaauauuggaauucccuccaagucuguuucuguucucugcuguuuuugcugguuuggguucauaauguguugucucuucauaggccacacuauuuuuuauuauuugugggauacuagauuugaacacuaacagaaauauuuugaggccuggguugauauuaucuuccccccagccccucuccucauuucccauugcaggaucuuucugcauccuguuaagaagaagaaggaaaugcucaauuuccuuccuuuucauuagaaaauaaauuucaaagauggcauauuuaaucugagcagucacaauuaucuucccuuuaccuuguguuuccagaggcucaaggugaaauuuuuguuuucuguucuuuuauccuuggacaggaagaaaugugugcugagcugguguuuaccaacagaauagcaagugcuugguucuuccaaccggcccuuuuguagaaucccccuucuuucucucuuacaagcucagcacuuaauauuauguuuaauaaaagauuacauuuccaagaaauagcugagcagguuaaaaugaaauuaugcuuacaagucccggugcaacaguucccaaauucucacuaaaauacuucugaaauaacaaaaaacaauaaacaccaaaauuaaaugcgaaucuuacaggaauucacaacgaaaggccugugaugcuggacucacagauauuacaggaggccuuuuguagguccauaaagcuuucucuuguguugguggaugaacacauuuccagggcugccugcaaguuuccagggauuuuuguuuugcuuuguuuuuagcaaaugacccuccaauaaguuucugcuagacugagaugggggucuucucauagccuuauuuccuggcucauugaaacacaaaaauguagaauauagggaaaaccucugccacagcgcguuucuuuuuccuccuuggcaaacaugcaaugcucugcagaagagaacccuccucccaggaaucucgccauucuccucuguuugggagcagaaugcuaucagggaacugcagcucuguauggacagagaaggaaguuaaaaugagaguggagguggagaggagcuaagagcucucuggcugccucagaacaaagacgugugcccagcuuugcuguugguucagucugaggcucucagggccuaugugagauggacacacacugagaguuucucaaagccugguccuccuuccuuucauacucaagagcaggaagcuugauggaccuacacaaggcccuccuauccugucugugaauccagcaucacaggccuuucauugugaauucccauaagauucucaucuaauuucgguguuuauuguuuuuuguucuuucgcaaguauuuuagugagaaacugggaacuguugcaucaggccuuguaagcaugauuccauuuuaaccugcucagcuauuuuuugggaaaccuaaucuuuuauuaaacaugaggaagugcugagcuuguaagaaagaaagaaguucucuagagacacacugaauuaguaaagagagaugauauuuggugacaaaucagcccucaauugucgaguuuauguagucacagauagucagauauuuguauuauguaugaggcuuggugcccugcaaagaaaugugacauuaccaaucaaaucacgucccuccucaucugggcaacaacugcaaaugaauggacgguuaaaaaacauuaaagcguauauuauuaaaauggaaagguauugugagugucauuuucagaauaauuggugcccuuuguagaauucaguuggcuucugggcacagcaggcacuauacagggcagcccacuccuauuuuagggagccuacugagaucauuauucucaggaaauaagcacauuaagauacuucuguggccagugugguuccaaguuuauuaacaauugacauuuggagccucccuccuauuaguuuagaaucuaagguaaugaugggauggaaccauuagauugguguaaaagucacugcuguuuuugccauuaaaagugauaguuccacauuacuuucauucucagcuagagucaagcacgaacucuaaugaaugacuggaaggaauccaugccuuaguagguacaucucuagcaggagucauuuuucuucucagauuucuuccuuaaacggucauuuuuguucuucuguauauuaccuugucauucugucauaacucuuacagagaauuuuguugggcaccuggcaugaauguaauauuuauaucagaauuuagaccccauaaaagagaauuggaaauuucaccagggaguggggaaagucagcccagccaaaggugauacaugagaggugcuucuaccaaaagcagaaacaaaaugagucaugucacucuugucgaaugaaugagaacuacgaucaucuuauuuaacauuuucugaaaguuguagacaauucuaugaaaucaaaacaagaggaacaauuaaaaugagauaaaguuaucacgccacugcacuccagccugagcaacagagcgagacucugucucaaaaaaaaagaaaagagagaaaauugucaagagaaucacuuaaaauuacacacaaauugaaaaugaaauucaaggccgggcacaaugguucauguauguaaucccaacauuuugggaggucaaggaagguggauugcuugggcccaggaguuugagaccagccugggcaacauaggaaaaccucgucuguacaaaaaauacaaauauuagcuggacguggugauguacccuuguggucucagcuacuggggaggcugagaugagaggcucgcuugagcccaggaggcagagguugcugugagccaagacugcaucacugcacuccagacugggcaacagagcaagacccugucuccaaaaaaagaaaaugaaauucaagguagcugaaugcaacacaaacauugcagucuguuuuucuuaucaauaaccagucagaaauauggaaacuucauuucuaguaacaacaaaaauauaaagcacacaggaauaaccuuaauaagaaauauacagaauugauacaaauuaaacuacugaaaacuaaacuaagaguugauuuaagugaaaaaacauaucaugcucucagaaagcaaaauaaauaacacuacggguuuuucuuuuauuuccuucagauuaaugcauagaucauugugcucugaaucaaaauuccaauggaacuuuuauugaaauggcagauauauucuaaucucaucuggaauacagaauaaaaacuuaagaccuugaagaaaauaauugauugagcuggguaugguggcucaugccuguaaucccaccacucugggaggucgaggugggaggaucaccugagugaggccaggaguuugagaacaaccugggcaacauaacgagacuccgucucuacaaaaaaaauuuaaaaauuagccaggcauaguagcgugugccuguagucccagcaauucagaaggcugaggugacagccugguuggcgugaucaugccacugcacuccagccuaggcaacagagcaagauccugucuuucugguugaguggggauagaaggaauaagugagacuuggccaaugggauauuaaaacacaguauaaaguuauaguauuuaaaucagugaaaucaacaguauaauagguccagaauuaaacccguuuauaaauaaagacaucagaugggacaaaggaagcacuaaaaaucacuaaggguuacuccacaaguagggcucuggcugugcuaggacaucaggcacaaggcaucagaacccaguuucaguagcuauaggaguuugaguccugaagaacgugacagaauauaaaaaacgagucuugccaagcuuuuuaaauccugggagauuuuaucaaguugugugaugucuaggugggcagcaucaugggaaggaguacaagccugauucacagagaaaacauacacagaucucuaagagaugaucuuuggaccaauauuauuuccuuagccuucaugucagcuccucuauucccagagaggcccaaaucuugcaaugggcagaacuaaagaggcucagaggaaaccuuaaugguucaucucacggcauuuucuucuugacaucccgagaauagccucagaguuugcagaagcaccuuauucuuuuuuuuuuuucuuuguauucaagacagagucuugcucugucgcccaggcuagagugcagugaugugaucucggcucacugcaaucucuaccucucagguucaagugaaucuccauccucagccucccaaguagcugcgauuacaugugcacgccaccacacccagcuaauuuuuguauuuuuaguagagacaggguuucgccauguuggccaggcuggucucaauuccugggcucaagugauccgcucaccuugccucggccccccaaagugcugggauuacaggcaugagccaccacgccuggccaaaagcaccuuauuucaacuagauuguacacuucaguuuaaaauaggguuucuccaccucagcaucauugacauuuugggccagacaauucuuuguagugggaggccuucuugugcaucacaggguguuuagcagcauccauagccucuacccacuaaacgccaguaggaucucccccguuccuugcccagccaagugguaaacaaccaaaaauaucucuagacauugcuaaauguccccugagggugcaggauccuucccaguggugaaccaccaggauaagauagcuuaucaagaaaaugugggcuguuaacagugguaucuaacguaaugaacaaggaaaagaaaaugaaagaaaggaguuauuaaacagaaccuuuuuauuggcuuuucagagucaauuucaaagccuugcaaguuguaauuuacuuggacacaucacaccucaaugaucauuuuaagcuuccuaaaagcuaggacaugcagacaaaaauaaguuugucuccaaaaaaaaaaugacgugguucucacgucauuuauuagguagagaguuagcuguuuuguuaauuauuuaacuauuagaaacauacaaaacucagaacauacaaaaugugaaaggagacagaaguagauauuucucaagccugugaaugaggagggcuuuguaagccccucuguuuacucugcucucaaagcccagcauacaugaaauugaaagucacacaagaaaccaggaaaaauaucuauaauaauuauugaaaauaauuuggauuuuuuuuggggggaaauggaguuucacucugucauccaggauugcaauagcaugaucucggcucacugaaaccucugccucccaggcucaagcgauucuccugaguagcggggauuacaggugggcaccaccauuccuggcuaauuuuugcauuuuuaguagagacgggcuuucgccuuguugcccaaggcuggucucgaacuccuggccucaaguaauccgcccaccucggccucccaaagugcugggauuacaggcgugagccacugcgccuggcccuggaucuuuauuuuaugagaaaaauacuagaaucucaauaguuagguaagcaaaaagcaggaacagaugaaugaaagcagaaaaauagauggccaauaaucauuuuuuaaaaaucuaucaaacuucauucaugguaaaagaaauauaaauuagcacaagauacaaugucagacuaucaaaucagcaaauauuaaauagugaugaaaauauucaauguggccaagguucugugcacuucaauaaacauuuauuuauugaguaccugugugccagucaccaagcugggagcucugaauaccgagacaggcaugauauagucucugcccucaagcuucuagucuauauaaucaauuuaauuuaacaaacacauacauagcacuuguuauuuuuuuuuuuauuuauuuauuuuugagacggagucucacucuguugcccaggcuggagugcaguggggcaaucuugguucacugcaaccucugccucccagguucaagcgauucuucugccucagacuccagaguagcugggauuacaggcgugagccaccaugcccagcuaauuuuuguauuuuuaguagagacggggcuucaccauguuagccagacuggucucgaacuccugacuucaagugaucugcccacuuuggcuucccgaagugcugggauuacaggcgugagccaucaugcccggcauauagcacuuguuauaugcuaggaaagcacuuuacaaauucugauacuuuuaguucucucaagaacccuauguaauaggcacugucauuauccucccauuuuauugaugggaaaauggaggcaccaaaaagcuaaguagcuucccgaaagacaacagccguggcagaggugggagucuaggauaaauaauucugcuccagagucccugcucuuaaccaguuugauaggcagcuucuggagaaagcaccauggaaguuggaacaaggcucccuugaacaugacuugugucgaguaaguccagaagaauaaugagccuucugaaaagcaauugggaagcagguauccagaaucuuuaaaauauucauggugacuugaacuaauaguucgauuucuaggaagcaagagcuguggacaaaaauuagaguuccuuugcuuuugucgcauuuuuaauacaauaaaaaucgaaacaaacuaagaacacaagaauguuccuauguuaugguauaucuguaugucgaauauuauacagccaugaaaauuguguuuacaauuagauuuaauaacuaggagaagguuuuuaaaggguagacauuuagguugaaaguuaggaaacaaggccaggcaugguggcucacaucuguaaucccagcacuuugggaggcugagguggguggauugcuugagcccaggaguucgcaacuaggcugaacaaaauagcaaagcccugucucuaccaaacauacaaaaaugagcugggcgugguggugcaugccuguagucucagcuacucaggaggcugaagugggaggaucaucugaaccuggggaguuuccggcugcagugagccauaacugcaccacugcacuccagucugggcaacagaguaagacaccaucucaaaaaaaaaaaaaaaaagcuagaaaacaaaauugcacauuugaccuuaacaauguuaaaacauaggugcauguagguauagguauauagguauaggugcauggaaagauauuggaaagagauauaccaaauacuaucaguaguuaugucuagauaaaauauuauggauaauuuuuuuucuucuuaauaauuuuuucuauuuuauaugagcauguguugcuacuguaaugaaaggucuuuaaagacuuuaacaaaguauugcuagaauaaaggaggaacacaguauggagagagaaagagggaaucagaagcccaggaacuguuuggaaaggagggaagggaagaugaguguuuuaugucacagucugguuggagaacauggacuagucccacaccuuauaaacaaguaauggcuccagagcauagcaacuuccaaggcaccauuugucauggcugaugugcccgucuuggguucuguuccuaaaaauucuguucucagcugggugcaguagcauaccuguagucccagcuauuugggaggcugaggcgggaggaucgccugagcccaggaguuugaggcugcagagagcuaugauugugccacugcacuucagccugagugacauagugagaccuugucuccaaaaaaauaaauaaauaaaagcucuguucucauucucauugcucucauucagggaauggaaggggauucaacucaaauaaccucaaaaucagccacuguuguguuucucugagaauuuacacucuaaagugaccaauucuuuuuuuuuuuuuuuuccgagacagagucuagaucugucacccaggcuggugugcaguagugcaaucucggcacacugcacccucugccucccagguucaaaugauucuccugccucagccuccagaguaggauuacagagcuaggauuacaggcgugugccaccacauauggcuaaguuuuguauuuuuaguagagacaggguuucgccauguuggccaggcuggucuugaacuccugaccucaggugaucugcccaccucagccucccaaagugcugggauuacaggcuugagccaccgugcccagccaaguggcucaaauucuuuucaacacaaucacaaauccauggugugggguuggaauauccguguccccccuuauucauagguugagacccuaaccuccuucaaggucaugauuuggaggcggggccuuucgggaugugguuaggucaugaagguggaguccucaugaaugagacugguguuuuuauaaaagagccccagugauuugcaaauggggggaagcuacugugagcauguguuuuauuuuuuaauuuacacuauagagugauuuuuuuuugccccaacgucaaguuuuuaccuugcauguacuggaguauuuauuucaucuauuaaaauguuauguuucuuaaaauaaauaaauaaaagagccccaagggagcuugccuuccaccacaugaggacgcaggaagaaggugccaucuaggaaccaggucaucagacaccaaaucugcugaugccuugaucuuggacuucccagucuccagagcugugagaaguaaaugucaguuguuuagaaucuacccaguuuaugauauuuuguuguagcagccagaaggaacuaagacaccugaucucacaucgcaccuggguccugggcacuggggugcaguuccugcaccuguccccagccuguacauuuucuguucuguguagcugguaccccaaguuguuccuaccuuuccugaucuccucaccacacugcggcuucccuccucagcgguggccuggauuccuacauugugaacaaaagggaacaucgaaggugaacauuguucauucuuuugccucauuugccaaacucaguggcaucauggugucuccuucugcccaaagcaccccaccccaagcucuggguccccugcccuccuccccuuucuccucuaggaaugggccccaucacgucaccccucuugccaccaccuccuuuccacuuccucacuaccagcuccgaacucugccugugauuguuaaccaccgaccuacccuagaaacgacuaacucccuucucacccaaccuauugccauaugcuuucuguucccuucacuuuauugaugccuccuucccugagaucaacgcuacuguccuaauuagcaacaucaaagacuacuuuuuagccguuucuuuauugaccuuuggcuguauuggacauagguauucauugcuuuuuuguuuuguuuuguuuuuuuguuuuuuugcuuuuuuuuuuuuuuuuaagaaaaaaugucuuucucucucucucucgauaauggcuucauggagauacaauccacaaaccauacaaucgcccacuuuuagugcacaagucagcgguuuucaguauauucauagaguucugcagucaucccuacagucgauuuuagaacauuuucaucuccccccaaaauaaacccacgcccauuagcagcccguugguuuuucagaugcuuuuuguucccaguuagccaaaauuguuugacuguucuuucucagccuucucuucuucuuccagcaucuuaagcauuuuuguuccccagacccuacuccuuagcccucuucuuauauuacauugcccccaaacucugggaggucuuauuccauccuaugcuuuuaucccagacuucccuaugauccucgcagcucucuuucuacgcccagacucauuucaaaacuuuagugccaugguugcaaguuuaaugcacauaugcaccaguugcccuacagacaugucaaacuccgcgggucccagguugaacgaaucaugcccuccaagcccgcaacacccaagccgccaucauuuauugcaacacauuuugcacacacauucucgguagcagcauucacuguguaauucaaaguaagccuuguccaccugcucuccuccuucucacccuccaucuccagccuuugccagacucugcuaacucuacaucccugagcauguuuuacuugcauugccuccucucuccugcacuguggcugccucaauucacaccuugaugaccucuugcuuugacuuuugcagagacccccgcucuaaucucccucccccuauguuugcuaccagagcucuuuuccaaaacuauaaacauaaucaugggcuaggugcaguggcucaugccuguaaucccagcacuuugggaggccgaggcggguggaucaccugaaguggggggguucaagacuagccugaccaccaacauggagaaaccccgucucuacuaaaaauacaaaauuagccaggcguggugacgcaugccuguaauuccagauacuugggaggcugaggcaggagaauugcuugaacccaggaaguggagguugcgguaagccgagauuguaccauugcaugccagccugggcaacaagagcgaaacuccaucucaaaaaacaaaagcauaauuauggacuugccagcuaaaaccauccguggugugugccuggugcacuugacuuuacagaucaagcccaaacacuugaguaugaguuucaagauccugaugagcagaacuguauccgucuugccaaccucacagaucuccuccugacacccccaccccuaccgcacaaaaucccucggcgcuccccaaccgugccauccuccuuacaccuucacacauuugcaacauuauuuagacuuuccuccguucagaauuuucccuuagcaaaaucucacucacccucuacgaugcagcucaugguuccuucaacuaagguaggcacucucuccccuaaguucucacagcacuuuguaccuaauccuauuuugcuaugcccccauuuuuaugguuucagggcaugucucugugccccaguagaaugugaauucuucagcagcgaacaccauuucucagcuuggauccucauugcagaaugcuaccccauaacauagaaggcaugcaauauuuuuuuuuuuuuuuuuuugagauggagucucacuuuuguuguccaggcuggagugcaguggugcgaucucugcucacugcaaccuccgccucccagauucaagugauucuuaugccucagccucccaaguagcugggauuacaggcgcccaccaccaagccuggcuaauuuuuguauuucuaguagagaaaggauuucaucauguuaaccaggcuggucucgaacuccugaccucagaugaucugccugucuucgccucccaaagugcugggauuacaggcaugagccaccaugcccagccggaaggcuugcaauaauugaccgcagacucuugcaugaaugaaagagcacaugaagcuuuauccugauuccuuucaacagaaagacgugagugacaugcuaagggggcguggcaguggcugaagcauuggacacugaagggaaaggcaggaucugccgaaaaucccuuccagggcacuucaggccagccuauuccaacuugggcugcugugacuuugagcuguccuaaggacccugcuggauuuaacaaugaagcuuucaaaggagauguucgccuugcggcgguggggcaagggcuuuguaugucacugugaaaugaugaaucacuccuuucaaagcagagaaaacuuacaacugucuuuuggauuuguguuaacagugugcuggauucuucgcugggacuuggaacccacccugaauuuuucagccagcuaucuucucuagaccccucagauuaacuuucuucugccauucacauguuaaaaugguggauauguuuguugggaaggaauuaaaucggcucauuguacuggcagccaggaugguccugagccuguuacuacggaaaugaauuuguuacuuuugugguuccuuccugauuugcaggcuguacagcaagguuugcaagacuccugugaauuucuccccaaagaggggaaaggaugaaaauagaaccacaggaagagagagcuggggauguauaauagucagaaacauuuggcaaaucugucugcucguggucagcgcgucucacucuuguuuauuuguuugguuuguaguuuaugugcuaaccucagcaauucuguuugcucauucugucccaacagaacucacucccaaaagaaagacaauauuguggaugaaaagagucaaacucuguaaaauauuagaagagauuuauucugagucaaauaugagugaacacagcuuucaggagguccugagaacaugugcccacggugguccgggugcagcuuuguuuuauacaucuuaaaggggcaggagacaucaaucaaauacauuuaagaaauaacauuggcggcugggggcgguggcucacgccuguaaucccagcacuucgggaggccgaggugggcggaucacgauaucaggagaucaagaccauccuggcuaacauggugaaaccccaucucuacuaaaaauacaaaaaaauuagccaggugugguggcaggcgccuguagucccagcuacucgggaggcugaggcaagagaauggugugaaccugggaggcagagguugcagugagccgagaucacaccacugcagagcagccugggcgacagagcaagacuccgucucaaaaaaaagaaaaaagaaauaacauugguuugguccagaaaggcaggacaacucaaagcggagcgggcagggagcuuccaggcuauaggugaaguuuugacauuuucugguugacaauuuguugaguuugucuaaagaccuggaauugauagaaagggaauguucagguuaagauaaagauugcagagaccaaaguucuuuugaagucuuacaguggcuucccuuagagacaauagaugacaaguuuuccuauucaaauuuuaguuaaucuuuuuaggauuggguaggucuggaagaaaaagaucuagcuacguuaauagagauuauuauagaugcagauuuucccccacaaagaacaacuuugcaggaccauuucaaaauauggcaaagaaacagguuucgggguaaaauauuuugauuccuuguuguguaauauuaugccagagucggguuggaaaguaaaucaugauauauaaguuuaaauaaaacccaucugauuagaauuuaugauuuguagggcaugaauccccagaccccuuaacugggaauuugcgcaagauuuaaaagaaucagaguuuaguccucaguauuauuuuuaaaaggugacuguucccaguguaaaccaucaccaccaccgagagaucgaucuggcccaagcuggaauauggugaccucaugguucagugaucaucgcccccagccucagggucuguggcuucuguuggguuucguauuccauugauuuucacaguauucagauaggaugauguguccgcccuguccaguguuuugauggaaggaagggaaacaggcagcuuacaccccccaagauucuggaccuccuccaggacugcauguggaaguugcuuaaggcguauguuucaaggugggcgggucuaugcaaacccauccccaaaagucccaggaagcugagaggcuaaccaaagaggcugauauggccgggcacaguggcucacaccuguaaucccagcacuuugggaggccgagggggacagaucaugaggucaggagaucaagaccauccuggccaacauggugaaaccucgucuuuauuaaaaauacaaaaaauuagcugggcgugguggcgcacaccuguagucccagcuacucgggaggcugaggcaggaaaaucgcuugaaccugggaggcggagauugcagugagccaagaucgcgccacuucacuccaaccuggcaacagagagacucugucaaagaaagaaaggaaggaaggaaagaggcugauauauccaguuucucaggaggaaacauuuaauggagacauauaaauagaagccauguaugugucuugggcagcggugaaacaagaugguaaaucucaugccaauacccucaagacccagcgauuauauaccacagggaaaggacaguucagaagggauggguaagguaauugaaauacgaucacaucaagguuguuugaccuaagggcgggauuuacaguaagcaccugcucuuacacaaggagcaguagauacacuggaagucuuagaggcauuccaggaacaggguuaaccgugagucaguaugguggauuagcaugcaagguggaguugcccuucuccuccacacuuccugcucauuauguuccuaacuccuuauuccugcucauuauuacuuccugcucauuauguuccuaacaagaagugggaagaagagaaacggagugacuuacagcuuaggagcuuaaaaugcuacugaguucugaggcucugaagacaucccccaccauuuuugguuuuuguaaagaugggaucucauuauguuguuuaugcuggucucaaaccccuggcuucaagcgauccucccaucuaggccuuccaaaccuagaauaaugaauaauuguucauucaguuauucauacagcaccaaauacuucugaguacuuauuuugugccacaaacucuucuggauacugaugacacaacagugaacaaacaaaaugugugugugugcauguguguauauguguauagauggauagauuuauauagauauagagcuauagauauauauaucacuauccucauaguauuucaugugauagagggaaaaugcacaaauaaauauauaguaggucaauaauaagugcuaucaaagguaaaguaagaugaggcuggguguggcggcucaugccuguaauccuggaaacuuuggagguggagguggagggauugcuugaagccaguaguuugagaccagccugggcaacauaaugagacacugucuuuacaaacacacacacacacacacacacacacacacacacacacacacaaauuagaugggcaugguggcaugcccauagucccagcuacuccagaggcugaggcaggaggaucacuugagcccaggaguuggaggcugaagugagcuaugauugugccauuguacuccagccugggcaacauagcaagaccccaucucuuaaaaaguuguuuuuuuuuuuaaguaggacaagggaauaaaguauugggggaagacuauucuaaauuggaugcaaaggggaaggccucucugagaggauagcaguuaucuagaacaaacuucauguauccaggauuugcaagauggcuaguguggcuaaagccacagugcuaacgcagguauucagagacaagguuagagcuaauuuaagcagguguggugggcugaaucauggcccuuccaagauguccaugucguaaccccuggaccugagacuaugcugucuuacacaguagaggaaauuugccgaugugauuaaaggccuugagaaggagagauucuucuggauuaccaaaguggccccaguguaaucacaagggucuucauaagaggaaggcaggagggccagguagauagagagaagacgugagaacaaaagcagaggucagagagaacaggagaugcaacacugcuggcuuugaagauagagggaugggcccaugagccaagggaugcaggcagccucaagaugcugaaagaagcgaggaaauggauucugccuuagagcuuccagaaggaacgugauccugcugaugccuugauuuuauacuucuaaccuccaauuuuuuuuuuaagagacagggucugacucugucaggcuggaguccaguagcacaaucagcucacuguagccucuaacuccugggcucaagugauccuccuaucccagccucccaaguagcugggacuacaggcauauaccaccacauguggcuaauuuuuuuuuuuuuuguaaauauaggguauugcuacauugcuuaggcugaccucaaacuccuggccucaagcaauccucccaccuacgucucccaaagugcugggauuacaggcaugagccacugugcucagcuauggccuccaaagcuauaaaagaauaaauuuguguuguaagccacuaaguguaugguaauuuggaauagcagcacugggacccugauacaaaggucaaaucauggagagcccgggauagccuugcagagccuuacccuagguaaggcuguugagcucuaaucggagcgugaaucaaugccuuggaaacauuuugagcaaaggacaacugugauccaauuugcauguuuauaucaacauuguggcuucuugguagaagauaacccaaagagggagaaguuggggaauggagaccaguuagagagaagugaugaugggacaaugagaaggugccaggacugggcuauuucaaaggugaagaccauagaacuugcugauaagcuaguguauguguugggguuuucuagacggacagaacuaauaggauagauguauauaugaaggggagcuuauuaaggagaauugacccagacaaucacaaggugaagucccacaauaggccaucuguaagcugaggagcaaggaagccagucccagucccaaaaccucaaaaguagagaagucaacagugcagccuucagucuguggccaaaaggccugagagccccuggcaaaccacugguguaaguccaagaguccaaaagcugaagaauuuggagucugauguucaagggcaggaagcauccagcacgggagaaagaugaauuccggaagacucagcaagucaaguccuuccauguccuucugccugcuuuauucuggcugugcagguagcugauuagauggugcccacccagauugaggguggaucugccucucccaguccacugacccaaauguuaaucuccuuuggcaacauccucacagacacagccaggaauaauacuuugcaugcgucaauccaaacaaguuggcacucaauauucaccaucacaacuagauggaaggaaugcgaggaaaagugguagggaagauaacuccugacaaauagcaaguaacuggagcaacuguggaauucccauuacugaaauacaaagggagggaagagucuggggauuuuauuguuaguuauuuaacuuauuuauuuuucuauuuuuagagagggagagggcuuaagaacuacauuuugaacuuaaguuugaaaugguccuuagaugcccaaauggagauguuucguaagcaguuguauauaaaagucuagaauucgggggagagauuggauuaaagaaauaaaugcaaaggucaucagcauagaaccagauaggauccccuaaacauagaagaaaagagaagggggaaagaaaaggcaagagaggggaagggaaggaagccaguagagaugggcuaagccuugggcaauucuuggauuucaagggcagccugagacacacagccacagagagcaagggaaaguucaugcaagagguagugauguuguaauuauagucuuccugaagcaaaaugcaagcuggaagaggacauagcuucaacccugggagaaugcuaucacauggagaauuagcacugugucaaguuaauuucuuucccucuuucacuuuagguugaugagcucaauugaaggaucaaacuaaucaaccuugagcaauuguuugagaaugugaaaaucucuaaccuccauuuuuguuuuuguuuuuugagacaguauccugcuccaucacccaggcuggaggguaguggcacaaucguagcucacuauagccucaaacucccgggcuuuaaugaucuuccugccucagccuccaaaaguugcugggauuacagacaugagccaccaugcccagccuaaccucuguuuuuucaaggauuuggcuuacaguaccuagaugucuguccagagcauagauggauauacuccaaauauuuuguguuccagaguggcuuauuaauucagaguuaaucuagcucacaaucucccucaccacaguggugagaaacuccuucucagucauguuugaggagccucuuuccaucucugugaggcacguaagcaucagagugguaccuggagcccaggaggguccuuuugguccuucuuugcagguugccaugguuacccucuugcccuuugcuuuagaaagaugcugauaguuuuccucucugccauccuuggacccuggagcucuucagaguaucuuuuccauuuagucucuaagccugagaaaaaacuggucugccagacagcuauccugcacucagcccagcuggggaaguaacaacaggaggggacaggucucuacaacuuucagaaaccccacaaucucugcucuuucucagccucuggaagggaagccuccaccucacaggagaccauuucugccuuuccacucucagcaagaguuuaucuccccuccuuuaaacaagucuucgccucuugcacaaaaucuuuuggagggagauguaaguaggcuuaucuucuaggugccagaccauucuaucuaggguguugaaacucugcagcuguuaguagcccccaaaaucuggaguucccuacucagaggacagagauaaucaucuucucauggggagaaaaaaacauaucucaguuguuuuucaauggcaauuuauuuaaauauuuuauggucuuauguaacucuuaaauugaagaaauacacucuuggaauaaagcaacucuguuuuugucuguccaugucccuuaauuuuauucuuucucugccaucagguaaaaacacaggcagauuuuucuacucacucuuagacaauaaaaauguucugugcuauggucacuugaggucccauaaguccucaguucacugccaucgucaaaacugcaaguuccauuggaagucacugucccagcaccccaucccugacccagguugugggaagggacuugguugauuugguucucucuucucaccugauucuucugcuccucuuggagcuccacggcuguggucucugggucaccaggaauucaggcuuggcguggagggaaggacagcaggggucauuccuuuugacuggcacaguuguaaucauuacuauugugaugauguagugucccagcucucuggacguggcagaugguuaaagccaccucuuucucacauuucaugggcauuuuuguguuuucaaggaccucccacacucuacauuggucaauaucacucaccugugguguucaugucagguaaaauccacuuccauuucagcuguucacuuccuucuccuccggcuuuuagggauucugucauaccuguagcuccuuugcacuggggucuggucugauguucccucuuaagugguccuucagacagcccuguaccagcugucucauagggcccagcugguccaugagaaacuaauuuugcauuuccuaugaaaccacauuauacuuuuuuuuuuuuuugagacagggucucacucuguugcccaggcuggagugcaauggcaugaucucagcucacugcaaccucugccuccuggguucaggcaauucuccugccuccaccucccaaguagcugggauuacaggcaugcaccgcugugccuggcccacauuauacaaacuuuuauacaucuuacuuuucuuacccagugguaccucauggacauccuuugucauuucuuaaauacuuaacuuauacuaggcuaauuccuggcuuuucuagucuagucuacugguuugucuucuuuuuggucaacacuauauugauuugagaguauuccuuagcccagcagccaccaucagcgucaccugggaacuuguuagaaaugcaaaaucuugggcuccacuccagacuuacugaaacagaaauucugggugaggccuggucuuccguguuuuaacaaguccuccagcaaauccugaugcaugcugacauuugacuaccacuauggcaaaauggcuuucuacuagaugcuuguauauugacugucauaaaaucaaugccccucaucaguguuuuauuucggacuuucucgccuauucaugggcauguauuuguucuuucaaaugaacauaaauuccauuccauuaaaacagucugugguuccaauggggcauugcaauaaauuauauauuaacauuaggauaacuggcauuuuugugacauuaaguguuuauaucugagaauacaaaaugucuuuuuauuucuccaucguuuuuuuuuuauaaaggucuucugacuuucucgccaaauguauucauaaauaauuuauaguuugaggucauuauauugaguuaaguacuuuuucuauuccauuucuagauuuuuguuacccaauuagagaaaaaagcuauuauauaaacuaaauauuuaucuuauauguagccacuuuauuaaauuaucuuauuuauucaagugguuuguaauuuuuugcagugacauuuuuaaugagaagauaauuuucuucuuucuauguuuauacucucuuuuguuuugcugcauucacuagaaccuguaaacaauguggaaaaauaauagcaaaagcaaaugcaccggucuaguuccugacucaauucaaaacagcuuuacuuuuucaacauuuagaauaacauuuacuauugggcuugguggucuuuaauacauuuaagugguuuccuucuagcccuguuauaauuaagauuuuuauuaggaauggcuguugauuuuuaccauaugucuuuccagcgucuauugauauuuauaugguuuuuuuucuuuaauguguugcucuuaugcuguagcaagaagaaacacaaauuccuaucacaaucaauuucugguuucaucaguuuucuuuaaaaaacaaaaacaaagaaacaaggguucuaauugauugcuuagguaaguuaucugaacacaacguaagucugauaagcuaaaacacaaaugccugcacaccuaauuauuggagcucuuucaucuuuuaccaucccaacuaaaccaaacgacagauaaaagguaaucauugauaacaguaauaauguggugggucggagcauuaguuucugucucagagaagucugggucccaauauuuguucugccacuugcaaccugggcaacuuuggguaagaaaaauggcuagcauuuauugaacuuuuacuguguuuucuaaacacauuauguagauucauuuagguuaguuggaguggaggggaggacacccggggucauuccucucuaaaucacauucucccccccuuaccaaguaagagaucauguauuacaaagaaucaauaaaaguuagcucuauacccucauuuauggaauuuuuuauaaaaagacuuguccuagucuguuuucuguugcuauaacagaauagcugagacuggauaauuuaucaagaaaaguuuauuuggcucaugguucuggaggcugggaaguccaaaagcuugguggcagcuucuggcacaaaguuuuguaacacgauggaaaaaugcaagugagugcaugugaaagggccaacacacgaggagugaccuugcuuuauaacaacccacucuaaaggcaacuaauccaauccugcaagagcaagaacucacucacucccacgagaacuaacccagugucacaagaguggcauaugcccuucaugauggcgccaucaugacccaaacaucucuuaaagguucuacuaccucucaacaccauuacuuuaggaaucaaauucuaacaugacuuuugguggagacaaaccauuuucacaccauagcaaggcuauuuuuuuuucuuucccuguuaacugucaaaacauaaccuaccaugaagcagagggagucacuugugugguuucuuggccaaaugccccaaaccucucaucugauaaauagguuucuguggagguuggggugaggucuccucuugacugcuggccuugaacuugugcucauggucagggacacuuugcuacugaccauggucugugagcacuaccuuuuucucaccaugguggacugagcaggaaauaacaaaagugccaacagaccacuuuuaaaguucuccccauggagucucccaauaacacagaccaauauggaguuccuggaauuugagucugucuaguguguaguauaagaaccuagcugggcccccuuaccccaccucuuuuucacuuuagaaagacagugacagguggcuucuuauucaccuauucuccagauacauagcuccugaugguagaugauggcugagcagaggaucuggggcauguuauucuaccacaguccccaguaucaggguccuagggucuggcuuccugccaugaccuccugccacagacucauaauugaugacuaugccccaugacccagacccucaauuacuggcuucauuauaucagaguuaagcacacacagugccaucaaaaguuggcauucuaccauguuuucccaaucugcaaaaugauuuacugcucuucaccccacggcuuuccuggacugcaguuccugccuagaaauccagguuucccuguaaacugaucccugguaucugguggcaaacuugggugugacccauacuucagggugguuugucccaguucugucaggucucuggucuccugcauggcuccuugcauuugcccaucugcugacacagcuggugacaccauucacuagagagcucaucuuacugauucuuuuuuuuuuuuuuuuuuuuuuuuuuugagacagagucuccuuuacccaggcuggaguacaaugguaugaucucaacucacugcaaccacugccucccaggcucaagugauucuggugcuucagcccccugaggaucugggauuauaagcaugcacccccacacucagcuaauuuuuguauuuuuaguagagacgggguuuugccauguuggccaggcucgucuugaacucgugaccucaagugauccgcccaccucggccucccaaagugcugggauuacaggcauggaucacaguacccagccauuuuacugauccuuuacccaccccaagacacauaaagcccuuccaacuaugugcucggcccugcuggacucggcuccugaguucccacucuggccguuucucucguuggccuccccuuuguacccuuauuugcccuagaccagucuugucucacucgaagucccuggaaucacugcagaagcaaaagcucugccagaauuucuucuugccagaacuagccccggggaaucacagaaaaauaaaguuguuuucuuguauucuagacccaauuacuguaguggcuggugaguauacacaacacuaauauucaaagccagucccaguccacgcugcaaguguggcuuuaaaucacaaagucauuccgugcucuggaacccaaacuagagaaugaagaaugugaaccuagcaaaaggacacgugcauuugcuuuugcugcaaaugaccuucuuuauugcauagaauaaucaccuuuuagauuuucugagauuagcccuacauuguagcaaugguauccucuuaggucuuaauacuugauggaugaaucuuucuguuccuaagacacggugagggaaucuagauuuuuuuuuuuuuuuuuuuuuuuuaauguuugagacagagucucgcugucacccaggcuggagugcaguggugagaucucagcucacugcaaccucuaccucccaaguucuagcgauucucauaucucagccuuccaaauagcugguacuacaggugcccaccaccacgcccagcuaauuuuuguauuuuuaguagagaugggaugucaccauguuggcugggcuguucucaaacucccgaucucaagugauccacccgccucagccucccaaagugcugggauuacaggcgugagccacugcaccuggccgaaucuagaaguauuuuuugaccuauaaucuauuacugaaauacauuuuuuacugaucauaucucuacuuauggucagguuaguugaauguauauaucaaggcuuaaaauccucauuugguuugcaacagaauaguuguuauaaguuuaugauuugggagccaaugaaaauagugucauuuuuccccuguagaauaaaagcucaagguagugucaagucuucagaaaguaaacuuagcacagugggucucaaacucugcagugcguuaaaacuacagauuuuuggggccuggccccaagauucugcccacguaggucugguggguagcccagggauguuuguuuuaaacaagcacugcaggugauuuuuuuuguuuuuacuuuuauuuuuuucuugagcaacuuugagucgaaagcagaugauuuuuaguaaaugauuuaugcacuacgcuuuugagaagaacuggguuagaugagaacauuggacucagaggaaaacacuggguuuuaauucuagcucaauggcuuuagguuucaaaccuuuuauuuucgugguccaauuuauaaagggaaauagcaauaacugccuucuuuauuauuucugauauuauuuucaugaugacuguauguauaggcaaccagucucucugaacagaccaugaauguguccacaaaaaaaaauuuucggcugggcgugguggcucacaccuguaaucccagcacuuugggagccugagacagacagauuaccugaggucaguaguucgagaccugccuggcuggccaacguggugaaacccugucucuacuaaaaauaaaaaaauuagccaggcgugguggugggugccuguaauccuagcuacucaagacgcugaggcaggagaaucgcuugaauccgggaggcaaaggcugcaaugagccaagaucgcgccacugcacuccagacugggugacagggugagacuccaucucaaaaaaaaaaaaaaaaaaaauugucacaaacuuuguguguuuaacuaugugggagaauggaaguaccuucaaaccuuacccagucauuuccauggaaaaauaaagcacggccgggcgccguggcucaugcuuguaaucucagcacuuuggaaggcuaaggcgggaggauggcuugagcucaagaguucgaggucagccuggccaacauggugaaacccugucucuacuaaaaauacuaaaauuagcugggcaugguggcacaugcccguagucacagcuccucaggaggcugagguaggagaaucgcuugaacccgggaggcagagguugcagugaccugagaucacaccacugcacuccagccugggcaacagaaugagacuguaucucaaaaaaaaaaagaaaaaaagaaagaaaaguaaauaaagcauauaauagagacagacauaagaaaaaguuaaugauaaacagucauuuaguagacaauaaaaacccagcaaucugugcaguuguugaaggaaugacauuaaccgucucugaggacacaauuuauuacaacauaacaaguuauguacagaaaagcgacauugaaauugcaaggaaacaauacauucugguacuaaguuaaaauaaggacagauucugcagagcuuagaauaauuucugaaaauguuuagaaugaaaacacucuggcucuuaaaaugauaaacuugaguuaaagggcauugacucacuuacugaacaccuacuaugugucaggugcaggaaaaacaucugcccuuauggagggugcaugcuagugauggggauaagucaaucagggguauuauuuucaggaagaucaaaugugcaaacagucaaccucugaauaaacuagcaaggggauaaaucaaugauagaccuacuauguccaacacaguagcccugagcuacauaugguuauuuaaacugaacuuaaauucauuaaaacuaaauaacauuaaaaguuaucuuauugcguuaggcauuuucaagugccuaguagacacauguagccaguggcuaccguguuggacaguacggaaugaucauuuccaucauggcagaaaguucuguggaugguccugaucgagaccaugguggaagaugaaauauauuaugguaaaaagcagaucugggaaggacaacaggccauguggagaacaggggagcugacauuuauauaaaucugagaaucucucugaaaaggugauauuugaaaaaaaacauaagaguggagagugagugaugggaaaccagaggagagugauucaugggaaacuagagaagaguaaaugauggaagaguauuccaggagugggaacagaaggugcgauguccugaggaggagccaucugguggugggagugggggcaggcaggaggcaguccaggaacagcaaggaguuuuuauuuuuuguagagauggggucuuacucgguuguacaagcuggucacaaacuuuccuggccucgagugauccuccugacucagccucccaaagcacugggauuacaggagugagcuguggugcccggccuggagguggcaacuugaugcuuuuucccagucacauucagcugugugggugcaggucuggaguagguggagggcugguuguguccaguuuuuguuugagaaagcccuacaggcuacagauaccggggaaaugaggcuugaugacaauucacgcuaauuggaaaaaggucagccaguguuagcaaaaacauagguuuuuuuuaaagcucuuuuauucauuaaaaauguauccuguauaauuuauguucagcugggucuugccaaaaugaauaaauaaagcuguauuuaauuagcuacaauauuuacauuucaacacuuaaugagcuaacagcuguuaaaagaguuuguucucuuaaguagauugagaaucucucugccucccugcaauuuugcuuaccuuuuuuucuuuuuucuuuuuuuugcuuaaucauuccuucaacaggugcguguugucagacaguugagggcccagaaauccccaaaacagaaggagaaacugaauauguagaaaacacgucccuugccuauaggaaguguauggugggacuccagaauagaauaagcauuaaaaguacaaucccaccuagugcucagcagucuuuucucuccaccaaccaugcaaggccaacccaacugcccacuaacuaauucagaauaaguaaaauacaaaguaaugagacuuaaccacauuuuaugcuucgucauuugccauuuuaucagcaucauccuugauccauuuuccuccucaguacguuucuauugaucucggcugauuggugauaugccuaauucaaauggagcuuguuguucuccuaauuauaaaaguaacagagacucaauaucaaaauuuuggaaaauauugaaaauuuggaaggagggaaaaaaacaauucuacuauucaaagacagccacuaauuguaauauauuaucuuucuuuuuagccuuuucucuuaaaaauuaauauucaauuaugagucauuucaaacauacagacagguauaaaaaauaauuuacaaacaacccaaaugaacaggugucaacauguugcuauauuugcuuuagagcacucauuuuuuuuuuuuuuagauggaguuucucuguuguugcccagcuggagugcaauggugccaucuuggcucacugcaaccuccaccucccagguucaaggaauucuccugccucagccucccuaguagcugagauuacaggcacaugccaccaugccuagcuaauuuuuguauucuuaguagagacgggguuucaccguguuggccagguuggucucgaacuccugaccucaggugaucggcccaccucggacucccaaagugcugggauuacaggcgugagccacugcgccagccacucuuuguuucuuaacaaauaaaauauuauaggugcagguaaagcccauccccacuccucaucguuccuuuucuccccagagguaacuacggccguuggggauuuccugcgaugugcuaaucagugcccaccuggguuggugucuugguuuugguaauuccaggaaaccugaggaaucuggucugcaaagcugaggcccaccccaaggagguggugaccucucugcucuacucccaaaacacgauccugcggcaacucgcaguuucacucaccuuucuggggcaucuuccaauuguauuacacgauuccauugucuccuucaaacaacccgaucaccccagagaguagaguguaaaauguacuacuucaugaauauucagauauauacauuauguuccaagaaugaaauuaaucccagguuaacaggauggcagaguaguacuguuugcccacucuagacuucaaauucacauuuaaaaauauugauuaccuguuagguuuuacaugaagaaauaccaaagggcaaauauaacaguauuagaaaccaaggcugaaaguugaccauaagccaguauuuaaaggaguguuuggccaggcacgguggcucaagccuguaaucccaacacuuugggaggccgaggcaggcagaucaccugaggucaggaguucgagaccagccuggcuaauauggugaaacaccguuucuacuaaaaacacaaaaaauuagccaggcaugguggugcaugcuuguaaucccagcuacucaggaggcugaggcaggagaaucccuugaaccugggaggcagagguugcagugagccaauaucgugccauugcacuccagcuugggcaacaagagugaaacuccaucucaaaaaaaaaaaaaaguguuuuuuccaggucuugaaaaaguugaauguauucucugcuauacagaucucuagcagcuguauauauagacccuuaugggagaguuucucaucucccauuuuaggagaggagaagcacucugucccugcccccauugugguagugacucacugagguuguugaagugaacauagcuaccucacccaacuuguucuuaaaaaggagaccauggaagcuaagaggaaaugagucagaugacaguuuggucagcugagccagccucuccuggucuccuuccuggagucagcguauauuucaacaggaaccucuauucuuaggcuacaaacacagugauugaacucuuauuaucacuuuauauucucuuuuacuauuaauagggcaaacagauccuucccagauaugguuucaaucuguguccucgagcaaaucucacguugaauuaucauccccaauguuggagguaggaccuggggggaggugacuggaucauggggguggcccuucaugaaugcuuuagccccaucuccuuggugcuagucuugagauaaugagugaaugaguucuuaucccagcacucugggaggcugaggcagauggauaaccugaggucaggaguucgagaccaacccagcuaacguggcgaaacccugucucuacuaaaacuacaaaaauuagccgggcgugguggcggacaucuguaauccuagcuacuuaggaggcagagguaggagaauugcuugaacccaggaggcggagguugcagugggccgagauagugccaccgcacuccagccugggugacagagcaaaacuccgucucaaaaaaaaaaaaaaaaaaaguguguagcacuuccuccccucucgcuguuccugccaugugagacgucucgcuugcccuuugccuucugccaugauuggaagcuuucugcagccucuccaggagcagaagccuccaugcuuccuauauagcccauggaacugugagccaaugaaacuucuuuucuuuauaaauuacccagucucagguauuucuuuauagccaugcgagaacaggcuaauacauugcccuucuuccgaauuauacugauucuaggauggggauagauuuuguaagcauaaauauuucaaagcagaaauaaagcaaaaaauaaaugguaauagauuugaaaacaaaaaaagaauacuuuuauacgugaaaagaccguacauuaaaauaaauaaugaaaaaggagauaugucuaucauagauguuuaaaaacauaaguggacuguuucuaauauguaaauaguccucauaaauaaguaagaacugagucagagaagccuucagcuaccuguaaccagcaagccugccuuuggcguggcucuguucacucucacagcccugacauagcugucaacaaauacugugggucuuugaugguuaaaaagaaaaccaaacaaaugaacaaaaggaguauucuaaaaggcaguccccagccgggcacgguagcucacuccugugaucccagcacuuugggaggccaaagugggcagaucacgaggucgaaagaucgagaccauccuggccaucauggugaaaccucgucucuacuaaaaauaacaaaauuagcugggcaugguggcacaucccuguaaucccagcuacuugggaggcugagacaggagaaucacuugaauccgggagguggagguugcaaugagccgagauugcaccgcugcacuccagccuggagacagagcuagacucuaucucaaaauaaauaaauaaauaaauaaguaaaaaggcaguccccaucucuccccacaacacaccaccaaaugcauucaaaccuacauguggucaaauucugguggguugauguuccugucauuccccuaaggacauuuugauguauuuuauaguuuacauguuauugugacuggccucuuuuuucccucauauuuccugacagacgccuucugguguauaauauagcuguugauuuuuauguuuauuuccauuccagaucauacucuaucaauuugaguaaugcuacuguaaauguccuuaguuuuuuuuuuugagacagagucucgcucugucacccaggcuggagugcaauggugugaccuuggcucacugcaaccucugccucccggauucaagcgauuccccugccuccgcugccugaguagcugggauuacaggcaugcaccaccaccccuggcuaauuuuuguauuuuuaguagagacgggguuucacuauguuggccagacuggucucgaacuccugaccucaagugauccacucauuucggccucccaaagugcugggauuacaggcgugagccaccacacucggccugcccuuagauuuucuaguagacaaauuaucugccaaauuuucuccuuuuucaaauaacagaccuuucucccccuauuucauaacucuacuauauugguuugaaauucuagaaucaugcuaaauuauuuugaaguugaaaagcauccuguaucauccccugaguuuaccuggaccaucucuagauuuggggguucgguaggauguugacugguaguuucaguuaaauguucucaagcauguggaguacucaguucauuccauuauuagcuugcuaaaaggcuuacaauucaaaaccaaauauugcauuuuauaaaaucucuuuccaauaucuaucaaugaucuauauguuuuuuaccaauaacauauggaucauaugcuacuuacuuuacaguuccauguaaaacaaauagcaaaaauggggaaaugucuauaagaucuauuacauauauaauauguauauugcauaauauacauaauauagcauauggaacagauaauaaauauauaauauugcauguguaauauauaauaaacauauaaaacuggccugguauuggcugggcgcggugccucaugccuguaaucccagcacuucgggaggcugaggcggguggaucacgaggucaggagaucuagaccauccuggcuaacauggugaaaccccaucucuacuaaaaauacaaaaaaaauuagccgggugugguggcacgugccugcagucccagcuacucgggaggcugaggcaggagaauggcaugaacccgggaggcagagcuugcagugagccaagaucaugccacugcacuccaaccugggcgacagagcgagacucugucucaaaaaaaaaagaaaaaaaaugugccuuguauuuaacaauuuuugcauuucucagaaagcugcuauucguauacuuuuguguuuuauuuacuacucuuucuaaaauugguaauuuuuauuugacuuguuucacauaaauauuaacuuaggagcauuugucacaucauuaaauauuauucugcaaaacuaacuuuaaacucuuuauugacucuaauguauaauacauaaaaugcacaaauccaaauguauaguuaaaugaauuuuaacuauaaauaaacucaauacccuugacuaaacagcaccuagaugagaugugaaauauuaccaauaccccagaagccaccauguguccucccaauuaacaacccccuccaagguuagccauugugacaaaacuacguuuuaauguuccaugaugagugaaggagaagauuaauagcaaauaaagccaacgaggcagggaagaaccagauaaggcuuugagaacuguauuagucuguucucacauugcuauaaggaaauaucugagacuggguaauuuauaaagaaaagagguuucauugguucaugguucuguaggcuguacaggaagcauggcggcaucaccuucuggggaggccccaggaaacguacagucauggcggaaggccaugccuccaccuccuggagaagcaggcacuucuuacguggccagagcuggaggaagagauagagaggggaggugucacacauuguuaaacaaucagaucuugcaauaacucacucuugacagggcagcaccaaggggguaauguuaaaccaugagaaaccacccccacgauccaaguaucuccuccagaccccaccuccgacacuggggauuacaguucaccgugagaauugggcagguacacagagccaaaccauuaucaaaaaucagauuuuauuggugcauuuauuuucuugcuugcuugcuuuauuucuugcuuucugucuugcuugcuugcuuuucuuucuuucuuucuuucuuuuuuccuuuuuuggagacagggucucacucugucauccaggcuggagugcaguggcgugaucuuggcucacugcaacauccaccucccaggcucaagagauucucccaccucaacuucccaagcaacuaguacuaccagguguguuccaccaugccuggcuaauuuauaaguuuuuuguagagacagaguuucaccauguuggccaggcuggucucaaacuccugaccucaagugauccuccugccuuggccucccaaauuucugggauuacaggcgugagcuaccacaccuggccagugcauuuauuuucuauuguuguauaauagauugccacaaacuuagugauuuaaaacaacucaaauauaucaucucucagucuccgugggucaggaggcuuagguggguccucugccugggaagcuauuugaaggcugcagucaagguguuagcuacauugggaugccuauuuggagcucaggauucuaguccagguucguucuaauucacggucagaauucaguuccucguggcuccaggauggaagucccuguuuuguacuagcuuugggccaggaacuacucuuagcucuuacaggcugcccaugaauccuugcuguguggcucacacaggcauuucacagcaugcacauuugcugucuuccaggccaaccagagccugguucacagacuucaccugauuugggcaggcccacccaguguacuauccauuuccaucaacucaaaugcaacugauuuuuaagcuaaucaugggagugauaucccauccucaagugaaggagguuauaaaagacuguggguaauugaagauuaucuuaaaauucugucuaccacagcgggaaggaaaauuauauuuuuuuucuauuugcaauaagaagcuauuugaagaauuguaaucgggggggaggaucuuauuuaaacauuaaaaaucacuaaccucaauagagaaucuguaaagaacaaagcuaacuggaugcuuugcagagaauaggggaauaggacuuugacuuuaguaauuaguagaaguggaauuaaagagcucagcuugggccaugcuaacuuuuagauuccuauucgauacagacauccaguggagaauucacaguuagcuaugcaugcguggagcucaaaaaagagagagagcuggaaacauagauugaggcaucaucagucaggauggaaugucaacuucccagacuucaugagaacacagggaagagauguagacaggcuagaggauugcugcaggugccaugauugcugaccuuauacuucuuaaucuuacagucaguuguguagacagacuccugcguggagccuucccaauaguaauuccguuguuuugcaguguguuuucuauggcaucaagcuaguugcuuguauggguguuuuguuguuauuucuuucuuucuucuuuuuuuuuuuuuuuuuuuuuuuuuugagauggaguuuaguucuguugcccaggcuggagugcaguggcaugaacucagcucaccguaaucccugccucccagguucaagcaauucuccugccucagccuccggaguagcugggacuacaggcaugugugaccacgcccugcuaauuuuuguauuuuuaguagagucgagguuucaccauguuggccaggcuggucucaaacuccucaccucgggugauccgccugccuuggccucccaaagugcugggauuacagaugugagccacugugccuggccuuuuuuucugagagagagagagagggucucacucaguugcucaggcuggaaugcaguggugcgaucauggcucacugcagccuccaucucccaggcccaagcaaucuccccaccucagccuccuaaguagcugggacacagguguuuaccacuaugccuggcuaacuuuuuaauuuuuguagauauaggggucucccuauguugcccaggcuggucucaaacuccuagccucaaguagauccacucauuucggcuucccaaagugcugggauuauaggcgugagccaccacgcccagccguuguuguuucauaauaguuccccuauugaaguucauucaagccacauucaacuaacuuggauuaucuugucauuacaugggauuuccucuucucuguccacuugcuggaacuggagggcgcccugucuccugaauuucugcccacuaguagauuguuaucuugagcugauccacuggaauaguaaguaaccauauugccuuacuuagaagaaacgcugaacaaaaucugggaauuuaaauccuggucaggauaauguaucuaaagaugugagcuuaucaagauugcaugaaucuuccuagcaauuacaagagugguuuugucuuuccauucuaacucagcauguguauuaaacuguucucaugcugcuaauaaagacauacccgagacuggguaauucauaaaagaaagagguguaauagacucacaguuccacauggcuggggaggccucaugauuauggcagaaggcaaaggagaagcaaauucacgucuuacauggcaacaggcaagagggugugugcaggagccccuuuuauaaaaccaucagaucucgugagacuuauucacuaucaugagaacagcacgggaaagaccugccuccaugauucaguuaccuuccacugggucccuccuaugacacgugggaauuaugggagcuacaauucaagaugagauuuggguagggacacagccaaaucguaucagcauucuugggccuuaacagcauacgcuagugucuccagcaugugcugaucuuaauuucagccacacccuagauuuuucaaaggggcguaagccuugaaucccagcugcuuacagcagguaccuuugcagauuuaugagaggcuaguuguuccugagaauuaggcucgggauucucuguccagcgcaaaagggucaaggaaagaugagauggccacgucuuagagaaaguuaguuaguugcuaaccuuugaggaagcaagcacagcucacaagcuagcaccuuaaggugaagcuucccauucccugcuucugccugucuuggauggucaaggauuuucaucuaaguagacaggcagcccuggaauucucuaaggaaacugaaaaggaccuggaaaggucuacaccaggcuaaaguaaaguccuuaaagcaggaaacccaaucaacauguuuuggacauuacucucucucucuuuuuuuuuuuuuuuuuuuuuuuggauagaguugcacucuuucacccaugcuggagugcaguggugugaccugggcugacugcagcuucagccucucaggguccagcaauccucccaccucagccucccgaguagcugggacuaggugcacaccacaaugccuggcuaauuuuuguaauuuuuuuuuucguagucacagggucucacuauguuaccauguuggucuugaauuccuggucucaagggauccccuugccucggccacccaacguguugggauuacaggugugagccaccacaucuugccuggacauuacucuugaacacagauuugauaaccuaugagaucuuucugagggugggguccaaaucugaguuuccccugaugcuauuaaauaacaccagaagggauuaaaaaagagauuuuguaaggacaagaaaguuaagugaagagaccaauucaaaaugagggauagaguaauacauuucuugaagucagggaaggugucucucuuuuuugcacacucaguuuggugcccaaaacaaguagaugcucaauuaauguuuaucggucagcuuauacuugcauaagcguaacacacacacacgcacacacacacaccccacaccacaacacaccaguuugcuuuaugcaugcaaaauggcauucaggguucaguguuaagcaugcaugucuccaugcaucucuuggagacaugaggaaggagugucuucucuucuuuccuuguucugccucucuguaucugaccuaaaugguccucuuugaagacccacacauguuaaguuaauaauguggguuacuuugaacuagaugguucucuuugucaucguuggucuccugaucacagagaguucuccgugggaucauccucugccuauaaauguccccucagcaaaugcucucuguagcuuuggugagaguagcaccacccagggaggauucaggcauuaaucaucccuggcagagugcucccuggaaguuuacucugaagacucuuccucgcugccuguuuucugucuuucacuuucaaccucuccuggcagugguacguggccuuaaaggcuugcaaugugacauugaccugguguuucuuugcuguguaacaaugucaugucauuuuuuauggggcaugucauaacuauuaguguuguuguuaccaaaaagggguccugauucagcccccaagagaggguuccuggaucucacccaagaaagaauucagggcaaguccauagaguaaagugaaagaaaguuuauuaagaaaguaaaggaauaaaagaaugcucaaggcugggugcgguggcucaugccuguaaucccagcacuuugggaggccaaggcgggaggaucacgaggucaggaguucaagaccagcuuggccagcauggugaaaccccguuucuacuaaaaguacaaaaauuagcugggcaugguggcaugugccugcagucccagcuacucaggaggcugaggcaggagaaucgcuugagcccaggagguggagguugcagagagcugagaucaccccacugcacuccaaccugggugacagagcgagacugcuucucaaaaaaaaaaaaaaaaugaaaauaaagaaugcucaauaaaggcagagcagggcuuucccgaaaggaggaaugcacccacccuagguacaaugcuuguuuauacaggguagcaaaaauauccugggagauaugcucuacuacaaggguuugugauaaaggguuaauuuucuuaauuacuauauuugcaagaauugauauuauucucuuuaaagcaagacuaggaauguuccuguucucaagauaucgggauauuaggacauuccugagucugggucuguuuaguaaauguuaucaaucuguucccuuaaucauacaccucuggaggcuaagaauaccuaauguccugggaaugcagccaagugggucucagccuuauuuuacccagccccuauucaagauggagucacucugguacccacgccucugacaccguguccgcaugggcucaguuaaaaagaacuaacagugauggauuuuccauccuacagcuuauucauauacaccaugcagcagggccacauugccaggaagggcaacuucuaauuuagucucugguuugauauccuucauugcuauagauucuuucaaguuuggaaugagcagaggagacaggagaucaaaugaauuuggaguguaccuggauacaggaguccacacuuacagucucaaacucauauagccaagggucaugaugucaacuggagguugaaggagaaacagaaguuccuagaggccucugacgggaacaacccauacacauuccuuucaaagacagcauaaagugauagaaacacaucaacaugaagaguggcuuagacugacuugguguccggaggucaacagacaaauaaaaaaugaugcccacaguggcuguaaucccagcacuuugggaggcugaggcgggcagauugcuugaggucaggaguuggaguccagccuggccaacaugaugaaacccugucucuacugaaaauacaaaaguuagccagauguggugguacaugccuguaaucccagcuacuugggaggcugaggccugagaauugcuugaacccaggaggcagagguugcagugagccgagaucaugccgcugcacuccagcuuggggauagagcaaaacucugucuccaaaaacaaacaaacaaacauacaaaaaaagaaaaaagacaaaaagaaaaaugauuacccagcagaggaccccuucuacucugaacuuguucaguuuacaucugugaacucaaaauauccgagacaggucucagucaauuuagaaaguuuauuuugccaagguuaaggacgugcccgugacacagccucagcagguccugaugaugacaugugcccaaaguggucggggcacagcuugguuuuauacauuuuagggagacacgagacaucaaucaguauguguaaaauguacauugguuaggucgggaaaggcaagacaacuugagguggggagggggcuuccaggucauagguagauucacucuuuugaaucucugauuggccuuucacugaacacacaauuuacaugugagaggagggcuuagugaaauauuagggcgggggaagcaaucagauauauauuugucucacauaagcagaaggaugacuuugaguucugucuguccucuguccauaaggaauuuccuugugggcaaggugggcaaauugugagggaggucuguagcuuuuuuuuuuuucuuuacucuuuguagcuaucuuguauaggaacagaaugggaggcagguuuuccugacauaguucccagcucaacucuucccuuugacuuagugauuugggaguugcauuagucuguucucacacugcuaauaaagacauacccgagauugggugauuuauaaaggaaagagguuuacuugacucacaguucagcauggcuggggaggccucaggaaacuuacaaucacggcaggagaugaagcaaacacguccuucuucacgugacagcaggaaggagaagaaugagugaagucaggggaaagccauuuacaaaaccaucccaucuaaugagaacucacuaucaugaggacagcauggagguaaccacccccaugauuuaauuacuucccacagggucccucccaugacacguggggauuaugggaacuacaauucaagaugagauuugggugaggacacagccaaaccauaucagggguccugagauuuauuugccuuuugcacaucuuuugugacauuuuuaucaucaccugauuucuuaagugccaggauucugcaguucuuuggcccacuuccuugauaauagaaauauagaauaugcagcauucccaggaacgugauguggccuuuggagucucugaaccaugaaggacucagcuauuucucauuaugccuuuuuuccuuuucuaauuauuguuuuauauuuucaucagacaucuugguuuaagauaccuugguccuugggcccucucccauggaaggaauaaauugaacaauuuaauuuacacuaaaauuaaugaaggaucgcagagcccuugccuggggugauuggccagugccaccucugcagccucagcgcucgccugauuaagugggcgggggcaacuccaccaagagaacagggggaggagagggaagaggagucggugagacagccaguugucuggagacaggaugaaggauggauguggguaaaucuccccugaugauuuucuaaaggagcaauccuuugaaacgcccaaggcagcaguucucagccagaaugggugagagcccugacagcacuuccagccccuccauuuaaacuccuuugacucacagggugaauucccacuucacaagggucugacacauucccuauauugaauucuuaacucugagcaauaugacagugccagaggcgggaagaugcagaaugaagcuuucuucaaaaaucuaauauuuaauagccauguaagauugcagaauauggaggcaccaaaauucacuuagcccauuugugagauuauuuaacucauguccuuuguauuaauuacaaauaauugugauagauauuuuugaccuacaucuuuguuugaauuucugauucuuuuuuaaaagaagcaugguccauuugaauaacacauaguuucuacacuuaggccuggacaaauuuaguuugcaacacacacacacacacacacacacacacacacacacacacacauacauauacacaccaugagguugucuacaguuauuauuauuauuucauuuuauuuuauuuuugagacaaaaucucacucugucacccaggcuggagugcaauggcacgaucucagcucacugcaaccuccgccucccagguugaagcgacccuuccaccugagccuccugaguagcugggauuauaggcaugcaccaccaaacccagcuaauuuuuguauuucuaguagagaugggguuucaccacauuggccagccuggucuugaacuccugaccucaagugaucugcccaccucagcuucccaaaaugcugggauuauaggcaugagccaccacacccggccaguuauuauuuuuuauuuggacauacauguauagucuugggaaaacaaauauaaaaauacagaacaguggaaaaugaagcaguuaaacaguaugaucuauuuuuuccagauguuuuaccuccacaucuagauguauauguucauauauauacauauaauaaguaauguuuuuaaauucuaaaaacaucuuugacucuaaaauauaacaucaaagauauugaccaggugugguggugcacaccuguaguugcagcuacuggagaggcuguggcagaaggauugcuugagcccuggaggucaagacuccagugagcuguaauuguaccacugcacuccaaccugggccacagaguaagacccugucucaaaauauauacauacaaaauauuuacauuaaaauuaaugaaggauugcagaaugaacagcucaggaguuuaaauauauguauauguauauuuauaaauauauauguauauuuacauauguaucaccccaggcaagggcuguauauauguauguaugcauguauauauuugagaguuccaaauauauauaugaaaacucucaaauauauacaugcauaucuuuaauauauucauauauauuugaaacucucaaauauauacauaucuacauauacaaaauacauacauacauagagacccugucucaauauguauauguauguguguguauauaaugugcacgcacacagacauaauaucaguugaaaaagugccuuuggagcaaaaccaaaauaaaauaaaugaaaaagcacugcauucaaugcacauguagucaggacucuuaaugcccacuacagaaaucaacucugaccaauuuaagcugaaaagaaauguauucuaaagcacuggguagcucacagaguugacaggaaggcuggugggucaggcuuggagaaggcauaggaaauaaguaagguauaggguagccagcaccagaguccaaaugccaucaccaaagcuacagcaagacccucacugccacuaggggacugagagugcccacgagggaccacaacacccugggugcugccuagggucagacggaaccuccaaaacagcuucuuugcagcccuagcuccagauugaaaggcuggggugcugcauuugaauugccaagccugggucacaugcccaaaucucaguugcaugggggauggugacauuuauggccuuuggggcuuccaaguugaggugggggauacuuaccaaggcuccuaagaugaagcaccgcccaauguagaaaggaaauuugggugccgugugcaccuaaaacugaaugucacauuuccacuaaagcagucauuguccagcgucagccagagcauccccuggaaagcuucaugaaacacggacuccugagcuacucccccugauuuaguaagucagacuugagacaugcaaguuugcaucuguaaucagcacucggguaaugcugccagcccauagaccacacuuggagaacgacgcuagaaugcauauuuauuuuucaauuccccuuagcaugcauugaugcauacaauuccauaucccuuucuucuuuauuagcucgaaguuugaguuuaagcuguguucacaguuaguaugaagcauguucuaaaucacuuucagccaucggcaguucuuuacacagaaccucagaacagcacagagcuuuucacaguucauagcccuuguccagacaggguuagcaucguuuugaauugcagcauaguuuugagauguaucaaagaacugugagauuuucugcuucuuaauguuuaagggaagccgugauuuauuuucuuuguuuaauugaauuaagcuuggcuucacauuauauaguuuuucuugggaaaugagcccgaagcuucugacaguuaucacccacugacugacagacacucacagugaaugaaucagcuauguggcuucuccaaaucugaaaauuucugugaucuuucgagagaguuuggcaacuucaacugcaucuaauugcacugucuagcaugaaacugccaaucuucaaaguaacuuuuuauugcuacuuuguaguguacacuuuuucuugguuuuacuuggaaaauuauuugcaguaggaaaaagaaccagguccuuacaacaaacaugcauguaaccacaaugcagaaugaacaaacaucaccaacuugcuauaauugcuucugaccuuuucuuuccucuuaaaauaaauagcacauuccugauuucauugauaucucuuuuguaugccauuucaguuucuuuuuuucuuuccuucuuucuuucuuucuuucucugucugucugucugucuguuuuuuauuguuauuuuuuuagagggagucuugcucugucaccgaggcuggaaugcaguggcauggucuuagcucacugcaaccucugccucccagguucaagagauucuccugccucagccuccugcccggccuguuucuuucucuccauucauuuucaggaacacacacugucaaugguuugggguguuuucuucuagcccauguuguguaaagacuuuuuaaagcaaauaucaaggauccaaauuuaaguuaaaauucuaccaucuauuuggccucuaccucaaacccuacacacacacacacacaaauuaauuuaggcugaucauagucccaaaagcauagaaauauguggauuguggaagaaaacagaguaucuucacaacuggagguagacaaagguuuccugaacagaacaugaaaaucacgaaccauuaaaaaauggacucauggacuuaaucaaaauuuaaaacuucaggcugggcgcaguugcucacuccuguaaucccagcacuuuggaacgccgaggugggcggauuaccugagaucaggaguucgagaccacccuggccaacauggugaaaccccgucucuacuaaaaauacaaaaauuagccaggugugguggcacacaccuguaaucccagcuacucgggaggcugaggcaggagaauugcuugagccugggaggcagagguugcagugagcugagaucaugccacugcacuccagccuggcugacagagcaagacccugucucaaauaaaaaaaaaaaaauuaaaauuucagaaugacagaagauuucaguuaaacaggaaaaauaauuucaaaagaucuaucauacauugugaagacucucaauaaagauauauuguauacuuuaaaauugcggagagauuuuaaauguucucaucacaaaaacugauaagcauaugagauaauguauauguuaaauagauugauuuagccauugcauaauguauacauauaucaaaacaucaaauuagaugccauaaauaauaauauauacaauuuuuaauugccaauuauauaaauaaaauuuuagaaaauauuuucaaauuuauuuuaaaauccaauuuuaaaaauaacuuuuuagacugagugcaguggcucaugccuguaaucccagcacuuugggaggcucagccaggaggauugcuugagcccagaaauuagaagcugcugugagcuaugacugcaccacugcacuccagccugggugacagagugagaugccgucucaaaaaaaaaagcaaauaauaauaaguguuuaaacuucagcucucuaacaggaaccacuaagaauaggaaaaggcaaggcacagauuaggaaaaaaauauuuucaacguaucuaucugagaaaagagucguaagcagaauauauuaaauauauuuuuaaagucucacaacucaauacuguaaaagacaaacaauccuguaaagguugugcucaacaucuaguuauuucacaagagaaaauauacaaauggcuaauaagcacaaucaauauaaagacguacaacaucauuugucuagauaaauuacaaauuaaaacagccgugaguuacccacuucuugcccagaaaaaaaguuaagcugaaaagacugaaaauaccgaauguuggcaaggauguggaguaaaugagauucucagacaugacugagaggaguguaaaauguuacgaucacuuuggaaaacuguuuggcaguuucuguuuucuuuuuuuuucuuuugaggcagagucucuuguucugucacccaggcugaagugcaguggugcgaucaugguucacugcagccucaaacuccugagcucaagggauccucccacuucagcuaagauuuuuuuuuuuuuuuuuuuuuagagacagggucucacuauaaugcccaggcuggucucaaacucuugagcucaaucugucuuccccacuuagcuccuggaagugcuaggauuauaggugugagucacugugcccagucggcaguuucuuauaaagcuaaauacauacuuguucuuuaacccaaacauucuucuccuagguauuuucccaagagaagugaaaacauauguccguaaaaugauguguacaagauuguucauggagucuugaucguaauagcaacaaacuagacacaaccaaaugucaaucaaccagagaacagauaaacaaaauuguggugaacgugugcaaugaaaugcuguucgaugacaaaauggaaugaacuaaucauguucuaaugacauggaugaauaucgaaaccauuccaccuggcucugaggauucugccuucuugcagaaccuccuuuagauccuccucuugugugguccauagacucugccuccugucccucggguucugcagggucauuaaaccacagcuuccaggcaccaggcuugggcagauccucucaggaaaaaagccagcucugagcucucccuuaauuaacugcuuguucuuaaugucugcccucuggaguuuucuuccuuucuugucaguucacagacacauuuguuuguuugugcacuuuucugcaucggggcggagaguugcaucuauuauauuucuccauuuaggguaggacaccaucuuagauccaugcaaagccucucucuuacuuguuuguuugcucauuuguuuauuuccuuuucucucuguuucccuccuauuccaccucuauuccuaugggcaauuauccaaaggauuuuaauguguggcuguuggugcaaaauuugcauuuuugcuuuuagugaauauauauauguguguguauauauucauauauauauguauauauauacuguuuuuuucuuuuuugagacacggccucaccuguuaccuaggcuggagugcagugacaugaucaaagcucacugcaaccuccgccuccuagauucaagcaauucuggugccucagccucccgaauagcugggaucacaagcacccaccaccaugccuggcuaauuuuuguauuuuuuuuaguagagaugggguuuuggcaaguugaccagguugaucuggaacuccugaccucaaguggucaucucggccuccuacugcacccagcuguauaugugugauguguguguguguguguguguguguguguguguguguguguguguuugagacaaggucucucucugucgcccaggcuagagugcagugaugcagucacaggucacuguaacuuggguucacgcaacccucacaccuuagccucccaaguagcuaggacuacaggugugcaccaccgugccuagcuaauccauuuuuuaauuuuuauagaaaggaggucuggcuauguugcccaggcuggucuugaccuccuggcuucaagcaauccucccaccuuagucucccaaugcucugggauuagaggcaugagccacugcaccaggccaauauugcaugcauauuuaauguacauaaaugguauucuguuuuuucauucauuucaaauauguauugaguacucacuaugugucaaccacuacuuucugccuagggauaguaguaaacaaaauucauaacauagauuuuauucuguucuuuauuuuauucacuaaucuaugcuuuuaagagcuaauuguauuguucugugugcuuucaccucauuaccacuaccugccugccaaauauugaacuccgcagagcuaacuagccacuguuauuacuuuaguauagaucccuccagaaucuauaaccuccccccuacaaaaaauauacuguuuucuugagugauuuuuucuuuuuccacaaauaauaucguagucauuuaguauucuugcuuuucauuucacucaagagaaugucaggcuggcacaguggcccacgccuguaaucccagcgcuuugggaagccaaggcaggugaaucaucugaggucaggaguucgagacaagcauggacuacauggcaaaaccccaucucuacuaaaaaaauacaaaaauuagcuggguguggugguaugcgccuguaaucccagcuacucuugaggaugaggcaggagaaucgcuugaacccgggaggcggagguugcagugagccgagaaugugccacugcacuccagccugggugacagaccaagacuccaucuccaagaaaaaacaacaacaaaaacaguaugucaguauauuacgcacucagaucucuugauauauggcauagauuccauguaaggauauuuuccuuaguuuuucuaaugauggacauuugauuccaguacuuuuuccuuucacaagaauccuucaggcaacauauguguucuugccuccaugcacgcaggugugaggcuuuuucuaggagagauucuaggaagcagaauugccaaguuguaggccaugcacauuuucagcuuuaauagacauugucauaucaccuuuaaaaguugcuaguacggguugagugcgauggcucaauucucuaaucccagugcuuuggaaggccugggcgggaggauugcuugaggcugggagucugagacuaaccugggcaucauagacccuaucucuacaaaacaaugacagaggugugguggcaugcgccuauagccccagccacuuaggaggcugaagugggaggauccauugagccuaggaguucgaggaugcaguaagcuaugauugcaccacuguacuccagccugggcaacugaauaacauccugccuuuuaaaagaaaaaguuacucuaauaauauagaagaccuuuucuuacuaaauucucuccaacccucaauaccaucaaaugugaauauuuugccaauuagauagauuuaaaauagcauccuauaguuuuaaguugcauuucccugauuacuaauaaacaaauccuaacaagauucucauggaaucgcuaaauugauccuaaaauacauguggcaaaaaaaaaaaaaaauaggaagauccaagauugaaaaagaacaaagaguuaucaaauaucaagacacacauauaccuaugcaguacuagccauaaauagaauagagucuagaucaauggaauggacugggaguccauauauaugcccaggucuacgugggaauuuagcgugaaacuugugcuaaaucacuugggcuaaggaugggauauucaauacaauuggggcaacugccuaucuauuggagauguaaaaaagcuacaugcucacccagcagcacuuauaaaaauaagccacacauagauuaaacacacauaagaauucuaaaaugguuagauguaaauagaguggauuauauuuaucccauugaguuaaacaccuuaagacacccguauccagaaggaaaaaacaaacagcuuugacuaaaugcaaauuuaaaaacccucacauggggaaagccaccauaacaaauuaaaaaagaaacuacagaccaggagaaaauguuugcagcauucacaauaaacaaaagauuagcaugcaaaauauauaaaaggaguaaaaauuuaaaaaguaaaggugaacaacccaaggguaaacugaauaguugacugaugagcuuuccaaguuuguuuucuguaaccugaguuagaguuucagcaucaucgauauuggacuuuacaacuaccaauguaauuuuuuucuauuauguuuuaauauuauuaaauuuuuucuuuucuugaauucccuuuuuucucaacuuaaaauaauucuaucccagucuucaauuaucauagcucuuguuucauagguaauauuauguguguguauguguguguguguuucauugagaacacaaaacagauggcuuuuaagcuuuuuuucuguaauaaccccuuuaguguuauucuguauguuuacaaaguaucccuccuuuuacagugcagacauuuucuuugcaauauucuacgggguuuuauuuuccuguuuauccuucaaagaagaaaggucuccccuaguuuacaaauaccaggacacagaauggcuggugcuucuuggucuuccucuuuggucuucuggauaucaauagaauuccaaacuuggcucuugaacagaaggggccauucaguauaaauacgggugugagcaucaaauuugauuagcaagcacagaugugaugcaguucugagggggauacuuuaucaucccaucuucugacugugggauuguugcucacaucuggcuaaucugacacagucugaacaguucuuuacaauucuuuaaaauuggcauucccaaaguaccauucucccagggugcuuucuuauaaccaguuucacuucugcaauggugaauuuuauguguuaccuugacuagacaacagggugcccagauauuuggucuaacacuauugcggguauuucuguucagguguuuuuggaugagacuggguaauuuauaaagaaaaggagauuuaauggacucacaguuccacauggcuggggaggccucacaaucauggcagaagaaaaaaggcacuucuuacauggugguggcaagacagaaugagagagccgagcaaaaagggaaaacuuuccucuucuucuucuccuucuccuucuccuucuccuucuccuucuccuucuccuucuuuucuucuuuucuucuucuucuucuucuucuuucuucuucuucuucuuucuucuuucuucuucuuucuucuuucuucuuucuucuucuuucuucuuucuucuuucuucuuccuccuuuuuuuuuuugacagagucucacucuguugcccaggcuggcgugcaguggugcaaucuuggcucacugcaaccucugcccccuggguucaagagauucuucugccucagccuccugaguagcugggauuacaggcaugcaccaccacaucuggauaauuuuuuuuuuguuuuugguuuugguuuugguuuugguuuuguuuuaguagagaugggguuucaccauguuggccaggcuggucuugaacuccugaccucaggugauccacccaccuuggccucccaaacugcuaggauuacaagcgugagccacugcacccagccaggaaacccuuuauauaaccaucaggucucaugagacuuauucacuaccacaagaauuguggggaaaccacccccaugauucaauuaucucccaccaggucccucccacaacacaugggaauuaugggagcuacaauucaagaugagauuugagugggggacacagcuaaaccauaucaccugccuucaggcuuccucucccuuuaaagggaauucaccaagagaagagacugaaacaugggcucuuccuggucuugagccugccacccuuugggcuggaacuacaccaucagcucucuugggucucuagcuugccaccuuacccugcagaucuuggggcuuauuagccuccaugacauaagcaauauauauauauguguguguauauguguauauauguguguauauauuauauauguauauauacauauauguauauauaauauacauauauguauguauauauuauauauacauauauguguguauauauuauauauacauacauauauacauauauaauauauacacauguauauacacauauuuauguauauauugcucauauauauguauauacacguauauauauuuauauacguguauauacauauauguauggauuuuguuuacuacuaucccuaguaggcuauauauauauauagccuccaaguagacagguagauaaauaaaaccccacagaauauugcacagaaaauuucugcacaauagaaggaggguuacccuguagaaguaaagaauagcacuguaaaugggggaaaacaaaaagcuugauauauaugcauaucuauaucuaucuauacacacacacgcacgcgcacacauacacacacauauuuuuauccuauuaguucuguuucucuggggaacccgacuaguacagcuucccaaggagcaguguuuggugccuuuccugcucagcagaaaacugcgggcuccuuucuuccuccugaagaaucugugucauuauuucaugaccauggacagcgccucagccuggccauaaccucugccuggcaucucccaagucucugcugaucucuguaaaauaagagaaucagaacggcaacaauuacaucacuuaagggguuucagcuuucccaaacuuuggcaucaauauauauucaaugagaaguguguuucgcuucauagggcgauucuuuguugguguauccuaaaugcugcagucagucaggugcugaauguucaacccuccuuugcuguuguuuuguuaugcaaagugggcagaagacgaugacauccaggaggagaguguuaaucuuuuauuuuuuuggagaccgaguuuggcucugucccccaggcuagagugcaguaguggaaucucagcucacggcaaccuccgccucccagguucaagugauucuccugcuucagccucccuacuagcugggauuacaggugugcaccccaugcccagcuaauuuuuguauuuuuaguaaagacgggguuucaccauguuggccaagcuggucucaaacuccugaccucaagugauccaccugccucagccucccaaagugcugggauacaggcaugagccacugugcccggaugagaguguuaaucuuaacccagcgggaaaucccaggucagcccuagaagugaugaccagaaucagcugaauucugggugcuggaugccaccccagagucucuggacggggccugaguguaucuauuucuaacaaguuccccagccaugcugaugaaccucugcauuaggguucagggcuagggggaaagggcuagaggcagaaaaucauaaagcaggaagucaggacccuugcaauaaggccaaacagcagagggcaaaguagaagaggagagaccagggcuugggccgugaacaaagccaagcugccaggagcuguuggccuuagagccagccucuagaaguggaggugggugaguuauugaaacacacagaccacaccuaaacgaaacacaggcaugaaggaaacccugccuaggccuccuccucaguucuugcuuucuggcagaguguuugccaaauuggaaagaugaauggaauucgucaguauagauguuccauaugaaauucuuaccugacauuguuuuucagacuuagcuuguuuuaucaagauacaggaaccaggugaaauugaacaaguaagacacauucugccaggugcaguggcucacaccuguaauuccagcacuuugggaggccgaggcaggaggaucgcuugaggucaggaguucgagaccagccuggccaauauggugaaacccugucuguacuaaaaauagaaaaauuagccuggugugguggcacaugccuguaaucccagcuaguugggaggcugagguacugcuugaacccggguggcagagguugcagugagccaagaucaugccacgguacuccagccugggcaacagagcaagauucugucucaaaaaauguaaaaaauugaaaaaaauaagacauuaaagaacucagauggaggaguauguuguuuccaauuuaaaacaugugauguuuccaauaaauuacagauccuuaguuuaaggcagaauuugguagaagaugugauuucuucccugcuuuugacauuugucucaggggugaguccauuucacaaucauuucuuaguuuagccaggauuucuuccuuuucucuucugcccuuuccacuaaguguuacaguucccucuuuugguccaacccauuuaauauuaauuccuuuccaucaucuuaaaagcuuuaauuaguuauugugauauguucccuaagaacucuggagucugauucaucaaagugauaacaagaagauauuuugggaauuuguuccaauugaaaugacuaaauuauuuccccauuuguuauuuaucugcuuaaggauauuguaaugcuugguaccaaauuuaugcucaagaaacuggcuaugcauaaagcuguuguuuuuccagggugagugucacauaaacuuagaacuuugguuuuguccuguagcaacacauuuuugagucauuauaaagaaggcagguaagauuaaaucagaaaaaauugggccuugcuccaagcuauuucugggaggagcaaauauuaucuggggugauggcaggggcaucugauggaaugacauagaucaccaucauaaaaggaauucccaagaaugaggcuucagaaagauagcuuugccacccuaugacaaucagcucuccugucuuuuguagccugcucuauggagaaaggaaaaucauaucgcagugugcuccuugugcaaaagugacaugacugucccaacuccaggguccaucucuauaaaugccagaaugcccagugcagcaaaucaaccaaaaagucaccgagaucaauuccugaguaacgugcauuuagcugcuucucugaugcuguuaccccacuuccucucccuuaaauaccaauccagaaaaucaagcacacuauguagaaucucuaacgccaucugugugcagauuucagucacugucagagaagaaagaggacacaggggaggaaauuaacauuuauagagggcuuguggcugcuggcauuuagcauaccucaugcgugcccaugagcauaauaaguaugguguaaguauaauguauuaauuagauccauucuagucccauuuuacaaaugaggaaacugaggguuaucuuugccaugaggagcuuagcuuagcucucugguuuuguuuguuuguuuguuuuuuagagacagugucuugcucugucacccagucuggggugcagugguacaaucauagcucacagcagccucgauuuccugggcucaagcaauccuccugcugcagccuuucaaguagcugugacuccaggugcacacuaccaugccuggcuauuuuucuaaauaguuuuuuuuagagauagggucucacuauguugccuaggcuagucuugaaguccugagcucaagcaauucaucccccucagccucccaaggcgcuaggauuacaggcaugagcucccaugccuggccuaaaauuuuuuacucuuaguugcaaugagugcauugauguaguuggcugguucguucuuuauuugugaauucaagauggugcuccauugcauuuaugggccaacccagcuucuaagaggucuucaggaagcauaggaaagaaauuuaaagaggggaaaggagaagugucuucuuagggagaauaagaagauguagaaauuaugguggauucagcuucuaucaauuauauguuucaccuacauuucuuauuuggaggccguccaauacccauccucacaucucuuccuuuauuaguuaaugccuagcagagaaaaaaaugaaauaacaaccucucacuacccuggaaugcuggaggucuaggauuuuccuucacugauuuuccaagaauccuuguaaaucagauuuacagucauguaaaguauuuagaguauuguuaggauaaaaugcaauaugacagucuaauguaguuauguuacagucuaaauauaguuacaggagguauaaccccgaagauaggcagugcugaggguacaggaacggaccuguaagcuuuugggaauaauuacuuauggaaguacuaauaguuaugggguucaaagccaggcaagcuugaagaggccuuauuauuuauuuuugccucacuaaguguauuagcauguuaucaaagugcucuaacaagcacagcuugcaggcaucggugaacguugcaaauggaagcagagaagcuaauguaccgguguauuucucuggcuggauuccaggcugugcugagguuuucuuaauucagaauucacuguaaacguggaugucuugcucuugugccaccaacccugcugccagaaucccaggaagaaaucagcuaagccacaggggcaaaaucccaacagcucagacucaucccuugaucuuaggugagaauggauucugucucuaagaacccagacaaaacggcagcgaucaacaucagggagaaauuugggaggagcauccagugaauuggaguaagcuuucaggacaaagcaggguccucacuuuuaugcucccgcagggcaggauaguauugcuugcuucagucauuugaggacucacacucaagcugcaauucuccauugucacauugggugaauccugcuugucaaagaguuuacucgggacuagacuuuguuuuuaggacagaggcagacacgugaguugcugccuaguaucuagcuaucuccagccucccuaugugagauaugagccauaugucucucucuccuaaucaguaacaaacuggcacggacccuugaccaagaagggcugggagauuuguuuuuugucuuuuuuuuuuuucuuuuuuagauucaggagguacauguacagguuuguuacauggauauauuguacaaugcugggguuuggguaucuauugaacccaucauucaaauggugaacauaauacucaauagguagucuuuaagcccuugucccccucccucugucccuaaucuaguagucccuaguguuuauugcuggcauuuuuauguccauauggacccaauguucagcucccacucaauugagaacaugcaguguuugguuuucuguuucuguguuaauucacuuaaaauaaugaccuccagcugcauccauguggcugcagaggccaugacugcacucuuucuauggcugcauaguauuccacaguguauaucuaccacauuuucuuuauccaguccaccaucuagggcaccuagguugauuccaugucuuugcuguugugaauagugcugcaaugaacauacaagugugagugucuuagguagaaugauuuauuuuccuuuguguagauauccaguaaaaaucagauugcugggcugagugguaauucuguuuugaauucucugggaaaucuccauacugcuuugagauuuguugaucuuguuggaauuggcccaugaugauuccauccagucuuugcaggcaugaacggauggaaccaucagucaugcaggcuccuuccugccacaugaacagagaagaagaaagagcugagggucuuacagucccagagagagggagggcagagaggcagcagccugccuucccggagugagagucuggggagggucgugcauucuacuuucaaugauccuguggaacacagcuacccuuguuacacuuggagaaccguuguugcauccuucaucuccucuccuaggauucuauggcacuuccuuuuguccuuccaacauagccucuguuuguuaccuaacucaguuuggaaggauuucugguuguuugcaaaacgucuccacuaagauaaugaagagcucuaggcuaucauucugugacagaugcuucccugacucuuuaccuuuaaaaagguuuuuuuuuuuuccaaagaaaaagggaaaaugacuucaauacauucuuaaaacacacacccacauaucuuaguaaaauauagaaaggauguauccaaaaugugguuuucccuccaaaaugcuaucauauauuaccaugaaauagucauggucaaacagugcuaacgaaggcuaccauuuauugacuguuuccucugugccaacaaaaaaauuucauaagugcugcuucauuucagccucacaacuguccuauucauuaguauuauuauccccauuuuauauauaaggaaacugagguuuugcucugagcgguucaaucaaugccuaagagagcccagccauacagucacaggucucuccgaauuuaauaucuaaagagaagcacugucuggacaauuucuuccacacacuuggcccugcaggauguuaagaagggguuuguuucuuuuucuuuuucucuuuuuuuuuuuuuuuuuuuuuuuuuuaaagagagcaucuuacugugucacccaggcuggagugccauggugcaaucguagcucauugcagcuguaaacuccugggcucaaaugauccucccaacucagcuucccaaguagcugggacuaugggugcacaccacugugcucggcuaauuuuuaaauuuuuuguggagacgggucuuguggugucacacaggcuaugaugcagccauagcucauugcagcauugaacuccugggcucaagcaaugcuccugcuucagccucccaaaguguugggauuacaggugugagccacugccccuugccuguuugcuucuguuagaacacuuuugcaacaagucaaaaacauaaacaaaacacaccaauucuaaauggcuuaaaggauaggaaaauaucucagaaaacaaaaacagagucagggaaaacuucaggguugguugaaucuguggcccaacaguaacccagauucuuugagcccccucucccugccuuagugcugacuuccauucagacugcauucuccaaagacagccguggcacugcaugugaccugggcagcccuccauagagagagggguccaccuucccacccuuugaaucugggugggcaugugacuuuuuuguaacccagagaaugcagcaagagugaugcuaggucagggaagggaaugcaguaucugucuuguuuccuggaucauuuguaauuagugccuugagaugccgccauaagaaguccagccagccugaggcuuccaugcuagguagaagcugagccauuuggagaggccauggagaggggcugaguuggcacuccuggucucagacuccuucuggcucuggcaccgugaacaaggcuucagcagauaauccaauccagcauuugauucuuuccugacccacagaauccauaaaaugauuaagcuguuauacagcagugauaaccagaaaagugucauuuucuuagcuucacucugucacccaggcuggagugcaguggugcaaucucggcucacuauaacugccaccuccuggguucaggcgaaucuccugccucagccuccugacuagcugggauuacaggugugugccaccaugccgagcuacuuuuuguauuuauaguagagaugggauuucaucauguuggccaggcuggucucuaacuccugacaucaagugaugugccugccucaacucccaaagugcuggaauuacaggcaugagcaccuggcccaaaagugucauuuucaugacgguuacaagaugguuacagcaguuccagacaucacaucuagacaugacaauaccuagaguuuaaagggggaguaucucuuuuaugggucucccuuucucucucucucucucaagaaugauaaaaugggccagguucaguggcucaugucuguaaucccagcacuuuagaaggucaaggugggaagauugcuugaugccaggaguuugagaccagccugagcaacauggugagacccucucucuaaagaaaauuuuaaaaaucaggcagguuguauuagucaguucucaugcugcuaauaaagacauacccaagaguggguaauuuauaagggaaagagguuuaauugacucacaguucaguauggcuggggaggccucaggaaacuuacaaucauggcagaaggagaagaaaacacguccuucuucacauggcuacagcaaagagaaguggcaagcaaaagagggaaaagccccuuauaaaaccaucagauguccugagaacucacucacuaucaccagaacugcagaauggggguaaccucccccaugauucaauuaccucccacugggcuccucccacaacacagggauuaugggaacuacaauucaagaugagaauuggguggggacacagccaaaccauaccacagguguggugguacaugccuguagccccagcuacucaggaggcugagacaaaaggaucacuugagcccaggaguucaagacugggcucaagcuaugauugugccacccacuccagccugggggauagaccaagacccugucucuauaaagcgggcaucaaagaguaucucuguggucaaaauugggucacaugcucaucugggacagaauggauguuagaggacaaugccaaauguuuaccacaauaguccaugagaaaagauuuuccugcuuuaauuacuggcaaacacuagacuuaaaaaaugaucucuuaacuacaagccugcuuaaaaagauuuauacuaacaggcauuuuucauuuuuucauuuccaguuggggaaaucauaugcuauauuuccauucauauuaaccauggcagaguuuuuccuuuuuuugaagagcacuuuacuuccuggaacucuuuuccgcagaacaaaaucuggaaaaauacacggcaauuuuaugcagccucuaaagccauguccauuaaaaucuguaacaugauaaauaugccuguuaccacaauuaccacuuaacguuaaucuacuaaucaguguaauuaaauaagaacucugcccccauuuaaauaauaaaauuaguacuucucccaccccccuccuuuucaucccuccuguucuggcguuuugaucuuugcuuauguaauaugggauuuagauccaauuuguuaugguaaaauuauugguuuuucauauuaugucuucccuuucaacccaucaccacgucauuuccauuuuguucuauagcuguguuuaaggccuuuguuuuaaauuaaauuuuagauguggaugguuucaguucucagaaacagaaccuuaagacccuguuuuacccccauucuugaaccccuuguuuugauucaugucucagggccuaugugcacuuucaguauuucuuuaggaagggugauagauuuuaugcuuuugagcucucgcauaacugauuuauauucuguugccuuguagauggaucauaaccuucccaggugucaaauucuuaaguaaaagcccuuugcccuaaaaacucagugauaucucuccauuguguccuggaaucucucuguuguauccaaggauugucccagaaggguuuucuucccuuauaguuaauucacguuuuaugccaagauauuugcacaauguuuucuuuauucuugcauuucaaacacaucagccaucaagguaugucuaaggcuagacaucuauuaaauuauguuaccugguuaacaauaagcccaacagaucuggagagcuaacuuuguggcuuuuuuuuuuuuuuuuuuuuuugucuuuuuuuuugagauggaguuucgcccugucacccgggcuggagugcaguggcgugaucucagcucacugcaaccucugccuucuggauucaagugauucucgugccucagccuccugaauagcugggauuacaggcccgugcuaccaugcccgacuaacuuuuguaauuuuaguagagacaggguuucaccauguuggccaggcggaacucgaacuccugacguuaagugauuugucugccucggccucccaaagugcugggauuacaggcaggagccaccuugccuggccaguggcucuuguuuagaaauaacaauuuucuggcugggcacugguggcucacgccuguaaucccagcacuuugggaggccgaggugggcagaugacuugagguugggaguuugagaccgaccuggccaacauagugaaaccccaucucuacuaaaaauacaaaaauuagcuggacgugguguugggugccuguaagcccagcuaaucaggaggcugaggcacaagaauugcuugaaccuggaaggcggagguugcagugagccaggauccgccacugcacuccagccugggcgacagaacucugucucagaaaaaaaaaaaaaaaaagagacagagagaaauaaugggacagaauuugccauaaaauagaaugagucucagugagccagaaacaguuccugaaugugcagagagcauggaauacagauaagucccuuaaaggcgguucaucgcuguuucucuaugaaggugaaagucacugaaccuggagucagcaccacugcagagaugcgauugcaccacugcagagaugcaaggucuuuuccucccuuuuauucauuggaccugaccuccacuccagauccagguccaccugugcagccuuuucccuggagcugcucccugcccccaucgugucguuacucuugcccuuggaaauugcaagggugauaguuaauguugcacaaugagguugcagccacccccaaauucagugacauaucacaagaagcauugacccugauguuccaggauccgcagguaggcggagacccgguugauccaggcugggcucagcugggaggcucugcuucuagaggaaauugggucaggucugucucauguauucauucuagguccaggcagcagaaacucaaggcaaguuuuucucauugagaugucuuuggugcaagaggucaugaccgauugccucugcucauuccacagcugcuaacaccucauugcccaaagcaagucaccuagccgagucuaacaccaacaggcaggaauauaccccaaagugagagaaguacauauuugcuuugcaauauuccaaauuauaacucccagcuguccccacauauaaugauucacgaggacaaaagagcuucacaaggaaagguccuuggucuaccccauggcugcucggaugcccucacagugccaacucuaguggggucgguguguuucuucuacaguuuucucugccuugacucuguaacuuccuagaugugaucucuaccuaucuuuuuaagugcuucuauggggcuggugguuuaugugcuuuauggccucuguuaccuuguuucuauaaaguguuuguuuuucuuuagcuaauuaaaauuucauaagcaacaaauaaauuuaaaaagaugaggccaggauguauaauugaaucuaacaaaugucacauugcacagcuuagccgugugcucgauuugugaucugagaggcaaugccacuugccauauuugugaucuguuuauuaaaagggagaggcuacgguuuaaacacaggcuaaguucgugauaugguuccuaaauauaauagauauuucuaccacuuaccccgugccgccauguuucccugugguuacuaaaacagaggguuguaauuccuaacugcaugccuuauguaugauuugguaagacaaacagaaggaagugugacuuauccaagugccauauuagugaucugguuacuggaggauuauaagcucagccauguuaccuuugugaucaguuaccaaaacaaaaggccaggggcuuaggcaagugccguguuugugagcugguuaugaaaacaaaagucuuggcagggcacaguggcucauuccuguaaucccagcacauugggagagcaaggcaggaggaucccuuccuugaagccaggaguuugagaccagccuagacaacauagugagaccucgucccuaugaaaauuuuuuuuaaaauuaccugggcauggugaugugcacccauagucccaacuacucgaaaggcugaggugggaggauugccugagcccaggaguuugaggcuacagugagcugugaacaagccacuguacugcagccugggugacagaguaagacgcugucucaaagaaaugaaaaagcuaaaacagaguccuguaccacauucccauacaccauauaugugccccagugacuauggcuuaaacgcagucugcauuugucaucuguuuaaugaacagagggccccgggccuaaccuuggaauccugucugauuguuuccuggaagaagaaggaggucuccaaauugcauagggcuuccccugggaacuaaaacuggugcaaggauauucugaguauuuugggcuucuaagaaaaaaaucauaauaacccccuuaguuucacuuuuccaucucagaacacuuuuacaucucagaacacaauagcuuaguuuucccaauguuuuuaacaauugaugcuaauauuuguacagcaugaaagggacacauuccuuaccuugcuguuccucucaaccacuucuauauacguauuucuuuucuacucuucacucagccugggcucaauugacuuaagucuucugauuuuuuuuuuuuuuuuuuuuuuuuuuaggguggaucguaauuaccuuuaaaagggagacugagauagcagguggccacuuccuuuuuacucugugucauuuauguaauuuaauuuaacuaguuuuuuuuuguugguuuuuuuuuuuuuuuuuuuuuugagauggagucucgcucugucaccaggcuggagugcaguggcaugauggcucacugcaaccuuugccuccuggauucaagagauucuccugccucggccucccgaguagcugggacuauaggcacgcacuaccaugcccagcuaauuuuuguauuuuuaguagagaugggguuucaccauguugaccaggauggucucgaucuccugaccuugugauccacccgccacggccucccaaaguguugggauuacaggcgugagccacugcgccgggccaauuuaacuuuuaagauuuuuuuuuguuuuuuaagagacaggaucucacuuugcugcccaggcuaggguacaguagcacaaucauagcucagccuugaacuccugggcucaagugauccucccaccucagcuucccaaguagcuguuaugacaggccuguaccacuaaacccagcuaauucuuuuuagaggggcacagggguguagaaacagggucuugcuaugguacccagucuggucccaaaugccuggccucaagcaguccugcuuuggcuucccaaagugcugggauuccaggcauucaucacugugccucgccuggucuucugauucuucauccucuauuuggucuuuuuuuuuuuuuucuuuaccauguuauauccuguauuuuccauuccuuaagucucauggcugucacuagauuuuauuccaccccucuccuugcuuuaaugcuucuauagaaucauggcuuauuuuguugaacgucuccauuugccacauauuuuucuucauaagugaggauuuuccuccaugcauugguuguuuuacccguuucuuaggacaaugugcacucauccuuguauucaacaaauauugaucuagggcucacgugugcuaaguaguauggagauaaaaccaccaacagggcaugguugcuaucccguaggaauucacagucucauggacagaacaaaaaugucagcaggcgauucucacacaccguugcaagugcucuauuaagguuguauagaauaacauggaucacauguaagagaaaacacauccaaccccuagaacucuaggaggcuugccagagaaugucagagaaguugaggccuaaaggaggaaucacuuuggagaaggacacgucagagaaugguguuccagacagaaagacuaggcaaaaacccauggaugaaagaaagccuguugcauagagcagccacuaaguagaauggcuggcauacagaggaucaagacaucgcgggcaggacacaaugacaaggcuggaugauauuauagaaacacuuggaagugggcgagcauggcggcucacgccuguaaucccagcacuuugggaggccaaugcggguggaucaccagaacucaggaguucgagaccagcccggccaagauggcgaaaccccuucuuuaccaaaaaaaaaaaaaaaaaauuagccuggcgugauagugcaggccuguaaucucagcuacucaggaggcugaggugggaggaucacuuaagccugggaggcagagguugcagugagccaagauugugccacugcacuccagccuuggcgacagagcaagacugucucaaaaaacaaaaaaggaaacacuuaggagcuguguuucagaacuuggacucaaugaugaaggaacuaagagucauugaaggguuuucagcagucaccuuggcaucugggaacuuguuucugaauaagugcccauaucuacaaaagucacagucccugcauacagaaucaagguaaauccacacuucauucauuugcuaagcacaagcaaaaaggcaucuccuuauuuagauugcacuuuguugcuguuugacucuuuuccguccccuucaaaaccccaucagaaauggcuuucuucucuaucugaagauauucaauaagaauuacuugccuagggucauuggugugguaaaaggaacuguccagaacgagacaagucauagcagugacaucucauccucuugcuuugcugaaugccagauggaagcuguugagggaagccuaaaagccuacaugacauucuuuaaaugagaacaaaaaaaagcagggguguuuuagccacgaggaacuuaaauuucaccauucucagggagaauuaugaauuggacaacaucagccucccaccuggagcagagauggacauucugagccuaaauacagagaugaaauuggcaucacaucauuaacgggccuaucaacaguaugucuuauauuuguauuacuuugcauauuuuuguggaagaaaauuaacauuucuuauuauuuaguuuucuuguuuuugguuuguuuuuuuuuuuuuuuuuuuuuuuuuugaggcaggguuucacucccuucacccacacuggagugcaaugugcuccaccuuccgggcucaugcgauucuucugacucagcuucccgaguagcugcgacuacaggugcgugcugccacacugcacccggcuuguuuuuguauuuuuuuguagagaugggguuuugccauguugccuagacuggucucgaacuccugagcucaagugauccgcccaccuccuccucccaaagugcugggcuuauagaugcgaaccacaacgcccagccucuuacuuuauuuaauucucacaaaaaccucuauaagguggauaaggaagggauuuucauuauuaugguuauucuuaucauauuauugcuauucauauuauucuuuuaauuaauuaauuauuuugagacagggucuugcucuguugcccaggcuggagugcaguggcacgaucuuggcuuacugcaacaucugccuccuggguucaagcgauucuccuaccucagccuccugaguagcugugauuacaggcauacgccacugcacccggcuaauuuuuuguauuuuuaguagagacgggguuucaccaucuuggccaggcugaucuugaacuccugaucucaugauccaccugccucggccuuccaaaaugcugggauuacaggucugagccaccgcgccuggcccuauucuuuuuaucauuaggauuaucuauuaaauguaugaggaaacagauuccaagucauuaaaugaccugcuucaggguacgcaacuaguuaguggcagaauccauccuagauuaugaguccauuagcuccugaacucggggucugcauuuaugugcaugaggaggcagagaacuuaggugauucauuuuauuuuccggaacagcugcagcugccaauaaaagugacacaaaggagcuuuggauggggaaucagggugucaaugaguucuuaccucugcgauaacaaacugaaugacuuuguuucuccuuaacuuuuuaugugugggccacagcaaaaugaagaugugugauuugggaauaaaaagaguucuauccacauaacaaccacauguuguaaacaauaucaucucuauuuuucacagggaagcuaaggaacagagaaguuuaguaacuuucaaugagucacacagccccuaugugaugguaucugaguaagaaccaaguucgaggacuuuuucucaguuuauuacuacuaagaacuuauucauuggcugggcaugguggcucacacuuguaaucccaacacuuugggaggccgaggcagguggaucacuugaggucaggaguucaagaccggccuggacaacauagugaaaccccaucucuacuaaaaguacaaaaauuagccaggcaugguggugggcaccuguacuuccagccauucaggaggcugaggcaggaaaauugcuugaaccugggcggcagagguugcagugagccgagaucgcaccaccgcacuccagccugggcaacagagccagucucugucucaaaaaaagaaaaaaagaacugauggccggacacgguggcucaugccuguaaucccagcauuuugggaggccgaggcggguggaucaccugaggucaggaguuggagaccagccugaccaacaugaagaaaacccaucucuacuaaaaaugcaaaauuagccagccgugguggcgcauggcuguaaucccagcuauucgggaggcugaagcaggagaaucacuugaaccugggaggcagagguugcagugagccaagaucaugccauugcaccccagccugggcaacaagagcaaaacucccaucuccaaaaaagaacaaaaaaaaaaaaaaaggaacuuacucaugcacacauacacacauagaaaaagauggagagagagacagacagacagacaauggcuucuucaguaaguccucaucuucacucagaucuguaauacaugcuugucuguuucacauaaaaugaaccacuugagaacacuggcacauccucuucgaugugcaauggggaauuuucucuguuguuuauucucaggagugcugugagguuaugaauguuuuuccuuugcccuguuuguuucccauuucaucauccccagacagugcagacugcaaacagcucccagguauugaauagagugggcucccuguugagaacuccaccugcaucccacuuuacucuagaggcuauucacagcuuacccucagggcccgacccaggcaauccaauagcuguguggccgccacuagcaaaccacagccuacccuguguccagauuucugaugaugaguuacuuccagacagagugagcucuuggcauaaaagcccuuuacuuuacagacaacaaccaaaauaaaucucuauucauucccuguugcucuuauaacaaauuaucauacacuuuguggcuuaaagcaacacaaauguauucuacauuucuggaggucagaagucuguaaucaauucccuugggcugacaccaaggugucuuccuggaggcuccaagggaagaauccauuuccaugcccuuugguggcuuuuggugacaagguggguggccgcuugccccaucuuccuuccccacagggccuuuuccucuuuagugaaaucucucucucccccagucuuacaugauuacauuuaggguugugaaccccaauuugagacaggucucaguuaauuuagaaaguuuauuuugccaagguuaaggacgcguaccugugacacagccucagggaguccugacaugugcacaaggugguuggggcacagcuugguuuuauacacuuuagggaggugagauaucaaucaauauauguggccgggcgcgguggaucacaccuguaaucccagcacuuugggaggccgagauggaucaccugaggucagggguucgagaccagccuggccaacacagggaaaccccgucucuacuaaaaauacaaaaauuagcugggugugguggugugugccuguaaucccagcuacuugggaggcugaggcaggagaaucacuugaaccuggaaggcggagguugccaugagucaagaucaugccacugcacagcagccugggcaacagagcgagauuccgucucaaaaaaacacacaaaaccccaaauuacacacacacacacacacacacauauacauauauauauguauauauguauauaucuuauguauauaucuuacauauauauauauauguaagaaguucauugguucuguucagaaaggcagggacaacucaaaacagggagggagcuucuaggucacuggaagaugagagacagaugguugcauucuuuuuucugauaagucuuuccaaaauacaaugggaggcagauuugcccugaccaguuccaagcuugaauuuucccuuuagcucaguaauuuuggggucccaagguauuuuccuuucacagggucuauccgcauaauccaggcgaaucuuugcaccuguaaaggcccuuuuaccauguaagguaacccauuuauagguucucaggauuaggauguggauaucuuuggggccaccaauuggcuuaucacaaaacccauuucuuugagggcagagugaacuauauucucuggaguucucacacauucugcacuccagcgggucagaucaagcuggugugaagggcugagacaccaaugaauuauuauuuggggucaaggcucccaucaggauagugguggaaauugggagcagagagcuacuaaugggcuucuccuuugaccuguccuccaaaaccauaccuauaauuuuacccgaggaaaugcacuucagcauggugauuaucuccauuuuaaaaggagaaacguuuaucugguucuccagugauacauauucauuguggaaacacaugcccucaucucccuuccagccccagcacacagagcacguucuagccucauggucuuugcucuugcuggucccuguaccuggaauguccgucccccaaauauccacauggacccacccuugccuccucuauguuccuccucaaauaucaccuucucaaugugacuuucccuggaguccuuauuuauuuauuuauuuauuuauuuauuuauuuauuuuuuuaagauggagucucacucugucacccaggcuggagugcaguggugcaaucucggcucacugcaaccucugccucccagguucaagcaauucuccugccucagccuccugaguagcugggacuacaggcacccaccaccaugcccagcuaauuuuuuguauuuuuaguagagaugggguuucacuguguuggccaggcuugucucgaacucccgaccuccagugaucugcccaccucggccuccccaaaugcugggauuacaggcgugagccaccaugcccguccucacucuuuuguuucuuaucuuugccuacguuauuuaaccucuuugaacuccacuguguuuaucuguaaaauaggcaucauguagccuuugcuuccuccaugagacuuaaaugaggccacaucugcugugcuccuggcucagaggaagcucucccugcaucuagccucucugaccugccaucagacagccuagguggggaccagacacuuggcaugccgacagcccaguccuguggccaucccuucucagauuugccgccggaggacccaccaaugggcuuagcucccagacaagcugucuguauucacaggucuucauuuaagugacacgccaaguugaaaugcagccuccucucacccaugauguaggggaauaccaucuuccacagagcccaggcucugugacaagcccaggcucugcgacgugaccuggacuccggcugcacccuaucccuacgugcauccggcuggcauuuccuccaggcugcaagagaucaauuucuucaucugagcccuuguugauguugacauguguucagggcugugcuuuauaagaaauagacaucuccaggcaccauagcaaccuaguuggagaccagccugggcaacauagcaagaccacccaucucuauaaaaaauacaaaaauuauguggacaugguggcaugcaccuguagucccagcuacucaggaggcugagacuggggauugcuggagccugggaggcagagguugcaaugaugagaccccacauugggcgagaccuguaggaaaugagaucagaggugggaacaacagauucacaccucacuucaucugaugccgggcaggcaagcagcaaggccacgucaagguccccuguccccuccaacauggucugugguugauugccuuugaagaggaguggagggaggaaugcugguacaagaggcuaggguuggggucagagcugcuucaggagcagagacuggggacacccuagcccuagguauucaagggcaggucaaagcaccuuccuggcuucacucagaaugaucuugugcucuuuuucagagagcaaagcuuuucaaagucaaccacgaugucugagucacaugucugcuccauagaucuugcuguuaguggaaaauuucuucuagacugugggagucaauaggugcucaaucuucguuuggguguuacugggcauuuucaucuuuuucuaagccaccagugcauucugggggucgacugcagaggcuuagucacaugcccuggccccauccccuugcucccuugagcugauuccuugugggccaaagaaggcagggagucacuuuucucucuguccuccugucucuccauaccaaugaggcaagaugugcaggaguccaaauggauuuauccauagucuggcaccuacuguuuuggguuuuuuguuguuuucugccuuuuuuuuuuuuuuuuuuuuuuuuuuugagacagagucucgcucugucccccaggcuggagugcagugguacagucuuggcucacugcaaccuccaccacccagguucaagcaauucuccugccucagccucccaaguagcugggaucacaggcgccugccaccacgcccggcuaauuuuuguauuuuuaguagaaacaggguuucaccguguuggucaggcuggucuugaacuccugaccucgagugaacagccugccucggccucucagagugaugggauuacagacaugagccaccaugcccagcccugcuuucugcuuugaacguugcauuuucucaauaccuuuaccagucuuccauuucuuugcccaaacuacucaucuucccaagcagucuuguccaagguacgucugucucucuguucuuggcagggaggagucugucucaggauaccuuucauuucggucccgcuguuuaauuccucauauagggaaaaaucucagaggccuccccagccauguggaagugugaguccauuaaaccucuucuuuauaaauuaccuagucucagguaugucuucauuagaagaacaugaaaacggacuaauacgaugauaaaagccacacucugugcauucaggcaaaaaagaaugagagacaagcaaaagggggaaacccuuauaaaacuuaccagaucucaugagacuuauucacuaccacgagaacaguaugggggaaacugcccccaugauucaguuaucuccuacugggucccuccuacaacacacaggaauuaugggaacuacaauucaagaugagauuuggguggggacacagccaaaccauaccagucagacucuagacgucucucugguuacauuggugucuccugcccuucacaucuggacccccgugggagguugaugguuggacccacccuuuaggaagggggucugcuuauuugauagaagaggcugcauuguuugcgcuguggggaccaaggaggaaggagaaggcccuggaaggaaguuaugcagaucuacugaccucgcuuggccuggucacgcuggcgcucaaggcagacuuaaaacaugacuguauuuuuauacuguguaccaagauaaaugggugagaucacucaacuguguagguaggacuccagcuguucaagaccccaucaggagaccccagauaacaggaguuacuauuguggugcacugcaaccaauucugcucccugguuaagaaguucugacccauugaucguccaggcagcucucucucggcaggaaaaugccuuuugcagaugggcagagaaaggaauagaggugugaaauauuuuggaguuuauuccgccugucuuuuucuccagaggagaaagaacugugucaucaaauucauuccagacauucagugaaaguugacaugagauuggacucgcucacaaaucugggcaggaaagauguuggcccccagcugugcaggucccaguaugagucagggacgaaaaauggagcaaaggccucacaaggcagccggcagccagcagcgagcucugggcuuuuggcagccuggcauuucaucuuaucgggaauucagacuucacuggggacucaggcaccccugagguuccuuucacagcaggaaaacaaguucaguuagucugcuuuuuccaugcaacacgguagagaagcugaacaugggaaguccaccuguagagagugcuccuccuggccuucuccuggauuuuggggggacaaugauugaggaaggggaaacaggcaggaaagacugggcuguggagcaaauagaagauucagguuuagucauucagaaaacauguauucugcauacauuauccaaccucuuggcucuuuccccacacuaaacaacagagaggccuggcaccugggcaggaggauugcuugaguccaggaguucgagaucagccuggguaacauagugagacacccaugauaugguguggcuguguccccacccaaaucucaucuugaauuguagcucccacaauucccacgugucaugggagggagcugaugggagguaauuggaucaugaaggcggaucuuucccauacuguucucaugcuagugaguaagucucacgcgaucugauggauuuauaaagaugagucccuuugcacaaguucucucucuuaccugccaccauauaagaagucccuuuguucuuccuucgucuucugccacgauugugaggccucccuagccauguggaacugugaguccauuaagccucuuuuuccuuuucuuuucuuucucuuuuucuuuucuuuuuauuaauuuuuuuuauuuuucuuuuuugagauggagucucgcucuguugcccaggcuggagugcaguggugcaaucucggcucacugcaacuuccaccucccagguucaagcaauucuucugccucagucucccaaguaggugggacuacaggcgccugccaccaugcccggcuaauuuuuauauuuuuaguagagacgggguuucaccauauuggccaggcuggucucgaacuccugaccuugugauccgccugccuuggccacccaaagugcugggauuacaggcgugagccaccgcucccggcccaagccucuguuucuuuauaaauuacccagggucggguaugucuuuauuugcagcgugagaacagacucacacaucccgucucuacaaaaaauauaaaaauuuauccaggccuguuaacaugcaccuguaaucccagcuacacaggaggaucacuuuagcccaggaggucaaggcuacagugagcucugaucuuacuacugcacuccagccugggccacagagugagacccugucucuuaaaaaaaaaaaagagagagagacggagagagagagaagaaacuggagaagcuucaacaacuuugagggggagauuuguaugauucuagaauuuuaugucagaauaaauugucugucaugagagaaggggagaaagguauuaucagaauucuaagaaugcagaaaauguaauauucacaaguguuucauugucaaauaguuuuaaauguucucuagcagauauuuggaugacaaucaggcacuuaguuuagggacaguuauuaaaaaauggaaguaagcauuggaaucacuuaaauauaaugaaguagcaggagcuguuguaaauuuuguuacaaaauuaaaugcagacuccaaauacuauucuagaaaaagaugcaaauaguagaaaaugugucaucauaaaucucaaauuaaacuuacaaagacugaaaagcaugaggcaaaagguaggaaaauaaaaggucuauuaaucuuauuacauacaagaaaaaaugacaggaugccauuuaguuucuugaauuugauaauuuaagaaaugguggcuuaagucaugcauuacacaaauggaaaaacauccagcagcauaaccaaaacuaaaauguccacagguuucuuauguaaaagagaaaacaaaccauaagaaccagaagcgggccaggcacggugacucacgccugcaaucccagcacuuugggaggccaagacgggcagaugaccugaggucgggaguucgagaccagccugaccaacauggagaaaucccgucucuacuaaaaauacaaaauuagccgggcaugauggcacacgccuguaaucccagcuacucgggaggcugaggcuggagaaucacuugaacccgggaggcggagguugcagugagccaagaucacaccauugcacuccagccugggcaacaagagcgaaacgccaucucagaagaaccagaagcaggaaauaaaauaacaacaguacagccaaauauguuuauaacaauauauaaaaauggaauuagacucuaccauuggaaagcaaagaaucucaaauuagauuucuuuagaauccaauucuagccuccuuguaagagacauaucucuaaaauauaacauuaaaaaguuuaaaaaccaaaagaaaggccaggugugguagcucacaccuguggucacagaacuuugggaggcugaggcggacagauuacuugagcucaggaguucaagaccagccugggccaacauggccagacugcaucucuacaaaaaaugcaaaaauuagccguagucccagcuacucaggaggcugaggugggagaauugcuugagcccaggaggucaaggcugcaguaagccaugaucacaccacuguacuccagcgugggugacacagcgagacccugacucaaaaaaaaaaaaaaaaagaaagaaacauuuagcagaauucacaccaaaggaauuaagcauagcuguacugauacaaaaauagauuuuuuuccaaaagacauuaacaaagcacugaaauauuuuuuaaagaccguguauaaugauugguaugguuuagcuguguccccacacaaaucucaucuugaauuguggcucccauaguucccacauguuguaggagggaccuagugggagauaauagaauccuggaggcaguuuucccccauaccguucuggugguagugaguaagucucaugagaucuaaugguuuuauaagggguuucccucuuuugcuugguucucauucuuuuuugcccgcugccauguaagacaugacuuucaccuuccaccaugauugugagcccuccccagccauguggaacggugaguccuuuaaacuucuucuucuucauaaauuacccagucucggguaugucuucauuagaagaauaugaaaacggauuaauaugaagauaaaagucacacucugugcauucaguaacgagggccacccacuuguucaucuugauguccucugaaugcaucccucggggcuuucauagcccacacucucuucuuggguggugucauccuuucugaugacuuuaucaucaucuguaugcaaaugaaugcuaaaucugugucauuaaccuguaucuauacauucuacugcauccuaggcuauucuacugggcugucccucaggaaccuucaaagaaugcauccaaaauuuaacguguagccuuucuuucuaagcccauacauucagcugaacguaaaacccaggugucucccuggauggcccauucgccuucacacaccacacacagugauccaucaagucuuaucaaccucucguuuacacagcucauaaauucucccuaucuccauagccuacuucagucucagaaucuguaacuucaauagccuccucucugguuguugggaccuuuguaucagcaaaggguaguuuuucucaagcucaaaccugaucaaguaauuucucugaugaaaauguuuuaguggauaaaaauacaacucaaagauacucaacagauaaaaccaagcucuguuccugaaaaauuuaaacauagaauuaccguaugauucagcaauucugcuucuagguauauaccccaaagaguuaaaagcagugacuggaacagauauuuguacaccuacauccauagcagacacuugggcugcuucuacuuuaugucuauugugaaugugguauguccauacaacggaauggcuaaugaaaagacucaggcucuaaacaauacgugaagauauuuauucugagccaaauacaaaugaccaauggccuaugacacagcccucaggagguccugagaacaugugcccaagguggucagccuacaccugaguuuuguacauucuagggagauguaaaaugucaauacacauaagaugacauugguucagucuaaaaaggcuggacaacuggagguugguggguggggagcuuccaggucauagguggauuggucauugguggguucugauuggcaguugguugagguauuaucuaaagacuuggaaucaaucaaaaggaaugucuggcuuaugauaaggauuguagagaccaagguuuuauuaugcagaugaagccuccagguugcaggcugcagagagaauagauuguaaguguuccuuguccuaucagucuuacucuguuuuaauguuaguuaauugaaacauuaauuaacuuuaauauuugggccugaauuccaaaagggaggaggguauaaugagucauguucaauucuuccuucccaucauagccugaagucauuuuucagguuaacuuuggaaugcccuuggcugagaagugggguccauuccgaugguuguggagcuuagaauucuauuuuggguuuacagaaaaugguccagccuuaaaaaggaagggaauucugacacaugacacaacauggaugaaccuugagggcauuaucuaagugaaauaaaccagucacaaaaagacaaauaucauaugauuccacuuaacauaagguaccuaaaaaagucaaagacacagagaaacaaaaaauagaguggugguuguuggguuugcagugagggaggaauggggagauaguguuuaaugauaauuaauaauaguguacaaaguuucagucugggaagaugaaggacuucuggagagaaguaauugugguguuuguaugacacugugaaaguacuuaaugccacagaacuguacacuugaauaaaauaggccaggcacgguggcucaugccugcaaucccaacacuuugggaggccaaggcgggcagaucacuugaggucgggaguucgagaccagccuggccaacauggugaaaccaacauggugaauacaagaauuagccgggugugguggcagaugccuguaaucucagcuacucaggaggcugaggcaggagaauugcuugaaaccggaagguggagguugcagugagccaagaucgcaccacugcacuccagccuggggagcaagagugaaacccugucucaaaaaaaaaaaaaaagaauaaaauaguaaauuuuuaguuauuauauuuuaccacaauaaaaauaaauaaauaaaaacaagugguggugcaugucuguagucccagcuacucaggaggcugaagugguaggacugcuugagccugggaguuugcgaccagccugggcgacauagcaagacccugucuuuacaaaacuauuuuuuaaaaauaagcuggucgggugggugcuguggcucacgccuguaaucccagcacuuugggaggcugaggcgggcagaucacgaggucaggaguucgagaccagccuggccaauauggugaaaccccaucucuacugaaaauacaaaaauuagccagacaugguggugcacaccuguaauaccagcuacucgggaggcugaggcaggagaaucgcuugaacccaggagguggagguugcagugagcugagaccgcaccacugcacuccagccugggugacagagugagacuccagcucaaaaaaauaaauaaauaaauaaauaaauaaauaaauaaauaaauaaauaaauaaaauaagcuggucaugguggcaagugccuguaaucucagcauuuugggaaguugaggcaguaggaucacuugagcacaggaauucaaguccagccugggcaacauagugagaccccaucucuacaaaaugaauaagaauuaaaaaauaaaaacaaacaaaauacaauuaagcuuuucaccgugucauacaaggccuuuacugacuagugccccacccauaucccucaccucauuccuucccaccuucuccuggcuacucgaagccucagaagaacucaacauauugucaguuaaugaacaugucaagcuuuugcaacucugugccuugguacggcugcccccuacccuaccugaccgucuccucuucccuccuuauccuuuucccacccuccccucacucaccuggcaaagucagccucuuuuuccuuuaggucuuugauaguaggcauguucuccagaaagcccccucugacccacccuucacccccaaccagguggugccaagacauccuggcuucccucccacagcauguaccacauugaauucaaaugacucauuugcuugguuucaagaacaggauuuauguauuguucgcuuuuguauucccaucacaguaucuggcagagucauucccaauaaccauuuguuggauuaguauauaaaucuuuuugcacuacagaauagccucauuuaacaaauauuugaacuauaagaauaauuuauggagaacaaguuuucuucacagacuucaauaugcuacucaugguccuugacuccaguaguccaaaaaaaaaaaaguaaguuuauagaaaaagauuauaauuauaagguuacguaauguaauuaauaaauauaaauauggccgggugcaguggcucacaccuguaaucccagcucuuugggaggccaaggcagguggauuacaaggucaggagaucgagaccauccuggccaacauggugaaaccccaucucuacuaaaaaugcaaaaauuagcugggcaugguggugggcgccuguaaucccagcuacucgggaggcugaggcagaagaaccacuugaaccugggaggcagagauuguagugagcugagaucacaccacugcacuccagccugggcgacagagcgagacuccgucucaaaaaaauaaauaaaugaauaaacaaauaaauguaaauauauuuguauaacugaccuuacagagauucuacuauaguggaaaauuccuuagguuuccaaaaauugcagauguaugggccacauucucuucccuaugauccauuaacaacagaaaaaggugacgaaaaucaacuagaagagagaaaccaauaaaaguacaaaggagaacugggauguaauaaugauugggaggaauuuaaaauugcaggacuaggguccauaguugcauacuaaugauaaugaaaauguucucucugguuuuccaaaaaacuacaacauuccaaaauugacugaagaaaaacugaaaaguaaaauggacugacaaucacagaagaaaggcuuguuggcaugggguacacauuguuuuacagugauuuuuuucaaacuuuugaaagacagauauugacaauauaggugauauauggaaugcuacgcaacuuauuuuguuuagauguccuaauacuaaauauauacccuaauacuaaaacaugacccagaucuccaaaacuauagauuuuuguuuuuuggagacagagucucgcucuguugcccaggcuggagugcaguggugcaaucucggcucacugcaaccuccaccucccagguucaagugauucuccugccucagccuccugaguagcugggauuacaggaaugcgucaccacgccgggcuaauuuuuguauuuuuaguagagacaggguuucaccauguuggucaggcuagucucgaacuccugaccucgugaucgaacuccugaccucgugaucugcccaccucagccucccaaagugcugggauuacaggcauaagccaccacaccuggcccaaaacuauagauuuuggagucuguaucuuuccuucucuucucguugcuccugaccaaucuuuuggccugauuucugaaugacagcaaccucucaacagguuagagguuuuccaggcaccacacucuucaaguguuaggaaaugguuacucauuuucugagucuuguugaccuugaucuugccacucuucaucucugaucauggcagggggucuugguguucucaucuguaaaucauccucuucaugcauucugccagguuuuuccccaaagccaaaugaacaauaccuugcucccuuacccaauauaaagagacagggucccaugaguuuucucugaguguaugucaaaauuccugucuaggaucguuaaacucuaaugcagaaaacaaguuuguuuuacaccuccccuucaguugcucugaaguguauaaauggcuuugaacuugaaucauuuagauuuuacagcaagauucaauaucccaauuuaauuuuuuagaacagaggugcacaguuaaagcaagguacaaauuguuuaacaagcaagcaaggcaggaggauggcuugaggccaggaguuugagaccagcuugggcaacauagcaagacucucucuguaaagaaaaaaaaaauuaaaaaaaaaauuagccaggucuggugucaugcaccuguaguuccaccuagaagauugcuugagcccaggaguuugaggcugcgguaagcuaugaucgcacuacugcacucuagccugggugacaaagcaagaaacaagaaaguaaaagagagaggaaggagggaaggaagggaggaaggaaagaaggaaggaaggagggagggagggagggaggaagaaaagaagggagggcgggagggugggaagggaggaaagggggagggggagagggaaggaaagaaggaggaagggaauggaaggaaggaaggaagaaaggaaggauggaagggaggcagggagagagagagggaaaaaagagucuaaaacuuccuuccucauagugcagaguaacugaaaacacugaguuuuguguucacccuugacuaaguuacacugcagaaaccacagagucuuagcaguuagcagcaagcauuuauuucucacucagaucccgcguccuuugugggaugguugaggaucuacucagguugaauuccuaggucauuccagaaccuagaaugaagcagcagccccucuuuuguguaaauguuaugugaaagaagagaaagggaaauggcagaaaacacaauggcuuugaagcuucuccuuggacuuucauacuucuaucacuuuggcucucaguugauuggccaaagcuugugacaucaacaggcaaggagauaucauccucuccuacaaggggaaacaaauauaguagacccuuaggcaaagcaaagaugaggggcacugacccacgugcagucaaaaauccaaguauaauuuuugaauccccaaaaacuuaacugcuaauagccuacuguugacuggaagccuuaccaauaauauaaaaaguugauuaacucaaggcugguuguguugacucacgccuguaaucccagcacuuugggaggccgagccgggcagaucacagggucaggagauccagaccauccuggcuaacacggugaaacuccgucucuacuaaaaauacaaaaaaucagcugggcgugguggcgggcaccuguagucccagccacucaggaggcugaggcaggagaauggcgugaacccaggaggcggagauuacagugagccaagauugcgucacugcacuccagggugggggacagagcgagacuuugucucaaaaaaaaaaaaaaaaaguugauuaacucauauguuguauguuauauguauuguacacugcauucuuacaauaaaguaaucuagggagaagaaaaugcuauuaugaaaaucauaaagaggaggaaguaaguucauuaacuggaaauggaucaucauaaaggucuucauccucaugguguucaccuugaguagguggaggaggaggaagaggagguguuggucuugcugucucaggaauggcagagggagaaggaaauccacauauaaguggacccacacaguucaaacccauguuuuucaaggcucaauuauagcuggaaauaauagacccuguuacaguccacacucuugcucaucaauauucauuucccucucuucagcugcaaaauauacuccuccccuccccaggggagacuucccaacagucccauccaguuauaacaccagacucaagcucuagaaucucaugaugcucaucaaaucuggauguggcucuucuugguauggaaacauaaaaacuaaaaagucaaauuaccccucacccuugcccgacacaaacacacacuugacauauggugguggaccagggucaggccaaccaccaaaaacauuccccucuggaaagcaaaacaugggauacccauagcggucagaggcucagagcaguucugaaacccuguuggacaaaaaccuuggggugaggaauuuucccucaauuagcugcuucugcuuccuagaagugacccuggaugacauuguucuccaagauucccaggaaagcuguccuuuuccacuauucuuguacuuacucuaugagggcauuguguaauacacccuuccugggacccguguagcuuauccucuuaauugcuugggcccguagguugggaaguccaaagaucuuuuuuuuuuuuuuuuuuugcaacagagucucgcucugucacccaggcuggagugcagugacacaaugucggcucacugcaagcuccgccucccguguucacaccauucuccugccucagccuccugaguagcugggacuacaggcgcccgccaccaugcccggcuaauuuuuuuguauuuuuuaguagagacgggguuucaccauguuagccaggauggucucaaucuccugaccuugugauccgccagccucggccucccaaagugcuaggaugacaggcgugagccaccgcgcccggccccaaagaucuuuuaaaguuuggaacaguuauagugucuuuuaauccaagauuguuggcucuuggccaguauagcucucaaggacuuaguuauguuuuuaucuggcuccaaucaguuaugcuaguaaacacauccacaauuauuuuugagacauaccucucucuaaacuuaauaacaggcuuccuaggagagucacuuaacacauucagagauuuuuuuaaagaggcauugauuuguuucaauagggcuguauuauuacuuaaagcauuucuuuauuuuaucucuuacuaguuggagaugagaaacaauugcucuuggugcagugccuguaaucucagcacuuugggaggcugaagccagaguauugcuugaggccaggaguucgaaaccagccuggccaacauggugaaacccugucuccacuaaaaauacaaaaauuagccagguguggugcacaugccuauaaucccagcuucuugggagucugaggcaggcaacauagccagacccugucucuacuaaaaauacaaaaauuagcuaggugugguggugugugccuguaaucccagcuucuugggagggugagacagaaggaucacuugaacucgggagguggagguugcagugagccaagauugcgccacuguacuccagccugggugacagagcaagacuccaucucaaauaauaauaauaauaauaauaauaauaauaauaaugaugaugaugauaaauaaaauagcuggacaugguggugcaugucugucauccuaacuacuuaggaggaugaggcaggaggaucacuugagcccagauguuugaaguugcagugagcugugaucacaccacagcauaucagccuggaccaccgagcaagaccuugucucuaaaaaaauagaacuagaaauagaaaugggggcuuugagaaauguguggauaggaagauaacaagaucauuacgagaaaaaaaagaaacaauugcuucuuucaaugcugcaacgccaggaauuucugagugguuuuuauuuuuggcuugcaaaucaaccaguucuuuccugagcucaucucuuucuuguagugcucuguuagaugcagcuaauuucaauugugaaucacggcauucuguuucacagacuuuuuaccuaaaaccacuggacucggauucaauaucugccuguccuccaagguaucacaggcaacaguuuuaccaaauguuuugcuaucguauuacagggaucugugucuuuccagccuccagucacaguuuucucauuuuucacugccuggcuccggaaccaguacauugucuuuuagaauuuugguuaugguagccucuuaguuuuauguaccaauuucucuauuuuugacauagaccaacaauggucuaaguuaugcugccguagcaaacaagccccaaaucucaaugguucauaacaacacaggguauuccugacgugagcuguccauugugauucagcuguagguguuccccacuuuauccucauucugagacccagcccgaaggaacagccucuaucuggggcauguaauucucauagcagagggaaagaacaaauguuagaaccacacaaugauucauaaagcugugaauuagaugugguagaugugacuucuacucacauuuuauuggccaagaaagugacacuacuggccaggcgcaguggcucacaccuguaaucccagcacuuugggaggccgaggcggguggaucaccugaggucaggaguucgagaccagcuugaccaacauggcgaaaccccgucucuacuaaaaauacaaaaauuagcugggcgugguggugcacaccuguaaucccagcuacucgggaggcugaggaaggagaauugcuugaacccgggagguggaguuugcagucagccgagaucgcgccacugcacuccagccugcgagauggaagcaagacuccauuucggaaaaaaaaaaaaaaaaagaaaaaagaaagcgacacuaucaaaccuaauauaaauggaguggaaaaguacaguccucucucggggaggggcaggauguaaucaggaacucugcaccucuccuucagcagcuuuucuucaugaacaugacuuugaacuuguguuuuuaucuuguuagaacaagauucauggccaggcacaguggcuuacaccuguaaucccagcacuuucaggaggccaaggcaggaguacuugaggccaggaguuugagaccagccugggaaacauagcaagaccuugucccuacaaaaaauuguaaauguuagacaggcgcaguggcucaugucuguaaucccagcuacuugggaggcugaggcaggaggauggcuucagcccaggaguucaaggcugcagggagcuaugaucacaccacuggacuccagccuggaugauagggcaagacccugucucuaaauuuuuuuuuaaacgauacauaauuaggccgggcgugguggcucaggccuguaauccuagcacuuugggaggccgaggcgggcggaucacuugaggucaggaguucaaaaccagcauggccaacacggugaaaccccgucucuacuaagcauacaaaaaaauuagccgggcgugguggcgggcaccuguaauuccagcuacuacggaggcugaggcaggagaaucgcuugaacucgggaggcgagguugcagugagccgagaucucgccgcugcacuccagccugggcgaaagagcaagauucuaucucaaaaaaaaaaaaaaaaagauacaugcuuaaaccaauaugggaauugccagaguguugguaaauuauaaaaauuuuagagacguaugcauuauauaaaggguuucaccauucuaaaguacacaaaguaugcaggguugacagcagauggcuggaugaauaggaaaccagacuggcggguggcauuuuuuuucuccaagaagcuaaagcgaagggaauauguuccacucucuaucauuccaauaagucccugcaaguucaugaguauacuuggagcugaacaggauggaaaacuguucaccugauauccugaaacgcugagacaaguuucugcagagcagcugugggucuggccugucauggcccgagccaacuucccaucuccacaugcuucugaccaucucacuacucuuuaucuccacaguuugacaugcaaaggauaacucuggaagaguugaagcacauucucuaucaugccuuccgagaccaccuaacgaugaaggacauugagaacaucauuaucaaugaggaagagagccugaaugagaccucggggaacugccaaacagaguuugaaggagguaggugccccugcugccauccccuccccgguccgggacaggccaaugcaccacacucucuauaugaaaaaugcguucacacacaggcucuugggcugauguucccuuguacugaagccaaaaauccaggacugagguuaaagaucuuuuuugcuaagaugcgguggguuucauuuucuccaucuuucuccuccaaauucugcauuuuuugcagaaucuccacugacccugucuuuucucucaaggcucucugaggucugcgugugauuggaugugugguuuugugcuguuugccuucucuugguuguggcugcauggggcggugcaaagagccuauuuuggcuguccggcaaacuugggucgaguccguugugugaccuugggcaaaggauggaccuucucuguguuuccucaucuauaaacaucaggaugauuacaccuacuucgcagaauucuuaggaauggaugaccucuauguucccaaaugcacuggccaaaaaaaagaaaaaaaaaagggacagaguccucugaugaacuuaaccaaguaguuacagaagaaauaagguucucuggaggccaaaaaagagacccaugaaagguuauuuuuuuuuauucaugaaagcaaauuuaaagaaaaaagagagccuacugaaucuccuaaucaguagagaauuccugagaagcuaaaggauuuaauccuucuuuccaacuuugaaaaucagagugguuuuaauagcccuguuguauagaaaaaaaauuuuuaauuacauuaaaacaucauauagcaggcuaucagcaacuuuucuguucaaugcugacauuucuuaaggaggucaaauuuuuuuucuuuucuuuucuuuuuuuuuuuuuugaacauuuaaauaagucaguauacauaguugggaagcugucacauagacacuagaaggauauauuugguugccuggucuuguagcugucucccuuagagccagugagugcuauggggggaggcuagugugcuuggagcugagcuggucccaggcaccagaacuguccaugcaaacccaggcucccaucagcccugucuuggcugaacugcugcaucauggacccagcauuaaaggccacgacaggagggaacaggagauggccuguacucugagguugcaaacagugggagagagggaguaguggagucuguugcaaaacagaaagcaaugaucucuucugaagucacucaaauuuaaacacugcaaaacugccaugcgcaucaaacaaaacccagcugugguccugaaguugccuuggucuccuugcugugacaauggggugauagcaucaaugacuguauuuggagugggagucacacugaucuuauaagggcaggaugggguggucacagccaaggccauuuccagcaggacaugcgagggugaggaggggugaggagcgaagggauugagaacugaaacuugagaaaacagcagaccuggccuucccaauccaucucgcucggggcugacagaugaugugagccccacacaaugaaagcacauggggcucaagcgcucuacugcuagucagcacucuugagauggguggagaaggguauuuuuggguaucaucucauuuuccacaacagccuuuguugguggaucaguguuuuguucagggaaaugucauagaucuuaguaauuugggaaaggucaggcuauacugggaaauaaucuaaauucgaaguaaggccuuuuuauuucucaaaaccuuauacauuaauaaaauaaaugccugacaaaggggcuaccaaacagaagccuugcuggguuugcuuuaaugauuugucaauagcuuauuuauaauuaauguaauaugauuaauauauaaugaucguuaauagcaauuauauuuauuaauaaccauacugcaaguauuauguuuauuaaaaauuauuaauccuuauuguuauaaaauaauuauuaauguuuauuaauaauuauuaccauaaugguuaauuaauaauuuuaagucagugcagugccuggacuaauaauuguuaccauuauuaauugccauuaauaacuauuagcccaggcacugcacuaaguggcuuaacauuaauuaaccauuaugguaauaauuaucaccauaacauuuaauaaauaucauaauuaauaauuaugguaauaauuaugguauuaucuaaccaugguuagguaccuaaccauuaccuaaccaauaacuauaguaguauuuuuguuuuguuuuguuuuguuuguuuuugagacaaagucucacugugucacccaggcuggagugcaguggcgcaaucucugcucacugcaaccucugcuucccggguucaagcaaucuuccugccucagccucccgaauagcugggacuacaggugcccacccccaugcccggcuaauuuucauauuuuuaguagagacgggguuucacuguguuagugaggauggucucaaucuccugaccucguaauccgcccaccucggccucccaaaaugcugggauuacaggcgugagccaucacacucggccuaauuuuuguauuuuuaguagagaugggguuuuaccauguuagccaggcuggucuugaacuccugaccucaagugauucccccuccucagcaucccaaagugcugggauuacaggugugagccuguuaguccaggcacugcacuaagugguuuaaaauucauuaucuuauuucauuuaaaaaagcuguuauuuuguaauuugcacguugcauucuuguaugaccucugggacggucauuacauaaucccuuuugcauauuuuuaucucagagaaacuuugcaaaaacauuaugucaggguuguuugucccccagacacaagcucguugauuuguguuuagguuuaagaauuuuucaagcaugaucaaagugaugggugaauauauuuaaugcucacaggccuuuccacaugcaagaaagagccucccugguugcauuuugggcagaggugucuaggaagagaauacugaguuccugagucuaccugcuuagcauccuaggacuagaggaguuugucugagauccuguggcucaccuuagacccuuugcuuccauauugcucccauauccacaaacgggggcccguuggcauuuugaaccuuucccuucuucuaucaagaccugauugcacagcugcauugcuuccaccuccuaaaucucccucuccuccucccagccuugagcgcuuuggggccuccccaucucucccaaacugucaacuccucccuauccucuuuugcccuuggccuaagcugcgugccuuguccagccacgucaaccaugcccuugcugacguccuguuacaggaccaccagguucuuaugcccacuguucaguaauagaccaauacacugagacagcaggguuugcagcagagaaacaguuuaaugacaguaggguagcugagcaaggagacaggaggaacccucaaauccauucccugaggaguguugagcuaggguuuuuaaggggauuguggagggcaagagacugaaaaauugagguuguugauuugaugaaaccaucaggauguggaaacugcauucuuugguaagucagcucccuggggggggguccuucagaccagcugacaucaguagucucauugauaugcagaaccuaaagaauaucucaaagggaaaacuuaauguuuuauacuguucaaauuguuaucaauagggcaauuaaggggaacuauaauggcucacgccuguaaucccaucccuuugggagggcaaggcggguggauaaacugaggucaggaguucgagaccagccugaccaauaugaugaaaccccgucucuacuaaaaauacaaaaauuagucaggugugguggcaugugcguggaaucccagcuacucgggaggcugagacaggagaauugcuugagcccaggagguggagguugcagugaaccaagaucgcgccauugcacuccagccugggcaacaagaguuaaaacuccaucucaaaaaaaaaaaaaaaaggagggggaaacuauaaucauguguguguguguguuugugugugugugugugugugcaugcgugcacaugugcacaccuggcuucuucauuaauuuuacuuuuuaaguuuugggguacaugugcaggacgugcagguuuguuacauuuaaaugugugccauggugguuugcagcaccuaucaacccauuaccuacgcauuaagccagcaugcauuagcuauuuuuccugaugcucuccucuccaucccccaccccgcaacauguguucucauuguucagcucccgcuuaugagugagaacaugcaguguuugguuuucugcuccuguguuaguuugcugaggaugauggcuucgagcuccaucuaugucccugcaaggacauaaucucauuccuuuuuauggcugcauaguaugccauuguguauauguacacacuuucuuuauccagucuaucagaaaaugguguggcaauuccucaaagaucuaggaccagcaauaccauuugaccuagaaaucacauugcuagguauauucccaaaggaauauaaaucauuauauuauaaagaacuauaaucuuauaauagggucuaugugauucuggggcaauaggcagcaaacgccuaugaggaagcaaguuggaaaacgagcugaccucacgaucaacacugagugugugucaaauuugguuuauuuuuguuucucuccugcccuucuuccuugauuaauuuucuaagguguaucggggcagaacaguucaaucucagaucccugacucacugucugcucccuccaucccaagucuugaugaaucuagcaccuaacugugaagggccaagaugguuuccuuuauuucuuccaagugaugaaauucuuuucucauuaaacugaauccuccucgcaaccccacaugaccaaugagagggaaaggaacgggcugggccucuucccucagccccagagcccccacucaggucuucucuacucuugcuaacccaccccucaucccuaggaauuucuuuccugcugcucucauuagagcaaacagguaaucacaccaauuaggaaggucuuugccaucagaagguggaagagcccaucugccucuucaccagaaacuaagagaugggcaaagaaacagacauuuuguggcagagauggaacuuaaagaaucccacaucagagggcugggagcucaggagagcuggaggugggacugagaucuggagcauggaaaagauuucaaaaugcugcugugggcagcacaagggacaaggacucuauuagaaauuaaugggaggacuugaaaaugccaucagcauccuuuuauuuuuuauuuuauuuauauuuuuuuuauauggaguuuugcucuuguugcccagugcaauggcauggucuuggcucacugcaaccucugccaccuggguuaaagcaauucuccugccucggccuucugaguagcugggauuacaagcaugcgccaccacguccugauaauuuuuguauuuuuaguagagacaggguuuugccauguuggccaggcuggucucgaacuccugaccucaagugaucugcccaucugcccaccucagccucccaaagugcugggauuacaggcaugugccaccgcacccggcucauuuuuguauuuuuaguagagacgggguuuugccauguuguccaggcugaucucgaacuccugacaucaagugauccucccacccuggccucccaaagugcuggaaauacaggcaugagccacggcacccagugaguuuauuuauuuauuuauuuuaauaaaauaaagagaguccugcugugucacccaggcuggaaugcaguggcacaaccacagcucacuaaagccuggaauucccaggcucacacaauccuccugcuucagccuccugaguagcugggacuagaggcaugugccaccaugccaggcuaacuuuuuuacuuuuguagaaacagggucuugcugugucacccagccuguucuugaacucauagcuucaagugauccucacaccucagccucccaaaggacugagauuacaggugugagccacuguggcgggcccauguuauagcaaugauucuauuuuucauuugucugaauuuugggucugauaauuuuacuaagagguguucagauggucuucauuaagugagcaauauugacuauuccuucuacaugaauggaagaauaaagaauaaagaaaaaaaauaagaccccaaagauuguggcacuuuugaugggaaagguuuguuuuugguuugauuuuguuaucuuguuuaauuuuuaggucaacacaaacaacagacacaugcacgcacacacacacacacacacacacgcacacacauacacaaauacacagccccuccaguuagccagucugccuuaucuuugugguaggagcacccugcagucauauggaagcaucacccuuuacauuuucucccaaggaagggacaagaauaaaugggaugaaacuccaagcuggauagugggcaagccuggcugggugcagugguuccugccugcacccaggcaggaacccagcacuuugggaggccgaggugggaggaucaccugaggucaggaguucgagaccagccuggccaacauggcgaaacccugucucuacuaaaaauacaaaaauuagcugggugugguggcaggagccuguaaucccagcuacucaggaggcugaggcaggagaaucacuugaacccgggaggcagagguugcggugagccgagauugugccacugcacuccagccugggcaacagagcaagacucugccaaaaaaagaaaaaagaaggcaagucuuccugacugcuccaggaaacccuguaucaggggcucacauugcauauagaauucauuuuccuacagcaccaaaaggaauucccuacagaaacccuuuugaaggcagggaggaggcuagaagacccuagcucaggggucugcagucgaccuuuccaucaaucacaccuggcuucccgauggaaaaucacucaaacugagucaggugcugaccacauuccacccgcgguucugggugcuuugugcauaugaauucauuucaccccucugaauucaggaacucucuggcauuacauaguauuagaacuuuauauguccccaguaucaugagaauauuugguuaaaagcaugacuuucaggcacucccagucucucagauaucucugaaucccguaauuaugauaaaauaugcuugcuauacuuuuuuuucuuuuucuuuuucuuuuuugagacagggucuuguucugucauccaggcuagagugcaguggcgcgaucucagcucacugcaaccuccaccuccuugguucaagcaauucuccugccucagccuccugagcaaauggaauuaacaggcaugcgccaccaugcccggcuaauuuuuguauuuuuaguacagacaagguuucaccauguuggccaggcuggucuccaacuccugaccucaagugauuccccauccucggccucccaaagugcugggauuacaggcgugagcccccguacccagcuugauauacuuuuguguuacuugucaaucuuugcguccuaauuuuuuggaaaaauuaccauagccuggcaacauagcaagaccucuuccuuacaaaaagaaaaauuuuuuaauuagccaggcaugguggcgcaugccuguagucucagcuauucgggaggcugagguggagggaucacuugagcccagggguucgaggcugcagugagcuaugauugcaccagugcacuucagccugggcaacagagcaagaccccaacucugaauaaaaaacuuaccaagcccauauccccauaacagguuggacauuuaaguaugugucuacugaaaguacccauucaccauucauacugaauaagggaguuuuuaaggauguuuugccucaguuccacccauuuuaggcaccagacauucuugguuuuagagaucauaagcucaaugacacugagacgaauguauaucuuauuauuugguuccaguugcuggcaucuauggaauucaguggucuuugugguugaaucaucuauuugccggucaccagauucuuauuaagugcucccaugacacauuauacuaucuauuaagguugauggugcuugcuuccaggauguuuacuguuuaauccauauggaugcaguccagaaggaagaggguggaagagaacugucacgcaugccugccaagugcuggucauuuauuagguuggugcacaaguaauugcggguuuugccauuaaagggaauggcaauuuuuucuuuuuuuuuuuggacacagucuugcucuguugcccgggcuggagugaagugauaugaucucaacucccugcaaccuccaccuccuggguucaagcaauucucaugccucagucuccugaguagcugggauuacaggcaugcaccaccacgcccagcuaauuuuuuguauuuuuaguagagacgggguuucaccauguuggccaggcuggucucgaacuccugaccucaggugauccacccaccucagccucccaaagugcugggauuacaggcaugagccacugugcccagcaauggcaaguguuuuaacagcaaaaacugcaauuacuuuugcaccaaccuaauaugaacacauugcauugaccccucugcauggcccugagagacaaguucuguuaccauuuucauguagaugaggaaacugaggcuccacaaagugaagucauuuuucccaagucaaauaguggcuaagaauuuuaaccugcaaccugggcaacauggcaaaacccugucucgauagauagauagauagauagauagauagauagauagauagauacauacauacauacauacauacauacauacauacauacauacauacauacauaaccaggcaugguggcaggcaccuguagucccagcuacucaggaggcucaggugggaggaucacuugagccugggagguugaggcugcaguaagccacagucgcaccacuucacuccagccugggugacagaacgaaacccugucucaauguuuuuauaaaaagaauuuuaacuggaugaagaaaaugugguacauauacaccauggaauacuaugcagccauaaaaaggaaugagaucaugucuuuugcaggggcauggaugaagcuggaagccauuauccucagcaaacuaacacaggaacaggaaaccaaacaccgcauguucucacucauaagugggaguugaauaaugagaacacauggacacagggaggggaacaucacacaccggggccugucagggggcaaugggagggagagcaucaggauaaauagcuaaugcaugcggggcugaauaccuaccuaauggguugauaggugcagcaaaccaccauggcgcacguuuaccuauuuaacaaaccugcacauucugcacauguaucauggaacuuaaaauaauuuuuuuuuuaauugcugagucaaaacaaaagaaaauaauuuuaaccugggucuaccugucaaugcccagcccuggccucuucauuggucacccugggucauuuaccugggcuuuggcauuucaaagucuucauacgaaacggugcuucaucacccgugcucauuuuccauuucauugccgacgaaagcauauuauauuuggaagucgaguagaagcacagcaagaucugugugugcgcccucuuaagacacaucccccaaguguugucccuaaauggaauaccagcugucagauuuuucuagacauucugacaaccggcacgggagaggcaaguaaagcgaaaucaccaacuggggaauaaauaguuucugugaaagacaagacagagcugcucugaaucacucagcgcuuccauaugagggacaaaagaaacaagugccaaggauggugacacaggccaggcagccccaggaagcccccuggggaagagguguggauucugugccaacuagcugugugacccugggaauguugguuaacuucucugagccuuauuuuccucauccaucccaugaaaaggcuggaugaugauggucauauuuaaauacagaaacuucugggcucacuggaaggucagaaggaauucugcagccaaauccaagguucccagcucaguccuccccgcugaagucacagcguuccugucgggcugucagguucacaccuggauggagagaccugccccaucaccuggccaugcacaaugguucucucaugcccaucuaaauaaaaagggcacaauaugucaucaacaccaucuguucgcaguucuccugugcugugacuuuccugaaauaaaaccuuucuccuuggguagacauaggagguuaaggagcugaggucaguagccaguggugagacagaggacaguuuucaaagagauuugggacuucagacaaaaaggaauuuuucuucuguuuggggacccuucacagcacaccuguaggaagcaaugagauucugaaacagaaaauagagacccagcugggcgcggcggcucaugccuguagucccagcacuuugggagguugaggccgguggaucacuugaggucaggaguucgagaccagccugaccaacauggugaaaccccaucucuacuaaaaauacaaaaagaaauaaaaauuagcuggguaugguggcgggcaccuguaaucgcagcuacuagggaggcugaggcaggagaaucgcuugaauccaggagguggagguugcagugaacugagaucgcaccauugcacuccagccugggcaacagagugagacucugucucaaaaacuaacuaacuaacuaacuaacuaacuaaauaaauaaauaaauaaauaaauaaauaaaaagacccagagagcuguuuuguguaaauaacacugaaacagagcugguuaagagcuccagcucugcacccaggacgagccuggcuuaaaauccuuccccagcaugcccucacuugagugaggcacuuggguaaauauugagagucuccuuuucuccaucugugaaaggggaaucaugauacaaucuuccucaugcaguuguuuugaggauuaaacaacaucauccaugacaauauucaguacaaaacucaacauauuaguaagcacuggaagugaaugaaugaaaggcaaggcuaaccagucccuagccccaguuaucuucuucuaguuauuuuuuuuaccuggagacauugcugaacaugugcugcugcuggagcuccaugucuucauggagcaggaaccaaaugcagggggugggagccuugcuguugacacauucauacccggagucaaaucacugcccacauuggggguaucaaggauauucaucaagacucucagcugggcgugguggcucaugccuguaaucccaacacuuugggaggccaaggcagguggaucacgaggucaggaguuggagaccagccuggccaacauggugaaaccccaucucuacuaaaaauacaaaaaaaagcuagucggucaugguggugcaugccuguaaucccagcuacuuggggggcugaggcaggagaauugcuugaaccccggaggcagagguugcagugagccgagaucacaccacugcacucaagccugggugacagagcaaaacuccaucugagaagaaaaaaaaaaaaaaaaaaagacucuuaccagccaggcgugguggcucacaccuguaauccaaacacuuugggaggcaaaggugggaggaucacuugagcccaggaguucgagaccagccugggcagcauagugagaccuauuuuacaaaaaguuuuuuaaaaaauuagccaagcauggugcagucccagcuacacaggagacugagacagggggauugcucgagccuaagagauugaggcuguagugagcuaugaucauaccacugcucugcccccagaagacagagugaaacccaguuucuauaaauaaauaaauaaauaaauaaaauauaguuuggguugcaaauaaaagaaagccaaccaagauucuuuuaaaccaaaaaagcacuggcucaaauaaugggggaagucaagugcaugaacuuuggguggccuggacucaaagagcucaagcaacaucucucucucucucucucucucucucucucucucucucucucucucucucucugucucugucucugucucucucugucucucucucugucucucucugucucucucucucucucugucucucucucuugccugcucucugccucucccucucucuguccuuuuuaacucccuguuagcuccauuccugggcagacucucucuucacaagguaucaagauuuucucucucaguaucugucuucauccaaaaaggagcuccaaucaaaccugauuaacucaggugccuacugcagaacaaucuuuggguaugacaccuggucaaccugguuugcgaugguggaaaaggugaagucagggacuaaguuccaccagauggagugguggugaaggucccaaccacaaaagaugaauuuuguuauuagaacaagggguagggcuuccagagagacaaaaacaaugccuggcuacugcaccagaguucauuguaggacccucaaagcaaaacacagcugucuggggucuagcaaaccugagaugcagggcaugagauuuuguagaggagaagggaccagcucccagccccacaagucagcaugacuuaucuuccucuuaacaaaagcaucaugaaacauaccagucucacucuuauuccauagaagccacauccuccagcucuuccuuugaguuuuggguaccugggcauuucugauaucauugguguauacaaaauucucuuugaaaagcucuuaauuaguuccauuuuagggugcauaaauagccaauuucauagaaucauaaaauaucagaacuggaaggaucaaagagcaaaaauagcucccagaccugguggcucugguuauccuaagaaucaccugaguugagacugcuacuguuuuauuuuuuaacaucccugcacccccagcucccugccagaaauaauaugacuucuuuuggucugucgcggagcaaggaaucagaauuuucguggcucugauuugccucauuuggaagccggugucucugaaaacaugcagcccagcucccaaauguggagauugaaggcagagggauuaugaaccuguugucuccagggccaugggcuaaugaguggcagagucucugcagaugacucucuccaggagaaaagccaagaaccacugccugucauuugcugaguggagcagugugaauggcuguuaaaauaagagagggaaagaaacagucaaacagucugucgcuagagcuugcacacccaggucucacugaggcagccaccagucugucaugcauggagccugugaacaagcuugcaggaaaacaggaaacucugccucuguguccucccgcggcagccuccucaacucacguuucauucccaaauacuuucugagcuuccacugugccaaggacugugcugaaaaagagcccaagguuuagugggaagauagaaaagaucaccagcagcaugacauauucaguaagaccccaaaaggucaguuccuugaaaaaacgaaacauaagcuggacgcgguggcucacgccuguaaucucagcacuuugggaggccgaggcagguggaucaugaggucaguaguucgagaucagccuggccaacguaguggaacccaucucuacuaaaaauacaaaaaauuagccgggcgugguggcgggagccuguaaucuuagcuacucgggaggcugaggcaggagaaucacuugaauuugggaggcggagguugcagugagccaagaacaugccacugcacaccagcccgggcgacagugugagacuccgucucaaaaaaaaaaaaaaaaaaagaaagaaacauagaguuacuauauaacccaguaauucaacuucuagguuugcacccaagagaauuuaagacauauauugacauguaaacaugugcauggauguucauagcggcaugacucauauaguacccaaaagguggaaggaacccaaacguuuauagcuuacgaauggauaaacaaaguaugacauauucauacaauaaaauauuauccggucauaaaaaggaaugaaauggccgggcacaguggcucaugccuguaaucccagcacuuugggaggccaaggcggguggaucacgaggucaggagauugagaccacccuggcuaacacagugaaaucucaucucugcuaaaaaaaaaaaaugcaaaaaauuagccgggugugguggcgggugccuguagucccagcuacucgggaggcugaggcaggagaaugacgugaacccgggaggcggagcuugcagugagccgagauggugccgcugcacuccagccugggugacagagcaagacucugucucaaaaaaaaaaaaaaaaaaaaaagaaugaaguacugguaaaugcuacauacagcuggaggaaccuugaaaaauuaugcuaaaagaagccagacacgaaaggucaccuacuguaugaucguauuuauuugaaagauucagagcaggcaaauccuuagagacagacgguagauuaguguuugccuggggcugcagagcgagcggaaugagcagcgacuguuaaugugccugggauuucuuuuuagggugaaaaaauggcucuggaauuagguaguggugaugguugcgcaaucucgcgaauguguuaaacgcugcugaauuggacauaauuuuagaacaagggccaauuuuaugguaugugaacuauaucuuaauuaaaaauaaauaaauauugaaagcuagaucauuacaacaaauaaacacaaggagcaggcccuuuuauagagcaggguguucagaagaaaccucagaggaaagaaaaguuugggcugggccccagagaaaaagagggaagauggccgggcacgcacaguggcucaugucuauaaucccagcacuuugggaggccgaggcggauggaucacaaggucgagagaucgagaccgucuuggccaacaugaugaaaccccgucucuacuaaaaauacaaaaauuaccugagugugaugguguaugccuguaauccccucuccgcuacucgggaggcugaggcaggagaauugcuagggaguuggagguugcagcgagccaauaucgugccacugcacuccagccuggcaacagagugagacuccaucucaaaaaagaaaaaaagaaaagaaaaaaaauaggcaagaucagaaggcaccacugaucuacacugaagaaaaugaggagaccugcuuggcuggaacagaaguggccaaggcuggaacagagccaggaagcggggaagagugagcuauggucuuaugugcugagcuuaggggcuggaacaggcuucucccaucagcgggggccuuugcaggaagggaaaggugagucuagcugcaguucugaaugacuugaugaaggaagagaugaaaacaaagauuugggagcaucugaguuagucucagccucgugcuguaggcugcagggaauaggaugaaaaaccagcagggguuuccuccuguccucaggggaugcaagaaugaaauuuuguauuucucuggcaauuuacaguuggauguagcuuucacuuugauuagcucauugaucuuugaaauaauucuugagaugagcagagcaauuauuagcuccuuuuacagagagagaaacugacgcucgcagaaguuccuucauuuguccggggcuucuaaguggcaauuaggagaagaagucagaucuuggacucacaguuuuucccagacugaccuauagucuucuauuauagacuucuaaauaauagacagcaagaguaaauaaauaugcaaaaauauaguacaaugcaaauguaugauaaccuucaauaauuaccaagaaaugcauaaauuagugccaggucgcaguucuguccaccacacucgguguuugaagugcauuuucuuuggaccuguuuauugcuaugcaggagaccaaaaagaauuuguacacaaguuuugaaccugggcguaacaguaagcccucagcucaaaucccaccucugccauuucccaaaugaccuugaacuucacuuauuggaauucaggcuccucacgcaauaaaugaagacaacacacccaucacacaugguaucugccacuaugcaaccucugcacauaaaaaaaaagcacuuaacgcaguacccaacccgcugaggcugguguucaauaaagaaauaggagcauuuaaaagguuuauacaagggagcucgcauucauugggcacaaacaauuuuccaguuccuuccuauaugcauaaucuccacaagaagauagaucuuuuuuguauguguuucuuuuuguuuuuuuugguuuuuuuagacagucuugcucugucacccaggcuugagugcaguggcaugaucaaccucugccuccuggguucaagugauccuccugcaucagccucccgaguagcggggauuacaggcacacaacaccgugcucaguuaauuuuucuguguauuuuuaguagagaugggguuuugccauguuggccaggcuggucucaaacuccuaaccucaggcgauccacccaccucaaccucccaaagugcugggauuacgggugugagccaccacacccagcccaacaaagauagaucuuauuaucccauuuuauagaugagaaaauugaggccuagggaaauuugcuugcucaaagucacacagagaaucaugauccacauuuuggucuggcuccaaagucauuccucuuugcuuagccacacuauucgugaugaugucagaaugugguguaaaaugauucucuucaaagcacaggguacugacucagacuaaggucuauuucagagcugcuacaauccacuaaugaucuagaagcuccucugugcuuuuuuuuuguuuuguuuugagauggaguuucgcucuuguugcccaggcugcagugcaauggcgcaguuucggcucacuacaaccucugccucuuggguucaagcaauucuccugccucagccucccuaguagcugguauuacaggcgcccgccaccaugcccagcaaauuuuuuguguuuuuaguagagacggaguuucacuauguuggccaagcuggucucgaacuccugaccucaggugauccacccaccucagccucccaaagugcugggauuacaggcgugagccaccgcacccggcucugcuccucucugcuuauaggacauuggugugaauucuccaggcgauugcucaguccuuaucucucccuuccuacugcuuggauggauuuuuagaucaaacuugcagccccgcucuccugggggauaaucccuguugcugguaaccuuguuuccugguugaccuucacgaagaagagcuucagcaaaaacuuucucccucagcccagucaugcaauguuucucuuccuaaugcuuucgcaggcccucaagauggaauggaaaagggcugccuucggaaacauuuccaggagaagaagcuacucagaauaaauuagccagaaaguguuaggauaugcuacuuccacauucucgucuuauuuucuucuuuggcccuuuccuucuuaaaugccaccuccuuuuuccuuccugggacuugguaucuuuguacauuugccuacugaugggauaaagcccaucucuaccccaaggauauugucuuccuccagguaagaacuuguaagauucugagacccacaccuaaacagcauuauuuguaguagccaaaagguggaagcuucaaucggcaagaagaaagcugagccacauauacuuuaaaucgccccagggaagcagaaaucaguggauucagaaggaauaaagauaaugagaugagaccuaagagaccauggcgaaauaauucacaaguaucauacuggugagggggcuggggguugcggcuggcucacuggggucacuguaagucagaucuuagacuuacaguuuaucccaggcugaccuauagucuucuauuacagacuucuaaauaauagacagcaagaggcaagaguaaauaaauauacaaaaauauaguacaaugcaaaugcaugauaaucuucaauaauuaucaggaaacgcaugaauuagugccaggucgcagcucuguccaccacacccagcauuugaagugcauuuucuugaagccuggcuuucuggagaaaccuuccugcucaaugccauuuuuuuuuucuuuuuuugagacggagucucgcugccucccagacuggagugcaguggcgcgaucucggcucacugcaagcucugccucccggguucacaccauucuccugccucagccuccccaguagcugggacugcaggcgcccgccaacacgcccggcuaauuuuuuucuauguuuuaguagagacaggguuucaccguguuagccaggauggucucgaucuccugaccuugugauccgcccgccucggccucccaaagugcugagauuacaggcgugagccaccgugcccggccucaaugccauuuuuuuaacuuuuaguuuagguucagggauacaugugcagguuuguucuguagguaaacucgugucacaggcguuuguuguacagauuauuucaccacccaggcacuaagccuagaacccaauagugauuuuuuucugcucgucucccuccuccuacccuccauccucaagugggccccagugucugugguucccuucuuugcauccauguguucugaucauucagcucccacuuguaagugagaacaugcgguauuugauuuucucuuccuguguuaguuugccaaggaucauggccuccagcaccauuaauguuccuguaaaggauguagaaagcaguguggcgauuccucgaagagcuagaaacagaacuaccauucgauccagcaaucccauuauuggguauauaucuaaaggaacauaaauugcuuuaccauaaagacacaugcauggaaucaaccuaaauggccaucaaugguagauuggauaaaggaaaugugguacauaaacaccauggaauacuacacagccauaaaaaagaucaaugccauuuuuagagauccuuugacaagcccuugggacccuuucucuuggagaaaauucuguuugccuuuggaaauauggccagcuuccuacuucuuaccugguauuaauaccaggaguuuggaugagccacuucacaucaagggagagagguaguugagcuugagugauuuuuauauucucuaaaggcaugugaacacaaccuugaccuuuuucuuuugcuacgcagucuucuuuaacagcugaauguaaagagccaucuucuucaacaccccugauuucauguccccaacaacacacacacacaccccuccuguccccggcagcuccauccuacuccgggccuacugaaucagaaacucccgaguggaugucuagcaauugcuuaauugccuggagagcuuauuaaaacacaaauucccaaccuccaccccagaggucugauucaguaauucugcaauagggcugagaaucucauuuguaucaaacucucagcuggcgcuggugcugcuguuucagccaguugcucuggaguagguggcuuccugccgaccucaagggcacagaugucuccucuaagcuaucuggggaaccgugcacaacugcaggacagacagcaagggagaaaguguagaggaaaaggaggaggagauggaaaagacauucugacauccacucaguuuccccuuagguaaugcaaugccugggauccuugaugcacuucaucaaagcccacuugcuugcuugcuucuuucuuucuuucuuucuuucuuucuuucuuucuuucuuucuuucuuucuuucuuuucuuucuuucuuucuuucuuuucuuucuuucuuucuuuccuucuuucuuucuuucuucuuucuuucuccuuccuuccuucguuucuuucuugcuugcuuucuugcuuucuuucuucuuccuuccuuucuuucauucuuucuuucgccugccuuucuuucuuucuuuguuucucucuuucucuuucuuugauucuuucuuuuucuuuuucuuucucuuucuucuuucuuucuucuuucuucuuucuucucucucucucucucuccugcagggucucacuccucuguggcucaggcuggaauacaguggugugaccacagcucaccacagcccugagcucuugggcucaagcgauccuucugccucagccucccaacuagcugggacuauaggcaugcaccaacgacacccagcuaaauuuuuuuuuuauuauuuuuuguagggacagggucuuucuauguuacccaggcuggucucaaacuccuggcuucaagcaauccuccugccuugaccucccaaagugcugcaauuacaggcuaaugcuuuuucuuguuauuuccauuuaucuguuucuggcccauauuaauauccgcuaauucaugccuuuugauugagaccuauacaugguuucucaugggcguuauaaaaaugaaagugcaagaccuggcacaacagaaagauuaagagaacgaaaccccuagacccaaaguaaacccuguggggccgugguaucuggaggcaggacacccugccucuggcaugucuaagagaguuuggugccccccuaucuucacauuggugcugcccagagcaagcaauccccacuuccccaacuucagcagcauccaagaucucacggagggcuuguuaaacacagauggggacccccacucccagagccucugaugcagcaaaucuggggugggggcuggacaagaaucugcauguuuuuuugagacagagucucgcucugucucccaggcugaagcacaguagccugaucucagcucacugcaaccucugccucccggguucaagcgauucuccuaccucagccucccaaguagcugagauuacaggcaugugccaccauacccagcuaauuuuuguauuuuuaguagagaugggguuucaccaugucggccaggcuggucucaaacuccugaccucaggugaucugcccaccccagccucccaaaaugcugggauuacaggcaugagagccaccaaaccuggccaagaaucugcauuuucaaaaaccucccaguggccaagcaugguggcucaugccuguaaucccaacacuuugggaggcagaggcaggaggguggcuugagcucaggaguuugagauuauacugggcaacauagcaagaccccaucucuacaaaaaugaaaauuaaaaaaauuagucggccaggcgcaguggcucacgccuguaaucccagcacuuugggaggccaaggcggguagaucacaaggucaggagaucgagaucauccuggcuaacguggugaaaccccaucucuacuaaaaaauacaaaaaauuagccgggcaugguggcgggcgccuauagucccagcuacucaggaggcugagacaggagaauggcaugaaccugggagguggagcuuguagugagccaagaucaugccacugcacuccagccugggugacagagagagacuccaguaucaaaaaaaauaauaauaauuaggcacgguggcacacacuuguaguuccagcuacucaggaggcugaagugggaggacagcuugagcccaggagguuaagaaggcugcagugagcuacaguaguaccacugcacuccagccugggagacagagcaagacacuuucucuaaaaaaaaaaaaaaaaacaacaaaaaaaaaccucuuaguaauggggaugcugcuuguccaacgaccccacuguagaaccacuauguguaugucugaaauaaugcaagaagucacuuauggugauuagcaaaacccaagaaaacguccaggaaagguaaguugcacccagcugaucacagagguguagggaagcaucugaacuuccacucuguuuguaucagcugcagaaauggauacagcagucacuggaugaugucuuuuaugaaacucacccuggaaugucccauauuuccgggcucugaaagucacucuggcucuauucuaucagaaaauuuaggccuuacucugaucaucacauccaucaugauucuuguuauagaaguuuucucauuucauaccuuucaccagaaggcauuuuguauuaugcagucuccauggcaguggucccauaaaugccugucaacuugauuugaccagucucauccuauaggacucacugcuggccuguugaggaagaguugcaaccuaucucacuguguuauuucucucuucucucuucucccaaccccucuuccuucuucccacaccugcuucucccaccaccagugcauucccagaagcagaacagacagaccugcguccggaagagccucauaugcgccuuugcuauggccuucaucaucagugucaugcugauugcagccaaccagauacuccggagcggcauggaguagcagccucccgccagccacacuguguugcagcucaccgcgcaugugcaugccgugcgggcagacucuuccuccacacagcagacacggaccuauggacuauggauggaugcggacgauggaaccguucaguaaagaacccaagguugagugcaacugggguugcacuucagcuucaucuccuuggcagggacacuaaagggcugucuucagugcuuuaaugguuuuguuuucuaaugcaauaaaucgccaggauuuccaaauuauugcuucaaccaucagucauaacucuagagaaaaacuucaucuucaucucggaauuccagcagccauccagguauaauggugagagagcaagagagaggcaugaacacacagucaccuccacuccccauucuuucaacccaagggucaacaggagacucucugcugaggucaacccucaguuccaagaggcugacuucaggguugccacagaagagggggcuuuccaucccacccuggcuuccuuccuccacccaguggagacccccccaaggcaugaggggaaagccauuaaguggggugcagcccuggcggucuucagcugcaccccucaccgcuuccguucuuacugccuuuucuagaggacugccauugguagagcuggggugcucucaguuuccgucggcacuuggcuuucuguuccuagagcccaucccgcaccagcauuuuggaaccugcagagagccuuucucccagcuuugccgccugugcugccauuagagaaaaaaagaagcauaaucgugggcaucucuauaacauagacagauauauauauuuggcuucuucgugugugaugucauucuucccuaaucgcuuacaccuaauauaagcuuguccucccucccacacucaucccugcuucuuuggggcaggggugaggcagguugaggggggaggggacugggacuggcggugagguuuugauacccacacccagccaucuggagucauggagacccaccacgucucuaugccggaugaccuuuguaaguuaagguccuugugcaucuuaccuuucccuuaccuuggaguuugcuuuguuagucuuccccagcuaaaaagagaaaugcaauccaaaauggaaagauggagagaucaaacgacuguauuuucacauaagaucuucuggccuucagauucugcaacugacucauuuucaggagguugggggaaaagauguuuaugaguuuagccaacagaacagguaauuuacuccugccugcagaauacuuuucguuggggaagagaacugaauccaaggaucuguuuucaacaccauuccaagucuguaauuuccugacuuuuccuagaugucagccacuacuaugaauucaagcuuguguagucagauuagccaguaaucucuagauguaauaguucccuuuguacuuuuccaagcucaggucuuuauuuuguaauggaauuaccuugcuccuacuucuuuugauuacauccuaaaacuacaugcuuccccccuuccaguagcgagccaccagaagcuuucuugucucuaugcaguggguaggauuuuuuggugcguuguguguuccugaucucccucccugucuuccugcucagcuuucucccuacugccuuuucagacuuggagcacccaaggucuccaaugaaaguuuucucauucaccucugcaagugcuacuggcaacagccugagggcagcuguagaaacuuucccucugugggagacuaugaauauuccugaugagcacaaguaaaacuaaggcuucagccauaauauggaggagggagcagauguaagcucccaagagccugggggaucacaggucccucugcaaaacuuccuggaguucagcccagcaaggccagaccaaggaggcagcaaccugccuuucccccuuaccugcccugcugccugcacacugcaugccugccccuucugcugcuccuguuggcugacucaccacuguccccuuaggauuggaauucucaacuagaaccgguccaaaugcagaauauuaauacaucgaacaacuucauccuuaaucucugcccugggcaguuugcccucucccaucuggacuuagaugggagggcauagcagaucuugaagggauauacuuuccuguuuuucccugacccccgaaccacccaaccacauccauaggggugcaggacccuaaguagacuggguagaaaccccagggaugauucuucaaagcccccuccuccaugagaggggacugaaaugcugcagcugaggcuggucuucagggcagaaaaugaguacuucuuugaagguggcuuuucugcgaguucuucugccuccugcuggagaacagagacccuucaagaggugaggguuagauuucauuggcagagagauuagccacugugcaggaguagggaggaaaaggaguucuggagaggcgccgccauccuguuuucuggaaaggcugcaggauuccuuuccuaacggugaccuucuucuugcucccagugaccuggaagcaagcccacccuccccaggggaaaaucuaggagaaugcauuccucugcagacugcuagagagagauggcaagaaggaagacacagaauucuuucugacagccuaggaguuaucuucccacugugguaaccccccauguggcacccagggacugaaggacacagugcguggagacggcccugagcuagcggcauuccuuagacuucaggagcucagaguuugucccggugacuugcacccuggcugcuuugcuuggacaguuugucuuggguauagggaagccuuccuugucaggcagccaacucccagcccuguucacacaaauuuuaugcuagggccccaugccagucaguguccccaucaugguggcuaugaagcucacggcugaagauuccagaagguccuggucucccaugcccaagggaugccauguagccccagcuggaagugacuuccgcaggaauugagagggaauagcucaccccucauucuguccuccggacuuaggaaccagugaccuuggcugcccaacuguguggaggcugagugauugacaaacacagguuggcucauucuugcugcaagagcagguaccccccgccgccccccuggaaagcacaagugaugagcaagaaggcauuuuccuugggagagaaggggaaauggacccugacccccuugauccccaaagaagcugcgccccaccuuuccagauacccacaaagcccccagacagaaucuagcaucgggacuauuagcaauggcuuccagaaugugcuugggucccacgugacugaucugacaaaaaaaaaagagggauauuaccauggcaacccuugcauuccacccugaguuugccaaggcacacaaaaauagggaacauuuucuuaaagaacacuccaauucagccugagugcaaccugacucucugcaucuguauccugcugggagaggcaauuacccuuaaagaaucugggugguaucucugccuuuuugucuggcauuugaacuuguccuucuauuuacucaggagagcaggagcuaccuguaagcccugguaucuccccaucccuacucccagccccuucucccaggguccagagccaggaccccuuaaucuagguaaauugacagaaauaucaucuuggaaggcaaacaagauauuaagccuccaaucuuuaaaaguaucgguuugccuguugagcacacuccugcaagccaaacacgugaacuuuggugaacugagguuuagguguggucuuaggcaaacccagugguuucagaaaugucuggguguuuuauuugcagagaacaagaugugucuuaugagucuucuuucucaauaccugcccugucucaaaucucacuugacaaauggucuacgaucuugcaguuauccaaaagagccuaugaaaaauggacagcugcuuuugacaauaaugccccucccaacuucccauucauagaaucauaaagcgauauguuucagaacugagagagaaaaguuuaccuuuuauuccaaaugccucguacucgguuuaaguccagacucaggucauaaaucaaagacaguuuugcacguugcucuucaccuaaaucuagcaguuucccugaggcccuaugagggcauggacagaaaaugaaggaugcaaccacccaggacagcucccugguuugggcuggccuggccacguguggucacauguccugggaucuguguuuacuguguccuugcucuccuuccuugcagaagcugcuaagcucugcuccuccuaacugcaggucucaaacccuauugggucauuuugccacacuauuucuccaaaggcccauagucauuacauuuuuuaccauuucaccaagauaacagggggggucuggaauuccccugcuaggaagggccccuuuuccuauaucaccgugaugguacagaugaacugagaugaaacuuuuagacuucagcacgucacacauccugguuguauaaccaggaggucugcagagcugcaaccccugaagaacaucugucuuaaaagaccucaaaucagaacauucucauuggccucuucagugauccccauggagcuaagaguccguaaccuaaaggccuuaccauagccaucuucccuccacaccugauugcucaacugccccagaaggggagaaucuaucugaaauagaaaagaagcauuaaggaccaggugcgguggcucacaccuauaaucccagcacuuugggaggccaaggcagguggaucacuuaagaucaggaguucaagaccagccuggccaacguggugaaaccccaucucuacuaaaaaaaaaaaauacaaaaauuagccaagcauggugucgggcaccuguaauccuagcuacucuggaggcugaggagggagaaucacuugaacccuggaggcggaggcugcagugagcugagaucgcgccacugcacuccagccugggcaacagagcaaaacuucaucucaaaaaauaauuuuaaaaaagaaacauuauucaccagcuaagacuuuucaauuuaaauuauuuaaagugacagcaacauagaggagaauuugggcugccucuuaccgacccagucuccaugauaauuugagugucacaacuguucagcuucacuucauacuugcuuugacuaagucacucgggauuguccucaauuuuuuggcccugccauaaauagguguauguuaguccguuuugcauugcuauaaaggaauaccuuaacacuggguaauuuauaaagaaaagagguuuauuuggcucgcaguucugcaggcuguuugagcaagguaucaacaucugcuuggcuucuggugagaccucagaaagcuuugacccaugguggaaggugaagggggagcaggcacgucacacagcaagaacaggagcaagagagaggagaagaggugccagucuccuuuucuuaacaacccgcaauugcaugaacuaauaaaguaagaauucacucauuacuacagggagggcaccgagucauucaugaggaaucugucccuaugacccaaauaucucccagcaggccccaccuccagcacuggagaucaacaugaaauuuggggggaacaaauauccagccucuaugauugguuuggagcaaugagaucaauuacaccaacaagccaagcauuucucuuaguauccuauggucauugcuaaugcauauggucauuuugacagcugugguuucuccuucauauucauuugggacucuucauagggucucgagagacaugacaauacuguucaaaacgucuccaaggcaaaauuaauuuuauuccguugacuggaaauauaucacaaagaaugagguuuuuccagucccacccacaagacaguccucugaaaguggaaaagcuugcccggccaccugccccuacccugaccuugggguaguucaucaguugagcacaacccccaugccgggcauagacucacccaucucuuuuccucaggugugauggguuggcuuucaaacuaguguuucucgcacuguuagaaguuauuguccaaguggaaaggaugcagaggcuggaauuuuccagugggauagaagagcaggcuaauuaggaaggaauauuccagggaaugcaaggugcaacugcgauauugcuccaucccuggaccugagggagacaaagaaaguucuuaaagggcugcagaugcuguccucugaaggucuucucuggaucgcuggccuacuuuggaaacaugcaggccauugagugccauggggcugcccaucagucugauccacacgaaaggcucugugcauuucaagagcaggcugguagcucgccauuccugggaggaugcugacaucugucaagcccagaaugccucucucagggcucucagaccuguuaaacugaggccaggagagcagaagaaagaacucaaaguguggacgguacuaccagcuggagaaagcccaggagccaggacucuuccacccacuaucuagguuauguugagugacauuccucccuggcuucagguuucucuaaagccagaggaaaaguaaaccagacaagcccucccaucuauuuugucugaaacaagauggagugaaugcucccuacugagagggucuggauuucacccaugaauugcacuaggaacugggagcuccuuuuugaacacaagucccaagaggcaguugugauaaagucucucuuuugguguccgcugucuguaaaugaaacaaugcaaauugguguauguuaaaugugucacagcuugcaggcaagagguuuuguuuauucucuaaggacuugcugacucgagggagcaucaaagaugagcuuucugucugucuuggcaagugugaaaauaaagggagucagucaccuccccaaaggucaugugaaucagaauucaggagaaaguuggaggaaacaauggcagauuccaagaagagaugcuuguuucuccauuugagaaagccuuacugaaagcuacugaauaaagagcacaauuuccaguuauuucuuucuuugcuuuuuuuuuuuucuggccacuauaacagcacuuccaguauauguugauaguagcuuguaauuauuccuaauaccccagaaagaagagagucgugaucuuuggugauugugaggaauuagauuaacagucgcgggggaccggcuaccugcgacagcccuuuaaauggcuaaugagggaugcugagugcugagcggugccugcuuuugauguggcccacccaugaccagggagagagggcaggaagagagcagcugcaggauccacaagucucuaacccuucugccccaggcaacauaaaacccuagauucuuguucuuuuucccucuuccuaaaguagacugacgucccaguaauuguuuuucuaacaagcccuguuguucucccugggaaagaccuagauuggccaagaaaggauccugucagcuccugguggagaguugcacaagccaguggcucucaacucucuccaaggaaaauuaaagcauauuuucucuuucuuagcucaaaaucagcuuucagggguccuuauuggggucugauuuucuuccccaguucugaauccaggaagaagcuuuuucuccaaggaccaaccaaaaacaaugacuuuggagaaaaauuagacucagaaagucuguccaggcauuggguuggugaacugucaacuguuggauggggaggaggggucgcugugaucguagcggucauuagacuugggacgugaguugucucucaaagcacaguaguaaaugacuguauuuuguauauugcccccaauauguuggguguaaauagaagcacagcuggggauugaucauggccaggacgauuggagcuuggcagcucucauauccagaauaagccacuaagacggaacucaucaaucaccaucuucccauuuaccucauuagcaucccauuuucucucauucaguauuaguugaugauuucugcuauuaagugaugagaaagucagcagacuagucaaaaaagaaucuuuauauaaaauguacauauuaauauaaauuaacuuagcaugcaacuuaccgaucaaaugaaguauauauuauuaauauguuaucuuaguguauaaaggaaaacugccauauuuaccagauguuuucuuuaaccgaacuugucuguaaauauauaaucuguauaaaaagagucuaauuuaccauuauuuaugcaauagaaaaaauaaaaguuuuuuuuucuuuuga

SEQ ID NO: 191544 - RNA, 1193571 nt, Homo sapiens
cgcucgcaguuucgcccucucuuccgcuaaugauugcauuauuaugcuccccucucuggggggucucgccccucuugggucgcuccggagccccggccuccccuggcugcauuucuuaaaaauuugggagccugggagugaguuuucuccgaggcgugugugagaggcggcggggguguuuuccugcgcgaggggcgggugaaguucauugcccccacuuuucccgcgaccuuuuucggacccgauuuuggaucgaguugaggggggcgcgggcguuuucggggggcggggggcgcggcggagaauggccgcggggagggcuccccggagccucccagucucuugaucaaagcauuccgcuauucugauuuauugcuugcuuggugaguuauuuuuuuuuccucuaaaggagaccuguguguucagccauuacuuugcucggcgcugcucccaggcaucuccgacccucggugcuguggggagccccacacuugggcuccucgccucucgcccucgcuccccgucccuccuccccucucuccgccccuucccccuuuucuuucuccucucuuucuuccccucucucccuucuuucggccgccgucucccccgcgcccuccucggggcggagggaagccgugaagggggagggagggcucggugucaauuuuuuuuuguguggcugcggccguagccuguggcgggcaagcggggagaccccggcgcagcagaaccauggauggcccgacgcggggccauggacuccgcaaaaagcggcggucgcggucgcagcgagaccgggagaggcgcucccggggcgggcugggggccggcgcggccggcggcggcggggcuggccggacccgggcgcucucacucgccucgucgucgggcuccgacaaggaagacaaugggaagcccccguccuccgccccgucccggcccagacccccgcggaggaagcggagagaguccaccucggcagaagaggacaucauugauggauuugccaugaccagcuuugucacuuuugaagcgcuggagguaagggggaccccccuucccccggguucccuuuaugcacgaccccacucggcugcgcccggcucuccugccucccucgccgcgcuccgggcugucugucugucugucugucugucugucugucuaggcugaggucuuauuguugguggggggagcugggggcgcgggcagacaggcagcaggagggagucgcaaagccgugccuggucucguuuccucgcucgccuuuccccugcgcccccucccugcacccccuccacagcagaugggcagaaagaaagggguucgggcaucacaacaaugcgcccccucuccacagagagcucugcccccacuccuuccuccucucccuccccaaucauggcuucuuggcugguggaagucucuuugcuggguuuggggcgccuguggacgguucugugugcuuucuacagagucauauguucgugugugugugugugugugugugugugugugugucuguguaguauauaccuuucccggguguccucgggacuggagacugaugggguuuugugauuucuuugcgccuccccccauuacccccccauauucuuuuuuuuuuuuuuuuuuuggugaagcuggggaagggggcguuuucuccugguugggagaaaggagggaggaggggagagaagagggaaggguggaauagcucucuguauucuguaugggguucuguuacagaaaggguuaauuauaauauuaucuauacacauacauaggcacauguguguguguacaugagcaauuuaguuaaaggacagaaaaagguacaccagggaagacuggugggagggaagaauaaaauccuagcugcuaucugaagggcuugucaccaauugucccucucccuuuccuuuuuuguguuuucuuuuuuuucuuucuaagugauuggcuuugugugugucuaugugugugucuuucuuuauuccuugggcaccugcagcguugauuuucaaaugcacauuuuccuuccagccaacuggcuccuaggguagggggaaagggaaaagggagggagggggagacuguccaggguuggggggaaacugucuuugccuggaccugucuccuuuggugugguauuggucauuggccucuauaaauuuaaccgccuaauuuccucccccaccucccuguccccaccccccacacaccaugcacacacacacagaaggcuuugagauucugcagaguugguccaccuuucuuaagcacaaaaccaagauacgguuuauaguuggcuuauaguguuucaugcaccugaugugaugguuugagguuccugaaggaaacuuuucccuuuccauuuuuuuuuuugcguuauuaugguauuguuucacaugcucagaugcaagcuuuguuaaugacagcuuaaaucucacauacgguaacuguacagguuuagauugcugguucuguuuauguguuugggugucagcuuuaaauauuuuuuucaaaggaaggcuuccuaucaguguuguccuuuucugugugaacugcuuuugguuugggcugcugguggugauggugguggaugguggccagugguugggaguaagggagguauugguggugguggugguggugcaggugguggugauggugauguuggugguauuggugguggucguagauuuugauguuagugauugaaucaguuacucucugguucuagaauuggugcuuuauuggccaaaauuuugaguguugagguucaccacuuauuagaauaauuccaacuguggcuuuaaguuugccaagguggguggugguuaccauacagugugaccucuuucugucucucucucuuguuuuaaaauaggaguugaaauggcagcauguuccuauuagaacaugcugcuuggaauuugguucaucauugcugucugugguuguuuuggaaaguacuuguaagagcugguuacaagugguucugcuuucugcaugguuauccugagcucagcaaucaagaggggccacuggauucccacgaacauuuuuggaggacaaguagggauauauguguguguguauauauauauauauauauauguguguguguguguguguguguguguguguguguguguguguguguguguguauaucucacuuaugcaguucuuuuugaugguuuuauuuuuaacaaauagguauuugacugggcuugugauauauaucuauuuauuuggcuuuugcgagaaaaugugcucauuuuaauuuauuuugugccuaaaaaacuuguaauuuuaaaagcagaccaaguucaaaauguacaguuaauaccauuucuuucuuugcucugauuauuuuuuucugcuacuuuucuagauuaaaauccaggauauuuugguuagcugaauacuaugucaccuucauaucuaaauaucauaugucuaucuauguguagguagaaaaggucuaacuuuuaaaaaaguuuacuuaaaauucuguagaaaaaauuaaacauacagaaguagacagaacacccaacauccagguuugagaacuaccaacucauaucucaucuuguauuuucuauauuucaucuauuuccucucccacauaugaucucauccauauuucucacacagaaauacuucuguaugaaucccuaaaccauaaugacuccaaaaauccucagaccccaccaaaacccgcacagcaguauuaucacacuuaaaugaauguauaacaguucacuaauaucaaauauccugucaguguuuacauuuuaagaggcccaacuuuuguagggaagccguaaauacauuugucagauuaaaaacacacaaugggaaauagaaaucaucauauaugucugguucuuuggcaaaagguaguuuuguuggcugugugcuaucacauuguguccaugcuggauggucagaacauauguguuagugauuguuaaauuaaaaccucuggugguccacucuauucagucuggaagauuuauugaacuaucaccaagaaaugugagggcuuauugggaacaggcaacuaaacuaugagcuuggacaaaaauguguguugggggaguguuuguaaaaguuaagaauuauuauagaugcuaagaguuauccuaaauacguaguauguuuucgggccuuguguuuagaaaugaaaucaguugucaccacaugucauuaaggcugcugcugguaugauauugugaaaagaaaccagaaauauuggcuugcacagcuagguuuauagcuugugccaguucagagcaauagcuggcaaacaguggaguagcauacuuuguguguuaauggacacauuauuugacuccaugauuuuguucugaguagcugguuuuggacuucucuuuuaaaaaagaggcuccuaacucauuaugaaaugugcuaauauaaauaguuccaguucaacugauuuuacugauacuggaguaaaagugauaacuugccuaaugagaaccugcauuuuuaucuugauuauuuuuugcuguuguuggauucuuuuuugagaugaugaaagcuuuagggguaguuugacaagucucacauuuuauaggcagugaaacuggcugaaacaguuucauauucacagggacacuucucuugaguaauugugcccugaaguucaaguguaugauuaugaagagccucaugauagaagauaagaggguaggcgaggaggcuaaaguugaacaugguguucuuuucauuaugcaguugagaagcagaauuaacguugguauauaguauauuguuuguuuggauauucuucgagugacaggaugagagcaaaaauccccagauaagaugucuaguuuucuuaaaaaguggcuuuuagcaaaguauaaaugggaauguugggguccuacuaccaucaguguguccugauguguuagauaguguuggcuuucugcuauuuggguuuuuuuucuguguugugucuauuaggaagccacgugaguaccauggcugaaaacuugacuuugcaaauccauuauuuuuccccucauuccucuuuugugcacuggguucuuagggcagccuccuuuuguacagcugaccaagggaagcuaagaugaaauuuguggaauuagcagaaaagaggccaauuggagcuuuauaggcuuaugaaaguaaaggaagacucauuucuagugguuagagcaucaaaccaagacuuugaugcggucuucacuuccuggcucuguuuucagggcuucccccacacaucaguagcauaagugggcuauacagaauuugguguacuuauaacaugccauguuaauaggcucucacaauuuauuauggucaaaucacuuuaguuguuuaaaaaacaacaugagucacaugccuucugucagucugcagauauuuauggagugcuuaauauguacaaggcacuaagaauauagagaaaccaaacauaaaucuagcguuuugagaaaguauguaguuuaguugauaaagccagcaccuaugaaauaauuuugaaacagguacuugaaugccugauaucaacuaagcgccauaggcuuuuagagacaggcuagugagauaggcugaaguguuccagaaggcuucauggguggggaaugggaccuagaagggugaagugauuuggauauauggggaaggaguuggagcuagggagagcauucuaaaggaauaaugaaggcacaggaacaagaugcuacaugguuaggacuugggggcaaggaaaggcugguggaaaugaguacaaaggugguaaguaaagagugcuuguuaguggggcaggagaccuguggagacccacaugccaggcuuggccugccuaacuaguguggccuuugaaaguuaacuuucuaaaagcaucauuuccuuuauccauuaguggagagguuuaaacuaguuuagaguaaagcuucucaagcuggaagggaacauagcuuuacaggauguucauaaauuguuuuuuagucugaaacagagugaucuaccgccaaauaguuucugaaacuugaugggcuagacaaaauuaaauggaugccauguucugucagaauuaaaagucuauugugugaaugugaauuuugaauaucagagaaggcaauguguugugccuaauuuccuaaaucuauuuugaccacagagcacuuuuauucucugcauuguaaucuauaauccaguaugggaaauacuagaaaggauccaaaaaagucccuccagaucuuggaaucuggugaucucugagucuggggugagugggcugaugguagacgacuuggaaaaccaggcacagaagcuuguagucggugcgugggagcugcuucuuaagcaggaguggcaaggggagugaaagugaggaagauguaaacagugagggagacuaguccaugucuuuuccugcuccccuuuccugccugacaucugccuuuuuacugauuguuaccaaccccaccaggaggugaauauuggugagugguucucauuaauagcucuuucagugugaugauacuagcccaauucugaugccaccaagcugcccuucagccaauguuuuauccucuuugucccuucugguuucauauauugcugcucuuuggcaaccuguaaaaaaagguugguugggaaaggagguugacauugauguuaaaacaacgauuucaaauuaucugccuuuggcuugcuguauaugaagugguaguucaaaaaagggucagaaccgcucuuuugcuguuacauagccaggaaaagcuguggaacuguguuucuguugcauuuuucacuuucuuuuuuggaaaauuuggccaugggacuguaaaauaaaugggucaguuccagcauuugacuucugaaaguaugcauagcuuuaggaucugagaagggaugagagaauuuggaggaaaggaagggugugaauagugugugugguuaugaauucaaguauuuuacuguacuuacugaguuucauuauuuuacuuuauaaggcagagcaucacuugaggaguauuuaugugagaugugguugaacguugugauaugaugauuccaugcagcuuuuguuaauuguggagauuaacuacuugcaccuuuuuuuuggaauuagaauguaaaugaauccgugaauuuaaaaaaugaauuaugagguuaggaauugagccuuugauccugagaguaguguucuguaguucucacuguugaaaaaggguuaagaaaacagaacaguaaacaugauucaaggaguguugagggugauagauucugagacucuucuacaccacaguuuuauguauuaucaaagauaaauggugauuauuuaguuuuaaagaauguuaggauuagaaaugagguccccagauggacacaacaauaguugaggcuagcuauuaggaauaauuuaggucuaagagcuacgagauuuggaagccuuuggacgagaaggucuguggcauuucggguguuuguguaugugugcacgcaccugugugcacgcaaagggugaaggaugguggguuaguggcuuuacauuuuauuuuauuuuaccccuauccuguauaguagucauaauauacuaaaugcagccuaacuuuguaaaaguguuucaugcuguuuuuuuccuccucaagaagcaacuuuuuuuuuucuuucagaauuaggauuaaacccaauaugcugcagauguaggauaaagaaccuaguaaugggagagcaacuguuaauuuuagaaaguucugaaaagauucagguagauuugaaaacuuagaucauugaaguuuagaagagcaauaugauaaugaauuugguaaaacuugagacaggagaagaucaaaaauaauuagugagcuggggcagaacuguuuucucuuauauaaucagaaccuguuccaugaauguagacuuuuuuccccucugggaggugaagaggacauagaauuuaagacuggugagacccuaagugugucuucuuucuuccaaaucugagcuguguucuccuucguuucuucuaacacaauagcagaguaaugauaguuucuauuauagcuuugcaucuguugguaugcaauuaauacauacugugaggucacaaagaauaggcccuuuuuaugcuauuaguaugaggaggggaggagugaguuuucuagaauuugacugccccugcuuguuuaggaagaaacuagacaaguacaggcuucugugucuuaguccuguucaggucucugauuccauccauugcaaggggcucuggacccugaaaucauaugaauuggugccuucuuugaagguguuuauuucauauauuaguguauguggcucucuuaggguccaguuagauuccccgcucaccugcugcccaccucccuccuuuccucccuuucucucuccuucauauccuucuucuuucucucucuuccuuuacugagguagagcuaucaaaauuaugaaugcuguuaauaaaagguaaugcauuuaggacauuguguaugaaacgcagaaauucaaaaauuuuuaaauuucauuauuugaacugugacaaucugcuugaggaacucuaauuuagcucucuaaaggugaauugcuugccacaguuuucuuggccauuacagcucacuuuucuaauuucucagcuuaugucugaauucuaguuaguuuguuugccagagcaaaccuuauaaaugaucaacuacauacaaauauuuuuaaaaugacuuaacugucauuuuagcuugcacuauaccucacggugccauacccccuuguuaccucuggagcccuggaaaacccaugugcaguaaaauggagucacaagagaaaagcccacaguuuguaaguaauggaaaauugcuaaugcaaguugggauucauuuuuggcaaaaagucuuuaaauugcaaguauuguguggcugcuauuaacugaagcacagccugcaaauauagauugugacucuugguuacaugggugaaaucugauauuuucuuucuuuuauuuuguuuuuuugagacagugucuuucuuugguugcccaggcuggagugcagugguaugcucauggcucacugcagccccaaccuuccugggcucaggugaucuucccaccucacccucccaagugcugggacuacaggugcaugccagcaugcccagcuaauuauguauuuuuuguagagauagaguuuugccauguugcccaggcugguuucaaacuccugggcucaagcaauccacccuccucagccucccacaaugcugggauuacagacgugaggcacugcacccggcaagaaaucugauauuuucaaacuguggcuaaguucuaaaccugagacugaguuuuagucauugccagggacaaguugugaugacgccugagggaucucauuuuccuuguuguccccacaccuacccucgucugcagcacaaaaucucauuuuaaguuuuuguaaaguuucugauggcaguaauauuuuagaacuuaaaaggaggaauuaagagauuacagucccauauuauaaguauuucuuaguuguuauguugaaguagacuucuuuuuucuuguuuucuucuagaucucuuuguucaguuauacucguuggcuaaagguugcugguuaaauguuguuuagcgaaauauucuauaguuaaaaucuuuacaaagaaaaaaguaagaaugaagauguggauagcacaauaauugaacauuagauuauuacuuguuuucuagccacaugauagaaauugcagugacuuccacccauucugucuguacauguucaguuggcaaagagaaugaagguccuggaccgugcuuuucuaagaaaugauuuuauauaguugacauuauacuuucacuggagcaaaaagggaaacaagcauuugauuagugugucuuacugcauauuguggucugcucccucauuuguuacgguggucacuaugauugcuugacaauuacaguuuugagauuaauaugcagagcuaaaucuuuaggagguauccuaaaguuaggaccuaaacuuuuucauagcagccuuuugauccauuuuauuccagccauugcuaguugaugugcuuucuaagccguguggcaucagaggcacagauguugucuuuagugauguaguucuaccucucauuuugcaaaugaaaacaacagcccacagggguuaauugaccuguucaagaucacacugggaguuagaggcucucacuguuacccuaugaaucuaggagucugcuucuuguaaguuaguacuggggagucccaaggauugggaaccuuggaaggagauuuuuuaaaaacaaaaagucuuacuacaaauguggaugagcacccaugauuguaaagcuucccauuucagcuaagaaauguucugauuuacacaauaucaagaaccuuuaaaaagcguuguucucucccugcgcucucucccaguguaucacccugaaauuaguuggccuuucucuguagguacauucaucguuuuuaaacacugccucccaccucccuuuuauaaggauguaaaauaaaaaaauaaauauuagggugguuucucaucauugaaugucuaguggaaagauaaaauaauuauuuggaaguaagaugaccuuaauguggcccauguaaaauuuuuaacauaauuucuuuguguaaaauauuuucuuuagccuagcaaucuguggaaacucagagcaacuucauaacauugguagcaggauguauggagugagugaacuuuggaguauaguggaguugaaggcucaacgaaaauuuucuucgaggaaauacuuaaaauauuaaauccacaugacguguugacuaaggcaucuugucuguucauugcugaaccagaacauuuauaacaacuguuucucauguguauguauucauagccauucauauaaugaaaagaaguuuucaugggauuguaauaacauaucaagauggauguaauuaaaacagaagcagauugacacccugaauuaaauguaaaccauaaaccaggauaccugagcauugugccuuacauauuugcuguagggggcagucagccaaauaugcaaauaaaaagacauugaugaaucuuccuggguguguaugugguugcagagaacccaacuauuuuauuaaucuuuuaucaagcauuguuuagauuugcagcagccauggaauguauuaauuuggcagaccaaauagcuuaggaccagaaaguaggaaauaauaaagggaagacaugauugauacgcuguccuauaaauaacacaugcgacugacaaaggggcugaguaaucuuuagaucugugcuucauuucauuaauggaguuguuaaaccaggauguuugaguugaacuucaaucagagaggcucugccucccauuuaaaaugcaggccuaccucuacucacucucuggacugauauguugacaaaauugguguaaaucgaauuuuuguaaauuggaucaaaugcacuaggggaaucuugcugugaaaaauaugaguccuuuuuaucaacuauaguacuccuccucucugcagggaggcugggauuuugguggagugagucucuucagaugggcauugcuuccucugagacaguuuccugcacguguucccggugcucuguuccccgugcuccuggaagacagugacugugagauuugcauuuuuucuucagguuuuauaccucacuuggucggugcuuccaggaauaauugguggugauuugaauaagcccgcaucauucagauuucagagcuugguuuucaagugcuugcuaaggagggcucccagcuaugaauauggaauaugauuuccauaucuguuccauuggggaguccaggcgugucauaaccacuucagagucaugauuguaucgagacacccuagcuguaauuuuucuauaugacaguucaguuuuaaaauuguaaagaugccaaaagcagggcugcauuguuauuagggaagucagugacaucuguuauaucuuguuaaccaggggaggaaaaugcuuuaaucaaaacaucuaauuauacccuaugaacugaugaaauauccuuugcuaaauuuuuggaauuggccuuaauggaagaagcuggccucuaucagaacugugaaguaaauuuacccuuuuuauuuggaaaaauauuuauuccuaaccauagugacauaaggguauuuuaauuguaucagauuacuuuuauaugucuguugaaaauaguuauuuuucagaaguuguucaagccagcaucacguuuuuguuuuugugcucucugacucccuuagcauaugaggcccccagagggaguuuguauuuccagaugugagccuaggaggauauguggugucuuagagccaccuggggagggagcaaaugauaauugcaggugagaugcagggggauaauucagccugugugcugggaggugcgauuucacaccugaauguugagaccugcuguguuagacacuuguguuguuuuaaaauguuuuauuacucuaauauagaaauggaccagauuguuccaggucaccuucaguugaaagaauauaaauguuuuuaaauauugaaguauaaugugauuccagaaaugguuccuguguuuaaaaguaguuuuacauauaucugaaagcauuaaaaucuguuuaacucagcaugucuauacugccucuaccucuguugaucauuuuuuaaaaauuguaggccgggcgcgguggcucacgccuguaaucccagcacuuugggaggccgaggcggguggaucacgaggucaggagaucgagaccauccuggcuaacaaggugaaaccccgucucuacuaaaaauacaaaaaauuagccgggcgcgguggcaggcgccuguagucccagcuacucgggaggcugaggcaggagaauggcgugaacccgggaagcggagcuugcagugagccgagauugcgccacugcaguccgcaguccggccugggcgacagagcgagacuccgucucaaaaaaaaaaaaaaaaaaaaauuguaaauuauuuuggcaauguggcuuuccacuuugaaucauucaagcuucaaacuguccaguaaaacuauccuuuuaucuauauuucaaaacuagaauuaauuuuaacuauagcuguuaguuguuuccagaaucacugacgaugauuauaauauuaaugauaguacauuauugauagucuuaaugcugggauauggauuauuucugagaaaugauuaggucugagaaaugcuuuauuucuuaguuuuggggguauuucaucuuucugacaugguuuucccauguauggagaucuuggggcccaccugaaggaguuuuuugaaguguugacugugacacuaugggcuucauguuuacuuugggaucuggugggaaguucaagugcuauuaauuuuuccuuggucuguuuuaugcuuuguaauggcuuucuguguguuuuuugggaguuaagacuagaaccuuggaaaagagagagccagaguuuucucccuauauuucuauuuuaaaacuuuuuuuuuuuuagacauguucucgcucuguugcccaggcuggaguacaguggcgcagucauggcucacugcagccucgaccuccugggcugaagugaucuucucaccucagccuccugaguagcugggaccacaggcgcgucucaccacgccuggcuaauuuauuauuuguagagacggagucuuccuauguugcuuaggcuggucuugaccuccugggcuuaagcgauccucccaucuuggccucucaaaagugcugggauuauaggcaugagccacugcgcagcauuuuauuucuuauguauuguuauucucucuguauucucugccuaaauguaaccccugcacucuuucuguauauauccuucuggggauauuugaggcuuucagaacuguuucuuucuucacucaguaaucuaugcauaguagguacucagucauugcuuauuuacaguugacaacaauuccaugaaaagaaauuuuugaagagggagcugcuauuuacuauucgccuugugccaggcauugugcuagcaauuuugcauucguuaucccauugacgcaccccaugaaaaaaagaauaauaaucucuguuugauaguugaagaaacugaagcacagagccguuaaaucaacuuggccaggaucaguauaagagaggcaagaaauguagcaguuuuugccugacuugaaagcuugggcuccuuaucccuuuacucauuuucauacagaugcauuuugugaaagauggccacauggucucuaguagaccacauuuguucauuguugugcugaaaauuguuacaaaggauuuucuagguauaauaauaggauuuagggaggggagaguacuuauuguccaggucuuuauuuccuuugaaaaguuggagcuuacaguuagguugcugccacucauacaauauaucuguaacauauucguuguuguuuuuucucuguuucacuguuucucccuguuauaaaaucugaccuuuucccggguuauacuacucagguagauuuuaaaccauugucaaaggcaaggauucaggcugaugauauagaggguuauuguaugucagugucuguucuaaacccuugcacucauuuaucucacugaauucuaaaaguagcucucuggaacacaaauguaaaauuggaaugaggacuagcaugcccucacagauuacugugcauauaagcuuauauucugcuauagauucugaaguauuuugucuugucugcuuuuaaacuguucuaggaagcagcacuugucuugagaaucuauuucacaauaaaagagaccuuguuuugagggcuagguguauuuuuuuaaaaucuauuaggaacucuauucuuucugguaaaagaccacacuaaauagcucuuuuugcuuuucuugauaucuguaucuugaagauaccaggugacaaauaguccauugauuuccucugucauuguuuccuuucauuauucuaagcagauuugcaaauuguucucucccauuucccauuccacccuguuaagguuuguuuaugcuacaaagaguaugcuaaugaauauaacuguuagauuuacuucuuaaggaaaucccaacugcauuuagaguacuguacauuuuugagaaggcuccuccucauuuccccucggcuaagaugggccuccucacaggucauucucugggacuucacgauucagaacugguccauuaccauucauuuacaaggaauggggguuaguauaaagauacacacacagaauacccucacugggccugaauuuucuaaagauuucuagaugaauaugaagaucagucaaguuacacacuucucucaagagucacucuccgucucuuucuuucuuucuuucuuucuuucuuucuuucuuucuuucuuucuuucuuuuuuuaagagaugggaucucacucuguuucccaggcuggagugcagcaguaaucauagcucacugcauccugaaacuccuggccucaagcgauccuccugcugcagccuccugaggaccuguuggugugugucaccaugccuggcuaauuuuuuaauuuuuuuuuguagagacagggucuugcuguguugcccaggcauucucaaacuccugggcucaagugauccuccugccucagccucccagguagcugggacugcaggugugaaccacuaccccugcuaauuuuuuuuggagggguagaaauggggucuugcaauguuacccaggcugaucuagaacuccuggucucaagugcuucuccugccuucaccucccagaaugcugggauuacaggugugagccacugcgcccaucugaguguccguaugaagagagguggcaguuucuucuuggaaucaccaugcucugagacacacagucuugccuuucucucuccaacugucucaauaaacacaauugccccuuuguaugucccgaauggaaauaccauacuagaauucuauuuuacagauuguaauuguuggggagacccaagucaaaacauguucuuugaaauuuaaauauaacuguaaaaggaaccacaaagucuagggcuuuaaaggugaucuuuuaugcuuugauuuuauguauuuguaaaauacaaguucuauauugacucuagggccugucucagauuguaaacccuuagauaguaacugugucuuuuuaacuguuccuuguauccuuccuugccccucugguggucuauaauaccccuguugugaugauuuugauuaaagaaacauagugugaagaugggcugucagggaugggugucaguuucacuucaggguagugggugccaucuauuuucugauuacaggugaacauuacuuuagcauuauuuuuuuuugagacagagucuugcucuaucgcccaggcuggagugcaguggcaugaucuuggccuacugcaaccucugccuucuggguuuaagcgauucuccugccucagccucccgaguagcugggauuacaggugcccaccaccacaccuggcuaauuuuuguauuuuuaguagagacaggauuucuccauguuggccagguuggucucgaacuccugaccucaggugaucugccugccucagccucccaaagugcugggauuauaggugugagccacugcauccggccuauuuuagcauucuuguuguagauuucuacaucugcugcccauauuucagcuguacucuuauuuuguuuaguaugguguaccugggauuagggacagacaaauauguaugcucagccugauuuggaaauuacauuguugaaauacagcccauauggccauuguaaaaugguuagugcugcauauaauugccuuuccaaugaugugcuuugucauuacuuccaucuuccaagaagcacuccuguagcaugcugacagcaauagcaucauuagaaaacauauggacaugcaaaggcauuaaaucgucuuuaguuuaaggauuagauuacaguguuagaggauaggucaccaggcuugcaaucgaugacucuugcuuaguucagcacugcuagacuggaugauagagauuugcaaaaguccuauuuacuugucugcugaguguauuucauaucuucccugcaauugugagaagguccuuuagcuguguauaagccucuaucacaguauugcagccaguuggcuucucaggaguguuuuuuucaacuauucauguccugugcagaauucuuuucuaggaugcucccucaaccucuguuuuucugaaugugagcccaaagcaggcuaagccaggaauuauuuuauuugggggucauuuagauauaaaaagagacuaagugguggagucaagaaaguaccagguggcugccauguugcccaaauauuuccucccuuguacagcaucuaucuccacaugggucucaaguccaccucccuucuuccuuuccccucuuagaagcaaugggauuauugcagccuagaggcucagugguagguccuagaggccgagggaccaugugauagagccuggaaagagaccacccccugaauccugcccuuuguaguuggauguuuuuuccccccacaacuagauagguuuacuaucuggcuguaaauauucuagggaugcaacaguugugggacaugguaugauuugaauuuucaggguccuuuuuguaguugccagugaauaguaagugaaaucgcagaauggaacaucauucaucaaauuuaauauuucuucuuuggaguuuaacagaaauaauguggauuuggggacuuucagagugauaagggacuuuggagauccucaugggcagugguuuuggguaccucaggguacgcugagucauuugaggggagauccugacuuuauuaaaucagaacuccaccuuuaccugucuucuauauuuauacuuauguauuaggauuacauucucuuugagaagaaaaaagugucuggauuuguuuauucuuucauucaaaaaaaauuuauugacagcuucugugugcuaggcaggcaguacuccaggcacaggaaguaccauaguaaauuagaaaaaauagauaucuauuuuaauggaguuuauauucuaacaaaggauggggggacauacuguaaauaaacaaauauauaauauguugggaggugacaggggauuuuauaaagcaggguaaagcaagagugagaacuuagcacagcagguccucaaauaacauugauucuuuucauuauaauguugaugagaaaaaaaauugauuccuggccagggcaacuguguggaguuugcaccaucuccucauguaugguaaaauugcuuucauuaugcaucgugucacguauuuaacugaggacucacuuguauguguaugcuuacgugaugcuuuauccaggguggguuagauaaggcuccucugaggaggugauauuugagcagaaacuugaaggaagcgagggagcaagaaauacagauaacccggaggagagcuuucaaggaaaggggagaacaaguguaaaggcuuugaggaagaaggaguggcaugguaugugagcaacacaggagauguuggcggcuggaacaaagccauugaggaggggacagagaguggggaggggccugcagucacuuuaacugagugacgccagaagcuuagaaacagcagaaagcaacuguccaaagcccucauuucccaacugaaaguguuuuugaauuuccccaaggucacccagcugauguauaaacaagagcacaucuggagcucacguuauauucuuuuaaaguagcuucucauuguaccuugugccaccacuccaggucuuaggagacauggggcaucuuuuuggagacaagauuugugucuccuuuccuguuaguggguauggcuccuccaagagaugugcuucaagacucuacagaauuccagugcccagucaucacaaagugggaaacggcuuugccagugccagaaucaccaccauuuggggaauuauuuuaaccacaauggcucauguuuaucacaggcuuacugcuugugauguuuguuguacccagagcuuuacaugcauuaacacaucuaacccucacaacaacucuguauaauaggucacauuaucauuauuuuagagaugaggaaauugaggugcagagaaguuaaguaauuucuguauggucaugcagauagaguuguagaguugggauuugaauuuagacuauuugcuucagggccugcacugagccucugacaaagaggagggggaugagcuugucucuagauaaacuaauuggaauaugcuccccucgccuccauuuuaagaugguucuagguagggccuagccuugggaguaauaccaacuugucacaacccacuucugugacuccagguguuaguuuguguagaggauuucacagccagucuggcucaguacuggcaacuuugcugauuuuagguggauuccugauucagcagguaccuuuggucuuucugagcugaguuugacuggagcguuuuucaagaccugcaugagaguguguuacggaauacaggccaguguuuucaagucagcggacccaguuuuagcuggucugucuuuuuuagccccagugaaguaaaagccccagacaccaccagugcccauaauccauaggaauguaaaaucaucuuuuuaguacuggugcuuuugaggaccaguacacuaugugcuugcuuuaaauuugucuaaaaauguaugcauauguagauauguguauauaugacuaugaaauauuuucuagguauggaaaaguauaaagcauaacauagccaacacccauguacccaccaccaacuuuaaaaaaccuuaugacuuuacuguaauuuucuuaaaauuguagguuauuuuuagugagcaggaaccacagucaaccguaaguuuuagaguccaggaggcucaaaccuggccacacauuagaauacccuggggauacccuggggagcuuuaaaaaaguccuuguaccucugggagggugcaggaagcccccaccucuaucaucagaauuuuaaaaagcuccccaaggcgaggauucuaucaugcagucaggguaagagaccugcuguuuggaggguuguguuugguuuuucuucacuggguucucagaugccugguaccaagccaugugugguacuccuggacuuuauauuucauuuucuuaaagcauuuuuuaaugugguucuacuuucaagauucuggaggguaauguccuggggaguuccucuccuuagacucuucccucuucagcaccuuaugaggcaagcugcggauauauuuacauauucauuacaaagcauaagcaucaggaacuuagagaguaggagugaggcauuagagaggggacuaagaaauucagaaguauugggagcuacugucuguugaaaguguuugagaugagugaaaguuauagcauuaccuuggaagucagggggaugcaggguuacauuuagaaaaccuggagucacacauaccuucacaggaaggcucugagcugugggaugguaguugagggccuuuuuggucuacaucacagguuuaucagugaaauaugugguaagauguacaaauaagaugugccccaccaccagaaugaucaguucuguguggacacguccgugacuguacccucuuucagaagugcuaucaauuauguguuauguguggccugauuauccucugugggccuuggcuccaugcagcaccuccauccccgucugcccacucauucauucaacaaauaguugcugaguuucucuucucuaugccagguucuguucuaggcacuugggauaaaaacagugaacuaaacaaagcuucugcccucaaggaaugacauucuggggaugugggggagaggugggugagugggugguguuacauucuggugucgcauuguuuuuugaugugucuaacacagaaaaagauguguaacuguaauccuccuuuagaaagcucuaggggagccauuuggcagguagggaaguguuuugccuaauuuggcuuaaauuaugauuuuuugauucugaggauuuugauuacaaaugccuucaugaaucuacuucuucaagagaaauuaagugcugagacauuaaagcuuccagggaccuuuugaauugguuggauuuuauuagcagcuuaaaaugagcaugacauacaguaagguucaagcuuaggggagaugcugaagaaauaaggauacuugauuuucuuuccacuugaaguggaauccacuaauccaucugugcucauaaauuugagagaaggagggcggaaaacgaaaguuuauuucuagggcucucuacugggcaaggcuaucagguuaccuucauugaaaagacuuaaucagaagugaaacuuaaaucuguuacagucuuccacagcuguccagggaauugggcacugaugaauaccgucagauggaccccugaauagagggaaugccuuagaggucauguuuggaguuagucaauaaaauggaucucgagaagaaaauagaaaguuugagggaaaaaaauuacuggaaaagaaaucuuaaagcuuuuggguuagauguuagauggaugacgaaaacagugggugauaugauuuccuuucuggauuaccaucuucaucagauauuguugucgacuacagaaaaaauauucccagcacguaaggacucuuuauaccugugagcucuuaaaaagaaucaucuaaaauacuaaaaaagcaagaauauguuguuucacuagcuuuugauuccuaaaguagauuuugacuuccgggugugggaagguggguggaaaaugaguuuuuguuaauauucaaaggcaugaaaacauuuuuaccaguuuauguuuuccuggugcauuuagaaaucuguggauccuuggggaugguguaugcaggcaaauagagaauccaguacuugugaaucugccugaauccacagguuugggaauaagggcagggacuugaggguucacagaugugaagguuguacacagaacucaugcagagagauacaagaucuuuuuguucccccuuugauuagaaagaauaggacaugaaaguacuuaauugucaacuucgucuucaccauaagcccaguauugaugcaaaaaugauaauaauaaugagaacaagcauuuauugaguauuggguauucuaauugcuuaaaucaacucauguaauucucacagagugguucuaugagguuggugccguuuugauuccuguuuuaaaggagaggaaacaggcacauagaguuuacacccaaggacgagugugucagugguggagccuauacauucuggcuccagaacccgacuugaaccacuacauaagggaacuaaauaaaugcuucuuaagaguuuuauucugauguugcuuuuacugggacuuucacucuuuuuucuacccaacccaccccaccccuaccccacucgccuccacuuuaucuuuggaugucuucagaaucuauaauauaucuuaagcuugcaccuuauuacagaugagaaaauagagagcuauaaaauuauguuauauaauuguucuguaugaccuagugaaucuuugguagaacagggauguggaacccagguuuucuaauauuuaggucacugcuuuuucucacugcacuguauggcuuccauuaaaaauauuuuaaacuaacugaacuaaaaauuuauaaacuuaauuugugucacucauacuucuguggaugaacuacauuaaaauaacuaggugcugugagauuuugcucuagggaggagggugguagacauuuuaggagcuaacauuugccucugggguuauuugaccuccuccugaggaugucuuucuaaucuuugguaggcguacuuaaaagugaggagaaaguauuugaggaaauacaagagccauucgcagacuuuaguaugaucuguggguuuauggaagggcuuuuuuuuuucuuucuuucuucauuuaggccuuuuuuacuuuaaccuccaguggggacacaacuaacuuaaaucuuaaaaacaaauaaacaaacaaaaacccuaaauacaagccuucuuucgcuauuguuuggcaaauaagauuucacaagaggguagaaagaacugccuugauucuugguguuuuagacuuuccuauagucuaguuuuuuguuuuuguuuguuuuuucuuuugguccugugauuccuuuuguuguuaccuguuuccuuggcuaaugcuuuguuuaaaaacaagugcucugguauuccaaaacaaauuuccagcaggcuucccgauuguguucucagauaaaagaccccaggguagugcuuuaacuugaauuuugguugccuaugcaugccugagagcaaaauucaguuuacuagguggcuuccaacccagauuaauaugguuauaucuaaaacgagggaauauacauuugaaacaggaaauguggauuggauuuacccuuucaaagagcccuaaugugaauguaaugaguagaguuuugucugggguuagauacugugggcuccaguuuguuuuugaguuuuuagcugaaugaaugacuuuaguccugucauuaaaccucuggaaauuuaaacuuucaacaauguaauaaugauaaugaaaauagggaaaggcuccuagacugugcuguggaaaaacacauguucagauuuuacugaagacccagaaucccauguggccacagauaauuugauuucacaguuucuauuucuagauauacaggaugggguugccagcagaaguuacauagugauaauaacauaucagcuuccuuuuuagggaagauauuguaauugugagaaaaauauucagaaaagccuuggccaaauauuguuuguaguugguaagagaauacucaguuauuaaagcuucugcgaaccuuuuccaaauaauuacacuuuuucccuaaaggaauccucccaccucagccuccuaaguaguugggaccacaggugcucauuaccacaccuggauggguggauggauggagauauauauauauuuguagagacggagucuccuuauguugccuaggcuguguuacauuuuuugucacacauguuggguauggagaauuuggaguagguaguuucagauuugcacaucacaaguucuugccuugugcagugguuucuaaaccgaguugcauaucuauacuccaugguaacuugguaaacauacugauuccuggacccugugucugaucuacuaaacauuaaucccugcucuguggcucuggaacauuaguguuuuguuuucuuuuugggguuugugacagggggacaaggucucguucugucacccaggcuggaauguagugggacagucaugacucacugcagucucaaacuccugggcucaagcaguucuccugccuuagccucccaaaaagcugggacuaccaccaccacgcccagcaauuuuuuuuuuuuuuuuuuuuuuuuugcagggguagagacaggguuucaccauguugcccaggcuggucuugaacuccugggcucaaggaaucuagcugccugggccucucacagugcugggauuaugggugugagacacugugccuggccuggaacauuaggguuuuuuguuuguuuguuuguuuguuuuuaacaucaaguuccaguauagaaguuucagaaacacuauuucuuaaaauauuuuugaguguuuuccuggggcagugguaauggugaugguuuacaauaauuuauuucuaugcuauguaacuuuucugaaaagaaaacauuccuguguauuugguuuuaaaaccuuauuuacuguaaaauagaacacauccuggaaaaaguguaguguacagcucaaugaaugauccaaugaaugaucacaaagugaauacccagguaaccaguacucagguaaagaaauagaacauugcccccuccccacaaaaaaugauuuuuauuagauuccucaaauuuucuuuucuauuccuccucaaaucccaagaaauuagagauauaaguaaagguugaugaaacaauauaauaagguguaagugaaaaaagcauugucuuuugguaggugguguuucuuaauuacucuuuucaguaaguuuuuggugauguuaaguuuguguuguuuaucuauguuuugauucagccuuaagccaguucuugacagugacugucuauuaaugcucacagcugauauuaagauuacguucuaagaucuaucuuuucugcaaucuguuucacugaaaauauucucaugauaguuuugaaaaugcguaaggacagauuaucuucugacucuaauaaacaagugagucuugucauuacuguccagguaacuuaggaaaccugucucaguagccagguaucuuuaucugguacaugauaaaaugugguuucuuaguuuuuuuuaaaaaaaguuccuuccuccucucuauccacccagaauaaucucuccuccauuccaacccaaucagaacauuuaaagcccugaugguuuuucuuuuuuccacugaagaaucauucaauucuuagugagagaaggucuagcuguauuaaauagcaagcuugcccauuuucuuuggaaagggaugcucaugguaaaaggaccucaagcaaacccugcacuuaagcugugugcaaguggagggagagagcugucugcagccaccugccagcagcuacacaucugugcucugcuagcaagcaugugggcucuguggaugugagagcugcucccuuuccccucucugccucaugcucccccaucuuagugaucgccacuaucaacuaaacaggugacaagacuccaaucacccugcucugaauggcucuccaucuucccaaaaguauaccagaggccuguuuuguuucaguacauugauuaaauaaauauuccugugugcacaaaggaacugaaaucuguuauggcacucugcaguuaucuguccauuaauaguggagaaacuacugccaguuuucuccccucggugcccccgccccccacccccuuucuugucacuaccacgcagauucucaaaggugccaguaacagauaaauuaucugaccucugcuuucaggcuugugugaagcgggaggaguggugucaugcucuuuggugaggcaugccguuggggcagugcccaaguguauggauaauaggagagcccgaaugauuuagauuagaagaugcuuucuugcuuugggguugugggaccuuugucucuccccuucaauucuuagcagaagcggacucagaaaggucuuucaaauuagcuugccucucuuuuauaggaaaagggugcuucuggcccugaaguaguucugugugucuacugucagauguggaagccacaaagugccugugaaacuuggucccuugcguuuauuuacaaguuucuuucaaauggcaguggcaggaaggaucuuuaccauuugggcagauagcccuagugguugaugggagggcuugguggaagggcaggcuuugugaaagauccaaguguggaaugguaggaauucuagccaugguggugcugacugguuuccuuucuuuuuuggcggggcaggggcugggguggaguguugguuaaaagaacaccuagauaaaaaacaugacggauuucgaaaguguuauuugggcugcgcacgguggcucauaccuguaaucccaauacuuugggaggcugaggcuggaggaucccuugaguccagggguuugagaccagccugggaaaaacagugagacccuguucuauaaaaaauuuaaaaauuagcuggaugugguggcuuacaaugguaguccugucuacucgggaggcugaggcaguaggaucaccugagcccaggagauugaagcugcaguaagcugggauugcccacuguacuccaacccgggugccagaguggggcucugucucaaagaagaaaagaaaagaaaaagacagggaagggaaagggaaggagaagaaagaaugacaauggaacauaggaaauuaggguuguagagaagacucuaugaacauuauuguggugugaaggaauggcaugcagagauaagugugauggaagggagguguugaaauguuuacagcuccuaacaucuaccaccaaggagggggcaccccuuugacagaaacgagaggguguuccugaguaguugugacauuaaaaaaaauugcagggaaccuuguagcugcauggauggcagagacacauaaguagggaaaaauguuggaauagguaaagugaaaucucuuagugugugugucuuccaacugacuguggguaauuaguuggaaaugacauuaaccugagcuuaauuguaauuuugcauaguaacaacauaccagcuguucacuguauucuuuccuggaggugcgauuuaauuauuauuauuuuuuuuugcuaucuuuuaagcuccaauuuucuguuauguuuuacuuaaaccccgccugguugccguguccacaguccccacaguuuagcaguaaugucauuuuuguugcuuucaugcccacugugugcugagggcuugggaugcucuugauuuugcuaaugacuuggauuuauaaagggccacauuggaaggucacugagaagcaugggugauuggaaaccuuguguuuugggcucuuccacaagguuuuaguuuauuauauaaaucauaugcauaauucuaggccuaucagaggugcucaaaguaucaagugaacaagcugaaagagaaguuaauuacugaacagugauuguucugauauaaccaauuauuggaucauuaaauguuuauuaccuuuuauaugcuccuuucccccauaagggcaguuucuuuuuuaagucauuaaaacagaaaugggaucuuaaaaaaauucugcuuaaaaaauuuccacgagacugaaguauuaaaaaggucuugugugaucugacagcuaaauagccuguuuuucuuuggucuguugaauuaguaauuaaugaaauguauugccugagcagagaaaauaagauuaguuuuguuuaggaagaaaacaaaagcaaaacauuaacccccaaaugcagguuaauauuaaagugcaguauaagaaauagaaauaaaacagucuucuugaaugauaagaugccuaaugguaacauuuguuucauucauucauucgucacuuucuugagcaccaacauuauguuuagaaggaauggguuuauguaaauacagaggaggcaaggugcccuguccccaaagacacauggguuagcagagcaguuaaaccagacacuuuaggcggccaggcacaguggcucacaccuguaaucccagcacuuugggaggcuaaggugggcggaucccugagguugggaguugaaaaccagccuggccaacauggagaaacccugucucuauuaaaaauacaaaauuagccaggcgugguggcacaugcuuguaaucccagcuacuugggaggccgaggcaggagaaacacuugaacccaggaggcggagguugcggugaacugagaucacgccauugcacuccaaccuggacaacaagagugaaacgccgucucaaaaaaaccccaaaaaaacaaacaaaaaaaaacaauaaaaaaacucagacacuuuaguagcuacuguugcaauguagaaagugguaggauaauagguacaggggcauuucuuuggggaggagugguuaugaagacagguuacuucuggaggcugaggcauccuguggauuaagaguaggggagagcaugguuaugaagaugaaucuugcuuuuugaggucacgguguccuguggauugaguagaagccccauuacuuggguucacagcccagcuuugccacuaccuagcugugugaccauuuaucucaguuuccuuguguauaaaauggaauaauaguaaugcaacccucacagguuugaggauuaaaugaguuauuauaugugaagugcauauaacaguuuacagcacauaaugaacauuauaaucuuagguugugguuaugucauuuuugugggauaaugugauagaacuucuuaggggagauugcauuugauugaaugaugaggagcggaaagauguuucaggcauuucuuguauugucccauguagccacauaccuaauuuauaaugccugcaguaaugugucgguaaugugugcuuauguagugccauugucaaaagauuacaaagggcauuuacagacguuuauucuaagaacaguccccugaaacgagaugguuuaugcauauucuucugaagugugagagggugcagagcaagcccauccuguucuuccauugaggugugcuuggagccuguguuuguuguggguaauuuagacucacagagagaggaaacuuuuaaaucuuuuaaauuauaucuuaaauucuuaaguuauauuugcaaacaaaugugguaaauagauuuuaaaaauguuuucuguagcuucuagcaauaguggaacuuguuuauuccugagguaccagaucauaggcaguugaauuuagaggaaguuuauaauaaugaacauuugucguaacugugagguugccacucuguauuaguuuucacacugcuaaaaagaaauuccugaaacuggguaauuuuauaaagaaaagagguuuaauuggcucaucauuccacaggcuguacaggaagcauggcuggggaggccucaggaaacuuacauggugaaaguugaaggggaagcaggcgugucuucauauggcuagagcaggagaaagggagagggggagaugccacacuuuuaaacaagcagaucucaugagaacucuuucacgagaacagcagcaaauggagaaaucugucccccaggauccagucaccuccuaccaggccccacuuccaacauuagggguuacaauucaacaugagauuugggagggauacagacccaaacuauaucuuauuauccucauuuuacagugaggaaaccgaggcacugagauguucaggaguguugcugaaaucaaaaagaaguguugacccaggaucuaaggucuuuauugcauuugcguaaaccauuucauuugauuuguguguuuuacaauaacccuuugagaaaggucagucagcugcuacgugcauuuugggaaguaucguuuaugagaaguugguggggcaucacagugagcuuagcauggacugaaaauuuugggguggcuguuguauacccuuuugcuacuucaagcaagacacuuuugggccucaagaucuauaaaauaacagaguuuggaggaaacauugagucuguaaacuaugaaauucuuguguagcuuggagugagacccaugugggaaucuuuggcagccaccguuuaccaccuuaacuuuucugagcauguuuuauuauugguaauauggagcugugguacucccuuucuucagggcuguuuugaacauaaugcuuauaaaauaccugacagaccuugcuagcucucagccaacggaggugggauucuuguuaauuguuucaaacuaggggucauacagguagcugagccugggugagaaguccagcuucuuaacuccucuggggcugguucucuucagcacccaagccauauugcuggggauaaggaagacauuuuaaugagaugagccccaacuucucauuagaagcugcaguccugauucuuucucuagauccuaucagguugccaguugauccaguaaguaauguaguaaauguaauggauccaguaaagaguuugggguuuucauggaguaauuuccuaaaaucaccgcagucaguagccugugagccacaugagggcaggggacuugcucucugugguguucaccuuguauaaugcaaggugaugggacagcuggcacauaguucggagucuggcaguauuuauuuugugaaggaaggaaggaaugaacaaccucagugagcuguagaaaaugguaugagaaagggaacaggauuuuuaaaauuucaguuuugugggacagaggaaauugaggcacugaaucaggcagguuaugcccagucucuguggucaccaggccuuaaaauugggcauaauuuauacccuugaagauguugcauggcaauaccuucugguggguggaucaccugaggucaggaguucgagaccagccuggccaacauggaggggaaacccugucucuacuaaaauacaaaaauuagccaggcguaguggugcacaccuauaaucccaucuacucuggaggcugagacaggagaauggcuugaacucuggaggcggagguugcagugagccgagaucgugccacuucacuccagccuaggugacagagcaagacucugucucaaaacaaaaaccaaaaaacauauuucuauugugaaacaaaauuuuauccaugucaggaauuuccucugaacuagaguauguucauuccucuuuugugauuugagucugugggagucggaacuugucaggaagacuuaguguagcugugcuucuaaggaugugcuauucucacaggcagccgugcuaaccaucuugcuguaaacuagccacgaguaaacgucugguugugaaucacagcgugaccuuucagggaaaacaaaacaagcaaaccaccaaacacaugaaucagauuuucuuuaguaucaggauuguaaagucugguauuuaacaguuugucaggcccacuuggagcaguugagacaacuuccuuucucuguuuuuguuuguucaagauguggaaguguauauccuucuuuagcaacauauuaggauaaaaacuuuaaaguuuucuuccacugaguuaaacuauauuaguuuuccuaacugucauggacuuuaaacaauuaaagauuccugguuaccacucaagaccuacugaaucagucucuuggagugggacccagaaaucuauucugaagagcacccuaagugauucuaugguuaaucagauuuggaagccacugagauacagaaugauaauauuguauuuucuauccacccauuuauucuuuuuuuuuuccuucucugugguccgaauauccauuuguucuuacucauuuauccacgucuugaguagauuagaauugauuaccuauagggcauuggucauuuuaagaacuaggcguagaaacaagagguagaacacaaugccugccccaugggguucacagguggucucagaaguuuuuaacuuuggguugaguguuaaaggauucacauacuucccaaaagccaggagcagaagauuuuguguacacacuuuuuuuuuuuuguuuuaagcuuucaucagauucuccaaggggucagugacccauaaaagguuaagaaccaaggucuugugcuugcacagcuguucuggaaaaaguagaagagggcaguguuucuguugccacuuaagauguuuuugaccuuuugagaggcaacagcgguuugaggacuguaccuguuuucuguccuacuuaaaauauuuaaaaagaagaaaaaauaguuuaacaucugggucagggucagaacaagaccaagggauauggaaaauaguuauuucgugaacugcaucacauuuaauguuaaagagcugcugacagccaaacagccuggugguuagcgugauggaggaacuucuuaagcuggauagcauaggcaagguucauuccaguuuucuuacaguauauaauuagccaaauuauggauaacaauuuucaccccauggauauacauaaagacuaauugucuuauuuuuguuccauuuuagccccagcauguccauugaauugcuuaauuccaaaauaacuuugccagccguacagcugauacauucuucuuuaucuucuaaaauccccaaauaacacuguucauagcaaaacagaguuggauauuaagaaagaacaucuuuaacugcuguggaaaguguuuacuuuguaaaacacuagaaccuuguauguauaauguucuuaucccuaaggauaacuuuauaauugaauuucaauuaaggauguucucuuccuuuuccuccuccucuucucucuaaguuguacucauugaauucauguuucaauggggaacaaaaauuuuucaaauauuguuguucugguaaugcugcauuuuaggaucuggagagggcagucagugggauuaaauguuaucaaauagguuaaauuauuuggccauuuacuuugguauaguuccucuggagcucaggaggauguuagaggucuuuguugucagugaaaucuuguaaauguauuuuuaggcuguucaaaugucuggaucaccuauuuugaacuuuugcauauaccaccuuacauuacuuauuuuuauaaaguggacauuuuaucuuuauaagguuuugccuugcuggacagugauuauguguucuaggucuuuauagcuuugccauuacccggcauacugagcacauaacagacacucaauaaauauuugauuaauuggauauguugauuggguacccaagaaaccagaagaugaaauaagucuggaguuagaacuugauacaugcuuagaaagguaggaacguaaaaguggauuaugaggucuaucucuuaggcugacgugcucuccuuucuccuuccccaucccucuccacccccucuccucccuucucucuuccauccugccucuccucucccucccccucuccccucuccccucuccccucugccuucuccccucuccccucuucccucucuguuuucuuucucuuuccuuucccuuucucuuuccuuaauuuucuuuucuuucuguucauauauagguaguagagccagcucacguuugcuaguucuuuaaaaaucuuaaguauuuagaauuccacaguuacaagaauuuuaugguagagccacaacacuaaguuuucauuuggaaaauguuaaauguagugaaccuugagagagguuuuuauuaguuauugcuuuuauuuauuuuuaaaauaaguuucauuguguauuuguaagauauauaagauuauaggaugcauagagauaguaaaaagguuacuauauauagugaagcaaauuaacauauucaucaccuuacauaggcaagagcagcuaaaaucuacucauuuagcauuaaucccaaauacaguacaauuuuauuaccuuuaguccucauguuguacauuaaaucucuagaccuguucauccuacaucuccuccauuuccuuccuaccccuaguaaccacuguuuuguucucugucucugaauauuugaaaaaaauuuuuaagauuccauauauaagugagaucaugcaauauuuuuuuuucugugucugguuuauuucacuuaguacaguguccuucaggcucauccacauuuguggcaaaugguaagauugaguuuuuuuaagggcucaauaauauucauacacacacacacccacccacacacacacaccccccacaguuuauccauuugccugucgacagaugcuuagguugucuccauaucuuaugaauaauccuucagugaacaugggagugcagauaucuuuauaagggggagauuucauuucuuuuggguaaaugcccagaagagagauugcugggucauauggaaguucuauuuuuaauuucuuuagaaaccuccauacuauuuuucacaauggcuguaucaaacuacauucccaccaaccguauacaagaguuccuuuucuccacucuuuccaacauuuguuaucuuuuuacuuuuugauguaagagcuguccuaauggguguguagugguaucucaugaaauggcauugauuugcauuucccugaugaguaaugauguugagcaccuuuucauaugucuauuggcaguuuuauguuuucuuuggaaaaaugucuauucaggucuuuuacccauuucaaaaucagauuauuuguuuuucuacuauugaguuuugugaguucuuuauacacuuugcauauuaacuccuuaucagaucuaguuugcaaauauugucuuccaauuuguaggcugccauuucauugguuauuucuuuugcugugcagaagccuuuuaguuugcugcagccccauauguuuaguuuugcuuuuguggucugagcuuuuguuauguuauccaaaaaaaucauugccaagacaaaguccaggaguuuuuccccuguauucucuucuaggaguuuuauuguuucucguuaguuagugcuuuuaagaaggaaggaggccucaccagacuugauuauuauuuuuuuuuuuugagacggagucucgcucuguggcccaggugggagugcaguggcgcaaucucggcucacugcaagcuccgccucccggguucacgccauucuccugccucagccucccgaguagcugggacuacaggcgcccgccaucacgcccggcuaauuuuuuuguauuuuuaguagagacaggguuucaccguguuagccaggauggucucgaucuccugaccucgugauccgcccgccucggccucccaaagugcugggauuacaagcgugagccaccgcgcccggcccagacuugauuauuaaaagacaucugcuacucaaauagaugccacccuuaaucuguccuaaucaaguaaaaucuuguuaguuauauuuggguagaggaaauauuguaggcuaaugaacaguggcugucaacaguuaucuugaaaaucuagacuuguagccuugaaggagagggacccgaacugugaagagauuugucacuaaccaugcuauauuggauguaaaccugggagugguuacaggagguggcuuaggguaauaugugcuggcaucuuuaaguauuucgggaagagggauuuagauccaaguggucacuccuacucccauuggagacgcaauuuggcauuguguauaaaagaagaguuuuucuaauagugcuguguuaggguccugaauuccagcugcugccauucaaacaggcucacuuaacacucaccuggauuauucuaaugggaauucaaacuggguauuggugaccuuugagggcucucccucccaaagagacuaugagugugugauuuuucagggcaaaauguucuaaguaaaucaagucaugguucaaagucuagauccgcuccuuguaauuuuuuuuuuuucuuuuuaaagaacucagucuugggugcuguuuacuucauauuuaagcccaugguccccauguguauugaacuggcacaaacuaaacuugucugcuccucuaggucucuucucauagucugaguucuuaaaauuaaggucaguuaaaagaagcaccuuggcauuuuccuuauuggaguuugcuguguguuugcaaaucaaaaugggaauugauucagucauuugggcuauacagguuuucaucucaagucacuuaagugaaauccauaaggaaagauguucaugcuuuaccuaccauagggcucacucaccucuuuucuuaaauacaaaacaaaaagcaccugccaguuuuaagggacugaaaagguguuuuaugauggcugaaaauacaucugagaauaauaauauaguuauaccuagacuggugauacaucauuacaguaucugcggggaaaaguagaggguggaagucuguauguggggucagucuuaacaaggaaagcugacaugaaugcucuagcccugcaguaccagagggcaccuggauuaauguucugggcccuaauucagcguccugucucucagacacuuggcacugauuugcucaucucagagcugaagucuuaaggacuaagaggagagaggaacacaucauuuucucugccagaggagguacuuaaacugggaaaggaggaggagaccuuaacaaaucaagccuuggcaaggaaaucugucaugaaucagcaaugccuuggaaagccucuuucgcuguauuuuacaaagcuaaacacuugucgcuacugacauuucucuauugcuuaccuugaggaucagcuuuagguagcacuaugaauggaaugaauccuuuuuugugugugcccauuuugacauuagguaauuaauuuacaacuagcucaauuagaguccagcccauacaguguguacauggccuuuuaaagagccuuuguuuugacgcuaauugaacugguuguagcagagacagccaaacaauuugcauucaucuuuggcagaacacaagggcucucccuugguauggacagccccauuuuuuauuccuucuaccaagucuggcacuaaagugaugugugcuuauuuuauuuuucuaauuuaaaaaaacuuugaagaggacaaaagccacauagguuuauuguagaaaaauuggaagacauagauaagcaaggaagaaaauaaagaucauacauuaucuuuucuucuuaagacggagucucaaucugucgcccaggcuggagugcaguagagcaaucucggcuuacugccgccuccaccuccuggauucaagcgauucuccugcugcagccuccugaguacguagcuaggauuacaggugugugccaccacacguggcuaauuuuuguauuuuuuguagagaugggguuucaacauguuggccaggcuggucucgaacuccugaccucaagugauccgcgcccccccccccccuuggccucccaaagugcuaggauuacaggugugaguccccacaccuggccuggagcacacauuagcuuaauaccaagagaaaaccauuuacaaccuaguauuuuucuuucuauaccuuuucuguauaugagggaaugcaugcaccuguguauguaacuguuuucauguguuguuuuuacaaaaugggaacacagcauacaaacuguuuuguaguaugcuuuuuuuuccuacuuaauaagauggaagugccuugucauuuuauaaaauguuguccuacaacauuuuuuuuugagacggagucucguucugucgcccaggcuggaguacaguggcgcgaucucggcucacuccaaguuccgccucccagguucacgccauucuccugccucagccuccugaguagcugggacuacaggcgccugccaccacguccggcuaauuuuuuguauuuuuaguagagacgggguuucaccguguuagccaggauggucucgaucuccugaccucgugauccaccugccucggccucccaaagugcugggauuacaggugugagccaccgcgcccggccuguccuauaacauuuuaaaugucugcauaauagucaauuguguggauguaccaaaacauauuuaaccaaucuguuauuauuggacacuugagcccuuuccagguuuucgauguuauaacuagccuugugauauauauucaugcuacuaaaucuuugugaagucuuaauuauuugcaaccaauaaauuucuagauauugaauuacuuggacaggggcaugcauguuuuaacauuuuuuaugcauacugccaaauugcaacaauuuccacuuucaguaaugacagcuuuauguuuauucuugauauucaggaguacaguauagagaguauugacucagaaguggauuaaauccugaucagugauuuugcuauugccccugaaauuuacgucagccuuauaaucuucuguucccaguaucaggugaaagaggccaguuuauaucauauaguacaauauagguuuacuuaucuugacuaauauguguuauuuaguuuugaaaaauuguagaauaaaagcagguagcugcugcuguaagacaaaagugccuuuguuuuucguaaggcaggauucugaaacaguguuuucacuaugaauaaggaccaaccuaaauaaauagaugaaaaucaaagcgauaguagaugguuuugcuaaguauaugaaaaaaauauuuggaucuucuugaggcagugaaacccaagacuggaggagcaagaugaacuguggcaucuuguaucagggguggccuuggagaggcuguuauaccucguguauguggucuaucauugacugaacauuuguuaugcugcucaugauuguauuugcagcaccugaaagugcaguuggacaaauagaugcucauuguugacugaaugaauaaaugaauagaauagauacacaggagagugagauuucagaaaaagaccuuucaggucaucuaagacccucccccuaauuuuauuuuacuuuauuuuuugagacagguucuugcucugucacccagacuggaauccaguggugcauucacaacucacugcagcuucgaacucuuaggcugaaaugauccuccugcuucagccucccaaguagcugggacuacaggugcaugccaccgugccuggcuaauuuuauuuuuuuguagagacaaggucuugcuuugcugcccaggcuggucucaaacuccuggccucaaucaguccuccugccucagccucccaagugcugggacuacaggcgugagccacugugcuuagcccauccaguuuucuaauuaaagacauagaaguucagaaagaugaagugacaucuuucucaagacuaaguuaaugaucacagcagaaguuguaguucucuguaucaauguauuucugagauucucauaguacuagaauuguauguuuuucccuugauaugguacuuuguaugauuaaauuucaaaaucaauaguaaaauuuuaauuucaaaugcaguauaagcacaauuucccuaacuccucuuuuuuuccucuguuuggaaauagccucaguuuuuguuaaaauucaacacagucuuaaacuugcauuucuuuuuuccuuacuuucuuucuuucuauaauauuuucaccuauccuauuucauucacaguggagguuuuaauuuacuucaagcaguauugccaucuggaugucaaaagacauugaauugacuucuuaucuguagaucccaauaaaggucucaccugccuagaaacaaaagauuuagucaggaauugaggaggagcaaagcaaaggcuucaccagaggcccaggugcuaccuaucugcccacuuguucuuugauugacaguggggcacagaggugccuuguguuucucuaggaaguagcuuuugcauacaguguuuguuuggaacuuuucaauuugcuagugcugaauaaugucugcaguaaaaguugguuuaggguaaacccggagaaaggaauuaaagagaaguuuuaacauuucuauuguuuuucuucugugacuuuagccuuucccccuucuuagugaauuauuauagaguuuuauuaaaauguaaguucuggaaauuagacaccaugguauuuagaccagcaugggauacuguacucuuagguuccauaauauuucauaguacaucucuuuauuguauguuaaaugauagcgaaguauaauaaaaugcaccuagagaguacuuaucuauuuuauguccuguaacauucaguacuugaugcaaauguagcagaucucgauucaaacaggagcaaaacugguuauaacucaagagaaaggggauaggcucaucuugauggaaaguucccuguugguggcauaaguucagcaaaaccauagaauuugaggcucuaagggaccuuuguaacaucuacuccaaucuuuuauuuugcagauggggaaagaauuagccacugguucagugucacucagcagguuaaagaaagaccugugggcagaaccuagaacuuaacgccugcucugcugugucuuuucauuuucugaucacaauugaagcauguggucuacccugucuuuaaaagagcauaccauuugauguuuguuagcuugaaaccuguugugcccaagggcaccuaaaggcuuccgucuugcucccuuuuccuggaugcccaggucauucugugccucugaggguggguuuggauauggcugaaaugaaagcuguguuguggcagugcuuagagaauugucucugaugauaggacucuuuuaagaaagcagugaaaaagcaguaaggagacuguuacuucauaaaacaauuggcucuggacuuggagaagacccagguggcggaugguuacaucccuuggcagcagcugucuuugcuauaucucuuacagucuuagagaucugggagucuuuggcucuuaauuuuaaccuagauucacuguaugaucuuggucaaacgccucaccucuugggccucaguuaccuuguaguaaauucaaggggaguuaaaguggaugauuucuauggcaacuuccaggccuugaauuauuauuuuuauaaaaguuuuuccacaugaucaaguaaccaaacauguauugcugacaguccauuuuauuacuguuuugauugguuuucaugagaauuuggaaaaugucugcagacuuuacugugaucaggcugcuagcaauuauuuacagagcacccaucaaguguucagggcuauaaaagaaauagugucuagcuucagggagacagaaagacuucuugaucuccccagccggggauggagggcauucucuuccacuggauuuaagcucugugagugcaggggcuuugucucucuuaaguagugcacaguucaguaaacauugguugcauuaaugaaagaaugaauccaguugucagucuugcuuauauuuacugaagauaucccacugagauuuauugguuucuucaacccguaaaugcugcuaacuugaauacauuucccagaaaguauuccuuaccuuccauagaaaaaugcggccaggaugcucugaggcuauagggaaaaaccauaaauauuccacuccuuucuugaaauucaauuuaauauuagcauauugaaugcccugagauuaccugccuucaaauauuuugguuuaacccagcauuuuugaaauucauuugaccucagaauauuguucauuccacucucccaugacacacuuguuaauaucccccagaacuuugauuuguaaaauaaaaagguugauauagggaguaauaauauggaauaaauagaagcagcaacauuaguuaagaauaauuaauugaacacaauggagcauauacauuaagugcuguuccuagcagcucugugugaaacugugguagacuuguagauuuuuuuucuuuuaaaaaugacuaucuaugucucauuacagauacaagguugggugguagagagauugaaggaaguugcaagugaccuaauagcuaauuuacaguuacggaaguugaaugguagcauuuuaacuugugucaagggcugcccugucagguacugcaggggaauaacgaugaaagggagucugugucugcuccuucuggagcuggcuguccaguggaggagacagacauguaaacagauuauagcaauaaaguacucaaauguguaaugaacagaaauaggacacaggaaggaaugguauuuuccccugguuuagaacaggguugcuguucauacaauaagcccaaaccacauuaacuggaaccccucuagauccuccagacaaaauucuacucauacaucaagauucaaacaacucggccucuucaugcuuucgcugauccagaauuaauugcaucaucuauauugccugcagagccuugcuuacaccugugucauaggccuuaucauaaucugcuuuguaugugaauuacuugagggcaggauagaguugucuuugucccuguaucucuggggccugcaguuacagcauggacugcauauucgcugcuuuguuuagacuuggagcaaguuauuggacugugaaagcuacucacuuuaaguaaauucaguaaauaaaauuauguuuuauggaagacagauuggacagguggugguauuauuagcauuuucucucaaugcuuaaauaugauuuacauuucaagauuucaguuacauuuuuuaaggaauucaacaauucugcaucaugaaguauucuuucacacaaauguuccauagucauuaguuuuuacagaacccuuuucuuauauucugcauuucaucuggaauacuauaagcacaaguucaguuuggcauucuguucuccacuagugauugaguuugaagcccaaggucaggauauugauugaugacauuucccuuuaaaguauuuguauccauuugcaauuuggggacagagugauucccaguauggugcaggaaauaacuaaacuggaagucagccugacucaguuuuguaguuaauuuucuuugugaccuugggcaagucacuuaaccuuccaauaacugagggaguuggcccagaacuagcacagucuucuaaugcagacauuccacgauucucuagggaggauucacuuccauagagguuuaaaaguggauacauuuuuagguuaaauggcuuuguucauuuaguuuuuuucuccuuaacccauuuuggagcaauaagacugucauggaguaaaaccaaauuaccuggaacucucaaaaggcugcaguucuuauccuauuuuuuuuauuuuuaagggaagggaaaaaaauggcaacaaacaaauuuauauccaugagucaggacaaauccaucccaguuuucuaacauacacaguguacauaaacauauucaaugaagcacugcagauucuuaaccgaaaauggaauauuugguuugacuuaccauccuaaaugugggaagaacuguacuuugauauauacuuuuugaguauuuuuagcaaaaauugauauaagcaguugucuugguuggcaaggacuuguguauaggaaccuggcucccagcucagugacgaguguauucuguaacuuugaauaagucacugaaccuuucuagaugucaguguccucagcuguuagauuugauacuguucugauuacuaacagaucugugauuagacauuuccaugcauuuauuucaggccucuuccuguucucuuccuugagagauuaacaaauauacccaccccuucccucacacagucucaggcaauuauugauuugugagggaaaagggguauuuuaaaacacuuuaaaugauacauucaagaaaauuaucucguauugguuaucaauugauauauaacaacauuaccacaaacuuagugccuuaaaauaauacacauuuauuaucccacaguuucugugagucaggaggagucugggcacuucuuaguuggguccuuugcaaggcugcaaucaagauguuguccugggcuggggucucacuuacacgcuugacuauggaagcauaagcuacugagcccacugugauuguugguggaacuuauuuccuugcagcuggaggacuagagggacuuaauguuuuugcuggcuaggggcugcccuuugcuccuugaggccacccacauauccuuguaaugugugcuucccuaacauggcugcuggcccccucagaagcagcaagggagagaacaaggcagugcugcagucuuuuggaauguaaucacauaaucauguauacauaaucauguauguccaucaucuuugcucuacucugguuaaaagcaagucacaggucccucccacgcucaaggugagaugaucacacaagggcauugacaaccaggaggcaagggucaugggggccgucugaagcaucugucagccacaccauauuucagguuuuuuuuuuuucuguaucuuccuuuggaucugugaauaaguaucucacuucauacuaaagccucaauaaacacugauugacagaaagucuuugugcucauuuaaaacuucucagcuccacagaguauuuguaccaugcccuuguuuuauggaguccccagauacugaugagggcaggguuugaguuugagggcuguucauucuucugcccgccaaccccccaccccgcccccagcacagaacugccaguguuaggugcucauuaaguguuugucaaaggauuauaacuguuguuccaauugcagcaguaaguaaauuugaagaagcucccugauauugagugaauuguauucuccaccccccaaauucguauguugaagcucuaaccuccaaugugaugguagucccagcuaccagagaggcugaggugagaagauugcuugaagcccuggagaugaggcugcagugagccuugauugugccacugcacucaaccugggcaacagagugagacccugucuguaaauaaauauguguguacagacauacauaagguucacaauucaauuuaaaaaagagaaagugaccaucuacaagccaggaagagagcccccaccagaacccuaucaugcuggcacccugaucuuggauuuccagccuccagaacugugagaaaaucagguucgccuguuuaagucacccagucuuugguauuucguuaugguggccugagcuaagacaggcccuguguucucuguguagcaagaggcaggaagcuaagcacaaagguugccagauagcagggacuggcuggcuguuagugagccagggccaguggcauuuaauugcagucauucccauucuuugcugagcuuuggucauaacuauuuguagaggaccccuagacuuuuuuuuuuucuuccaggacaaaagugauccaaaacauacugucuucaguuuuugagcauuggacuaccaaacaggaacauuuaaggaaaacaaaauguugcuguuguaaagccuugauggugggaaguuauguagugaauucucaauuucuucuuccugcaucuugucuuaaaaaaaaaaaaaaacuuuuaaaguuuuuguuuguucaucauucauucauuaauaagucaagauguagagggcucaguagccuuccccuaguuuucuacauuucugacuuugguaaacuuccuuuacuucugcaauuucccuaauuguaauauuaacauauaucuaaaaagaauacaaugguuauguaaaccuccuagcacuuaauaggcacucaagacaauaugacuuaacuguauaagaaugacuaaugugcuauguuuauuuauuuggcuucauucauuuugccagcaaugguguaguauauauguaguauauauuaaaaaucucuugaguaagagagguuuggaaugggaaaaggaaccaagaaaaucucaccaucuuucuucugcuuggcagcaagucuugaauucuguuuuauuuuucuuaagagacggggucuugcucugugcccagacuggagugcaguggugcuauuauagcucacugcagccucaaacuccugggcucaagugauccuccugccucagcuaccugaguagcggagacuacuggcaccuaccaccacacccaguuaauuuuuuuuuuuuuuuugguagagaugaggucuugcaguguugcccuggcuggugucaaacuucugaccucaagugauccuccugccuuggccuccaaaaauacugagauuacaggcaugagccacugugccuggcagagucuugaauucuucaacagggcuuuugaauauuuuaaagccacauaaaauuuccuuuuuaaaauugcaaugaaaauugucaaguaaagugggucauuuuuugaccuggugcuuaauuguacuuagaagcaaaugcauaucuguaaguaaggggaggacucagaagugauuuaaagggaggauuguaaaagaguuugggaaguccaucccuuucauuuuacagguuaggaggcugagggcauugugcaaugauguauagucagguagagagaggaaacaggaaucauaaaucuuaccuuuuguacaaagucaauguuuucaguaauuuuguugaaaacaaacauuaaacaaauuuggaccuguaaaauccauugaacugguggaggucagccugaccuagcaggacauguggcaucucuguuuugugaugcuguaucugcuuugggagucccagugcccaauccccucaguguugaaaacuuagcuccugaguuuaaggugguuucugugggguuauggggcagggggagaggguuuggaggaggggaggagcggaaaaagagacuuccagucuggggcuccugcuguguuaccuuaggggauuuagggccuauaaaaaacacauuuacaucucugaauggcaacagauaaauaccaacgagcguuaauugaaaaggaggagacccaauggacuagaggucaggacucuacagugaugacugguggccugggggugucagcugaaacggucuggauuuuuuuuuuuuuuuuuucuccuucuuccccuaccuccuuccugggcuuagaaaugcuggaaggaagaaggagggaccauuaguugaacuaagagguauguuguuuauacuguuguugugguugucccuggguggucugaaauuuuggaggaggggguagggaaaggcccccuaaaccuuuuuuaaacuaguauaauacaaccugacugcuaccugcaguuucccaauuacccaauuauaacacaaauuugcacauuuuuuuaaaaaagcaggcugcuacuguuucuccuuauacaaggauuuuagucacuguacaucuugugucuuuaaauaauguauuaggaacauuuucaagucuguaagugcuuuuuuaaugagagugugaagauuuuaaugggacuagauugcuuuucaugacauuucagagugacuuaauuguaacaauguugagaggcuguauuuuaaaguuugcuaaguaugucuguguggauuauagucagacacuuaaaaggacggaugguuggauaguggaaucagauagcuuuuccuuacuacuuucuccaaauauuagcucuuugcaaauaugguuauaccaaaccaggcacaggucaggauucucuuaaaccuuuuaauuuucagauaggaacagaggcuaauaacagaccaauguggguaauuuuagagacaauuuccuuaaaacuuaguuggacugcaauauugguccuaaggccucuccucucuccuuuuguagacccaggaggccaggcugucuuuguguauacuuccuguuagucccugaacucucuucccuguuugcuuuaaaaacauagugaccuugaccgggugcgguggcucacgccuguaaucccagcaucuugggagggcgaggcaggcggaucacgagaucaggagaucgagaccauccuggcuaacacggugaaaccccgucucuacuaaaaaaauacaaaaaauuagccgcgcguaguggcgggcgccuguagucccagcugcucgggaagcugaggcaggagaauggcgugaacccgggaggcggagcuugcagugagccgagauggcgccacugcacuccagccugggcgauagagcgagacucugucucaaacaaaacaaaacaaaaaacaaaaacaaagcauagugaccuugugccucauuuuuuuuucagguauuugaguuagcguuucuaaagcauuaugacucuccagauaacaguuuaccguuuuaaugauuggaauuucagacucaauuuuuuucuuaucuccaaaacaagaagguuauucagaggucuuuuccuaugcaaacauuauuaggauucuagaaccuguggcagacuucucaaaauuagaucaaauggucagacacuuucacuaucuuuuuuuuuuuuuuuaauggucuugcucugucaccuaggcuggagugcagugccaugagcauugcucacuguagcaucaacuucccaggguugagugauccucccaucucagccuccuuccugaguagcugggacuacaggcaugcaccagcacaccuagcugauuuuuaaauuuuuuucuagagaugaggucucacuauauugccuaggcuggucuugaacuccugggcucaaacaauccuccugccucagcuuccccuaagugcugggauuacaggcgugagccaccacgcccagucuccucagugccacucuuaauagaagcuuguauuaguuuccaaggcugccauaacaaaguaucacaaacugaguggcuuaaaacaacagaaauagucucauaguuuuggaggcuaggaaaugugaaauuaagguguuggcaggaccauguuuccucuuaagccuauaggggaaucuuucuuugccucuuccuagcuucugguaguuuauugacagucuuuggcauucuuuggcuugcagcugcauaauuucaauauuugccuuuguugucucuuaguguucuccuugugucuuuacauggccaucuucugguaaggacaucugcccuaauccacccuaauccaguaugcccucguuuuaacauuggugucugaaagaaccuuauuucuaaauaaggucacauugugacauacugaggguuagggcuuuaacguauauuucugaggggacacaauuaaacccauaacagaguucuacuuugaaaagugccuaggagauucugaugcagccugcauggguucccaaagcaugauuccugaccuaucuguacauaauucaucaagagcacuaacaaacuuacaagacauauauguauaaugguauauaaguaugagugauauacagaagaaaaauaaacccaaaacucauguacucaucacccugcuuaagaaguaaaacauuaccaguaccuuuaaaggcucuggaaagccugggguguuuguuuaaaacauagguucuccucugagggguuaggucagggagguuuggagcaacaauguguauuagaauucaguaacuuuaaaaaaaaaaaaaacuccacgugcauuuuaaaguuggucuuuaaaauuuuacuuuggagugggaugggauuuuuuuuuucuauuagcgaauagaaaacgugcaagaaaagauguaguaacuuuuuucauaguguaguagaacagucuuuggcuccucuucuuuuugugagguuucuugagaaaucucaccuguacuugguauaauuuuccaaauuaauuuagaucucugacccagagagacuuagagugaugcacagucauguagggggaggauguguaugugugaagggaccuguuauugauuauacgucuuacauucuugccuuucuugugggauuuugugaagauuaauaucugccagauagguuuaaguuugcaaaaugccuugaguuccuugggggaaacuguuacauaaauguaaauaaauuaugcagcaccugaauuugguuguucaucauuuuuuauaguguguuuuaauuaagaacuuagugcuauuuaaguuggauggcuggggagaggguuuaaucacuccaagaugguuaaguaaguagguaggagcaacauuuaggcuggaacccauggaggaauaaaugaacaagacuggagaccagucauuuuccauggcauuugcugagcggagcuguggauuaaugucucuucuuguacguguguacauggugcuguuagaaaaucagccaguuuuucacuacacuuugucucggaccuguagauaccuuggaccucucugguuuuccugaguaagcuggaaacccuaacaacagccaaaacaaaacaaaaacggaguuugucuuacagucuagguacuuggggagcaagaggcauccagcaaacugcauuggcuuuugguacacuguguuucuguaguccaaugagcuggguuccaaacuaccuccuuuugccuguuacauacagcuuuguguuccaguggaugauacuguuccuuaacucuuaaagaguggacauacgaaacaguugccaacaacccgugguccaguugugccuccuuuguuugcugcuuugucagagucucacuguaugcuuuuuuuuuuggccuuuggcgcugugagcagagucaccucauccuccuuuccguggccaacucaaagacuuacaaccuuucucccucauuccuauguaucuacagaacacucacuaguugcuaacuaguggauacaugugaauuauguuuugaugccauagggcugucuaguggaggauacaaacauuaaaaaaaaaagcuaaauccagcaaauagcuauaauuagaugaggguuauagagaauaaccacagacucuuucagagcauauaaggaggcgaaucuaacccagucucggauucuggcaaauugcuucugaagagugacucucagcaaaaucuggaaggaucacugggaagaaauuagcaaggaaggaggaagaaaagagaacagugccuucuaagaaauauaccaugaagucauuuuuuuccuauuccuuucucugcccuuuuccuuccccacacagucuuaugcagcagcacaauuuuagccauccaaacugggccaguuguuuuguuacacuguggaugguuggagauugagagcuaugggaauggguaggaguuaaaaacugaauauaaauuaggugacaagagauggcaaaaucauuuauugggaugauuaacuuauuaaauugggcuauucccaugcuguuuuucuaaaauugugcucugauggccauuuuggaagccugguacuacccacagacuggaguauguccuaaguagguuaagagcuugggaaagaugcuugcugagggagggccuucuuuguacucuuucuaucaauaagaaauaauaaagaguuaaagcaucguuacauuuuagauauacuuucucaaacugcugacaucagaauugccaggagccuguuaaaaaggcacuuucuguagccuuccuaucccaggccuucugaauuagaaucuuagcaguaggauuccuggccacuguaaaguacucuauugaaggcguggauuaccaguggguuauucagaggagaacuuucaucauuuuagccccgugggucccugccugauuuccugccaucucucacuaccaggaccagcuauguaauuugugaggccccuuauuuaaaaagaaauauuaggaauuucgagacagugaugguagagcauuaaaccaaguauggggcccuuucuggauguaggucccucugggauugcacggguugcaagcccaugaagauguucuuguucaccauuccuguuugccuuuuuaaaaugcuccugcaguaaugaacugcuuauugcucccugugcaugauacuguuuuuugccuuugucccuugggucucacuauguggcaugcuguguuucaucucuuuucugucaccugggcuuaccucaguuuuugcacauacugcguuagaauccugugcaagucgcccgugcuaugcugugugcuuugagggcccggaucugcucuuccucaucuuuauauucccugcccuuagcugaggcucugccuuggucuucuguuaagugugcugaaagggauacuuuuuuaaccugaaucuuuucuuaaaaccuaauuagguuauaggccauugggaaugcagauuugguucagagugaggaguuggaggcuguguugcccuaguagugucgugaggacugccugggcgugacuggucugagacagugugaggaacggggugugaaacaaacuuaugacaucucuggcaaguagugcauacucugcuguugacaccuuugauagcugcuacccucugauaaccaguguuuuuuuuucuggaucucucauugaacucugaguuucugggaacagcagauuuuucugagccacagguucagauguguuagcagaaccugaggaaauguuucuugcaccaggaagguggccauuuuacuccguggcuaauauuuggaacuagucauuucuggauuguuugaacuagcguguucuggggaauuccccaaagcuggacgcacuuguuaaaugagguuauggcucuguggggugagaaauagacccgccuacuauacuuaaaaggacugacuguguuucugccuucagguaaccagagguaguuaugaauuugggugaaaccucuucaucucaugauagacuagcaacuagagguucagagaaguuacacagaauauucaagguugauucagauagugacugaauugggacuagaauccaugguuucuauucuguggauuuugaguaagaucacuaaucaacaugugaaaucuuccuugugucauucaauuagaauuuaagugucaaauggaugguaaaaucauuucuuagcuuauguagaucauaaagauuagcaaaucaaggcagaaaaagacccccacacauauuuguugccaggucugcacuaauuucuggauaaagguuaguauauauuuggucuacagggugugauuugaguguaaguuuuuucuuuaguuuuuagauuauuguucaaaguccccacugacagaaugcagggagacagccuugauuagauuaggccagauuagauuaaaucgaaugguuaaggccuuuggagccuccagcuuguaggagacaccauaauggccuucauagcguccuuaaauccuauuagguaaguuaaucuuauugaagauuucaggucugcauaaagcaguauugcucuuauacucucuauggugggcucugcuuguuaaggugagcaggcauuuuaacuuuccgggaauaaguugguuuuauugguuuggggcaaguuaaucuaaauaacuugaaaguagacaccugugccugauagagaggccauuccauguagcaaaauaggcugucuccuggcuuccccuuugcuugguggcuguuaguaccugugacagggauuuuuuuucuuugcccugauuuggggaaagagagucaggugagauguguaauaauaauguacggagacaguaguaugguuaugacacugaggcacuacuagauauugagaauaaagcacuuuggaacuuaggagcuggaagcauucuuagcugucauuuuuugaguguuuauaguuuuauuauaggugcuaguuggcucuugccuguuucuacaggugcagugaccauuuuucugaagcaaaauauucuuguugucacaggcuuuuccucaauuugugaauuuauggaccugcaaaguuuuacaaacacaugaauuaugucaaauuuuguaaugucuuuugaaaaaaagggggaaaaguguaagaaauuuagaccauguaggucugaaaguaugcuuacuacaucgauagugggggcuggaggaacugugaaaaaaguaauaguaaauuuccuuuuuuagaucuuugccaaagguaguuuuguuagauauaaacaacuucaagacccacaagugacuacuacacacuggauuggccuucagagauacugggauuuucuuuccaaguaucuuuaaaaaugagguucguagugcuuuagcuaggaggcugagugcccacuauuaagauccugugaguuaauugguuugguucacaaacuaacucauauugcaguguaucuggcuguuuuguggcugggagaagguuccugcauugaagggacugaagugacacucugaccuugggacuuccagugcuguuguggaguggggacuuccuucuucaugugggcuugcuggcucuucauuuauugucccaccugggcucugccuguuacucuucucaggccaagaagugaguuagguuccuuauuuaacuuuucuaauggggcagcucugcaucuguguccuguccccaaagacuaaagagaaauuucaggugugggccagauuauggagccugaagaacaguuuuaugauugauuaaugguuuugauuugcuuuuaggaagaaaagugcaacuagcccauuggaugaagauaguaucucucuccagcacuccuguaucaaguguacaguguucucuuccuguauagcacuuguauuuucaagagcuagggucauugagagaacacuucucacucaugaguuucagagcguagcagaguacacacaccugaagcaagaaauguaauuuucucuaaguguacuaagaauuacuuuaauucucuguaugugcaugcaugugcccacauaauggugguggguuugguuuuuuuuuuuuuucaugcuccuugaggagaaauaacccguuuuuugcuuuuauugauucacgauuaccuacuuuucaggguuaccuuuguuaggaagcagcugcuggaagaaugugugcucauuuuguacuuguguccuuuacuucuauguccucucugaccugaggcucacccugccugccaccuccucugcaucagcccagcuuuguucuucugggccuguuguuuccacucuaugaagagaccuccuuacuucucucugucucuacuuaguauccauuucugcugaggcagauccagaugggcagagguuggggagggaauuugaaugaggggaaaaauuggaucaguuaggggaaauuuauaaaacuucuguauucugugcuaauaguucucagaugcuuuggaaucauaagacgggauguuggucuggcgaccuuugagagcugcucuuaaccagccaguggacagcuaugcuugcuuuuucuuccugucaccaucucugcuuuucuugcccaauuugccaggaagaguccaccaauucuucauaagcccacuuuuuauucucucuuuugaagucaucuugauucacuuccuacaccugcagcccccagucuugcuugaucuagcuccuaaucuucugcuucccuuugggacagaggagaagcugcucuccucgccaugcuuugcugacaucuccaaggggaaggagagcacaggcccuuucauauccugccccagaccuucacagggagcaguaauaaugccuaaaccuuauugaguacuuaacaugugcccagcacugugacaaacacuucacacagauuaucucuuaaaauauucaggccagcccaguaaaguuuauguacugucauugucugucuucaauuugcagaugaggaaguugaugcucagggagguucaauaacaugccauuauguacacagcugaaaugagugaugcaaucaagauucaaacuaggcagcccaguuccagggcucuuguccaacuacucagggaaagguuuucgaggucacugccaggauagcuggacuugugacgguuuuccuguuugagauaucuacccuuuuacaucaaccuaagcacuuacugucuuuauauuuucaaugaacuaagugggguguucuggguggucuuugaugauggcaacuguguguuuuaaagaaccagaaagaaaaauguuuagaggugggcuucuuuagcuguagucccucuugacuguguggucaaauaauagggcuccugacaaggaaauaaggcuauaagugcucuugcuuuguaaagauuaguuaauugguagagguuguguuucugugguuaauuugugcuccugucuuagcaauacaugaguauccacaggcagcaagugugucgcccagcagccccauaaaacaaggcacucuucagcaccagcaucaguugaugcaccugaauaacaauagggaagcuuguugaccauuuggcacuucacagccuaguaauuagaaacuguaaaacaauaauacagacaugaagcaaauccuccaguuaaugaaaaaaaaaucuacaaucuugcauuguggcugagugcaaaaucacaaccggccgcuuauacagcaaagcaaacacuucaggauuuuggcagcuguuuuguggauauaaaaagcucuaggcucuguauuaauuuggggccugucauauuuuuuaaaaacugaaaacaauuaccugacuuucuaguuuuuuguuguuguuguuguuguuguuuuuaauuuacugcagugguucucaaauuaugguccccaguccagaagugucagcgucaucugggaacgguuagaauugcagauugguggggcccaccccagaccuacugaaccagaaauucuggcagugcggggcacaguaauuuguuuuuacaaguccuccaggugauucugauggacuuuaaaguuugagaaacacugagggugugggaaggguaauuugggggaagggaaguggaguccccucuuggccccacccagagaugagcuucucugucuaguggugggauaguuggcuugagaugugauauugagaauauaugaaggcucccuacugggucaggaaguugggggagugucucaggggagggccgugccuuccuggggaccuguuuaggagaaggguccugggcaguagcuuguuacuagccuuucgggaacaauuucaauguuucagucacccucugggcuguuguacuauugcagucagcccugcuaggcccacaaguuguauggggcagaggagaagaggcauggggacagaaaccuuauaucccaggcaaagccuuagcaaugcugcugaugucauaugcucaucguugucaagaauugaaaauuaagauagugaugaggugguggcaggacaaauuucuucuuuucacuguauguccccuuucucuucuggaucucauuucccugccuccagcuaucuuggcagaugggauuauuuaauaauuuucuuggggccuguuggcaaauggccccucugccccuuccccaguguguggugaccacaacagugacauagcuucauuucacagccauuaggaaucuugacgcagcugaccccuagaucuccuggaaaggccucuugggaaauauaagcuugccaccagagugaagugaauucucgagugguauuaccacagaggcucagguuccugaugcuccuuggagugcuagguuaacagucucucuguuggggaaaaacuugauacaaauagaagauuugcuaauuuugcucacauuucaaaauuguuuaauuugcuuacuuuuuuuuucucuuucagacuauuggguuuuaucuaucauuccuuuuauuuuacaaaaaagaacauagggcauguuggccagauaauguauccuguuuuuugauuuaaucacccaacauagcaugggaauaaaaagcugaaugagauguagccuugcuccucccugacauugaagagacuggcuucugggagaggaaaaugaccaagaaaagaaccacccagaucuuggguucaguuuauucucucuguauuuucaaguggcagaacuugcuugaauaugugaauuugauguuggaucacaagcccaacauguggcuucugugggcauauguaguuauuuuggauuuuauuuuauuuuaaagggucuguguccuguuggcuuuuaggaggugauaguugcugauucuccuuucaugugacauucagggcucauggagaagucaaaggcucacacugguguucaccuuccuggacuucaggaaagauaguccuuuugccagaugaaugggaggaucuaagucuguuagauuuccaugagucgugcagccuuucuggaucgggacaggaagacugacccacuguccuucccaggcugccugccguucaucuugcuuuaauuaaauacacagcugaugaugucagcuuggcucccggcuccuucagcuuuccccucagaacaaaacauccgggcagacaguugugacaauuaagucucaagacccaagcuuaguuuguucugagguaguuaagauaaaucugccuaagcaucuccaaaugcagauaaaaccuagugcugauuagaggugacccucuaauaaaccugauuugauuaggcagaaccagcgaggugcaggcaaauauuugagacucuggccaagcugauauuccauugaccuuucacuuaggggaaaaaaccuguuugauuuuuuuccuaucccagaguacuugaaaauuauuaccuauggcagcuaaagcacuagggcgaaauaaacaggugagaccuguggacuugcccuuaagagucgcagucagcuaccaccuggguugugcuugcuuccuggcagaucaguggagaauggauuuugccggagguccuggccuggaaugauaauuaaaaaggauguuucagaacacacccaggugcguucugauaaagccugagcagauguggguggugaaggauuuuuuuuuuaaagucaaacuuuguuuauaaagguaacuucuaacaauuuauuauagaaaagucaaacuagaauugcauuaguuuguuuauaucaagaccucauuagaaauuaaggagaaauuuccuuaauugcuccaucucuggcuccuguaacagugggcauacuucucuucuuagcauuuaucacauuguucuguaauuguugguuuaccuucccuuuugucuuaaaaagcagggaaauuguauaauuauucuugauguugcucaaaugcuuggcaccugggccagguacagggauuggcaaaguuugguccacaggccaaaccaggccacuaccuguuuuuaugcggucaugagcuaagaacaguuuuugccuuuuuaaaugauugaaaacaaaucaaaggauauauauuucaugccacgugaaaauuauguggaauuugaauuucaguguucauaaauaaaguuuuauuggaauacagccaugcucauucauuuacguuauugccuuuggcaucauuuugcacuacaacagcagaauugaguaguugcagcagaaaccauauggccugaauagccuaaaauauuugcuaucuggcacuucacagaaguaguuuguugaucccuuuccuauuauauagcaggcauauaguguaaaugcuuauuguuugaauuauuucaaauauaaaucugaguuuacaaauagaguuauucugauccuaaaaguguucagugaaaguuagaugaaugacugaccaaucuauuucucuuguuauucauuuguaaccuuagguuuaaguuuuagagguagugguucguuuauuagagcuagacaauuauauacuauuucucuucugagaaacuuuauaaagaguuaauccuuauuacuuuucuagguucugaaccuacuauaugggaugcagagacaccaagaggcacagagagguuaaacugacuaagacacacaguaaagaaauggcaugacucuucaugucuucaucucuuucuuuguuugcuaaagccauucuuugugaugaaagagaagucaaaucuggagauauucaugagcaaacuacugucugauacuauauaaugcauuauuucuuauagacaucaguaucuuuguaggcucuuugguucauuaccagggaaauucauuuaaaaaaauaauaaauaugugguuuaaaaaguaaauacugcagagaaugauagcaauuaccaaauguaaacaauguggccuuugagaaccacuaugaaauuguuuagugaauuaaauuauuaugcuuuugcuauucacauauccacuuccauugacuguuaaggaauaugcuucaaggaggacagaugagauauagguaaaguuuauuuuuaagauacuuagguaaaacaaaauaaaccagcaacuggcagauguuuggugaccuugaaaucuggcuuuuguuuugagacagugucuuuaaaaugaccagugccacaaauguaaacaggggaguuggagggcauuggaguauucaggaagaaagugagaaaucaguaauuuguagaacaugacuaacuggaacuauuguuuggucugcugggguuugagggaguagaggaauuugugaagaaggaaagaagguuaggagaugcauagagcagagaaacaagggucuaagcuuuccuaggaaucucaggucagacccuuguuaaauuuuguccguauauucauuguuugcuguggaaucuuuuaggagaguguaauuuuuuuuucuguuuuucucuuauuaaauaauuuaaagggaugacauucagggcuuugggaagcaauuuuuuuuuuuuuuuucaaaacgccgcuauaccuacuaauuggauauccaucaggggauggauacuuacaacagcucugcaugauagggauaauauuccuauuuuauggaugggaaagcugaggcuuaguuguuuuuuuuuuuuuuuuuuuuugagauggcaucuugcuguggcugaggcuuaguuuaauuggcuuucccgaaguuuuacaguuagcagccagagccaaguuucaaacccaaaucuagcugacuccaggggccuucuguuguuucuacuaucccacuuccucagugguugcaucccagagauuucaucguuuggugcauaaauccagccuaaagccauacuucaccauuuugugugaauaaaucucuuccucauuuuaugacucagcuaccugcuuucucuuucuaaccuguuauuuuguacaucugauuuguuagcuucccauguucccuuagcuucccugcccuuaguuguuaacccuuuugaucaauaucuaguugauuuugcuacuuaauaacagacuuuagagggacuucagaggauaaaaacuagaaccuccacccuacugaaaaauuacauuugguuugccguugguaguaugugccccauccuucugcccuggcacuccaggggaaucaaaaaggaagagcugagaaacagcauuccaggcuuagaggcuccacauucuuuggguuuguuggaagacuucuuggcagcauugaaagaugccuguguuuucauacugauuuuccauccugggccaccugcuuucucccuuccugcuguuuuccuuuuguaccuaugugguuggugcuucuggggcuuuuuauagcagcuuucaucauuuauacuacugaguuuugcaggcgcuuuucuuuucaauuuuugauguuugacaguauagacuuuuauuuauuuauuuuuaauauguucacuucugaaccuuuuuagacuucauggugacagccuccaggagaggaaaaacaaaacaagggaaauucuaggaagaggcagaagguaguuacuauugauuucucuggaugcagauccuaacuguuggcaaauuuaaaacuuacuuauuuugaguggaggugguucuguguuagugagaaguugaucuggaaaagaugcugauuuggacauggcuguuguaaaacuaaugaugaagcaaaacaaaagaaggaauagugcauuuuggccaggcaugguggccuguaaucccagcacuuugggaggcugaggugggcagaucacgaggucaggagaucaagaccuuccuggcuaacacagugaaaacccgucucuacuaaaaauacaaaaagaaguuagcugggugugguggcgggcaccuauagucccagcuacuugggaggcuuaggcagggaauggcaugaacccgggaggcggagcuugcggugagcugagaucgcgccacugcacuucagccugggcgacagaggaauagugcguuuucacuuuuuaaccuuaguugcacaggguauguugaaagcuacuguuggcuucaccaugucauugggaagugggaacgcugacaaucaaagcagcuaaacaagaagcaacucaggaauuaugacauuggcggcaagucuuuugccccucuucagagguaacacuacuagaucuggagagaguucuguacauucagggaaucuuccugaucucuaaaaaauuugagaggacuagagaggaguaaagacuggaaccuggauagauugauuugugagggacaaagauucagagaagacauuuucuugaaggugaugaaccugcuuuaccaaaauguuguaaaaauucuaaagaaaaguuaauuggaucaaguugacaauaaauguuagaagggaaaaaucuuaaaggguaaaauuugaaaguagaaaguuuguccuguccacaguguuugccauuucauagaccaaggugguugggggagguggggcaaaauuacuguaguuuccagugaucauugccuucucucgguccuauaaaugcaggcacuauuuagcacugaaaccaucugguguuggugguuguuucuuaugucguaugaccugccucuauaaauacauuguguauaagcuuaacugggacaguaauuggugugauccuuuucuuuuucugaucucuaaggucugaggcccaugaccaagggaaagagaagugcuuuuuaaaaaaacggacacuuuuguuguuuuggucucaugguuucacugagguaguguuccacaguguaagacagguuaggauuguauguuccagaauuaugaacaagaguauccuugggaaugauaaaaaccaugcugcaguguugcauguguauuuguguguuccauguggaagaccuucugggcugugucugucuuugcuauuuauuuaucaccugaaauggugcugcucaaccacucugugacaguguuauuuuaacuugaaauagcaugaggguuaggagaaaauaccucaugaaugugaagggggauucuccugggcguauguaauugcaaugauuugaaaugcuuucacagguuuguaggagaggguaauuuuucuucuuuauuugcuccuuuuaucuuguucuaaagccaguauuaccuccucucccaccgcccauguauacuucuuauucccuucuccuucccccucccuuucucccacucuccauguaaagaaacucuuuccuaauaagaaucauagguauucagagcuuuuuuuuuuuuuuuaauuaacaguugauuugacuuuuuaguacuguguaggagaugggaaaagucagggccauuugauaguaauugcuuccuggaagagccgaccaacuuauuauaagggugaggaguguuuggaggcauuauuuucugguuccagguguguuuugaguauugcugguggugcucagcacucuugacauuuggggcuggauuacugcauguugcaggaguaucuuguguauuguaggauguuuagcagcaucccuggacucuacacaccagauaccaguagcaccccucaagugugacaaccaaaaaugucuccauagguugccaagugagggacaggaucacucugguugagaauuucugccuuagaaagaggaaaauggauucccuggaagcagagguuagccauuaaccuuauagggcuggagccuucauuuaaaugcuuugguauauugaaagcaccacucaaguaucaguggugagggcacauuuagcuuguugaaauuccuguguaauucauaaauaucauauuagcucuuggcuucaauuuccuaacacuagaaauguagauuuuuccccuuauuuucaaaaugaggaggauuguaguaaaauauaguaaucucugaggucgcucccaacccuuacauuuuaugauuuuaguuauaacagacaucuuauggaauuacacaauauaagaguugaaaauguauuugugaucauuuagccagcccucuucuguuaguucuaucccgugugauuuccacaaauagaucagaccagaagaaaauaguugcuuuuuacaaguggauguuauuaaaugcucauauuuagaauauuuaucagaacagacuuauauuacaguguuuacuuuucuaacugauugagauucaggugacuuaacugccuaagcuucaacugucuguuguuuggaauuaggcuuuuaaaaguuggucuuuauauuaauauuccuaugccuaagcugguacucuuauugucaaauagcuuuaugcucuguuacauuaaugagggaaacuuugacuuuccagagugccuuggcugauauauugguguuaaauugguaagcuuucuaucccaacugcuuuauuuaugcuuuaaacauaaaugaaagcagagaauuuuuuuuuuuggccugagagguaguuaagagggaaaucuaauaccuuuuauggguuuauaugcuucauaugugaugugcccaaccagaaauaauaagauacaccccagaugugaagguaccagcuaauauaauuaugcuggagaucauuuucaccuuuugagggcugaauuacauugaauucauuucuucaacucuaacaggauuugguauaguuacuuaaauuugaauugggagcugagaugaagucccaacacuugugcuuuuacuggaaggauuggguuguguauaccuuuuguauuucugaagcuugauaaacuauaaagccuugaguauucagguucauggcaagguuuagauggauggggagguauacucuaguagaaucuaacagcuuaguaugcuuucugugggcucuugccuggaaacccaaucugaagguauagugaucagacacaaugcuauucuuaagccuucuuggaaauaacaggugucuuagccugugguaaaaagguaauuuugcauguauuaaauauucaaccaagggcaugaucugugcuuauuuuggcaaacaaauagaucccaaaaugaaucaaacaaauuguaaugcagaacaaauuuaaauacuugaggauuuguuuuagacauuuaaacucauauuuuauccucugugucuucauaguacccucagaaagaaaagaaucuuuggaaaugucagugaaagggcaguauaaucucacacugcaguugugguuccggacucagucugugugccugucuuuccuuucacuccuagccacgugacaacacaaagaggguacuuaaaguguuuauuucacccuggaagauuuuuauagagagcacuuuuuaaugaagcacagcacauggcaucauuaucauuucuaacacagagaacucauuuucaauuuugcuaucaaagaaaaaugacaaauagagaaugcaagaaaaaccagauggacuaacuguauuaggagcuuaguaugcauauuuugugucacauauuagcauucauuaagucaaaagggaaaaaaaugaguuuugccuacaugcauuaaaccaauaaggcuggcaaaguuccaagcuagcucuugugaauuaauuguuuuauaacuguuuuaauuaaaauuguucaguauaugauuaaccuaaaaguuuuaauuuccacaaaacuguugaacaaaugagacauuaauauuuuacguuaaccauggcaauauugcugugguuuucagagcucugcuuguucaagcaaagcauggcaagugguagguggaaaguacccugugucucaugccacuacuaagaaaaccugcaaaucagaagcaaauucuauacacaagcauuuauguaggcaucgccccaaacccccuguucagacagucuaguuagagcugggcaccugucauaaauugucagguugaagagguuaacgauauaacauggcaagaauacauuuauugucuuuuucuuccaccuggcuucauaguaguguugguguaccgugugagauccuuagauuagaagggguuggccaguagggacuaugaaaugauuguuguuaaauucuagggguuuaauuuaggauauagguacaaauguuaguucuggaaucaaagggaagaaagagaagauuuggaugacgcaucaccuuuacuugagguucuuuagguuggcaucaggcuaacuuugguaaaaccacaucccauuuugcaaaugguaaaacaggguugguaaaauuucacuguguauagcuguggcuccugaaauacacagauuugcauuucugucacuccucccucuccccacuuuccacauguacccccauccuaauguacuucacuuuguuaaaagauggggaugucuuuccucucuccuccccuaagccuuucacuuugcucuguggauuugggucauggugcuguauaaauucaagguaaugaugguauuugaaccccauagaaggauauuuuaagagauaagauuaauacugcucagcauaaaugaugauaaaacucaggcuguccuaaaugucuagguagugaugcauuuuuuaaggcacuagacugagcuuaccuuuuagguuguaugacacuugauauaagcuguccuuacagguuuaaagcuguaggagucuggaaugcaaaacugaaccacagaaguauauuggccuugcacuuacauagucaggaucauacggcauugugaucuauccagauuuccagcugcaguccugauguggucucuucauuacuuuguccagcuguuucuucccagacggugcucuguguuagccuucccuucuguauaaucauucucuucccuaaauuuuucuguuuaacuuguuaagcaccagauucugaauaaauuauucauauaaucaguauuuuugaaguaguuaauaaucagaguauaauaauaaauuuuaugauuguacagguugccauauuugccagaaaucagcuuuacacaagugauuuuugagauaaaugcuuuauugggcauguugcuaucuguucauuucuucaggcucucuugauuucuauuauugugugaaguuaggccauuagaaaugcgcauaccuggaccauauuauuuaggcucuucagagaacugccaucacggaguuagagugcuauguccuugguaaauggaaaguaagagcccucaauuuaauaauacaguauuuuauagucaaauaauacaucuggcuuuuguaaaaccuuaaaaguaaucugguaucuuaauguuucauuauacauaugcauauauguguguguauacucacaugcauauauacagacauacauauguguacauauauuuacacauauacguacacacagucauacacauauaaaaagcuucucuaagaauuuggagcgaggaaaaaaugucugucuucugaccaacauguauacauucuucuaacucucauguguuuguuuagugaaugaaugaauacuauguaauuagguaagagaacuauugccuuacccuggaaauucgaaucguaauucaguaaacaauuuuagguacccauccuaaguacuuguugaucaaauacuauuacucuuuugcuuggugaguauuauuuuucaucuacuuuuaacagguucuucuuugguuaaaaacugacuucuaaaauaaaacaaacagaaaaccuacuuacuucuaagccgugauaugucuguauuggaaaauaggcacuggcauugcaccauguuccccaugauaaggaaacaauaagaggaaucaugcguaugguuccuguccuguaaagucuaauggguggcucacaccuguaaucccaacacuuugagaggugaaggcaggaggauugcuugagcucaggaguuccagaccagccuaggcaacauagcaagacucccaucuugacaaaaaauaaaaaauuaccuggguguggugguguacaccuauagucauagcuagucgggaggcugaggugggaggaucgcuugagcccagcauauugaggcugcagugagucaugaucaugccccugcacuccagccugggcgagagagugagacucuauccccaaaaacaaaacaaaacaaaauacaguacaugucuggcaagaaggagaaguaccuagcucaguccauuuucuacugaaaauggguaauauauaaagaaaaggaauuuauuucuuacaguuguuggaggcugagaaauccaagguugaggggccacaucuggugauggccuucucacugguggggacucuacaaaguccugagguggcacagggcaucaugugcaagggggcugaacaucuaguucagaucucucuucugauaaagccgcuaucccuacucccacaauaacccauuaauccaccagggcagagcccccaugacccagucaccucuuaaagacuguaucucuccauguugcuacauugaggauuaaguuucaaugugaguuuuggagcagaugaacauucaaaccauagcagugccaaaaucaagcuuuuguuuuguuguguuuuuuuuuuuuuuuuuuuuugagauggagucuugcucugucgcccaggcuggagugcagugagauguugucuuggcucauugcagccuaugccuccuggguucaaacgauucuccugccucagccuccugcguaguugggauuacaggugcacgccaccacaccuggcucauuuuuguauuuuuaguagagaugggguuucgccauauuggccaggcuggucucaaacuccugaucucaggugaucugccugccuuggccucccaaagugcuaggauuacaggugugagccacugcacccagcccaaaaucaagauuuugacaguggggcuguaauaguaguuuggaauauacuucauuuauucuaguucuuuucucuauuuuauuaccuuucugaaugugcucucugcuccccuggggcccauucccaauccaguagcggcaauuaccauugggauaaaccuccuaccucugaggcccacaguuuuccugaccaucucucuacagccucacuuccaccucuaccucuccauaaaacaauguguauacuucuguucaucagcuaaaucacuauaccuaucuuacuuguuuuucugaugcaacaagcagccuuccaaaaauaccaccaagucuaauaauccuuuugcuguuuaguacaucuuuuguuugaggcuuacugucacaugacagaugaugacaggcaacaaaugacuguuuaaauggucaacagaugugcccauccaggugacucuccuaauaguugacacacaguggguggagggauuggguuguuccagauauucccuguuguugggcuagcuugcucuuggugauuauaguuugacuuauuuugcuuuuauucaguuuuugugguucuguuuugcuacuugguuuugauacauguagguaguguggguuccauuuugguaugugaaauuucauaucaugaagaaaguuaugauuauaauguagcguuaguaauucccaguggucauucccaaaaaauauuuucugagaaugccagguguauauaaaaguuauuuuugaaaguacacauguagugugccacacccucuaucaaaacaggcccacauuacugaaagaaggagggaaacuacccauccacuauuacuuuacaguacuuaaaauaugcagacaaauacauuuuagcacguggugaucuuugugaggauauccugucaaucaagagaguaaauaucuuuucucuuucccaugaaccuagcaaccaauuugcuuauaguuccuucaaagcuguuguuaagauuauuuuguggcugguuaugucacuuggcuagaaaaaugguacuggaauuaagucagcuuuagcccuaugcugcccaucuuucuuaacuuauggucagccauauguuuagaccagaugagguaggagguaugauuggauacaaguacauuccuggaaaagauaaccaaaaucauguucuacuaaaagugaauuacuguguuuuuuuccuucacauaagaacagcaucuucauaccuauggcaagaaccugucauuuuuuuuucugaucacauauguaaaaaucauuuguugguaguagcaauuaacauaaaagucagguuagugaugugguuggggugagggagauuugaccauugagagacacacaagggggcuuuugagguacuguaauguucucuuuauuaaccauaccugugguugcaaugguguucauuuuauaauucuucugaaaaacagacauguuuucuacauucugcuguauguguaauauauuuugcuauauacguauguuuuacuggagaagaauuucaaaaauaccuaaauagcacaaaguagaaaauguuaucaguaauccuaacacuaagaaauaaucgcaauuuuuuuggacauguaucuucccaguguuuuggggacaaauaaaaauaauaauguauaucuacucccaugaguuaagauuuuaagaaugcauacauguauguauguauguguauguacaauauauauguguguguauauauauauaaguauauacaaaccugacuuuuugauuuauuauauuguaauauuuugacaugagguuucaggauucuauagaguuaauuuuaauagccauauagaguaccauuguuuggcuauaucauauuauuugcccaauccuguauucucuaacauuugcuuguuucuaauauuuauguguuauaaauaacauguauuuaucuuguagguauuuaaaauuuaaauaggcuaaaugggacccuucuuuauguaguauguagauauuucauaaaagguacauuuuguugggaaagauaacucuggcuucaaaugcuuuuugaaagaugauuuuuuuccccucaaagaaaauugaaaacaauuucacuuuuuuuuuccuuuuaugaagcaugugugugucauuuguuguaagaaggauauggcccugacaucuucauacucgauuguucucugugaaguuauuuuauuuauucacuuauugaacucauuuauugaacaccauuuguaugccaggugcuuuguuccagaucugaggauauagagauggagaccugguuucugcuuucacagccuggcgacauaauggauagcaggguuugggauguugucuguccauagacucuugaguuuauggauccaaauguuuuugcuuagauuacuuugcugugauuuuuauuauuagacaggugauuuaggagcuuauguaccagagaggcuguugcuuuccucccuccccagcccuuccacccccagacuguauguucuucuuuaagguugagucuuggaauucagaacuuggugagcaagaccugacuagaacagaaauggaaaugaccuuuucaugcacagcaugagcaugacagagaaugggcuguguguuaacuccucucugauauugcugagguccuuuccagcccuaaaauucugugauuuuucugauacuugggccuuugaagauccuaauacccaauccuuucucaaacauuaaauuuguagcagaggggaaaaauuaaauuccuccuuuuugagacaccagcugaacuuugcaguauaaauagacucaagagugaaagaaaggagaaaagugcauucacccaucccaggaaaucagauggggauugagagugugucuguucaucuucuguaaacaaaaccauuaguaacaugguuguuuuuuacuugaucccucaaaaaaaaaaaaaaaaaaaaaaaaaaaaaaaaaaaagcagcuggguaccguggcacgugcuguguaaucccagcacuuugagaggcugaggcuggaggauggcuugaacccaggaguugguuaccaaucuggguaacauaaucagacccuaucucuacaaaaagauuaaaaaauuagccaaguguggcuuuccaacuacuugggaagcugaagugggaggaucgccugagccugggaacucaaggcugcagugagcuaugauuguacuagcacuguacuccagccugggugacugaucgagacccugucucaaaaaaaaagcaucguuuuaggguuucuauuugaauagacauuucuguggcuugaguuucgaguuaggaauguuuuggcauagaaaaaccuguuggcccagaaacaucuggcaucauucacaaucaggccaaaguaaaggaaaacuaauuuuuuagguagaauguuggcaccuggaagaauggaggcuguaaguucuuuugcuggcaaaguauaaaaagaaauguuuaguggacaggugugugaguuaaacucuagaguauaacuaagcaguguggcugcccauuuuuuacuugauuugcuugugcuucuaccaccuucuuaaugugucccuggaaugccuacauguaaaaggauucugauggagaagaaacuucuagaccuuaagugacuguccugguuccagcacucauuuaguugcauaaccuugggcaaaucucucaagaaaucuguuccgucuucuguagaaugggguaauaaacacuuacucagccuguuucacaacauuguuggaaagauuaagaaagcauauaugaaaguauguacuauaaggugauacuuagguauuauaaaaaaagugaacagggaucagcacaaaauguuuuggcugcugcugcugcuggugugugugugugugugugugugugugugugugugugucuguguguguguguuuugugucucugugccuuugucuguguuucucuaccaccuuagauuuggcagcccuaguaucuaagugugaaaguuugggauggaucucaggguuuuuuugguaaugaugacugacugguauggcuauugaauaaaauauugaagaugcuauugguccuuuaggacaauuaguuuugucucucuccuuuaaggucauuuggaugaagcagcaguuuguguagaggauacuaguuuuuaagauauuuuuguccuauuuuauuuuauuuuauuuuauuuuauuuucacuguuauuccacaaaaaucuuugagcuggcuuacaaaaauguguacaaugcaacagaauuaaaauaaguagaaaaggaauuggggcacugggaaauggguagggaaaauacaauaaagccauguuaaggcuucugggcagaaacaugcaaggcagggucugaggcaguagguugagggggggucccauauucagcuucccagagaguagaacaaagaggggaacguaacuuuucuuuuucuuuuuuuuuuuuggaaauggaguuucauucuuguugcuuaggcugaagugcaguggcacgaucucagcucacugcaaccuccgccucccagguucaagcaauucuccugccucagccuccugaguagcugagaucacaggcaugcaccaccaugccuggcuaauuuuguauuuuuaguagagacgggguuucuccauguuggucaguccgaucucgaacucccgaccucaggugauccacccgccucagccucccaaaguguugggauuauagaugugagccacugugcccugcuggaacuaacuuuucuugagaaacuuugucaauggagaagauguguccaugaacucuaucuuggauauacuuaucaauacacacaacggugauuugugaacaguugcuuuuauaccgucaaugcaaauuaauaacacugagacaaagcaugauuucaggaaagaguaacuauaaggggucaagaucaugugucucaccuagauagcucaaaggacuggcuugagccaaggacaauuuuuagaacaugucgaggagaggauaagcuaccuguccucaggcagucuaccacaaauacucuuuaucucagcugggagcugacaucucucccugaaagguuuccagugauauuguggcacaauuuguuggccagaauccuagagacccagggauggagaugccagugcugucuugagaguucagugucuucccuguuggcaucuucucuuucuugguucuggcauaucugguucaaggauuagacacaugaauugauuuaguucuuugcuggagagggcagcaaaaugccaguugugauuuuugggcuuggcuauguugggaaccacugggaauuuguggacugccaauaacucauuuuguacuagcuuuugggugaccauucaguggcuguuauuucaauucauaguucagagugacuguauuuagacccaucauguuucuagaguuuuuuccuagauucaaaucaugguaaaugcuuucauuagauaauuuagcuuaugcccuuuuuccuacuuuuauguuucccuguuguuacuagcccuagauacuuaaaaaaauuuuuuuuggaaaggacuguguguuuuuagauauggggauuguauucugugcuuuaguggggcacagaaggagacugucugguuaaggcaagagauuguggugcuaaaaaaggaaauuuggcaggccuguuccugguacuuuuaguaaguaaagaaagagaaugacaggcuggcuggggauuguauuaaagggagcccugauccucauaugaccuuauucccugaaccuagaaagauggucugccuauguggcaguuauucuauggcgcuaaagacaguuuuguucugcuuucugccauguauauuuaggggccuaacggagagauagaaaccuguuaaggaauaaucauggauguucaggccuauugcuuccuucacuuauccagaagccagccucaccaauguccaugggcaaguuuguguucacacaaguugcuuguaacaagagggaagauucucauuaagaaguuggcccuaaaaucaggauagaaucaggcuauauuuguguuucugucaauagucugaauuccuuauugguagaaaggucuuauaauuaugggguaacuuugccaacuaauaguacugggguuugauguggguuacuuacaucagaagucacaucaacuuuuugacauuaguuucuauuccaccaugugcuccagggaaaaggagauugauguggacuauuaagccaaaaaugagaaucuguuauugaaacccagaagucugaaauaaggguuuagugauuguuuuguuuagacacaaacuuuucuucauagaugcuuuaacuuccuaagugaguuuauauauuuuucuaaauauguaaucuuuuaaaaauauugcaaauauuuaauuuauguauuugccauuuaacagguaaaacagcaccaggaagucuugcuccuguuuugcaaaggcacauuuagagagugacagagguuucccacugugucugggacaagccucccagugugucugggacaagccugaaaagagugccauuuugucucccugaccauuucacugauucuguacuuguuguuuaugaaacuucauuauguaacagacaaaaaagcaauuucaugagcaauuccuggaauaggcaaguggacaaaaauuucucagguaccuucucuggaggcuguuugucuuccauucuggcugccucucuugagaacuggaguggcauagugguuaagaccaggggcucuggagacugccuggaucugggugcuggucugacucuugagcugugggaccuuaacuucucugugcuuacuguccuuaccugugagauggagaugauuggagucuccaccaugucaauguaucaacacuucuaaauuauuuagagcagugccugagacauuguaaacacuuaauauauguugguuguuauuguaauuuuaauaauaauagcuauuaaauuauuauucuauggcugucaugccugagaguucaucacaggggcauggguggguggguagggaauaagggcugagaaucuaaucaguuauuuuuaauuuauugggcaaaaaugaaucaaauaaccguggcaggcauaaugaaauugagguauucaguguguggugaggaugaacuguuuuaucacaguuccucugguguggccugugugcuuugauugcaggucagauggcuagggaaaagaguagucaagcugaaugcucuguggugaggcugugagagggacaagaaacgugggucaggacagaaggcguacugcaggaacagauuccgaagugugugcacagcauccuauaauuugggcuccuguguauuuucuuuaguugguugcauuuguuaauauguuagucuggugucuuuaacccugugacugacaguugacaaugguguagcucuuuaaaagaggugaaacuggucugaccacaguuuacccuugauagugcuuucacuuuggcaacaagacagagggagaaagucccugcuucucugcucugggaaucuuaccaaaucaauaaggagucucugguagcacuaaccucuuuuaaauagccuaagugugagauccugaccuuuuuuucuguauguggccuacuuccuugaugagaagcuggcuuuuauauuagaacuuuuuuagacguacaugaaacuugaaucuugcuauuuguuuccauuguugcuuuuaaaaaauaauuuuacaaauuuauucuaauaauauacuaacguauuuugucuccaggacuagugaaacuuuuuaagauuuuuaacagauucaucuagacaccuaaaucucucuaggacuugauccuucuccacccagcagaauacuguacugugcugugaucauuucucagggugguuuuggcugaggguuuuuuuuuuuuuuuuuuuuugagauggagucuugcucuguaucccaggcuggagugcagugguguggucucaucucugcaaccucugccucccggguucaagacauucaccugccuuagccucccaagaaacugggauuacaggugugcgccaccacaccuggcuaauuuuuguauuuuuaguggagacgggguuucucuaugcuggccagguuggucucgaacuccugaccucaggugguccuccugucuuggccucccacagugcugggauuacaggugugagccacuguguccggccuuggcugagguuugacucuuugcacccacagucccaugauguguguacuuguauguauauauauucacaucugaggacugacaucauuucgcagaccgggaaacuaagugugaggaguacauuuuaaaauaauuuuuacauuauauauuggcagaucauccaugugcuuguagaagguauuauauugguaagcugcagguagacaggaagacugaaagagaagguagaaccugcuuggaucccagucugugcauaccuaaggaguugaguuggcaauuccugaaccaaagguucugguguucagaaauaucuccaguuauucagaaggauggcaugacauucuaaaaauaagaaauuauuuguagucacaucaguguguaauauaccuuacagaauauuagaagggagaugaagcauuuggggauucaaaggaacuaguuguagacccuuagguauggcccugagacuaccuaggguggcuuuuguagcaaucuaaaccuguauccugggauguuagcaucucugaacaaaccuuuucucuccccuccauugagaucacuuucuuuaaagucuuuaugcauuuagagaguugcugaggcaaggccauguccugguuugcucuuuuuaaaaugcagauguuucuagaaaugacuauaaacugaguccugagccaccucuuguaacuuuucaggucuuggucugggggaagauaaagaaauggaggucuuaugcuucacaauuugguuuaagucaacuauggcaagguaucuugacuuaaauaagugugacuuaaguaagucugacaauuuaaauauuagaaugguaagacauuuuugugccucuauagccauauguccaucuuggggaggaaaaacugaaaauaaacgaugauuacuuuucaguauucuguggaaaucuuacuucucuuuuuaguuaauuuuucaguggauaggcucccuaccugccagcccuaaauucuuauuuauuccugaaacucugguuuuuuucuuuuuucuuuuuuuuuuuuaaaguauucugaaacuguuuucugaccaugcuucauauauugaaguagauuuuuuucacagaaggguaaaggaagugcauuauguuucauauguagaugcuuuucaagaacacacagcuucucaucauucauuuuaacaguggacaauuuuggugccuguuuauggagauuccuugggaauuaucagcugauagaaaauuucugaagagagauagaaaaucuaaucuauuuggaugucuuguuaaauggagcuuuuugaguauaaggguuucugaagaaauauaggcugucagagcugauagaguuuagagagucucuguguaccauucuuuauaaauaaagacagccaaaagcccagagaagugaggugcuugauguuaagauuuaguuaguggcccccuacuggucucugagcugcccaucacucuaccuugacuaauagugauaacugauguuucuggcaacaaauccaagguacaaguuuuccagggucuucaaaggaaagcuacauuauauuaaaguucaugcugaauaucuuuuauuguguucugauaguuugaaaauugguuauuuuuguacuguuguaaaacuauagugcuuaacuggaaaccccagcauuaacccagccuuugccagcguuucccuucuauaggaugagaaaguuguugaagagugaggaaaaaagaugguaucuuguccuuaacaaaaggucuacguggaugaaaggagaaacugacacuuauuguuagggaaaugguaaugcuuacaugaugaucuaaucuggguuugaguuucguuuuugaagucaccaguuuuuauuuugguguuuuucagauauucuuauagccuuccuggggagauuuauuuuuuggagacaucgcucacauuguuuacuccucuagguuaaauguacuaggccaucuguuguuaauuuuguaguuguauuaaauuccauccuuuggcuggauuuuaagcaccaaaagcaaacuuagacagaagcaggagcauuugcaaauuacauagcuuugagccuaaauggugguuuuuauaagugcaguuuucaaaugggcugagauucuauuuugaguuuugggaucaguaauuuaaacacagggaccucuacgaguucucuggaaaagcccauuuugagacccugaacaguuguuaugccaaagcaagcucuugggguaagguuggcagugaugcugcugauaaauuacuuuuaagaugcuuggggcugaaggacaaugauuuuguaauaguguuuuaaguucucaggcugaccuaugaaaucuggaagugcucaucugaaaggccaguauucuuucugacaggcacaggaaaaacucguccccugcuugauccucaugcaagcauuucuuggaggaagccaggccugugggucuugggggccagaacagagacacugagagcaacacuacuggcauuuugaauuucugcugaggcugcaaaaacauuucaagggaaaucugaaguuaucccuucacugucuacagccucuugaauugacuucuggguguuacagaugggaccagcguguguaaaagcagaauuuauauucuauuuggauaucagaaucaaguuucucuuuuuaaaauaauuuuaugguaagucgugguuucucugauaugauuucuguugugagcggaacaaaaaucauggcgaaaugguguuauuacuuaaccaaauugccucguguacagacaggcugaacuggugcuuugccuagaguuggccuggaguuuucagaaacucaauuguggccuuuauaaggcugugccugggguuguauuuccaaucucucucaacuuuuguucuuguggaagggaggaaguagagcugugacagauauauugccagauagcacacaauagcacacaaaacgagaaagacacggcgugagccauucauggagacagauuuacgcucugugcugcccucaaaccauagauccaucuauuucagagaaacaacuugcccacuguauuauauuucagacagggacauggcuuagaagagagaugcugacuccuucuguuuagcuuuugccgauaaugcugcacguuuugcuguagaauuacuuuuguggggaugggaaaguauguuuggcaaaggaaggccugucucuagauuggaaguggaagaagggagauaucaggagaguaauuggccaugcugucgccauagugaaguauauguguauauuuuugcuggguuuuguuuccagccaacuauauuaucagguguuggauuuuuuaaacuuacuucacaauaagaaaaacaaagcuagagagauugugacuggccaaggccagaauguuuggcauucguaguuucucuuuaguucucucuguaggaccauuuccuggaguuacagaagaauugaccagugugucagugucuuucauguacauuaaugggcgauaguauugguagugguuaauauaauagcauggguucuggaaccagucugccaggauuuacauucaggcucaacaaugccuuagcuacaugccucaguuaucuuaccuauaaaauggggauuccaggucuuaccuuauaaggcagcucugagaauuguuuaguuaauauugaggcaguuauaacuaaguguucaguaaacuuagcuauugcauuuuaaaauuuguguugauuuuauggaaauaaaugaugaugugugauaccugguagauuguucggcagacauuucaaauguaaaaaaauaacucugucugcauugaaaucuuucuagauugauaguuuuaaauaaugaaaaaaauacuucugggaaugaucuacauuuggaagaaaucaggaaagagaagacuguguguacuuuugcauuucuauguuuugggcuuguaagauaugugauuguauauuucaugucaguaauaauuuauuuuggggaguagaagcaaaugucaguuacauacaucaucuauggaauagauuuuuaguuuuauuuauuuuaacuggaugaaaugguugaguguugccuuacuugguugaauuuagacauuugagaaaauuuuuuuuuaacuuuugugacacacaaggaccuuugaaugaaaucaguccccuuuucuuccuuuaaaaaaacuuauaagaauuaccauuucuugacuaaacaguuguuuucuuuuaacauuauauacuugucucuacauagauacuacauuuuuuaguuagauguguuuuggaagagcauugacuuuuuuuccuguuacauuggaaaaauuuaauggcacguguauguuauucuuaucaugaaguggguuuaggcaugcugccuuauacuaaauagaaauccuauaguaguuguuuuucagaaguaauccauugauucaagucauucauugauucauuuaugaauacuuaaguaugguuacauagguagggauugucagaauuggcuuuugagcauuuuguuuagcaguuauaauccagguggcaaauauacugucugauucaauuacuugcaugaaaucacuuuaaacagcuacuuaagaugaguugucccuaggccugucuuuaucuacuuauugugcaugugugcuagcauacacgcauuaucauuguuguuuuuuauuguguuaaaaaaauauuacaaaguguaccaucuuaaccauuuuaaaguguagauacuucaguaguguuaaguauagucauuucauugugaaacagagcuccagaaauuuuucaucuugugaauaugaaacucuauaccccuuaaacaacaacuccccucccuuguucccuccagccccugguaagcaccauucucauuucucuuucuaugaaucugaguauuuuauuuuauuuuuuauuuuuugagacgggcucucuguguugcucaggcuggagugcagugguaugguuucggcucacugcagcauccaucccccagguucaagugauucuccugccucacccuccugaguagcugggauuacgggcucgcgccaccauacccagcuaauuuuuguauuuuuaguagagacaggguuucaccauauuggccaggcuggccuugaacuccugaccucaaguaauccgccagccucagccucccaaagugcugggauuacaggcaugaaccaccacacccagcugaauuugaguauuuuagauaccucaucuaaauggaauuacauaguauuugucuuuuugugacugacuuauuucacuuagcacaaugucuucaaaguucauguaccauaugacagaauuuucuuucuuaagacugaauacuguuccauugaauguauauaccacauuuguuuaucuccuuauccugugauggacauuugaguuguuuucaccucuuggcuauugugaauuagugcuucuaugaacacgagugugcaaauuucucuucaagauccugcuaucacuucuucugcauauguaccuggaagugugggauugcuggaucauauggcaguuuuauuuuuaauuuuugaggaaccucuguacugcuuucuauaggagucauaccauuuugcagugucaccaacagugcacauguuccccagucuuuuaaacagccccuuccagacugacagaguggcuacauacagaacagggcagcuuugaagauuaggguggccuguuccaagcuucuucagacuccucgggacuggcuaauuauuuuuguuaaggucauacugcuggaccagggccuauagguuggcacugacuuacgcauagaauguuggccuggguguugauagacuuaggcugcaauugcuaugagugaucuuaggcaaguuaccuccacucuguucccugccauugucaucuguagaugaggugguuaugcuucucucuauuucuuaauuuguuccaaaaucuuauuguuuguuguagaauccaggcaucuaaaaaauauacuguguguagcuucguguaauuauuugauagacuggauuucuuuuugcaccagauaguucgguuuuuuuguuaaaugucuccuuuuucuuuucuuacucuuuaacugccccaaauacuaagugacgaggauggagaccuuggcaauugagugcuaucagugagucugaaugccuggguucaaauccuccauuuacuagaugugugaccuuggagaauguaacaaacuguuguuucacaguuucuccaucugugaaauggaaauaauaauacguuugugagacuuaggugaguuaaugccuguaaagugcuuugcaugugucuagcccauaguaagcacucauuaaacucuuaauuaucauauaauaugcuaauuaugauggugguaaaugagugaggucaucuuccauuuuggucauacuccacauuuggguagcuuuagacuuucugaagauacuauuuccuguaauguuucuuuguagguggggaggauauaccuauuacacaguuagaaaaacugaacaguagagauuaugcuuuauauggcugggauuaaaacuucagugucguguuuagagccuaguacuuccuggccuggcauguuguccuacacuuaaugacuguggggccugaguggguucuaauguuagaaucugguaagaacucuuccugaccucuuugcccauuuauaaacagccuuccagggugaccugaguaagaucauuuucuagcuguguaauccuggugguaugaaaacacuggaugucuauaguuuuuuagaacugugacuuaguacuaauacuagccucuucaauacucauacucuuaaggcuuaauauuugucucuuuauugauuuacauauuugaaaccuagacagucuuuucaaaggugaguagauauuuuauaugucugccuucuggucgguagcagcaguugugcaguuacucagcuguuggcaguucuguuacuuaauacagaggcagagagcgaaagacuuauucagaaacaaaaccucugcuugaaaaguucucaaggccagccauggugguucggccugcagucccaagcugguguggccugcagucccagcacuuugggaggcugaggugggaggaucacuugaucccaagaguuugaggcuguagugagccauugauauggcuccguugucuggagaaacacccagggucucuggucucgugcugagaaaaucagcaacauagauacacauggagugguuuaaggagcggaaaguuuaauaggcaagaaagaagaaaacagcuccaccguacagagggaagagggcucagaacggaaaacccccauugcuggggggaaugccguagguuauauugggaggcuggaugaggcgguaucugauuuguauagggcccaggggauugguuugaccaggcuugucauucacauagcccaugaaaaacuggcccuccuauccuagucuuuuaauaugcaaacgcagcuaccuggcugguugccaugauguccugcccacauagucucuaccuggcuggucgccaugauguccugcacacguggcaacaaaaaguggcaggaaccgccauacuggguggaccuggcuuuuaguugccugcauuugcauaucaaugcuugcaggucugguuuuucagucugcuuucuguuagaaaagaaauguuuugggggcugcuuuuucaguaaaagaaaaagccucaccgaggacucuuuuacccucucuaucugcuuaaaauaauucuuaauaacuccuguaauaccaugauugugccacugcacuccagccugugugacagagcaaaaacuaugacccugugucuaaaaaacccccaaaaacccaaaaccaaaaaacgagacugggcgcaauggcucacaccuguaaucccagcacuuugggaggcugaggcggguggaucacuugaggccaggaguucaagaucagccuggccuguuacauagugaaacccugucucuacuaaaaaaaaaaccaaaaaacaaaaauuggucuggcaugguaguacacgccuauaaucccagccacuugggaggcugagguaggagaaucacuugaaccugggagguggagguugcagugagccgagauugugccacugcacuucagccugggcaguagaguuaaugagacuccgugucaaaaaacaaaaaacaaaacaaauguucucaagucauguucaagagauaauggcggacauaauggaaccucccuaaaucugauuuucuccagcuauaaaaugaagggcccagaucaggggaugcuuaagggcuuugcaaguucuaagacucagccaucuugagauuggaaacagcccuguagguucuuagggcaugaugaagaccuuugaggagaaguauuuuaacagcuuugugucuuggggaggaagagucauggggaggugauuaggugggcauuaaaggagcaacuggagaaaggagagacuaggaggcuguuuugauaauccacaugugagguagacugccccuuccugagugccugaggggcacuugcaccuugggacagggucaagguuuucucugagauagcagcucccacaggccuaggagccuucuuucaugagcuugcugcccugguucaugagggagggauugauggaucucugccccguucuguuuuuuugcuagcacugucuucacacccuguugccguuuauguuuuuugaugaaugauuaauuagaaaaauaaucauuuguaaauugugagugaaccagacauuuggcccugacuguagggaaauggcgccucugagccggguguagcuugcagccaguacaucagagcuccaguauucccagaccagugaugaauuuacaugaaguuccuuuucagcauguuaaugacuguuacagcugaguaacuagcgaaaaauaauagcaaaugggaagaguaaauauuuaaugcuuuuauaucuuuuagcuuacuguggaauauguauuuugauuuaggaaggacaugagagucuuagagacauuagagacaauguuagugugucugagccucauuccuuguuuccuuuucuuucuuugcacuuaauuaaauuaaaaggauaaagugaguuguugugagauggauuuuacuaggggagugguuuuucuguaaguuuuaggucacaagaugcgucuuuccuggcaguuaaaaucuguauguucagacuaccucauugauuacgugccugguguguacagggacucauauuguuucuaaaauucagcuuucaucauuuuacucuccugcuuaaaaacuuuagugacuccacaccgcuucugggcugaaagauauacucaguagccuggcuuuuaagggagggccucugugcugugaguccagccucuuuucaggcucucucccuaaggcagcuccauguggcuacauugcucaagccacagugguugacucccuguuccuguaacuugcuggaggcuuccucaccuuugcaccucugcucagaucauuuuggggcaugaaaugaucuugucuuuuucucuaucuaaagccugcuuuuccuccaaggcucaguucuagacguuucugugacuacucugacuggauaggagccuguucauuuuggaauauagagaaaauugaaaguaggucacaguucucuauuccuuccaguuugccaccucucuaccacagacaauuaauaaugaacccuacuuuuccccacuuccuguuuggccaccaucuagucuuagacaaacuaagcuauuuguccagguaaacaaguaguuguggacuacagaaauuucugaagauuagaauugaaguuaguagggaaacaggccucaaggauagugccauauuuucugagagcagaugauuuucagacaaaagguuuuaccaacagcauucauauaaaguacugcuuuagucugaguuugcaaugguagaaguagaguaucuaaagaaaggauccaugcccuuuuuuuuuuuuuuuuuaaauagagacaaugucucacuauguugcucaggcuggucuggaauuccugagcucaagugauccuccuaaagugcuagaauuacaggcaugagccaccacacauggccaauccaugccuuuuuacucuguuguagagacugucuuggaguguugaguucagacccagauaaaacaauaaucuuuagaggaaaugaccaagaugaccagagguaggucugaaaacaugaaggccguguggguaagagagaacaagggaguccaugccuucuguuuucaaauauuuaggaggcuacugucaggaaggagggauauuagacuucauguauggaaccauggagugagaacaaagauugcuggguguagguuauaccaaagauaaauuuuaugccaauauaagaaauaauuuucucauagugcugugauaaaaugaauuuccccaggagauaguuucccaaguaggaagggauaugaacaacaggagcugauauuugaaucgugaauauacguggccuuauaguaaaaggaccacagauacucgaaugucagaccuuuaggaacaagucauuuucuacuguaggauuuuggaggguucauaauagaaaguaacacaucuccuugugucuaaaaauaggaauaaauccuaauaugaaccaaaaaauauauuagguacaguuuucugaguugauauugaaaugaugaaaaagaaagagaucugggacuggggguucuuaacacacuggguuuagggaccucaagaauauuguuuaagaaugacgagagauuugcaauuuccaaggagucauaagcaguuucaaaaaguugaauguuuuugaggaacuuaaaauucuguuguuuucaaaauacuauagaaaaguaauauuacaaaauugucuugacauaaguaauuuggguaugcuguauaaaggcuucuaagaauuaagaaacauggcccggguugcaaauuuuaaugcaugacuaccuuuuuuucuauagaauauagcuuuugucagauucucagcaguggcucugauccagaaaacauuaagaaccacuggucaugaguggugauuuucagcuuuuuuggucuuaacccacuuaggugggacagaagcuccuuaucucaccuauaccauccagcaucaagauaagcacacguuaauaugaaccauauacauauuuuguuuuauaaaaguaucccauaagcuuuaaaaauguaauuuugucauacuuaccuugguauaguagauuguaaguuauuuagagacuauaaagucacagaugaauguuuacaaguacucuuuuuggaguugggcuuauucuaucuaugucuucuuuagcaguggggauuuggauuauucuuaaccauaacacauacaagucucauuauuggaaaauuacaggacagaaacaaaugcuguaaauaugcaccacugcgcaucaugagauuaaacagacaauuuucaaaaagucaaauuucuaaugauaaaauuaaaguaaguaauuuauauuuaaaaagcaggaauagcagcaaugcaaacugugauugacuuaagaccacagugagguuacagugauaauaaaucauucuucuggagaauugugagaauuuucuaacuguugguguguguaagugcaagguaggcacuuugcauaauuguauaguagcugacauucuugauaugccaguuucaaguccuuuauauacuuugcuaacuugcugauauuaauuuauuaauacagguuuuuaggacuccccucucuuaucuaagguaacuagcuuauuaaagcucauauuaaagaaaacaaguaucuguggaaauguucuuguggguaccagugauucuagagccuuacguuaagaaacacuagucuaauggaucaauguauagguaaaugauauuagacauuuugaguaggauuaagauccaggagacuaucugaauaaugaccuuucucucucuuucuuuuuaaaauauggucauccuaacgcguaugauaacccagauacucuuucuuuuuaaauacccuuuuauuuaccaacccucuuaaaccuggcccugaaguuaagaucaacagcuaugugugaauaauuuuuuuccuucuccuuugcuuugcuuuuccuaucaaauugaaauacccugccacuuucuucccucucugaaaacacaaaagaggauuaagccauauaauggacuauuuaugugucaaauuaaacguuuuacucugaggcuguuucugaguuaugcgagcaguaaaaauauguauuaagcugccaagccuuuuaaaaaaugcauguuauuuagcugauagccuguaacagucugauggacccauaaugguguuuugaguaaauacgcauuugaacaauuuaugaaacuuauguuuacauguguauuaaacagccuggguagggagugaccaaaaguuauuaccaguugacagcuguugucuggugaccaauuugaaaugaauugguggauucccuucagugcggaguaaacagguuucccagucaggggagcaugcugaauaauuaucaguguguggggccucagcccuggaggccuguguguugguugaaugaggugcuggaauaaaaugucucaacucuacagugaaguugcaccuuagauucacauuuaugaucuaguuuauuuuguacuuggaaauuuauaauuauguucacagaguacaggcugugcauaacaauauauucugcccuugggaagaggguucauguuuguuuauuuccuuuuuuucuuuuuuaacugacauauaaucguacauauuuaugggguacauagugauguucaauacauacaauguauagugaucagaucaggguaauuagcauuccaucaucucaaacauuuaucauuucuuuuuguugggugcauuuaguauuuuccuucuagcuauuugacaauacguaauauauuauuguuaacuauagucaucuuccagugcuauagaacacuauaauagaacuuacuccuauuuagcuguaguuuuguauccuuuaacagagcucucccuaucuuccccacacccccuuguuuauuucuuugacauuauccaucuagggaaaugaucuugaaauuuuuaugauguguccauaucaacaauacauauuuuauauuuguucacuucaaaauuauaugcauauuuacauguguaaauuuuauuccaaaauuaggaguuuaaaggauugagauaaaaauuaauuacauauagauaauuugauuuucuuuuuguaccugaaugaauccucuuuggcacugucugggaugugcagauuuugccuuggagauuaaggcgagugucuugaaaccuuuguguaaugaaaagggcauuguggauuauagucauucauaaaccugggcaaaucauucagcuaccuugaggucuaguuuccucauuuguagaauauggaucccugccugggggguuucauaaagacuacugauaguaaaugucaggugucuaccuugaccacaaaaucacuuccucagagaggcuuucccugaccucuuuucuccaugauagcuccucuuuucuuccugaucacucucuaacuccuuaccuuuuaauuaauuaauuaauuaauuuuuuuuuuuuuuuuuuuuuuuuugagacggagucucucucugucgccuaggcuggagugcaguggcgcgaucuuggcuuaaugcaacuuccaccuccuggguucaagcgauucuucugccucagcuuuccgaguagcugggacuacaggugcgugccaccaugcccagcuaauuuuuguagagacaggguuucaccguauuggccaggcuggucuugaacuccugaccucgugaucugccugccuuggccuccugaagugcugggauuacaggcgugagccaccgcacccggccuuuuauuuauuuauuuauuuauuuauuuauuuauuuauuuauuuauuuauuuauuugagacagagucucucucugucggccaggcuggaguguaguggcaugaucuugacucacugcaaccucuaucucccaggcucaaguaauucuccugccucagccucccgaguagcuaggauuacaggcaugugccaccaugcccggcuuaauuuuguauuuuuuuuuuuuuuucaguagagaugggguuucaccaugucggucggccaggcuggucuugaacuccugaccucagguaaucugccugccuuggccucccaaagugcugggauuauaggcgugagccacugcgcccggccaacuccuuacuucuauuuaaaacaacuuuuuaccaucugaaugaauauuauuuaaguuucuacuggauuguaagcuuuguaaggggagauauuuuuaaaauuuuacuuuuuuggucuguuacugcuguauccauaacuccuagaauagcaugugcauggcacauaguagguacucaguaaauauuagucaugauuugaauauuucauaacuuaguaguugacuaauaaauagaggcuguuacuguuuucauggaguauccuacauauaauauaguugguguucuaggauagaagacauaauucucuauguaugaauugcucucacugucacaggauccuuagggugucacuuuuccagcuggaaaccucuguggccuauggugccuuugcccaaguuuugcuccggccugcugggcuuguuccacccacucagcugggcaggcugugcucagguuuugcugccggccugaaucccaugccugccaagugugagcaggcgcagagcggcaaggggugugugagcaagugcaggguccggccacuggcacagccaggcaugcuggcuguggggugggcagcuccauaugaggcuguggcuggaccagguguacugcaagcagcuuccacugugggcacuggggaaugcgguggcaccuggaagcuuggagacuccaggaaccacagaaccccaaacagggugucacaguccuggcuuguagagccacuagguuugggcuuccugaagggcugcaacucuucucucuuucucgucaccugcaauguggcuauuggggguuguguuacaccccuuucagucccgcaauucagcgggugcugaguuuuguccugcauccaggaagaaugagauacguggacaaccagagggugagcaaggcggagaggggcuucauuuaagugacagaagagcucuuaggagaucagaaguggguagcucccuuccacagcaggucauccugacgaguuuccagcugucagcagagaggagacccauaguggguaagugcuuuccauagucagguuguccugacaaguugaggagacccaaaguggguaucuccuuccugcagcugguaguccugacaucugccugagucuaccugaguccgaggguuuuuaugggcucggaagggaggaaguaugugcugauugguccauggguggccaugagugggccuggagaaagcaccguaaguucuuauuccaagccacggacuccagcuggaacuggcagccuggccccuaggcuucaggccaucccuggcuugaaguugggguuucacaggggaccuaccccuuuccgcccaggaaccugucugccucccaccgucaacaagcuguccauugugucuaggcuguuugugcagagaggggugucugcagacccaugccaagcuacccucagcacccacccccauccuccacuucccuccugcaccuguuugcagccaaaguccagagggggccgagguggcagagggcuggugugucaacaucaccugagcuacuguacaccugacugggucgcggcagugcccagucucagccacaacuuugcucugcaccagagcaggugccgggaguggggagaggccagggagugggagcauguacuuccaagccuaugggaguugggcccccgagaacacagggaugccuggguccagagccacagcugggcagcugcagcugugcccaggagugcagggcucccacccugcuaacucgguaugggguggggcuccugucuuuuccuggcugugccuccccugcugcagcaugggccgcugcugccaucaucagugggacccaaggcaggaaguguuuuuuccuguagggaggauagauuuuuuuuugucucuuacagguagcaucuggcaggcauguagaaguuagacaugaagccuccacccauggaucugagccaaguagacugaccuguguaagcuucagaugccucagucuuggucuccuuagcucccuguuuuugucaacugugccauccagcugagcaccuuagagcuugaagcugagagcuucagcggggccagugccuacaagggcuguguguauaugcuuuagaggugggagaauugugcugccagugggcguuuggcccacuaaggagaacaccugugaccucugcaaucuucccuaccccuggcauuccaagugccauuccaagucuguagagauaauagaacaaacguaauuuuuugugugguuggcaacgaagacuggaggagaauaaccacaccuuuggaagacuucggugguccuuugaaaugaggaguuuuuauagaaacacuuaucauuuuaaagaccuaccauuuuuaaggucacucuucugcuagggcugugaaauacagacauaugaaauguuuuccaguguugcucugguacuuacgugugugaugauuuuauuggagaaauggaugaauaugagguuggagagucuuuacauguaugaacuaucaaauauacaguucaguagccugaaaacauuaacaaauagcuuuuauuuauuguauccuuaugucuuucaauuugguucuuaucuguugucucuucaguugaugcaaauuugugcucaacuuuuccugaggggaaauggagagauacuuucuuggauuagcuuaugaucuugaacuugacuauuuuaaagagucaugguauauaccaaucuggauuguguuuaggauggggcuugggggaugguuucuuuguucucuuuuggcccacgucuucuaacaacccauuuguuuaggggguuuuaugcugcuuagagugagcugagaaugugcucaagcacauaauuuuagccuguuuuucagguuuacaugaaaaauguaacaggcuucugaaaccccucuagguuccagcuuucaagaggcuggucaggaaugcacugaccgagagacuucccucaaaauuaauuuauaaacacgcuagaacuuuccucaccuuaauuuugagaaaaagaucucucucauggcauuuucaaguguuaugguagauggaaauaaugaggaaacuguggcaccuugaacagagugagagguuuagaguuguauagaccuuaguacaaauuuugacucugucauuaauuaccuguucugucaugagugaguuacuuaacauucccugagccucaguuucagcaucuguacagugaggauucuauuuauuucauacuguuguggagacuugagcaacagagugugaaaacaucugucagcgccugguguauuuuggacauucuguaaaucuuagcagcccauuuccccauucuggggguaaagccacaggacuuuuuuggcaaauaguugagauacuuggugccaaaaggaaauuuaacucaugccaugacaaguuuuuuuguauaaggaugggauucuggaaacaugauaauuuuuucucuuggccauauggauuagcaaaggcuuuagaaaacuacaaaaaagacuaauuuguugccucuggauguguguguuauuuugggcuguuaauauacuugacugcuuguuucaaggacuggaaccuuuucuuuuaccuuuaagauuccugcauuuucaugugcucauucagcugggauuuguguuucauagaacugguaguauuggagguagaggagauacugugauaucauaucucucucucugucugucucucucucucucucccacugaagaagagaagacaaaauuuagagaauuugagacuugcucaaaguuguguagcuaguuagcgauaaagcuggaauugcaccagauuugauuuccaugacauugcuuuagccuggugguucucaaagcaugguuauuggaccagcagcaucccuugggaauuuguuagauaugcaaauucaugagauccccauucccuuaucagaaauuuuaauacgcuguguagggugauucuaaugccugcuaaaacuugggaaccacuacuguggucuuuacacuauugggcagggagaugggagacuacagguagauuugcugaauuucaugggcaacacuagguuuucauuuuaccuuauuguucugccauuuagaugucuccucuuaaaacauuuuuacuugcagugauggcuuccuuagacucgugugugauuguugcuggggcaguuagguggaacuaauagguguugcuuguugauucccugcuaccaaguacuaguuuugaaauuugaguauucauuaaaaacaaauagggauuucugugucucacuccuggaaauucugacucaguggggguaaggauuaggaauguuuaauuuuugaaagcccugcagguaauuuuuuuucuacuuuuuaaaaauuauaauuuuuauuuucuuuacuguucuuuuaagacauccuguuauagcaucugcaggugauuuugaugcccagccauguuuggggaaaaaaguuuggguucugagugaaaauagaaaacguaaugacauggaaaggaagucaggggauaagaaaagcucuauggccagccaugguggcucacaccuguaaucccagcacuuugggaggcugagaugggcagauggcuugggcucacgaguuugagaccagccuaggcaacauggcaaaaccauguuccuauucaggaacaaagaauagaucacaaauuaaacucuguggguuuucauaaguggaaaguuggcuuucguuguucuguauuugggugcuuaguggacaggaguuaucuaaaagaaguaauuauaguuguaaugcggacccucaaaguugaaaguagauugaaauccauuauuuuacaagguggccuuacuauuuauaguuugacuguagguauggcagugagagauaaaauuacuuuuucuagcuuugcaaaacgccaaacgucuuugaaauuaagaguaaaagggguuuaaaauauguacugcuuuauaaagcaggaaaaccccacuggaacauuuuggguguuuacagaaauggguauuccaugggagagaacgugguaaccuauguuuugucaucauuuguuuaaucacugaaaauauauuaacaggccaggcaugguagcucaugccuguaaucccagcgcuuuggcaggcugaggugggaggauugcuugagcccaggaguuugagaucagcuugggaaacacagugagacuccauuucuacaaaaaaagaaaaaagaaaaaaaagucacaugugguggcacaccccuguggucccagcuacuuuggaggcuaaggugggaggauagcucgagccccagagaucaaggccgccgugaacugugaucgcaccacugcacuccaggcugagcaacagaucaagacucuuguauaaaaaagaaaaaaaauuuuuuuaaaaauauaaauauagauuaacaaaguaacagggaauauaauauuuucagguuggucauauagaggaaauacuauauuguguuauucagcuuaauaaaauauaaaacaaaaaaauuauuaacuguuugaaaaauuguagucagauauuugauuagggguagguccugauuuggaugaauuugaaucacauucgacuaaauauugugcuuuuuaauacucacuuuaaaaacaaaauuaauugggcaaauguucauauccauuuuaaaaaacuauccucuuaaaacuagauugauaguagacauuaauaggcuugauguuguuuauaauauuuugcuauauuuuaagagcaugcuuuuguauauuuucuguuuuagugaagcauuuuaaaaaugccccccucccacaacugcaggaauaaaucuaacagauuuugaccaaaauuacucuaauuuugaauuucuugaaacuggguauggaaacuagacauuaaaaaaaaucuuuauuuuuaagcacgguuucuuggucaguagcuucuguauuacgggagaacacaagaaggggccuucuugacacucaagaaaugcucuuuuuccaucuacaaauaggaagacacccuuugugguauuuuuguuuugugggcccugaaugaaaacguauuaugaucaguuuuaaaaauugcugccccuuuaauaucugaauauauucguggcuagugaagcacaugcaucugucagaucaugggugagaauucacuuuucuuuuugcgauuucuccagccacaaggacaaauuuaguuuugcagagcaguuugacaccucuagaagccugcgguuagccucggugcaccucuagcagcugcauaggcucaagaggaccucuguucuucccuuuuugguuugguuaccuuaccccuccucagggaaaggccaagagacucagcacuuccuccccaagugaguuuccuuaguaacgucagccuucucuaaugcuggccaagggugucuuugcugggcuguuuucccuccaaaauagacucacugggguauagaauuuuuuuuuuacgugaaggguauagaauuauuuucagaauagcagcaggguaauuaggcucauuguugacaugucauugaagucuccaugugacaaaauugcuccucccucuuugagcacucugaauacucuuacccucuuaucucgaucugcucuuuagaaauaccagcagauaaucugggagaaggccaccauagccaugcacagaguggggagaaugaggagaucuuugcugaaugucuuuuaguuguuugaguuggagauaaaugcagaaugaccuccauuuugcccuaagaaccugaccuucuugucacuuuguguaacauuaauuuucuaauguguucuggucaauuuguaaaaagauuuuuuuucuagugucucagcuguugguuugacuuuuguauuuucauugguaaaauauguaugucuuugcugugagcagagagaaacagauuaauaaaaaccacugaaccagcauugcauauguaauuaauuaacaccaccaggaaagcugguucaugguuguguguaaacuuauuuccaaacaucuaaaaaacguuuagaguuaucuuauucaguugucucacuucuaagggauagguuaggaagcuguaacguauguguaugcacagaaacuguuggacaaugauucucaaacuuuacuuuucauuaaaaucgucuggagggcuuauuaaaauguagauugcuagaccucauccauaguuucugauucaguaugccuggguggggccuuaaaauuugcauuucucauguggccccaggcauugcugaugcuacuaguccaaggaccuuacucugagaaucaguuuuaggauguagaucuuauguuccucuuugccaagggcaaaugaacugaauuguauaggcuuccuuuucuuuuacaagaagcauugccucuucuaaguagacauccaccaaauauuuauguacuguauccauggugccaugcacugagcuaggugcacuggggauaaauaaaaugaucucugccuuggggaacucacaguugagagaggauuaaauuaagaaacccaccaaucgugauucaauaugagaagugcuguggugaugucagggguaggcuuucuagauuugcuaugaggugcagucugagcuuuuucucagacugucuuagcuuuauaccuacagaaauaagugaaagaaaaugaaucuucugcagcuuaggauuuuguuagugcucagaucaguuuccucucguccuugacuuugggcaucccaagcucuguauucagacacuccugaacuggcauugugagcucuccaccccagcuuuuguggaagaguccuuccuccauuuuuaaauuacaauuucagacacuguccacuguggcagcaggauuuguaacaagaccaaguuaagugaucuuggcugaacugauuuaugagacagcuucaaaaauucaugagguaccaugggaacuuucuguaguggaucagcaugccgcuuuuccuucacuucuucaaguagaucagacauuuugugauaacacggcaguuuauaguggagccuucuagauuauggcucugcugauuaagacacuaagacagaccugaagacaaagagaagggagaacaggauguuacuuuuagaaacuccuguuauccuaagcuugagcagggacuuuggguaaaauacaucuauguauaacucaauuuauacauagaacucucuagggcaaguuuuucuccaguggugaucugauauggagugucuuggccauuaauaauggucccauaauuuuaagcacaauaaaauguuagguguguauaugcgaaaaauugagugacauaguaguugucucuccucucuuugugaaaaccgguagacaggaacgaaggauguggccaaaaccagugacagguuauggugcuuucccuauuuuauugauugcucauuucuagucucuaaccuuauuugcuacuuauugaucuaguagaaaagcaaauaauuuucccuagauaguauuuuguugagcugggcuuugaugacuugucuaccaaaggguuuuuaaaaaguacuuaccugcugaguggcagccugucuaccauuuaauguuauuaucugugagccuggggguuccuucuuaguaggaucacugaugucauaggcugccucuuuauucugccuacuuuccugcaagauaccacacaugcccguggucugcuuuaauggccucacagugcacacagccuuagacuuaacacaagaaacauaugagugaucccauuggagauaauguguugccgagucaauuugggucagcaucugccaacaugucaaauuuucacacuagguuguauuuugagauuuuuauucaugcuuuuggguucaaauuuacucacaaauaaguuuugaacuuuuaagugcuaaaacugcugaguucuugacuaucugcacuuggggaggggaagguuaaagauaagggguggguauguaugggaaggaaacaguagcacagaucaucuaacauaggagguaagauagauuucccaaugucauauauaacuuugacuauauauuuuuuccuauguuuacauucuccuguuuaugauuauacucuuuugguucauauuaaauugguguuuaucuccuaggaauauauauggcgaggugugucauaggaagcaauagaaaaagaauuuggagacuggucacuuauaauucuugaauaauauaacuauguagaguuaaaagcaaagauugauccugucauucaugggauugaugggcauuuuugcugguaucuuauuauuguucauuucugaguagguaauauauuaauaugaucccaaaagcaaaauuguauuaagaaguauauagaggaaugucucacucucaucccuggaccuaugugccccauucuucaggcuuuuauaacuacuuuauuagucucuauuacaucuuuuguaauuucuuaaauaguguguguacucuccuauuuguguaugcucucgcuuuuucugcccuuuguuauaccauauuuagcauacuauaagcacuguucugcaucuugcuguuuuguaguuaccaauauaucuuggagaucauuccaucucacuacagagagagcuuccguauuccuuuuuauagcugcuuaauauuucauuguauagcuguaccauaauuuacuuaaccugucugacacuuugguuauuuacaaucuuuugcucuuacaagugaugcugcagugauaauguuuuuuuuuuuuuuuuuuuuuucccgagacagaaucucacucuugcccaggcuggggugcaguggcacaaucucggcucacugcaaccucugccucucagguucaagcaauucuucugccucagccuccugaauagcuggaauuacaggugcccgccgccacaccuggcuaauuuuuguauauuuaguaaagacgggguuucgccauguuguccaggcuugucucagacuccugaccucaagugaucugcccgccucggccucccaaagugcugggauuacaggcauacagugaauaaucuugaucauauggcauuucauccuggguguguguucaguuguaggauaaauucccagaagugaaauuguuacagugaaugugcauuuguaauuuugauagucacugcuaaaucccucuguagaggucguacuaauuuauauucccaucuguuuaagaguagagauuuccccgcagucuugucaacaggguggugguguuaaacuuuugaauuuuugccaaucugauaggagaaaauugguaucucaaagugguuucaauuugcauuucuuauuaugaguaauguugagcauuauuuacuauguccaagaucugauaguauuuccuuuugugucaucaacagucugguuauauuucuuuccuguuuuuucuauuugauuauugcuauuuuuuuuuaauuuuuaaaauaagcuauuuuggaauacuuauagacuuaccaaaaaguugcaaagauuacggggauuuuuuuuuucuuuucuuaugcccucauuagcucguuaauuggguuagaugguuugaggaaggacaggucuccuggaauucuguggcuugucauagguuugucagcccaaauaaggaugcacauccaauucacgacuccuggcugccucuggggauuuuccauauggagugacagacuugggaaauucugcugagcuucugacuagccuccauuaugaggcauauaauucagagcccaucuuccauuauucuucuuuuacuaguaucaauuauuaacuagaaagguuauugaagugaaaaccuugccucaaguuuguauuucuugagauuuacuuccaauaauaaaugugguuuucaagugacugaaucuuucauagaccaaguuucgagcacauuaaauauuuggugguuuugcguccucucugccucacaugcuaauugagaggaugaguagcuauaauuuuucuggagcuucaggcugucauucuguccuguuaauugguucuuggaguaaggagcuaaaauguggaggcagaaaugcuuucccagauagaaacaugccuugaagcuuuguguccuguaaggguccacauagccuggaaguuaagaauacuggcucuggaauaaaaccuuguggauucagauuccugcuuugccacugcuagauguaucaccucggacaaguuaccuaaccucuuuguaccucacucucucccuguuuauaaaauagggauuagaacaguaccugccucaucuaguaguugugaagauuaaaugugaugagacauguaaagugcuugguacaggccuagaacauuguaagugcucaauaaauacuggccgaaaagucguacagggcagugguuucagaggccaugcaauaaaauaguggguuauguugcauuugacuuuuguugauuaaccuuucuucuuccucuauucuuuaccuugugaggcacuuaaccuacuaacugaaaugccauucauucagccaguauuugagugcucagcaagugccagacucuaaacaagaugauguguaagaugcugcaaggagcccucgugccuugcagccugagcacaagugccuauaaacgcaaggcugguugucgucauugccauccccaguauacuuugagaauacaaaagaaugugaggucacucuccuuugacuggggugacgaggacaugcauugugaaagggggaacuguuagaacugggagccauucguaagugaaauaaggauaagagggauauuaucagcauugaugcuaauuagcauuucuguagcauuuugcaguuugggaaacauuuuauguauuuuauuuuaucucagucucauaaaagagcuugagguauuauuaucuccaguuuacgacugaagagauggggagucaaauagguuaucugauucucccaaugccauacagcuccuuggugguggaguugggguuugaguccaggucuccugacucugaaucuccacgugcuucccucuggucucuugagugaaauaacccguacuagcaagaaagagaagaguaugucggcaaaagagaaaccuggaauaguugccaauugucccuagguucagaucacauacuucuagggcaucagagcuagaaggaacaugagaucagugcauccucuuuauuugacuaaugaaaacauugaugugcuugugagggacuucgagaggucaauguggugcuggaagcagcucaauggagaggguagacaguuccccuuggaugcucauguguggucuucuggggauugauuaguugcugguaaggaaggagcucauuuuggggaaaguagguacauagauucauagagggaaaaccuuuauucagaagcaggcaguuuuucugcaauaucuuccugggaaacacaaauaaaagggcuguaguuuaguauucagaugugguucugguugugcaaggauaaggagaaaaggcagaggcagggugagaaggaaggaaaaugaaugacugauuugaaaggucagugagaagucugugaaagguacauacuuagggucuguagggcagucauuugaaauccaggauacuuaguauauauauaggaggacuucguaguaguucucugacuggaagaggacugggcugccuugugugugugagcuuucaucaugggggcagugguuacuacaugcuauuucuaagaauugcacuuguggggugauuucuacuuuggguaggagguuauucuagguagagcuaguguggaucagcaacaucagcaccaccugggaucuuguuagaaaugcagauuuggggacuccuacccuagacuuacugaaucagaaucuccagugggugcaguucaagaauguguauuuuaacaagaucuccaagucauuggucugcauguucaauguuuggaagcauugcucuagugcagaggcucuccaagauccuccuuuggguucucggcuuaugugauuaaugugccauucaccaaacauuuauugaauuucacuuauguaggcacagcacaaagccaacucucacauggauccugcuugcauucuaguugaggagacaggauuguuuacaaguaacuauuagguuggugcaaaauaauugaaguuuuugccauuacuuucaauggcaauuucaguggcaaaaaccaugguuacuuuuguaccaacaguauaaaaacaguguuaaaggcuaguacaggaggcacagagaaugccugugaaaguggaggguggacguuuucauaggugugugcgggagcagguggcaugcaugguagggggaaucauuacuucugugcaggacuccugaguaauuuuaaucugugguuugcugcugugcaaacccagaggccugucuacaacuuguuuaaccucccccagcccuugacuggguuuacuuuauuggccugauaaguaguauaaaaauuggcagagcuauuaagaugacucauggaaggauauccucagcaucuccuuuuggaucuccucacaccugcacugcuucuucuuaaaugccugaauauccaccacuuuguaaaagaaaaaaauugauuugucacugaauuuccaugccucagccugagagaaauguaaauguuguacuggccuuuaguacucugccuucaagccuagauuuagagcugaucauuauacuuuuagaguaggcuagguaugaaaauagcagcagguugaagagucagaggaagcuguuugcucucaucugcugguuuggucaggguggaaguacgaauauuaauacaguccacuuaaacaauaaaauagcucccagggaagaggaacuauaaacuucaguaaauaucagagauguuaaaugcuaaaaauaaaagcucucugcaguuguuuggcucuuuaaagagauuguuuauuggucaagagugcuagucuguuuggucauguuuugcuagcuuuuuaaaaugcauguauguaaaugaauuagaauauaaguuaauuaagcagggcaguguuucuagaaugugaaaauaguaaccuggcuaguuaauuuaauuaaguccuugguaauuuucuuuuagaaacaaguuucaucuugggaggucacaacguccuggcugcugugcuucugagcuuuaccuugacuccauccucuccucucugucauccuuuucucuggcucugucacuugcauuugcccccugacuugucacccugacuucauuuccucucucccagcuguuuacagugcuaucacaguggucuuucagaaaucccaaacucugcuguugaacuggguucuaaaaaccuucagagacuucauguuguccauaggauacacuguuuucugaacuccuuagugugccauauuaggcucucuacagucuggcucuaaaauacaauuuuuuuuuuuuuugagacggagucucacucugucgcccaggcuggagugcgguggugcgaucucugcucacugcaagcuccgccucccaaguucacaccauucuccugccucagccucccgaguagcugggauuacaggcgccugccaccacgcccggcuaauuuuuuuguauuuuuaguagagacgggauuucaucgugcuaaccaggauggucuugaucuucugaccucgugaucugcccaucucggccucccaaaguacaggcaugagccacggcacccggccucuaaaauaccauuauagccuaauuuucaggcuuacuuuuucuugugguccaggccacaggacuaucugcuauucucaauacaaauaaaauauaaccaguagccacccugcaguaguagggacaauucaggugccucgacaagcauugucugauuacacuauucaauacaggaucaaagaguuuugucauuugcccaaggucauguaccuuguguuagagcugagauucauauucaguauuuugauauucugacucaguuuccugcuuucaugucucugugcuuuccuuguauguuuucuuucuuuuuuucuuuuugaggcagggucuuguucugucacccaggcuagagugcaguggcacaaucacaacucacugcagccucaaccucccaggcucaagugauccucucaccucagccuccccaguagcugggacuacaggugcacaccaccaugcccggcuaauuuuuguacuuuuuguagagacgggguuucaccguguugcccaugcuagucucaaacucgucagcucaagcucucugccugccucggccucccacaguguugggauuacaggcgugagccauugugccuggccuccuuaugucuucuaugccuagacugucuccuacccuuuuucuuugcagacuuggaaauguauagguguuagguauuccuaacaaugugcgugcauaggucaucgggccuaucucaauuuagccugauaguguaaauacuaguacuacuacuaccuagugcuaguacuaagagcugaucccagaucuuaauuuuucuucauuucuccuccaaauaauaggcgguuuauaaguauuauggaaugaaugcauggauggaugaaaggaugacuggauagauggauggucagucccagugguuggguccguuugugauuugaccaaguucaaggcuguagaauugcuauguggaaagaaugcauauuauuucagcuauaucaaauagcaccuagggacggccugacugacagggaacaaauugucagcccucauuuggauccaaguggaaauuaaucugaagaauuuggaaugggccuauucgugggaaauugcuuauuuuuauaagaguuuauuuucugauuuguggcuauauucguuggcuagggccacuguaacaaagaccaggugacuuaaacaauagaaauguauuuucucucagcucuggaggcuagaaggcugagaucaagguguugagagguuugguuucuucugaggccaaucucuuugucuugcagauggcuaccuugcuguguccuuacauggucuucccucuaggugcacauauccguguucagauuuccucuuccuuuaaagacagccgccauacuggauuagagcccaccauaaagaccucauuuuaauuaauuaccucuuuaaagaccuucucuccaaauacgguuucauucugagguacuggggguuaggacuucaaccuacaaauuuugaggauaccucauucaccucuacccaacccauccccucugccuuuuccucuuguugucuuucuucuggcaguuuuguuucacucaagggcagucaggaagagaaguaaagauagaggaaaaggaaauuuauuuugggugcaguucaggagguguagcugggguuggggaugggcaguggcugaagcuauugguggaaaugagauuuugauauugccuauagauuaguauuguccuggaacauucugugcugguuuccuggacagccgauagcuggcuguguguguuggagggcccagggaauaucuguucuguuaguaagugagggggaaauugauaauccugcagccggccuggagaaguaaggacucuaucuuugucugucagcucuuccucccagaaguagcucagagacuugcugagcacaccuaggguagaggccaggauaguugaguuuuggacgcucugccuuggcuaacaccuugccuggcaucuagcagaugcuuaugaaauguuugucaaauugaauuacuuaauuuacuugacucaaauauuuuguucuucuccaaaccuuuuaugaggaguuuuuucuccaccuuuguuuguuaauucccaaacuucucuccaguucucaguuguggcuuaugucuuuucuuuccuuucucuuuguaauuaucagguaauuuauuaaauggagacaagcuuaacuagacauuaaauaauugcaggugugcagcugaacugagccgcuguccuuuaacuaggaaaucacagcugcuuguguuguauugugugaugagauuacacuucaccucauuugguuacacgauaucuugcuuauuguaagguaaaagaauguugaagcuucugcucuaagcaguacacaaaggcugguauguucccaggaaaccaacguaaaaaguacuuggaggucaggucuggagccuuugcaaccucugaugcuucucuuuucuuggaauuuuucauuuccuuugccuuuuucuguauagagaacaccugaauuacuccuuaacuugagaccuguuucacauuuuaaaauuuucuuuuggucaccuuaacuguaaaagcaagauuuuucuguuuccuucuaagagauuagcaguggguccauugguuagcucuuuuuuugcuuucauuaucagaccucaucugcauacuuuuuauacaaauuugccccauugguaagaauuguagcuuuuaugaauguuaauuuuagucauagguuaaauugugaugucaccagucuguuuucuuuggcuaguuucauaguuugugacuauugcuagagguagacacuaguuauauagcaaguaccuagcuuauuacagaacucagaguaugcugcuaauaaaggauugcuugauugcuugaaggguaugcagguguaagaaauauucaucuuucaauuggugucaaaauuuuuauuuaaaaaaaaagucaugcugccacuucccagcuuuguaacuuugggcaugccacugaaauaucuuaaucauuagauuuaucaucuagguaguugugaggguuaaagaaauucaacaaauauuugaaugaacuaucuuuugugccuuucuggaugcuagggauauauuugugaacaaagcagaauaaauuccuauccuugcgggauuaacauauaugaaucugguuuugacugucaacuggauggaguccaauuggugggagaacaugauaccuaccauuuaugaaaaacucuuuaaacugaaauaugugccuaauaacacuaacuuucuuuauuagggacauuuuaaccccauuugggcuuugcagaguaggucuuagagaaagcccuucuccauacuuguucguucagucguguaucauguacagccauccauuuuaugguuuuggcuguuguaaauaaaauggcuagagccugugcaucuggaguuguggugacucuuagucuugggaugcgugccucuuccucucggucguugcuuuauaggcugucucugagguuccagaaggggcucagagaaugagcuccaacugacauguuugagccuuugagucucuucaugaaagcucaguuuguucaaguaaaaucugaauggcucagagaggacacugugguguuuagcuuaccaagcccagugugauaucacugguuuguuaauaucuacagaaacacacacaggaaaaauauucuagagcaucauauugcucaccuccucuaaauucuuuuuucauggaugaucgaaagaaaaaccuuuuugagucucucucuucuuuuuugugaaugacuaauagaaagaagacgacacugguaacuuucagaagcauugugauagcauucugauggugggauuaugauguucagacaugggaggguauuagcaaccaaacaucauuuccuuuaggggacuggagguaguggucaucugugagucuagagcugucuucgagggaagugagcaguggcucuuccaaggacacagagaugucaggcaccucucucaugcaugcaagugcuacauauuauguccacaguaucuggaguauuuaaaccaggaauaacacguagucuuuauuauuggaagaaauaaauuaggucagaguuaguaugccaucgugugaugccaguuuguauucuuuauuuucuguacuugcuucuagagagggaguaaauacuaugagauaaugaagaaagacauguuuuugugacuuuucugauuuaggacacuuuauguuguggagguuuuuugaaggauuuggaauuugguugcuuauugagaaccucuugagaaaaucagauuaucucugauacacaaccaguccuacauugaguuuuuuccauuuauugcuguagagacaugaacauuuauuuuuauugaagcugagagagggguguuacaugguuguuuaucagcucugccaaaaguagcucagacaucccugaugacucagcugaugcccuugcugccugauugggugcuuguguacuaaguacuuguuuccuuguugagggcuaggaauaugucacaaagccccauugcuguggggauuguugcagugagcagacuuagcggaacugcacaaggcuggcuagaggccagguuuagacuaccuuggaagaauuggcuuaagggcagaggagagguuuagaaaacuccuuucuuccucuuugguggcauuaaucuuugcgaaaccaggcucagacuccuuuugcaccuuucccaggaaugggguagcauagaucuucuuccuaugugaaucacagaaagggacuuugugugggugcuguguguucauuguaaaccacuggugcugcuaucuagguggaguuaaaguugauaccagcagaguaaguuagccugagcaggaggauggaguucugcaguacagccggaaauuuucacuucauaguguuucuacuguaacuucucacccuguguugaaaaaggcacaccuggccauucgcauaguuuggauacguuuuaacccauaagagugcuguccuuaaagaugaugaaaagagacauuuuagcuccuuggaaauaagcacauuucugaaaccacccgucugagugcacacuugugcagauaaacagguacuuuuguuuaugcucugacucaaguggaaagggcaaaauaagagauuuuccuucuccugagucuuuucacugugaggauuuuguccuuuaaauaaaauaaaccggaacuguaaccuuuauuaugggaggaguguggaggaguuaggaaugaggcaaaaugcccucccuguuucucagauaacucuugcuaccgucugagcaguguuuauuuaacagauuuaaugcauugccucaauagcaucacacgaaacaugucacccccccuuuuuaguuucuucccuucaaaaauuuucuuaaaaaugccagaaccuuaccaagucacuuaaauaaaucaguccaaguaugaaaugaucucugaagugacuuaacacaaaugauucugacuuuacuacuugggagacucuuuuuugauggccagcccucuaaauuguaggaagaucauuuucuagcucccuauugucaaaaaacaaagcaaaaucaaauuaaauaagucccuuaauucccauaaguaauuuuaaaauuaucucuuguauauacuuuacuugugugcagcuugcaacugaauaucauugugagagcuauaguuugucaggguuuagaucuuaauuagcucaugagauugcauccuuuugaagcuguauaccacagguuguuggcuaguuuuccaaaagcaauuaaaaugcccacuguuauaauuaagccuguuacuaguuguauguucuaguuauaaaauauauuuggcaauuaaggaaacugagauugaggcuuuuggcuuggcucuuugagaugcaguagacuggcuuccaccuugaucuguuaggaugacuggugcggaugccuggaugaugggacaugucuuaguccuugaguaccuaucuuuaugaguaagagcaaccacagguuuuuacaagaaagcuaaaguuagagaaugugacucguguccucacauaugccgauuauguccuacuugguauacaggagucaaaaccuaaacuucuaaguugcagucucuuagcugagaaguccuuuuuaaagaagcauucccuuaucuuuaagaagauggcucgacucugacugugaacauuuaaucuguuaaacuaacaccuccauugcgcuguuuaaauuucugucugguuguugaaaagaaggugugggagaaauguugcagguacaugugguuaaugucuguuucugaacuguauuucauuuaggaguuguuaagcugugugcccaccaucucagagacagauuugucugaacuggccuguggaggaagaucucauugucagggcuggucucaauggcagauacaguucucaguggugugcuuugcgugucgugucuuuuauucuuccuuuccuccugcucacccuuaggaauguuuccuuuuugugccuuaacaccagaacgguaugguggcugagaccaugggacaaaugcgucacuuagugggcagauagaaaucaguauuuaaaguaugauugagguuuuuguguuuauuuugaaauucauuuaguacacagggaagaaaacagcacuuggcuuaugugguucuaucccauugcuuugccuguuugugcccccgugcaauuaacaugaaaaugauaguuuaagaaugagcucauuaacauuuagaacuggguaggaacagggcuucauaggauguuaaaaucagagaaaaagagaaaagagcaggugcuuuguaaauacuaugugguuuugagaaauaguagaaaguugggucuuauuuuaaauuuccuuuuuuccagagucccuuuaaaguugugauuaaugauauacauuauuuucuuuauugggcaaaauauuagaauuauuagagauacauuuuucuugggaaaaccacugugguucucuggacauuucuauguuaacugugucauauauuaguauagaauaaauucacaggcuugugggucugaggacauuugcuuguuuccuuuaaaucaauuuauacaagcacuuccuaugcuuccuuccuaacaaauuuuccauaauuuauuucuggccucguaaaaauagagggaaaauaaccaaucaaauuauuagcucgauuccuuacaugaguucuucaauuuuuccuagguaccaaacaaaauaaaaccagucuuuguaacaaagauuauugguucugaggaaaugacuauccacaaaguguacauuuguguguaauaugugguaugcauuaugugugguauuuuacaguuaaaauacaacauaauuaccauaaaauaauguauaugaaaugaguuguaacaauaagauaagauugacuuuuaaaaauaaacaaccaagaauaaacacagcagaauuccuaaucagccuuacucauaggucaaauuuagcuuugauguccuuuccuccauaagccauauuuaggcaucaauucaguauaauacuccuucuuugugcucccauaucgcacuucauccuucccucaucauggcacuuacugugcuguguugcuuguuuggcuaauuccuucauuuggcuauaaacuauuaggauaugagcagacauggugccuuuuucacuuuguccucugaauucuuuuuuuaaaaauugaaguaaaauugacauguaauaaaccuuggauauuuaguauacaauguguuaaguuuuagcuuaguguuguccaugaaaccaucucacagugaggaucaugaacacauuucccaaaguuucuucacgcuccuuuggaauacuuacuucuacuucucuucuuuccuugucuugagacaaccauugaccugguuucuaucauuguagauuaauugacacuuccaacaauuacguguaaaugaaucucauauaguauguacuguuuucuuuuccuuggcuucuuucacuuagcauaauuaagauucaucuauguuguaguguauauugauaauuuccuuuuuauugcugaguaguauuccauuguauggauacaccaaaguuuguuuaucuauuuuuaaauugcugagcauuugaguaauaccagcuuuuugcaguuauaaauaaagcugcuaugaauacuagaauacaagucuucguauggguaucuacuuuuguuucucuugggugauuauguaggguggaauggcuggguaaaugggcagguguauguuuaacuuuacaugaaacugccacaguuuucucaaguguuaguaccauuuuacauucccacuagcaguguaugacaguucuaguuccuucacauuugugccaacacuugauauaguugauauugguaagauuuuagccauucuaauaggcauguaguaaaaucucguugugguuuacauuuuccuuucccuacugacuagauguugagcaucuuuucaugcuuuugcuguccauauaucuucuuuugaaaaccaucuguucaaaucuuuugcccaugaaaaaaaccuuaguuguuuguuuucuuauugaguuucaagagcuuuuguuuguuuuuauugacacaugauuauauguauuuacaggggacagugugauguuucaauauauguguacauuauguaaaaauuaaaucaggguauuuagcauaucuaccaccucauacauuuaucguuucuuugugacaacauugaaaauucucugauuuugaauacuacaauauacaacccaucuuugguaucaaauuuugaaauauacaauccaauaucauuaacuauaguuacccuauagugcaagagaacaccagaaauuauuccuccuaucuguaaucuuguaccuguugaccaaucucucuuauguuccccugcuuucccuucccagccucaguaacuacuauucugcuuucaagaguuuuuuuuuuuuuuuuugagagggagugucgcucuucuugcccaggcuggagugcaguggugcaaucucaguucacugaaaucucugccucccagguuaaagagauccuccugucucagccuccugacuagcugggauuacagguaugugccaccaugccuggcucauuauuguauuuuuaguagagaugggguuucaucacguuguguaagcuggucucgaacuccugaccucaggugauccacaugccucgcccuccgaaagugcugggauuacaagugugaaccacugugcccggccuuaagaguucuuuacguguucuuaauugagguguuuuauuaaauguaugauuugcagauaauauucuuccagccugugguuuguauuuucauugacuuaacggugucuuuugaauaauagagguuuuaaauuuugaugaagucccaauaccaguuuguucuuuuauggaguaugcuuuuggucucauaacuaagaaaucuuugccaauuuaggguuacaaaguuucuucuagaaguuuugucauguuaaguuuuacauuuaggucuaugauucauuuugaauuaauuuuuguauauggauugaauuuuuuuuuuuugagaugggguuuugcucuguuaccaagucuggagugugcagugguaugaucacagcucacugcagccuugaccuccuggguucaagugauccucccacaucauccccucaagcuguagcugggacuacaggcaugcaccaacacacccagcuaauugugcauguguguguauauguguguguguguguguguguguguguguguguguguguguagagaccaagucucccuauguugccugggcuggucucaaacuccuaggcucaaucgauccuccugccucagccucccgaaguauugagauuacagguaugagccacuacacccaguguaaauuuuuuuuccauauagguaucuaauuaugucagcaucauuuguugaaaagacuguccuuuuccauugaauugccuuucugccuuugucaaaaauuaguugucuauauaugugugaucuauguaaaaauuccuuauucuguuccauuggucagugugucugucccuucccaaauaccccacaguuuugauuacugaagcuuuauauuaaauccuaaaauugaacagugugagacuuucaacuuugcuguuuuucauccuucuuuuaacucuucuacugguuccuuuaccuuuccauagaaauuuuagaaucagcuuuucuguauccacaaaaauguccuucugggauccugauugaaauuaaauuaaauuuguauaccaguuuggggagaauuguuuauuguguugagucuucuaauucacagucauucuccauuuauuuuggucuuucuguaaauuuuuuagcaguauucuuguagucaguauucagcauacuuuauauauauauauauuauguuuacucuuuuuauguaacuuuaauucaaaagguacagagacucucccuuagugcuguucuuaagacauguuuauaugacaucuuuccauuaguaucuuuggucguguuccugcaguauccucaguugugcucaccacugcuuaacucaccuuugcagccaaguuucauuuugagucaaaucuaccagaggaggucauuuaccaccugagaaaucccucacuuaguuuuaacagaaauaaauaacuuuaaaacaauugauacagcuccuucuuuggcuuguauaauuuucuucaggcauaaguaaaaaaaaaaaaaaaaaaaggaaaaagugauuucaaacauguucagaguaacuguaauccagcugugguugaaagaagaauuuugagugguuaaagagcugacugaccauguugguggcucuugaaacacuaucagcuuuucuuaaccagaaggcaaucaaggacauacuugaggucgggaacagauauuucauaggccacuggagugcugcaguggaaggauucccuccagauccuugguucacagacagggaaggugaagccugaggagacuugguuacuugguuuccuuggaggaucauaugcucagugagcucuuccugaaaaccagcccuguucccaucagaaacugcagagacauaguacuucccauucagcagguuacauggagucagcguaggcagucaaaauggagagaugaaggauugguguuggguaaugagagcaagggauggucauagaacucagagaugauaaugugaccaacaggaucauuauucaaauuucccaagaggcacaaauguagaugaugauugcuuucauaagcuaguggaguuaauuucugucagacacuauucuaagugauuuuguauaugaacucauuuaauuuucucaacaaccuuguaagguauagguaccguaauuauuucauuuugugaaugagcagaaauuaagcacagaggugccagagaucuuuucucauaggugaugaagguaggagaggaacccaggcagucuggcuauagagcacagagucuuaaccacuacacugucuggcugauggcaaagagcaugucuauuaagaaagccuauggggaaauggucgccaaauccuucucuaauucuuggggacccugaguuucaggguuuuuuuugguuuuagaaauaagggaaacuccugucaaaugauaagauugacauuuuucauuuuugaaguucuaaauguaaagcucuuugaaauguauagguuuucagauacucugugugucuguguguguguguuugugugugugugucuguguguguguguguguauaaguucagcuccuuuaaaagccccaucucugucacaaucacauuuuuuuuucacaccgcauuccacccuacuaauacucagagcuuagauuagggaggugacuaggauacuguuaauuaaaacuauaugaccugauuagacaaauuaagagaaauuuucgauagggaaaagaagcaggacaaggacugaacuucugagagauagugaaaaaucaagguguuuuucuuauucucagucacuucacauuuuacuucugacacuagaugugugguggauuuuccccacacaccaagcaguucuccagaagacaucaauuaauuagcugaacuuauucaauuuaauuuugacccuauauaccaggcauucugauacugucuaccuggagauaguaucagaucucacaaucucagggcucagucccacacaacugcccccgacuucagacaccaauugcaaguuccaggugauguguacuucugaccaaccagcuauuaaucgggguucucaugacccccuccucagguuugauuaauuugcuggagugacucagagaacccgggggggaaaaauuugcuuauguuugcccacuuauuauuaagaauauuacaaaggauacagauaugaacagccaaauggaagagaugcguagggcaagauaggagagaaggggagugaguggacuucuaugccuuccguggacuugucacccuucuggaaacugcacguguuuagcucuugcgaagcucauuuaaacccuguccuuuuggguuuuuauggaaaauuuauuacauaggcaggaucgauuacauccuuagccauuagugacugauucaacuuuuagccuccucucuuauuuguuuuaaacguuuguuuccaaaguuuuuuucuccccuuugaggaggacagauucaggcuuacaucaaaauggaauuaaaugugccuuugauuuggaauggggcaacaagagccgccugcauggcuguguauauuuauuuauauggggucagguaaaagcacuuuuaaaauaagcaaguauuagagaucagagguuauggagcagcugcuggcucuggcugacaaagcauuccugguggcauuugccacuagcucucugggugugggcauuagagagugugagaguuggccugauggccuuuguguuuguggcccuguguggaaacuuuauagcauuucagccguucuaaucugugcaggcacagagccacagcugaccauaacucuuaggggaaaugaggacagaaaaguugaacagcacugugugcuguguagaguauggagaccagaaugaagggugcagaaugaaaggaaaaaaaauuuuuuuugaaguauccugcuucaggguuucuauuguuugggaaacuauuccuauagaaaugacauuugugcuuugugaaggggguggagguagauuuucuggaguguaauuuucuggaguguuuccuuauugaagggggaaaacaaaugauuggaaaggcucuuccucuguuucucucaugcaucccuacacccccaauauaugcaguguccuuguuuuuguuaaauacagaagcuauacagagggcaguuagaguucauccaccguuuuacucauuggaugggauuauuaagagauaagaccauuuauugcuuagcaugagaaucuuacugucccggccagcaaaggaggccaaagauuucaucugaacuuuaccucuucaauucaagccaccaaagauuuauugggagucuacuauguaccaggcauaacauauggcauauaaaggcuaauuuuaacaauuauauugccguuuauguuguugguuuggauagaaacccugucuuccacuaauccuuacuuuuccuauaauacaaagauuaucauugaugaaacauauuacagauuauuauuuuaagcuauuuagcaaauauuagacauuuucuuagagaauguuugagcauaucagaaauugugguggauauguuaguuuccuauuugcugcaauaauaaauuaccacaaacauagugacuuaaaaacaacacaaacuuuuaucuuacauuuuuguaggcuagaaguccaacauggaucucauugggcuaaaaucgaggugucagggggcuguguuccucguggaggcucugggacaaauucuaugaccucaucuuuuuccagcaucuagaggcuucccugaacuccuagguguauggcucuucccuucaucuucaaagccagcaacagcagauugagcccuucuuaaaaugccaucucuuuguuucucuuuuccauaguuacaucuuccucuuccacuuuuaagaacccuugauuacauugggcccacccugacaauccaggauaauccccuuauuuuaagaucugcugguuagcauccuuaauuccaucuccaaccuuaauuccccuuugcuauguguaguaacauauucacagguuccaggaauuaaauggacauggacaucuuuggggagccauuauuucuaccuguuacaguaggguggacuuuccccaaacuuugcucuuuccccacucaaaugaaauuguauagugcccucuauuaauucuuugcaaaauaaauuguuaccuaugaaugugucuugugcgaguggugggugguuuaucacugcuuaaagccucacucuucuucauugugacaaaaccccagccacuuaguuuuguacaaucccaguguucaaggaagcuagagauccucuuagccagcccgcccgcagggguuuugcacacacauuguuacaucucuucaaaauggcugucccaccuuugcuuacaugaaauggccugccuuggcaaauaaaccucuuugaacaguucuguuuuuguuagauaguuccugcuuuaauuuaggggaaaauauuucucuuuguggguuuguagaaccuauugguucuuguuuuacucucuggggucauauugaauaaaucuaauuucuucuuucacacuugaagcccuugagauuuuuuuuaaagacaguucucauaucccccaaguaucagacuuaaaaaucucaauuucuucaacugggucucacauaaaacugucuugagacuucucuccauccuguuccuucuccugaguaugauacaacaugaagaaggggaggcugaaggaagauuuaauaggaggcuuuaaaugcuggggggaauugucauacagaaaaagcugguaaggucuuuacauuuaccauggaaacaagaaaucacaggcucauauuguggcuaaggagauuuaauuagcaggaaaccugucuuaaccuuauggauuuggugucaggaaaccugucuuaaccuuguggaucaugcaauggacugccugcuaugggaaguugagggaucuuuugccuuaguguaagacaagucuucaagcucagaauucguauauuuuguguaagagacguugcuuuuaguuaaauguuuugcuuaaaguauucuugucauugcuugucaucuaugccugaugccugaauuucccucuuguguugguucauuggauguaaggcaucaucaugacugcuguuaaucauagggggaaggaauaugguucagggcuuuaugaaggaagggaaacaguggcauagcacaggauaauuaauagcaaguggagugacaguuugauucccugguagggacccuggcauuguugaaggaaaaaaaaaucacuuuauucuuucauagagagaggcagcuguaauucugguuggauggaauccaauuaaaaggaacugacaugcaaauugaugaugagacagugugagcauagaaguaguccaagaagaguuuuguaagaaauggcagagaagaguguaaguaauuuggcaugguaauguguguaagaaaauggaaagcugauggguuggcuaccugaacaauuaugucuggaaucucagccagcagagaacaggagacugguugguuugguagaguuguuaacaaaacuuucugguguuuugaguuuuggucuacauuuuaggaauuauagccuuucauaauagaaugaauauaaaucaacccuugaggguuauaggcuuucaaauugguggugguuaaauauaauauucucaagauucuaugaugggagucccagccuggcucuuggaaagaagaucucauuguacagguguacuucaccugaccuaaugauguguucucaaagauuugugugagaauuggcuccuaaauuuaggaugaaauaggagagcuugccauuucuaguaaugcuauuaugaaucauuuucuaauguaaaaaauccuuuuauaaccacagucaugcccaauuuaucuuuuaaguaaauucauaaguccacauauuagauuuguuuaaaccaaagguauuuuucuuugaaaugaaauaauuguaggggcacauaacaguuaagcuuuagaguaacagaggaaaaauuggguaagauuuuauaagucaguauauugcuuuuuagggaggaaauucugccuaagaagucagacagcuucugcuguuauuacgggaaaaggagaaggcugcccaacguauuucagggagauuuacuaggaucucuugggaacugcaguagaaaucacuacgaaauauuuugaggauagaggaaacaggacaacagcguuuacuagguuuuauucugaagaaagccaaagaagguggaauggaguucaucuugagaaagcgguagaagauugagaagcuaagaaaagacuuacacagcagcaaaaagaagaagagacuggaguagugggcagaguuuucaguuagcaagagagcaccauccaauuguuaugcuggucagcagcaaggaacauuaaugaaggagaugaagaaugaccagggucaguuuuuguucauccagguuugagcaggguguugcuuaugaugcuccaugcaguuuugccucccacaaucucucucugaucuuugccuccugaucugcucaaguacugcagcagcaaugcauucucuacugaaggcugucacguuuacuuuucacugugccuagaaugcucuuacccucaagccucccuccuucacuugauucagguugcugcuagaagcucccuuaucagagagaccuuuagugaccauucugucugaaggaggcagacacucuucccuuauuccgcuuuucuucauagcacucauuaucaccucacacaugguuguuuaauguuuccccaauuuucucugcuagaaguaaguucuuugagaguucagcuucaguuucuuuugcccaucaguguauucccaguaccuaauuuauauaaaaauuuguggaauggauuuuuaggguaucucuugccuaucacagugagaagagcugagaaugaagaauacaggacucaguccuuguccuguguuaugcaauguauuacauaguuauaguaaguauaacagccugagcacagagugcugugagcuuugagaaauaagcuagagauggucaucacagaacuggaucuugaaugauaaagaggaguuuuguucugugguggagacaaggaaugaucuucuaggcuaucaaagcagggugagugaaguuggagagauguagaaaugaguuuuguguuuggaugucauugagugauuuugauuuggcugcuagagcacagguacaugggaaagcaugacaaaggggccugagagguaggguuggggaggacaugugaaacauauguugagaucugauugguaaaguuauugauaggcguuuggaccuugucuuuugggaagcagggaaguagcaauauccaaaagagagugcuuaaggauggauuggaagagggaagauuauagaggggauagagagcaaagcaggaugugacuuucccagccuugaaaugcaugagaaaguuugggauccucacaaugaagggcaaaaaaaaaaaaaauaaaaagcaauucuguuuauggauguauagcaauauauuguguauaggugguggcuauuagaagacuaguaguucuuggaacuguuccuuuuuuucucacaauaguaguuaagcugugucauugggauacaaagggaaggagaaggcuauuuccauucuuagaauagaaaaauuggaaaaugccuuggcaaauggagguauucuuauucuacauuuuuuuuuuuuuuuugagaccaagucucgcuuugucacccaggcuggaguguaguggagccaugugagcucacugcaaccuccgccuucugggcucaaacgcuaccacacccagcuaauuuuuuuauuuuuguuuuuuaagagcuggaaauuugcuauguugcccaggcuggucuugaacuccugggcucgagugauccgccugccuuguccccgcaaagugcugggauuacaggugugcaccacugugccuggccauaccuuacagguuaagcagcuauguggccuugugcauuucauuuaacuguguuucauuuguccuuucauggagauagacuuuguugauauccuuucaucguugaugugcagaacaaaguaugcugcuugggaaauuauaaacauacuuucauuugaaauauuggguaauaucaggaguccuuugcuuuaauagaaguagaucuggaauugcuuuuuuuuuuuucuuggaauaugguaacaccaaagcaucugagcuacucacacccauuuccagaggaaaacaugaucauuuccaggagauggccugcaguuuuaaagcuuuuugcugcuuguuuucuacaugucaaaacacaucccauuucagcaguuggugagcgcuaccauagaacuguucagaagcaagagggaggauugagucauguuguacgugcagcugcauauuaaccugcaggucauagcagucccugauccaaaggacugucugacacuuuauccccguucuuacugccuucaucauucacagcagccaguguaggacucucccacuuuagccuugaucauuuggaguagcagaaucguggucuuguguauauauagaguguuauauaggccaugugauucucggagaccuuuuuaggaaguuugagcaaccuuacauauuggaauucuuuccucuuuuugagaaggaggaaagaaauguauguuuuauaaggauugcuuugaaauagauccauuuugcaggguuuaacucaagcaaagaacagacuagcuuaaugguuaauauuaaguuacuggaguuugaaugccuaggucccaauucaagcuucaccauuauuagcuauaugaccauuagccaguuuucucauuuguuagaugaugauaauuacaggaagauacuguaucuucccacagagugguccagaggaaugaaugaguaaauacauguaaaucacuuagacuaaggacugguauuauggauucucugacuguuagcuguuuuauuccugauuuucucauagccacuggcauuucuaagaccuugcaagaaccacuggucaacuuuucugccugcuauguuuaacuaguagaagucagaaagugacuugguggcagagugcuagaaaugauucauuggguggacuauugagcuucacaccccaguccacuggcaucauguaagaaacaacucauuacacucuaacgguaguuuagugaaauggaugaguagucuuagucugccuccucaggcugcaacagaaagucaagccaagcagccaggaaugucugggaaucaccuggagagaggacagacaucugcagcacaguggaaggugauagaugagugggacccaggaauaaacuacagaagcaguguggauuguguugauucuagcaagcaggagggggucuccaugguauuucugaguauaagccaaggaaauguguuaauguggggggaaaaaaaucaccgaacugggagagagucagacuaccucgggugugaccuuugcccugucaccaacauauuguaugucacauccccauggggcgagucacauuuucuuucuaacucuguuucuuugucuguaaaaugauuaaaugauuucuugacucuuucuuuucuagauucuuuuuaacgauuucauuagcuuuuaauaacuaugugaggaaaggagagcaaccugcuauagaccuuggccugugugagucuuuaauuuuguuuuuuguuauuucaaagaaguucuuguucaaaagaccaugagacauuucaucauuggacuuuuuagggaguugucucuuuaaucucucauauuuccuuuuuucccuacaaaugauauccacaguacugcuguugucuugugcucucuggaucagcacuuuuccagagaaaugaaaacacugcacuuuuaacggcacagaaagcaaaauuacuguagcaucaggauucaagguuacagaauugguuaacuuucugguuuguuuugcugagcugaaugaaaaagauuugaucgaauguuacugcuuagggauaaauauuaauaaccacaaacucucuuagugaucauuguccccccuuuugcagaaaauuucaaauuauggucuaggacuuagauugugauugucagcugaauaugggcgugaaaaauguggaauaaccagauaaaggacccuuaauugguuguagaggaacaacuuuuuggggauccauguccagagagggaauugguucuggauuauugauuuguaucauuacuuugauuaagugucuagcaguugcuguagaccuuuauaacauuauauaauagaaaugguauuagaaaaaagucaucaaagguaggauuuuuuuaaagauauaagaaccgaaguuuuuaaucuucaguccuucauagagaagaauuuauuagguuugagaguucucaguaccaaguaaauucuaacugcagacuuaaaacauaugaauacacucacauauagucaccccauccucuggccugguuuuguucucuauuauaguugacuuugcuuuaggggaaaggagggagaguauugguauuaauuuauuugaaaaauuagcaggaguauaucaaacacuuacuguaugccaggacuuaccaugauaaauaagagguggaccccuguccuuauggagcccacuugaaucaaaaaguaaacauaugagcaugcaaauagauggcuguaagaaugugaugggcaugccauuuuuucuagcagguugccuaccacauagucuauauguguuagagauacacauuagguacacagaagaggguccauuuguggcauagagagagauuagaggaaucuucaugaaggaagugacaugaugaugauguuuugaaugacaggaaggaguaugcaaaaaaaggcaggguugacauuccagacagaaagacuaguauggaccaagacauguggacauggaaaugguuugcuccuuuugggguccugaagguaauaagugcaaugaggcuggagaacuggguuugucuuaaggggcuaugggaaaugagggucagaguguaggcucuuaugaaggcugucuggucagacuugaggggaagguaugcugguaaauugcacugagaauaguuccuagcugucccauauuucagcaucuccugaaauagauguguacugugauguacaaguuccaggauacaaucaguucaugaguauccaguuaauguaccugcaggauuugggcagcaauauauguaggguguugugugaaaauauuggauaugaacaauuacaaucuuggcuugcacaagaaaucauugugaugcaggagggaaggguagaaaaguuagauuauuuuuuuuccccucuaaugcagugccucucaacuuuguuacaaauuagaauuaccuggggaucuuuuuuuuaggauauuguuuacaugcagugaaaugcacagaucuuaaguguacacaucaaugaauuuuggcaaauauacauacccauguagcacacuuacccaucaaguuauagaccauagucagaaccugaaaaaguuuuuuaguuuccgguuugaaucaauuccugcccaccccucccauauguaaccacuguucugauucguguuaacauaguuuaguuuugccuguucuugaauuucaugugaauggaauuauacaaguaugugcucuauuguguuugccuucuucuguuaacauaauguuuuugagauuguucuauauuguuacaugucaguuuuuuuuaauugcugaauaguacccuguuguacagauauaccacaauuuguuuaaucauuuuccuguugguagacauuuaaauuguuucagauuuuuggcuauuaugaauaaagcuguaaugaucagucuuguacaaguuuuuuuuuuuuuuggcagacauaggucaugauuuuuuuuuaacguaagugccuaauuguggaauuuuguuauagguaugucaguguauguuuaacuuuauaagaaacugccaaacaguuuuccaaagugguuguaccauuuuacauucccuccugcauuguaugagaguucuuguuguuccauacugucaaacauuugguaugauaagucuuuuuaauucuagccauucuaaugggcauaauaugguauuucaguaugguuuuaauuuacauuucucugaugauuuaugauguugagcacuguuuucuuuugugaaguguguggucaaguuuuuuuugaccauuuucaauuugguuaucuuuauguuauugauuuauagggcucuuuauauacuuuggauacaagucccuugccagauauacauaaugugaguacuucuuucagucuguuacuugccuuuuuaguuccuaaugacaucuuuggauaagcagaauuuuuuaauuuugaugaaguauaguuuaucuuauuuuuccauuauauauuuugugucuuuuguauccucacuaagaaaucuuuucuuacccuagguuauagaaauauucaucuuuguuuucuucuagaagcuuuauuuaucuuuugguguauguuccaucacaaauuuuugagugugauaugagguaaggguagagguucauuuucuccauauguuuaucuagucguuccagcacuauuuguugaaagaccuuacuuucuccauugaaugucccuggcaccuccguugaaaaucaguugcuugagggccaggugcaguagcucacaccuguaaucccagcacuuuggggggaugaggcggguggaucacgaggucaggaguucaagaccagccuggccaauauggugaaaccccgucucuacuaaaaauacaaaaaguagccagguaugguggugggcaccuguaaucccagcuacaugggaggccgaggcaggagaauagcuugaaccugggaggcggagguugcagugagcugagaucgcgccacugcacuccagccugggagacagagugagacuccaccucaaaaauaaaaauaaaaaaaauaaaaaaucaguugcuuguuuaugucuauuucuguuuaggucuauuucuggacucuguguucugcuucacugauuuauuugucugucaucccaguaucacacugucuuguuuaucuagcuuuauaguaagucuugaaaugcaguagugugaauccucccacuuuguuuucuuuucaagguuguuuuuacuauuguaggcccuuuucuuuuuuauauaagguuuagaaucaaauuguccaguucuuaaaaagaaagguagcuaggguacuuuaccuuacaaaaucccuugauacccagaccauacuucaucccaguuaaaucagaaucauuuagaaaugaacagaaucucguucauucccuagauucuucugagugcagccaaaauugagaaccuauguacuaaugggauuuuagugugguacacuaaagaagauacugucauggauugcugggauggaagccauuccaguggaauguaugcauaggagcugaugugggccccuacacgaaagaaauuguugauguuuauggaaccaggagagcugaaugaggaagagaaggagcaggagugagaagcccuguggucaagguaguagaguucccucucccuggggcacauggagccccauugcugaggcgcugccuuguguggcuccuauuccugauuauucaggguauucccacccuaaaccugcugcagugcagccaacaaaccaccaacuugaaaucuagggaauacucuuaguagagcguguaaauguacuauuuuaaagaauagcuuuccccuggauuagggaaaugcuugugaaaucugcauagugaugaacaggguaggcacauucuagaagugccuguguggguuuuuugcuuuuugaguuuuuucugucuuuuuaauguaaugucuuuagacaaacauugagucauccauucuucccaaggguagguaguucagucagaagugauguuuucccaaaaggcuuuaaagaaaaacgggacaaaaaguuacgcucaaguaauauguucuuugggagcacucaaaguaugcaggcugguagguugcuugcuuguggcuuuuuuuuuuuuuuuuuuaauuuaaacacacauuuuccucuuugaaaagagagguuggaacuagucagcugagucccucuuucugaaauacacguucccuaaacagcuguagagaauuaauuucagucaaagauagcagagcuuuaaucucagcuuucugcucaguguuauggaaaauccuuucuagaaaauagccagugucuaccugcuaugggauguuaaaaaauucaaacgaacauuggauuuuuuaguguuuuccuaguagaaacagcauggaaaauccuuuagugagcuagauuuuacagugcacacagaaagcaaguaucuaugauacauuuauaauuuugugugugucacauguugguuguacuauuuucuuauuccuaauagaauugaaauauaccauguccaauuccaaaccuuauuuuuuuugugugugaaggguugaagcauuuuagacaagaaagagcuuugauacuagcaacuuuaaacucauuuauaggauauauauacauauauaauacauacauauguaugcucuuucaaggcagaggaagaagguaggcagaguaugagaggagaguugcuuuucuuucucaacuuaugauuguauuuaacacauacucgcaugcacacacacauucuuuuaauagcauuuuuuuuuuguagugagagaaaacuuaucuuuaagaagucucuaaucuauuaugggauuaagaguuuuaaaugucccccaacacccccccccccauuuuuauacuuuuauuucuacgauuuauaugucacgugaacaucacuuuuugguggugugauuauaucggaauacuuuuguauuuugcuuaacauuaaaaaagccauuucuuacauugcuauaucaugauaguaauuuaauggcagcauaauaguaccucaaauugugccauacuuuauauucuucuguuguaaguuuucuauuuugugcuguuaaaccucaaagaacuuauuugugcauagaaucccucuuaauuucuucaguacauccucuguguagaauagucacaaggugcauuuuguuuuuuccuuaucuguguacaguuuacacuguauaugauccucagugauauaggguguauuuaccuuaagaaugaucauuauuuacauuucuagggauaaaaagcuacuggauuucuuucauaacuguauuauuuaaaaaguuguucuuccccuuuauuuuugugcacaaauuugagccacauuuauguuugucuuuuaauggguuauggguucaaauuuuuuucuuaacugguauguuuuuuuuuguuguuguuguuuuaauuuuuuuuuuuuuuuuuuuuuuuuuagaaacuaggucuuccuaaguaaguugucugguuuggucucgaacuccuaggcucaaagugauacucccaccucagccgccuguguagcugggaguccaggugugugccacugcacuuggcaauauguaacucuuugugauauuugucaugaguauuuuuuccaaguuuuuucuuuuuuuauuuuagugccauugugccuggcaauauguaacccuuuguaauauuugucguaccuuuuccaaguuuguucuuuuuuauuuuaguuuuucauuacaaagcaguuuaugaaguuuuuuauauuuucuucuguugccuuaagaugaacaaacuugucaucccuucugagaucuaacaucaauucuguccccaccugccccccaauauuuccugugguuuaauuaaaagcaauuuuuaaaauccaucugaguuucugucgauacauaugcccucuccuuaccugcugugcuaugaggaaaggugggcuaaaucaggagcucguguuauucauaucuugggagaggaauagaaacagccaguacuccaaucucagcuuccuguaaugucuacaagucaguguuugcucaucuauaaagcugggaugagaauaacaaauguacagagaauuuuuuuaaugcacuuaagccuucucuuaagcacuguuaagaacuucaguugaaaguguuuaaaauaccaaauagcuguaaccuuugauuguuaauaugugugcaccaucauuucuuggauuuuucucaauagcuagagaccacaugggaucuuugguguuuuccaaaaugaaccaccaugcuauuaccugcagacauuaagggucugauuauacaaagaaacugagaguugaggauguccaucagaaauacacuguuucaaagucagaucugaguacuuggugaagacuuuggggacuacuuaauaguaaugauuacuagaaaaauaaacacuggcaauauagauagugguuaaaaaacaugggcuuugggcugggcauaguugcucaugccuguaauccuggcacuuugggaggccaaggugggaggaucacuugaacccguuugagaccagccugggcaacaugccgaaacccugucuguauaaaaaauacaaaaauuagccagguguggugguaugcaccuuaaguucuagcuaucuggggaacugagguagaaggaucgcuugagccugggaggucgaggcugcagugagccaugaucaugacacugcacucuagccuggaagacauagcccaacccugucucaaaaacaaaacaaaacaaauaaacaaaaaacgugggcuuugacagagagacuuguuuaacuuaauuaaacaagugccacuuaagugauuuggggugaguaauuuuagcucucuaaacucaguuuccuccacuguaaaauggggauaauauugaugagugguuuaauuaagaaaauguaugugaaauauugagcauggugccugacccauagcaaaugcuaaguaaguaguagcuguuauuacuuuuauuaacaaguaacauuuguauaacauuuaugaccuacagagcccuuucacaugcuguuucuuauuugugaacugaguguuuuauacagaauggguuuuuaaauguuccauaggcuuuuuauucauggcuucaagagguuguucccuuuuugggaccuguacagcuuguguauacucaguuggcauuugucacguaucuucaugccagugucuuuguaucugaauucuaaaacugcgugaacacaaagguuaugucuuuugucuuauucaucuggguugucacuggaacagagucaggagacauuccuauuuauuaugugcguaaucguaggcaagucaaucucuggcuugccaaagcuguccuuuccucaucuguaaaauggguaacaaguuucuugugaagauuacguuaaauaaugcauuaggaagcacuuuguauagaaaauuacaaauaguuuuuuguuuuuuguuuuuuuuuuccgccaugccucacuagccuaguaucacaguagaugcuguaagguuggagguuguuaggaaggcuauagagccaagucuuaacuuuagugucacaauaccuuuguuaaacaaugaaauucagucuuugggggcuaguugucaugcugggugcugugccaggcuaauuaauacuuugguaccuugccuuuaaaguacuuacugcugcugucucccucccuccccuuugguauucauuauuuauaguauaaaacauuugcugcuugcuguuguaaaggugggggaugggguguaguuacacauaggugcucagagcagguucaaugauuuaacccuacaugaggaaguaaacuuaaucuacauaaaauauggauuugggggugugugaucucuguggucagucuggaggagugugcgugaggugugucagccacuaagcaaacaauggagugcuggcucuguggacucuuggcugagucagcauuguuucccauggaauuucuuuuucucuuagcccacagguguauuuauguguccugguauuucuucguuuuuauuuucccccaauuugauuucauaaaugauagugcaaaguguuggcuaugguuaauuucaguaaauaaggcccaaauaugagguaucuguuucucucuugaguaaaaaauaaagucauguuauggggaauaaaagcaaaagcauuuaauaaaaaaaucccuuuguucauuuuagaaaaugguaccuuuguuaauuccuuaagagacaauuuauuauauucugacacuaucuuugaauagucaaagaaggcaugaugucucaauuuaaauuucuucuuccuggcacagcuuuuauucugcaagguuugugcuuuuaggaagaggguauuguuucucauaggagaguagagugccuaguggacagaaaaagguaaagauugucauuuccuugaacauagauugguguuuaauuucuacuuaagggugucuuuugagaagaacagagcccacucuguuuagcagcuugcuuuuugcuaaucauguggugcaugguguguuuucaucuaguccguuccauuaagucuuauuuaugcuuuggggauauggauaauuggcuacggcucaggugaggugcauaggugaugugucauuucucuccugaggggauagagaugacaggcuucuuuuagauaaucacugucaguggcugggacccaggaaccuuugguauucaccuguuuagucaguggggggcaaauuugaugcaagagcagagagggaacuguuuuuaaacuauguauauagucacuaugugauuaacucuuugguggcccuuuaaguacaggauaaauuugcauuagaacuuagugucucagagucuucgauuacaugaagucugaaaaagugaugaccaauugucaauauuuuggacauauuccaugagugcccccucagaccauugguagagauagguuugcagguggugacccuggugaaauccuccucugagaagggaguguucaagggcauacguuggcaucauuuaaguagcagaagagagcaccccauugagaugguuuaaaaaugagaugcuaacuuucaaaguuuuuuaaauuuuauuuuuuacaaugccugugaugcuacuacauuguauaaacaguauguaguguuaaggaugugccucgcauguaagccaccacuagcauccuuaguguggggguacuguuccuuuucuacccaaaucccugcaagauguucugagauuuuggugccaaggagucucccaacauucaacauuguuaaaacacacuuccuuaucuucuuugagguuuuuuaauagcaaaucccaagccacucaccuuuuucucauaguauuaauguucuaagaguggcuauacauuauguuaaagucagcguaguucuccacgggaaggcuguuuuuuaaaugagacuuauucaaccucuuuuuagcugguguuucauuaccaccgaggauuuauaaugcaauagcucugaggcaaagcugguaagaaugccagcuucgcuaauauuuagagucauaaaauucuggauauuggacaagcucuuaauuacucugaauccgucuuugucuuaauaaaaguuggauuguacccacuaaaacaagauggcuguguuugcauuaaucuccaaauguagguuaauaccuuuuuaaaagcugucuccuagacaagagacuugaaaauuaauuucccauuuucagcuuaaaacgaagagcucuuccacguguggagauugaagggcugccauuuuucugaugcuguagauucaagugccaauaauaacucuuuguuccucuuuaguuuuuuuuuuuuuuuuuaaugucuuagguaaagaagucuuucuuuucuggugcuuggggacuuguauuuuuuaaaaaucugcuucaaaguaaauagaugaaauuucauuuucucaguggaguuuggaucacugggauugagggggaugaggaagggcuagauagauaguaugaaaccuauuggauucauacuauggcugcagaagucugggcuuuacacauuagguugcuaccaagcuggauauuuugaaauauauauauguauaugccuguaauguuuuagcauuugcuuguuggguuuuuuuuuuccccauaaugguagguucuuaacugacuuuuucaaaugcaagguaaaacuuucuuuuccuuuucuugucuccagaguacugauguguaaccacuuaguaccacuaaugccaggauucauuucugugcuacagauggucagugagauuauaaaagcucugaaaagguuuuuauauaauuugaggucuucucaguugagaguuugugucugacauauuaauuccuucccauccacccccugccccauucucaauguaaaccauaugggacauguauuaaaaaacaaauuucagacauuuucuggagauuuuaauucaguaguucuggaauagguugcaggaaucugacucuuaacgaucaagcacauuugauauucagacaacucuauugcauccuccagaagcuccaggauucuguauauaauuuguaggauauacuugccucuucuaugucaagucucuuacccagucugauuaugugagaugucuuaaacagagcguuuuuucauaaaccuuuauguaggauaauacuacuccuaaaacacuuuauuacauaguuuuuggauugguaauggcaaaagaaugagaaagcaccugaggaggcaccauugugagugaugaaacugggguaucagaccugguuaugaaaggagaugauaacccuuguacuguuuucagacaguugcagaguuauccuaugaaggaggaaccauaauucugguggcccugcagagcagaccggggacugaugaauggaugcugugggggcugaacauaaagagaacagguuuaacagaagggaccaacauccuuugagagauacuacuuuuuaccuucuaauuauuuaacccaugaaacuauuauuuucucccaaagacaccuguuuuuagacuaucaguuaauaaaaagaauggggcuacuuagguggaagcuggcugaggggcacaaacagauuaagccccuuuucuccccagagcuagcaagcaguacccuuagccagaagccuugggcuccauagaaguggccacaaacacaacuagaguauggugaguucuguucaguggagguggccgcacagcccccugacaaggagucuugugagcuccguaagggcuggcccuuaucugauuugcugcuguagacagccagugcaggggacuagcacagagggcagagcuuagugaaaugucugucaaugaaagcuguggaggacauuuguaucucacauucagugcugaaugagauuuaaaaguccuuucuaacauaaaaagucugugaucucugcuuccaagauuaauucuuaggucucaguauggauggcccaaggauauaagcuuugugucugcagggacuuuguuuccuauagugcuggauuuccaguacguagacuagcaccugacauuagugggcacucagugaauauuuguugaauacaugcauuuguugaaaaaagugaaaauuguuuaaagugguacuuugugaaccuuuuuuucucuuuuuucugucauccuggagacuucucauuuaacccccagucugucucgugauccaugccccauccuuccuucaugccucacaccaccuccuucucaaucuauacuuggcaaagaggaauaaagacgcuaaggauauugugguaaaccaaagucaucucagaaacacagugaaauucccuaggcaucugaauugggaaaccuauuggcugauuugcuuugacuuggguauuuccugugauuuucagccgggaugugcuccugugcucagaagugaggaucuguuguagguuuauggccuagauuaauugggauauuuugugaagucucugaaguguuaucacuucaucuuuauccuugccugcuauuccucaugaaaagcauuugaauuauuuuagagaagauauaaauuugcuuguguuauccagugucagcuuaaagcugauuagcauuuugcaucaccuuugcaacucauaaaucauccacuuacccucucaguaagcaggcuguaagucagcauggaagcaccugcugcagcuucuuguccugugauuuagaggacacuccagauucucugcagacccuucugugguguuauucucugguaaggcuucaccuauaugggaaaugaguaaagacuuuuggugacuuuuuuuucccuagggaguucuuaaggguuacccuggacgagagacuucucagaaauauagucuuuaauaaaccugguccaggcacagguuugguucauuuggcauauuuguuguuuuaaaaauuuuggagguacuuuucaacauuuaaaguccaggacauuucacauuuaaaaaaauccagauuuaggguuauuccgggaaaaucagaacaccuggcagugucaggccaugcugcaugccuggcuucauuuguuauugagagcaggagugcucuaggaaagggguacagauuuuccauuuugcuguagacucuaccccucucaguuuuuccaugggagucaacuuuacucaaaguccugcacuguagaugcuugaauuggugacauccuucuauguugugcgaguguauagauuguuuuuuuuguuucuuuuuugaguaauaucaaccauuuaacucaauugaauaauaacaagaggcuaacauuuaucaaaugcuauuaauguaccaaguacugugcuaagugcuuguaauauguuuguuuauauauucuuuacaauuauccuaauuguauagaugaggaagaaauugaggcaaagagagguuagauaacuugcucaaggccaccuagcuaguaaaagucgggcagagucacugugguguccucagaagcaagucccugcuugggcuagcauuuuugccuaguccggguuaucuccagaaccuggucugcuccucauucccauaucccauuaggaacagugggcaucaguugcaaaaguagaugacaguaacacacucccuaaguccccagucugcuccugggaggagcagccugccuuguucauggcagucauagccacagggggauguuugaaagacagccccuuauacagugucuauugauuuucuucacccucuuguuuugcucauccauccuguuguucuaggaugcuuauuugucaugcauaaaagccuuguuacagugaacccaaacaagucauugacauuuaaaauuaaauugcaacagguauugucaauagcuaaacugcucauugacagugcauugcuaauugcauugagagaacauccuaacuggguauauucugccaaaucaaaucggaaacauuggcugucuaccagcaaauucauuuugacuugcacagaguuuggggauccacagaucccucaccaaucucaaaauacuguguuuauggaaacgcuaauuauuauuuuuuuuuuugcugagguucuuugcagagaaggggaauucugaucaucuucacugacugcuaagccaggagucagaaacugugccuuuggaagggagagaacuacagauuugggguggaguaaaguucaaugcaagggggucauuuggggaggugggccaucagguucuuuaucuguaaaucuaagccauauccuuggauccauuuuuuuuuuccuucucuccuuuuucauccccuucucucucuucuauagguacaugggagggggacaaggguggagacacuuaauuuuuauuaagcacuguucgugguauuuuaugugaauuaauuuguuuacuucccacaaugacccuggggagcagauaugcuaucagguaaaaaaacuaaggcacagagaggguaaaacucuucgaaagagucuugugguuagucagcuucugugagagugagagugggcugcccugaggccaucuguucccucuccccagcugauauuuuugugcucucaggguaaacauuuaagccugugaguuaaacucagccuuggacuagcugaguuccucuggaggccuugcaaguagcaguuugguuggcagggcaauuaaguaugcuaggugcacugugcugaaccccaggagggagggaaggaauggaaucuagucuuugcuugcguuauacaugcuuauugguuuguggcaggcgugauugaugccagaaucaaaaugacuuaaagcagcuucccuugagaagcacuacucuaacgguuuuuuuuccucuuuguugcccuaggucccuugugaauaggauuuagcucugauucagcugcugcuguucuuuugguaaucaguguggaggaaggagaugagggcugcuauuaauggcuucuuauuuugcauucuccuaaucagauauccugcaguuauuagugugaaugcaagauguucgguggugucccugggugguuuucuuagguguacuggacuguuagcuuucuaagauggaauguuuuauuagguucuggccuaggggguugguuagauggguggagguuguuaaaaagcacuaaagaaaaggaauaggauauaaaaccaaucuucagggggugggaauaacaacccaccaccuucacuucccuccccuccugcccugaaaaccuuaucuugcuaauacccuucagauauuaaaagugaaauaacagagcuauuuacuaggcagcuaaaugcaaauucucucccccauuaguuuuaauuaggaugaaaucauacauuuaaauaaccacuucuauuacuaauaacugaacuucugauucacucugaacccaggcaaaugccucuucugguaugaauggcccaccucugagucauuccgcaccugcauauugacacagccaggcuccugauguggguacacacaucugggauuuaagggcaugacuggcauguugaaucuuggguauaaagcuuucugcacuauacccuggggacaaacaggauagcucaacuggagaauaaagagcuugcaagcucaaaagaaaacaacaaccaaaaauaccucaaccaaauucugcucuugcuucuauccuacuguuucuuuagguguuuaaagggcuguaguuuuaaaaaucucccacccaccucaucuuuuuaaguaaaugucacaacaguacuaugucaauacaguugaaaauaaguauuugaguugaaagaauuggcucuuugaggcuuuaacuaucagauuugugcuaauucuuuacuguuuccuugacauaguauaugcagucugugcuaagagaguauggauguugucgucgguguauagaaugguggcuguuguaaacuucuguauguuggggaaggauugaaccugcugucuggagaauuagaaaccagcagcuugacuuaaaucccucagugucacaaccagcuaaugaaggagaggacugcuaaacucccaguggucuuuguggcuacgaggacuuacucaaguuugagacuaucuuuagugggccaaugacguaggaacacaaucagcagaggacauguaguuuacagcagccuguaaugugccagagacaugacuagcugccucuuuggcccuggggaagugugucuggcccugcuugcauccucugugagugggaauugugccagacaccagcuagacaugaccagcugcuucuucgauguucuguggacaugauuggcuguagcuuuugaucaggacaguguuccuaaugaagugugaccagcgucauuuagacaggaaagaaugacagcugaugugcaagaauuuuucuugauuggcagcauuuggaacuaguaaccagagaagguagguggggggaggagaagccagcucugauugacaagagcuuaucuuuauuuaaucuacuucugaggcacugaaguugaaaucuuaggcaagugaaagaaaggaagacacaauugugaaacauaauuaaagauucuugacaaaaacauacuuaaaucagaaaugucuuuuuuuuuucuuuuuugagauggagguuugcucuuguugcccaggcuggagugcaauggugugaucuuggcucacugcaaccuccaccucccggguucaaggaauucuccugccucagccucccaaggagcugggauuacaggcgccugccaccaugccuggcuaauuuuuuuguauuuuuaauagagacggacuuucaccauguuaggcuggucucaaaccccugaccuuagguaaucugcccgccucggccucccaaggugcugggauuauaggcaugagccacugcgcccggccagaaaugucuuucaauaggagagcaaugcagaguuuaggugugagguuaucacugcuccuucggcuaugagaaagagcuuuugcccagggauuguuaauuuuuaggcaaaauuuaaaguggcgaugggcuuggauaguucuagcaauaaaaaaaguucugcuucuaguuaccaucuuguugacuuuccaaccuacuuggaaagauuuccuuuggagaggccaaaaacaagugcuguguauggaguguggccuguggugguaauuucucaucaacucuugauccacugaggauuuaaaucuuaagucuucaugugcuuugagaaaagaugacaagcggaaauaguauguuuguuuccuaaggacacacaugugauuucugagagcugauuguaugcaauguggugguauucuuuugcaaauaggcuugggaacuuggcauccuggauucgaaucugggcaccaccauuuuccagcucauuccuucuuauucaacuccaccccaccucgaaccccgauuugguuuuaaagauucacauacuauuguuuuaguaauuacccuugaaauaaagucacauauacuuuuaagucuaaaguuaauccaggacaggugcgguggcucacacccauaaucccaguacuuugggaggccaaguugggcggauugcuugagcccaggaguucgagaccagccugggcaauguggcgaaacccugccucuacuaaaaauaaaaaaauuagcugggugugguggcaugcaccuguauuccuagcuacuugggaggcugaggcaggaggauggauugagccuggaaggcagagguugcagugagccaugauggcaccacuguacuccagccugagcagcagagcaaaacccugucuuaaaaaaaaaaaaaaauccauagccuaaccaccuuggauaauacaagugacuacccuauaucugaucauacugccaccccaaccuaaauccaguauuuguuuugccuuuuuuuuuuuugagacagggccucccucugucacucagguugaaguucaguggugcgauauuggcucacugcagccucaacuucacaggcuuaagugauccuccccacuuagccuccuaaguauuaggcaugaagcaccacgcuuggcuaauuuaaaaaauuucuauuuuuguagagacagggucucccuauguugcccaggcugguguugaauuccugggcuaaagugauccuuuccaccucagccucugaaagugcugggauuauaggcauaagccacuggugcccagccuauuuuaccuuuuuuuuuuuuuuuuuuugaggggggagggcagauggucuuuuagauuuaccuauguauuugacaauuuguuuguucauauuucuuucuugugucucagaccuuccuucagguuugacuuuucuuuagaauuuccuugagcgagugccuauugguaguaaaugcucuuuuuuguuuaucauagaugucuuucuuuugcccuucaucucaaaagguaguuagcuggauacacaguucuagggggaaagauuuucuucucuuugagucuuguagguuuguugugaagauuaccuggguucauaucuaaagcccuuagcacuaugcuuggcauguuugcucuguaaauaacaguggcuguuacauucucagaaaaauacuggaacaguuggaggcaaugcaggcuugguugggauguccauacuuugacuaacuuuuuacauuauuuucuuaaaacuuugauuucauugagauuggggugggaguacauuuaagcaucaaaacuaacuuugaagauagauuugauugaacugugaguucuaucacucgcuaguuguauauaccuuugguagauuaucuuaccuguccuaagaaucaguuucuucaucuauacagugaucauuguaauacuuccuauuucucugaguugcugggaagguugcaugagaacacauuuaaagcucuucuccaagccucacauaguagguggcuaguugugguaauuauuuguugccuguaaaccacuuuuaugacuuuuauguagagauguuaccaacuugucuuuuuuauuguuguuguucuagcuauucuguuuuuauuugcucuuccccagauccacagaaaagaugggguaucuccugcacaauuaacuuucuacucuacugauggggaaggccuucugcagaguugguggcucuugcuuggaggcaacacuuugaugcuugucuuuaggugggaaaguagcuuuccaggcccaguacuuugcuacuuguaagacucucacuuaccugaaaauuguuugcucugguuuuucuugugacuuugggcaaguuaccuaaccucucagugccucaguuuccucaucuguaauaugggaauaauaauaguuccuuccucacaggguuguuguaaagacuagauggguugacacacaugaagaccugagagcaugcaugacacagaggaugugcuuaguacuuuagcguucaucaguguugucaguagccagggcuuccuucuguaccauauuguugacuuucagaauaaaaaauacauuguuugcuaugacuuugucccagggcguguguauuaagcuuccacauauaauuuauaucacuuauuccuuaauaacauugucauggguuagaugggacauguauuuuuuucaacuuuauuuuuuacauacaauaaagugcaucgauuuuuaaguguacaguuuuaugacuuugagcuacagucaccacugcuaucaagauauaggauauuucugucaccguaaaaauucccuuaucucuuucccagucagucugucauucuuacauuuggccccaggcaaccacugaucugcuuccugucauuauagaguuuucuuauuuagaguuuuauauaaauggaauuacauuuuacacacucucuuaugucuggccuauucacucagcauaauuauuuuaaauuuuaucuaccuaccugcauaguaccuauauuuugagauaggaucuugcucugucacccaagcuggaguacaguagaacgaucauagcucacuauaacuuggaacuccugggcucaagcaacuucucccaucucagccuccugaguagcugggacuguaggcaugugccaccuugcuaggcuaauuaacauuuuuuuuuuugguagagacuggguguagcuguguuucucaggcugguuuugaacuccuaguguuaauugaggccucagccucucaaaguacugggauuauaggcaugaaccaccacgccuggccagcguaauuauucugagguucauucauguuggcauguaucaggaggcuggucauuuuucuugcucugugguauuccacuguugaauguacuacaguguguuuagccguucugcuggcgauggcuuuuggguuguuuccaauuuggggcugcuauaagugagcugcuaugaacauuuauguacaaaucuuugugcagcuauguuuucaucuauuuugaguaaauaucuaggaguagaacuucugcaucuuaaggaauauguauuuuuaacccccuuuuacugaucaggaggaacuuagaggguuggaacugaccaaggucucacagccagaaaggugucaagcauggaccaacauuugauacuccuuuucuguuuccucuucaggagucauucuauuagaccagugauuucacacuuuuagagcaccaagacucuuuuuaaaauaaaauacuguagguccaggugugauggcucaugccuguaaucuuagcacuuugggaggcugagguaggaguauugcuugagcucaggacuuggauaccagucuggacuacaaaucaagacuccccacacuacaaaaaaaaaaaaaaaaauuagccgaugugguggcauaugccuguagucccuguuaucuggggaugcugaggaucacuugagcccaggaggugaaggcugcagugagcuauaaucacaccgcugcacuccagccuaggugacagagugagaccuuaucucuaaaaaauaaaagauaaaauauugcuuagaauuucuauaaacaagcuacacaaaagcacuguaaacaggcuccuuagaaaguucagucacuuuuuugcuguuauccuguugugcacccaagugcuucucaaggaaugucuuuuuugcaaagugcugcaguccauuuggcugcuucuugagaggagagucguggacccccugaggccuaguucuuaaacaucucuucuuaguccccauugcauuaguuguuucagaacaggucauugagcauuucgccuuugcauuuuggugguucagagaguaagaaacucuuucuccggcugaccaaaaaaccaccucucccuacgccucguguauagauugggcuguacaacuggugagaauaguaacaucaccaucccuguugcuauaaaucacugcuggugauauagcuccuugauccaaaggguacuucgggggauguagggccagauagguacauucaaacucagacuauuuaccuuugucaccugguaauauuuacagauggagcagaugccaguauguuccauugcccuauucuggaguagugauucucauuuuauguuaucagagccuagcuuaugaaauuugaaaugcacuuuugccuccuuugcacuguuaccacugcaucagagcauuuuaaucagcuugcuuucguugaaguguacaauuuuucuucucauuacgucugcaagcucucaaguuuacagacaugaucuccuuggcuagacuaauauuacuuggccauucuugcaugcaaauuuaaaauuuaauaucuugcugcaggucuguugaguuuuaugcaaauuccaauauagauuauauuuuggagcuguaaauuagaaauuacauuugggggaaguaauauuuguguggguuuaaaaaaaguaaucuugcaguuuguaugguacauggcauuucuucugaagaaacgggauuuugaguauucuguguggguuuaguagaugucuugccaauuguguuacugauaaugaaaauacaaaaacaaugccaguauguacauuaaauuuuuuuccuuaggagacaaagucucacucuuuugcccaggcugaaaugcaggagcacgaucauagcucacugcagccuugagcuccugggcucaagugauccuccugccucaacuucuugaguggcugaaacuacaggcgugccucgcuaauuaaaagaauuuuuuuuuuuuuaauuuagagacacggucucccuauguuaccaaggcugaucuugaaauccuggccucaagcaauccuccugcccuagccucccaaaguacugggauuauagggcaugaaucacugugccuggccuacaucaacauuuuuuaugacauuuggcugcuuuuucuaaguuauuugggauuaacuguguucucucauuuauuaauucauugaguauaugguuauggaugcuugauaggcucuccucuuggcuuugaugauacagcaacaaacaaaacaggcucugugcucaugaaacuuaccuucuacuugggagaaacagacuucaagcaaauaaacaccaaguaaauauuugguaucucugauggugauacauucuguggagggaaauaauucaggguguaggaauaaaggugugcugagauggaggugcuagucaucaggaaagaccucucuaagguuaccuuuaugcaaagacuugaagagggaauggaaugagcugcgcaacucuucuuaggagaacauuagucuggguggagacacugcaagguacaaguguccuaagugggugcucuugccguguuugaggaguagcaaggacgucagccugacuagagcagagagggagguagaaauagggcagaggagggguagcagaugauggagaggugucacaggucauauaggaccuuguagguacuauaaggacuuuggccugugcucugaaugagguggggcacugugggcgagggcuguauuagguaagaagacucugaccauuguguugagaauggaguuuguggggggaaacucagaucuuuggaugaugggcaugggacaccaucaucagccauugcagguguggaccuuggaugcugccugccuaaggcuggugaccaaaaagaagguagaguuggauacaagagccuggcauuguuggcauuuuuguguuugagugucggaaagaucguggcagaagccuaaguaucuguguugcuugggccuagcaucuguguuuucacaaaucccccaggugauuugaugccucuuuaaaacacagaauguugggcccuacccaaaggguuucugauucaggagguuuagggcagggcccaagaauuugcauuauuuacaaaugucaaggcgaugccagccagugcugcuggucagggaccacgcuuugagaaccacugcucuggugaauggguauugcuguguuguuaucugcaaaguuaccuuuguguacuucugcuuuacaaaauaggauguagcuugaacucugagucaaacugccauuuacugugguaugaccuuggauauggcauauacagugauuccucacacaugguguuaauaaguucuuaguaaaugcuggcuauuugaauaugguauguagguauaaaaugaugugguggagguaaaauaugaauaauuugcugaauauaagcucuggacuguggacauuauaaacaagaucuuguuuuguuuucagcaugacaugaaagguucauuagcuuuguuuuacacauagggaaguggcuuauucaugaucacgcaacuagaaguagcaacgguagauuucaaauucaguucuuucuggcuucaaagccugagauuugccaccaccgcaugagcugcuuggaguacuggauuggcucucccacaguuuuugucauuguguguguguauguguguguguguauauguaugugugugacagacagagagaaggagagggguguguguguguguguguguguguguguguguaugagagagagagagaaagugugccagaaauuauuugcguacguuuuaaaaucucuguuaggccauuuuuuaaaucuguaaaaugggcaugaagcaugcagaguucauaggguuucuuugcugaguagaauaugggauggcuuagcauuguauuuuuuuuccuuuucuaauuaaaaaaauuucaaagccaaaucgaaucuagauagaauaaauuuauggauuuuuucuuuaggguuccuuauuagaauggauucuuccuaauaugaaacuugaguuauugaauuuuguguggagaggaugcuucucauuagggucucaguuugggaagaagagauuauguucccuuuaaaaacagcuuacuguguuugcaauuuuagauuucuuaucucaggaaguucacauacuguuaggauaaaacuuuccuagauaaggcaucuguacaaaggaaugaaguauaugggaaacugcguguguggggagaccauaucuuuaauuuuugaaagggcuaggguagccuggugguuuggaaaaauuaaaaguauugcauaaaagucaaauguaauagcaauuauuguuaguguuguaaacuuccacuuauccacaaaucagauggguggcagucucuuuaucuuaaguucugguuauaaaauugaaaaagccauugauuaacaaauagcugucacaaagcuggaacuuucauaguaacaguuucuggugaagcuucccuugaucccugacucaaucagcuagguagagauaaaagagaaauuuuguauucugaagauguacagacaauuauaaggaacucugguugacugcagggggaagagacacaauagcuauuaaaauaaaaguaugacaguugggcuaaacaggcagccucaaacauccuaggagucccugagggcaacacuguauguagugacucagguucuuagaggaaagugggucaucaacaagaagcauacaggcuuguuuuugguaucuuuauaagaauagagggaaauaaugagugugucagagagcucuugucaaguuuaguuucaauaaaacaauuugcuuagggguaaguuuauuugggaaaauaaaucacugauaacagcauaaauacuguguuccucagugaugagauuagaugaguagggagguaguggggugagguagaaggagcauggacuuggacacagauacuugauuagaagcagaaucaccuuagauaucucugcgccccagcuucucugucuauaaauugggaauaauaccugaagaggucauugucaggauugaaugagaugauguaagcagugcaccuugcccagggcuuaauaaauagugaugagacugguagauuucucugugagggggcuucaggauauaccucccuuauacagacuucuauuccuuugaguccaccgccccccacaacaucuuuaugaacuguaauguaucucauacuguacaagucacccauuuaaaguguacacuucaguggcuuuuagauuuacagaguugugcaaccacuaccacagucaguuuuagaaaauguucaucuccucgaaaagaaaucuguacccuuuaguuaucauuacuuuauucccucauccucuuccucaucagauguuguaggcaccaccuuucuucccuuccuucccuuaucuucuuuucagcuguggacugugcugauuugccuguugcuggaucaugugauugaaauucuuugaauuuuucuguaaauagccaauuuagcuuuuucccuuccagaguauuuguuucuuuggguguggaagcagcugcugcagccagugcaagggcucaccauuuugcgcuuugcggcuguucauauggcaacuuuauucaaaaccgcuccugcacugcuuaaguuauuuguuuuauacaaaaacaguucucgcuggcuugcggcuucucugcugccauguugacaaauguugcuucuagugaaauacacaaaaauaaauaacagcaagggagaggggagcacagagcuaagugaauucauuuugccucuugagugccauucucauuuguuuuaaaaaccacccuggcacagacagaaaaggagaaggcagagaaccgcaggaaaagaaaaggccacauuugauucuuugaauugggcuguaggggcuggcugaacagacaacuugagaaguaucuggaauguaggcccuggggaugaggaaaaguuuacaaggaaucugaauaaccugcagauauucauauugcaacagcccccauuuacauagucuucagaguucauuugguauguucucuuguuuucucguucuguugaugacgagacucaaauuuaagcacugcugguguaguaguacaugaccaugguugguuucugucagugugguagguuguguauuaggaacuggaaaaaggcaaaagcguaaggguguguggguucucaaguuucgauuugaaggucugacccacaugagaagguggagggaaugcugacaaauauugauugccuuucugagccaaguauuuccacaaauacuauguuauuaguauuauuauuauauuaagauauauuaguauuauacuauuauauuaguauauauuaguauuauuaguaguauuauauuaguauauuaguauuauuauuuguauauaacaaauacuauguuaguaguaguaguaguaguaguaguaguagcaguaguaguaguaguuuucagagagagggucucccaggcuggagugcaguggugagaucauaacucacuguagccucaaacucuugggcuuaagugauccuccucacuuagccucccaaguagcuagacccacaggcaugagccaccauacucagcuaauuuuuagauuuuuuguaaagaucugggccuuacaaagugcuggguuuauaggcaugagccaccaggccugacuucagaaacauuguuucauugguuagcaugacaaagguugguggucuuagcuucauuucacagacuagggaggacagaguuuugaggaauugugguacuuacuugccaaaggucuuacugaaauuaggggaguggaaugaaauggaaaccccgugcuuccagaccuagaacuuguuccuuuucuauauuaguaguaagccaucagagguauggaagaagaaaaggagaagggcauuggaaaauaaggagggauaacagcaagcaguagaggccaaaaacauuuuguuuagaaaaauuguacaucuucuuugaagguuuuuguucauuaaaaaucaccaggaaaacgaaagugacuugcaaguccacaagaaacuuuguuuugggugugugaguuaagaaugaucaccugaccaauuauuauugacuagaaaaacauuucccugagccuuucauaaauuaucuuaaugugcauauuguugaggcagugucugauaaauaacagccuaauuggccacccagggucugagagguuugcuuagccacaacuagccuuucauucugggucuggcagauugauuucuuuccauuuguugcaugauuuucaaugcuauuuaugaccuaaauauucuguucaaaauauuuuuuuuuuggucuauugcuaauaguagaugccucuagggagaagaggagagaagcaagagugaggugacagggacuuacuuuuccuuauauucuccuugguacuuuuugaauuuuguuccguguacuauuccauaugauggaaaggagguaaguguauuuaggcagguggaagguaagaaggguagaugaaaggaugaauuauugaccugaacuucaggccuuuauucaucagugguuuagccugugggauuguuucucagcauauaaacuucuucaguuauguagacauauaauaguuacuuguucgauuuauugcaucugcaaagguauggccaggugucaucaugaggaaguauaguaguauaguguuuaggcuuaaaagauucugaaaccuagacuuccuggguuguaauccuuucucuaccacuuaguggcugaacgugaccuuggaucuuacuuuaucuagcauuuuugugucucggauagcuuguaguuaaaauaguaguuauaacaaaacuuguggaauuggaaggauuacauauauuacuuaauccacaugaaguucuuauaauagugcccaauacacaguacucacuaaaaguuaaauuuuuuuuugaugacuauuaucacagauggugauuugccucauccaucucucugucccuuaaugugguccaaaauccaccccccgccccacacccggccuuaaugcccagacagugccccuguacugacuaaggagccuuucuuuugaguucacuggucuggcacuggcuccuagaagugcuguuuuccagugacagcaggauauuuggaccacugggagagucagugggcuggggugggcccuugcucucugcagagguguucuuucucccagugggaggaaacaccacuugucagaacacagcuuuggcuugcccagguuccuguugugcagauggggccuagagucucucugggccccuugucauggauccaagccaaggcugucgcuugcugagccaggaauaauauaggaauuagucuuuuucuucuuuauacuaagcacuaaucaaucuacaguuaacucuguaucuaauuucugaaccagaugccgugaauaacugccccugaauguguuuuugccaauaaaaggauaaguuuaaggcuuuuaaucaaugccgcuugcacucaguauuuaaggucagaaucuugugugcgacuuauuuugaucaggauaauuguuggguuaaaaaaugaacgguuuuugaaauugugacacucgcgguugacucgugggugaauuaaucuuugagaggauggaaaauugucgaguucauaagaguucucuugcucucuaguugucuuucaggucacuuauggaaaaauaugacuuuuaggaggaaggcauucuuuuucaaugggaaaggagauaagagacuaauagaaauuucuaaggagucagugauggaggcucaggggaaauuggaaaugaagcuggguguuuuggaucugcggugagcugagggacuggaacagcagcuguguauguucuagguaauauuaacuuguuguaauuuuaugucuccagcauaccuuuuucaaaggaacucauguuuccugaccaacgacuguguacugucuagaaugaagcauaguguuuagaaacaucugggguuuagauauuggcuucacugaauggccuagggcaagucacugagccucugugcccucaguuuuuauaauuauaaaaugggaugguaauagcuaccucgcaguuggaaaacuuaaaugugaucauguaugugagaaugugaagugcagugccuggcacacaagaggugcugaaaggagcaucuccuuuuacuucuuuguggaguuuguuuggcuggucugcuggucugucauacauuugucuggugugccucuagauacacguaauguggaaauuucccuaccuuguaacagugaguuggaaauuguuccuguugaucuguuuuuuuuuuucuuuugugcuuagggaaaggcaugagaaaaaugagucaggaugcccuccauuucuggagaagcuuggugguaauucuguuccccaguggcucacaagccugggcaguucagagaauaugagaauugguagaucauggagaacuaggcucugccccuuuggcuaugcgggaguuacuuagucuuccugaaguuuccuguccaugaaaaggggaugugugagggugcaauauggguaauguuugugaacaaccuuuguuagugucaggaaaguccaaaacuauguggugugguauuuucaucaucuugaguugacaacagugcuuauccaaaagucaauuuugguauuuugucaaauguuaaaggcucaggaaauaacuuccaacucaaggaagauuuguauccacucuggagcuggaggagcuuauauuaagaauguaagauacuugggcucccaggauuucuggaagagcuggcagucucccugagguucagguucucagaccagcaggccaugcaugggggcuugugauuaagcuggugccgaacauugcugaauuauauaggucuuucugugcuacagguugguuuucugcuguucacauguagucuaacaguggccuguuuuccuuugccucaacugugacauccccucgaagugaccuuuaugaaggcagagcuuggaucugccuugcuucuugcugccuacugugugguuuugugcagagugcuccuuucccuccucuggugucuucacaggugacucaacuggaagaggagguuaaagaaggucggguuaccaagcaccucucuucaugccucagccaauccaggccccaacacugugugggaagagguguucaucuguugagaagggguggggacaacauauguuacauacagaggcuccaaggugguuuugaugagcauagaguauagugggagaaggagcaaaggaugguuugggagguaggaaguaaaaguuucagcuagagcugacugucaaaggccuuuucugucuuuagacuuuuacucuguaagauacagggauuuguaugugaggcuuuugacuuuaacucuguuggaauagggauuuguugcaggcuguuaaguagggaggaugguaugagagaugcauuuucagggguuucauuugcucauggcaugguagaagaugaaggguggauggugaguagaguagaaauaggaacacagaagacugcugcaguauuucagauggggauuguguggggccuauuuaggucaucuccagugcaggugcccaggagaaguuacaguagauacuguuguacuuguaaaggaaaaugacauucgaguuccuguuuugugccaggaacuuuaaguaaucugcauaucuuagcucaucucauucucaaaacagcaacaagcggaagguguuauuucucaccguuuuucaaauaaagaaacuuagguuuagagcauaaguaauuuguuugccaucccuggacagcuccuaaauugcaggguugagguuaauaccugauuacauccaacuccaaguccuuucuguucgcauuacaccacacuguggcccucaggacacagccucauguagugauuuugcauuagcaaauaacuuuguaaggacuagucuguuaauagugaucucuuucaacauucccaugagaugagggagcacaauuaauuguucagcugagggauuagagauauaaggagguuaagugacuugacgaggucacccaucaagugguuuggggcggacaggcagaggugagugaggcuuggagcuggccauuuugagacaguggccuuaucgagaacaagaauuuuccagccucauuuuauaaauccaggcuucuaguucuauagacuagggaaacuaucauggaaaugguaugcaaggcaagugccugaggcugagauggcacaaagcaccgugguaucuugggguuacuuuauaaucaaacucucucuucuagcauagucuuuaauuaaaacaacaaucaucuccaccaaaaacuaaucaucuuuauuaagcauacagauuggaggaagaguggggagucuugugucugagaaagaucucaccaauaaauuguuuccuuugccauaauaauuguguugcugaguuuaauaauuagaauucucacucuacgcuuccuuuuucuguuugauuuuacgggucugacaucgcuguuguuuuuccugggaauacuugaggugucacaaagagcaacauuaugaugagagccaugggaaacacuugcuaauuacaguauauugugccccuguuccuuaucuaucagucucuauugguuauuauuacucauuuaauuuuuauuuuugagagaugaaugcacagggcagaauagguccugagaaugaaucuagagcuuugccuuugacuuggauggacacuuugggcauguacgggucaagaaauagaugauuggguaucuugugguaggagcuagaggaacuauuaauacauuugggaguggggagugaaggccauggacugaaaagaugccgaacuacaaaccugaaugauuuuauaguuugcuaaugguuaucccuggaugccaugcaccaucaugauuuaacugagccuugcaaacagggacgauacuuuuccuaacccccugccaucuacugcuuucucaccagaggucacagggcaaagacaaguaacacuggcauugugcaugugugacagguaacuguagguaguaaaguggccaccuguaccauugcaacccuguguaauagucuagugaagugaucugcuuucugcagucaggaugccaaauacgguggagaaggaagugacagucauuuacagugucauguuuagucuuuugcagaugugcuuacaguuuuaacaaaggcggagaagaaauuauagggugggaaagaaaugccuacagacaggcugcuaaagccuaagaaggaggaaacuaguauuuguguguuuuaggaaugcuaagcccuugcuuacauaucagcaagcaaaauauuggcauucacuucugacuugaggaaggcaucucugaagucaauagaaggaaaugccuaaacacaggccucacucagaaagaaaggagagcuguggaaauacucaggauuaucucauaaaagcucuuuguguauuugaagccucuaaugaaaucagccuuguucuccaggccagacaacuccaguuguucuuaccuuucuuuauuguaucuuuuuuuuuucauuucuuuuaugcuuuugucaucucuugaaauuucuuuucuuugaauaauaccaauaaaaauugaacuuuuugccugaaugcagggaugacuugcuaguaacuaccaguuuuuaucagaaagcagagugggaugcucagugauguuguugauggugaggauguccaaaucuucuuuuuauaugcuagcuccauugucugcugcauuuaccuguuuguagcguuggugcguggaacauuggggcauauaaauguuuauugaauuagugaaugaagauauacugaauuuuuuccuuaaaaagucaguauuugcuuugggucaauaaagaaacccuuuauuuugcuuuuucuucauaaacaccaaaauccuaggaaauauugguuuuacuuugccacagcacucugcagcuuguacagacuuuuccagagaugaaaaauucuuucucacuucuguauuaguccuucgcuuuauccucugauuccuccuuccuuccuucccuuuucugccuuccucucacccauucauguauucauuaauucaguaaaugcuucuucaaccucugcuauaagcacuauuuuaaguucuagggauauuguuauaagccaaauaaugucucugcuuucaugaagcuuauauuuggguggugggucaaggaacaugauugaucagaagaaguuagauuucccuguugggacaaggcuuucagagaaguaagugguuguauagguaguagagauaaaaggauugcucccugugagggacuugcuggcaggauaggcugugauuucacuuuauuuucuauuuacauaacaaucugaaucccaauauaguguuuaaccugauauguaagauucuguuugggcaggguuuugucaguuaucauuuauaucuccuuucuugaaauuagaucagauuccuuugauuuauuuggagagaaaaaugggcaauacacaauguguuucugcugaauauuuugcuaugauguugacacaguaauguacacuuuauuuugauuuuaguguguuuuauuuaaacauuccauuauucagaaauuguuacccccuccuuguuauuacuguuugccugcaguuauuuagaaagcaguuuaauuaauguucuuuuaccgcccccugcuucaguaugaguuucaacacuuuuaauacaaaguguucauaucacuguaugaacuuacuaaaacccaggacagugauauucauucauucauugcuuuauccagcaaaugugcaauacaaaaaaagauacaugcuuccucucuacacauuucagucuaauaugaacuguuugguugaaauacagaaacauaacaugcaauucucugggauaaacguuucacuaaauaaacagcagugagaauucugaagauacacuuaacuaggucagccuaggcuuaucagagaaggcuucacagcauaggcgaucuuugaucugguucuugaaggguaaggauguguuuuccccccagggaccaguugagaaauagcuagaauuaauuaguucugcuguaaucauugaggugcugauccuagaguguggcuuccacugcaguacuggauguggggaugaugaucucauugcaaacacagccuggguggguguuuuugguuuuguuuuaaggauucugaagcagcauauacacaagguugaccucaggaccucuuuaguugguugcugcugcuguucacaauagauuuagauuggauagggcuucaguuuucuuacuguugcauuccagcauuuuggaucagucacuuuauuacaucauuuacuuucuggcuuaggcuuaguuguuauuaagugaaucagggauaaaccuuaggcuacucuccugcuuccuuuuucaaaugauccggaguaaauaaaacaacuacaucucuuucgucacuguguuucguucccaucucagaacggguaaaauggccaauauuuucagugaaaauguauugaaaugcauuucacugaaagaaauguucacauucagugaaauguaucuaaacucuaaaaagagucuagaaaagcucauugacacauuuguuacuugcugaaagccccagugaauuuuccaaccuccguauuguccuuaaaaauugccuuuuaguucuuaaggugguggagguguguuuuuuucuucccccuuaaacccucuucugagcaaucuuugcagagacaccuggugagagaguaggcccuucugcuuugugugcccucuaguaagagaugaucaucagcagcuuuauauccuaauguagaaaaugugcugugcuagaucauuucaacccagcaacucaccucuucaugccuaaugccuggagcuagggccuuguuucucucuacauuagacaaaaaauaaauaaauaaaugugggugaggauaauaauaauuaugauggcaggaacacuuauugaguaagcaaguguuugcuuauuuaaucuaccugacaacccuaccagauguagguacuguuauuuucuccauuugguggauaagaaaacugagucacagagagacucgguaauuugcccaaggucagacagcugucugcccggggaaccuauacacuuaauugcucugcuguacugugguugaguaucucuuauccgaauugcuugggaccagaagugguucagguuuuugauuuuuuuuuuccgaguuugaaacaucuguaucuacauaaugggauaucuugguggugggacuuaagucuaaacacaaaauucauuuaugccucauacacguagcuggaagguaauuuuauaaaauaccuuuaaugauuuugugugugaaacaaaguuuugacuguguuuugacugcagcugcucaugugaguccaguguagaauuuuucacuugugguaucauaaaaguuucagauuuuggagcauuucagacuucagauuuucggauuaggguugugcaaccuguacuucaugagccaauugagaaaaaugccuucauaauuucuuucuagggccucaaacgccuggacgucaccccugacuauugcauguugugcauuggacaguuagaucuccucagugccugugaacaaguguucuuuugagugauacucuucuuuuugugacuguauuauauaauauagcuuucauagcccccacuuuauuugcuguuauuuuauuccccucucauccccgcccccccccccccccccccauauaaaggacucauuucaaagaugggcgaaccuggaagcugaaccugacucuacucuucaugucuucaauuuacuggccauaaagguucaguuuuguaugggaucuucuguccucuagaagaucccguacaaauagaggcuuuaauuuaugcuugcauucuugcauuuugugugauuuauugccuaauaaaugaaagaaaaaaguuuauuuagauaguaaacugaaaaugaaaaaccauuuuuuuccacgaacuugcuaauuuucuuccauuguauaguaugaacucaaucuacaaagaucuggcaaaaaaaacaaguaucauguucuguaacaaacucaguuacacuaacaccagaacuuacugaguuuaauuggagauaauuaaaaaaaaaaaguucuuuuuuucuuuuuuuuuuuuuuuuuaaauagagauaggguuuuccauguugaccuggccgaucucaaacuccuggccucaagcgauccucccaucucagccucccaaugugcuaggauugcaggugugagucaucgcaccuggccucuuaauguagaugauuuuuuaaaaugaagauuuuuuucauaguaagaaaagggaaaccauaauuccagaccacagagaaggacuucuuuaauauauuuaaccucuuuauuuacagaucacuucuuucuagagagacuaaaauuagggcagagaaaccuaaauccuacauacaaagagcugcugcccauucaaaauaauuacaagugugucgggcgcgguggcucacgccuguaauccuagcacuuugggaggccaaggcaguggaucaugaggucaggaguuugagaccagccugaccaacauggugaaaccccgucucuacuaaaaauacaaaaauuagcugggcgugguggcacaagucuguaaucccagcuacucaggaggcugaggcaggagaaugcuugaacuugggagguggagguugcagugagccgagaucgugccacugcacuccagccugggcaagagagcaagacuccgucucaaaaaauaauaauaauaauuauaagugacaguaaagcaucuccccacauaauccuguauaucaguaagaaaauauguuuugagauucacaaaacucaauuuacgaaucucugguuguaguuauuugacuuaauauauaagacacuuaccagaggagaugguugcaaacagauuugaugacagguaaauuuuucuaaaggucugcuaacuucuuauucagucauggccaaccacugauacaaugcugagaguugcuuucuccuuuccccucuacuagcuugggguccacagaccaaaaaaaucuauaacuugcaaggcuaauaaaugcaugcuucagcugccuggaaaugcuguuggacuggcaauuugcugccccgcucuaauagagacugccucagaucuggucuuuaaccuggauuagcuggauaaagagaauccucugggauccugugugccaucaccuguuaguguguuugcuguauaaauguaacauccacuaacuuugucagaugaugucuggccuggcugcuguggcugugauuggaauugaaacauacagcuuguuauuaagguagugacuggcugugggggacaccgacgucuguuguuuuucauuguugaucuagugaguuagaaugccuuuccugggcuguuaauguuaaauaguucaguccuguuagucguuuugugagaucaucuuucugugugauuuguguguauuuccuugaucuaguggggugcagggucagggacugaggggaagguauaauuguuuacagaaaaugugacaggacauggauuugaaaucagauaggaaguuaaggaaugccgggcuccucugaauauuaaggaaaaucuuuaagccccuaauuaacuucagaaaauccccuugcucucacagaugggaauuuggcuggguaagcuaauaacuggaaugaaggcuaggaguuguggguuaaguuucucccuggcaaauaccaauauuucaggauuacuucgacucuuguccugcugccucccacuggaucuuuacaaacucugugcaguagagauuaucuugauaaagauuuuggaugcauguugggccuuuauugaaugaugaaugcuguuuuuuauucauuugcacauuuauuggguaccuacuauaugucagccucuguucuuggucuuguauggugguauacaagagaaacaaaauucuuagccuuauggaauuuauauccuaguggacuauaaauuacaauguucacuauuugagaggacccaagcuucagauguuguggcuguuuggcacacugguccggguugaaagaagagacugggauucaaguuguaguuccuguccugauuucucugggccugaguuuaacuaccgguaacauaaugacauugggcuguaucuaauuauuuauaggguucuuuccaguucuuucacuuaugauccugauuuucccaaacauuuuagccaaguugucuuuuuuuuuuuuuuuuuuuuuuuuuuuuuuugagaugggguaucacccagucacccagguuggagugcaauggcacuaucucgguucacugcagccucugccucccuggcuccagugauccuuccaccucagccucccagguagcugggaccacagguaugugccaccacgccuggcuaauuuuuuuguguuuuugauagagaugggguuuugccauguugcccaagcuggucucaaacuucuaagcucaagccaucugcccgcuucggccucccaaagugcugggauuucaggugcgagccauuaugccuaaacagcccaguugucuuuaaucuaguugggcuucuggcuaauucguguuggugaccaauguuugcauauuaaaucaaacaaucaguuauuguacuggagaagaaaauaauuguuucuaaaaaguucauauuucgacuacauggucaugccauuuaaaaaaaaguaguaaagcaacaauaaggaaauacucuuuuauucuggaaugacauaccuaccugaaaucuuugaguuucccuugugucaugugagcugguugauuacaggugaggagaauugcauguucuuacaugcuccucagaaacacucaucacuguguaaaaaaugcuuuuuuguuugugugaaaucauaauauagagcccauuccaccauacaccuucaucaucaagcucggggauacaagccuguuaaucaagugggaauacaggaagugagacaugaaacacugguuuuauuuucacaccucuaaaugagugacugcagaggaugaacuuaaaaauaauaaugccaccucauacuugcaucacaccuuuuaauaaggcgguuuaaaaauauuuagggugaaccuucaucaggaugcuuuaauugccucagcauaguugaauaguacauuaggguaaugccucugcugugcugaaaagccuggagggagauacugucacucaaugaugcguugaggaugauuagguagaaccccuucagaucuugggaucucaguuuccucucaaaugcaugcuguggguagagaagccugggcugguguguguauaauuuacaucuguuauaagugacuaaacuuguaagaacggguacacaaggcaucuuuaguaagaaguaauaauaucugccuuaguaauaauaucuucucauucuuguagguccauuugaaauggcuccaucucuaguacaucuuuccugacuacucccaccuggccaucauaucaucuuucuccauuagauuucaggcagacuagaccgagacuguggguuuuuauccuguuagccacuuagaggcuguuugaucuugggaagauuacuugcuuuucuguacaaaguaucuuuauuucugcaucuguaaagugaagauaagaaucccuacuucauaggguguuagugauaugaguuaguaaacaugaugcccuuagaacagugcuuggcaugugcugcugugguuuugucaucauuauuacuccacuucuuccuugguacauagcucauguucuccuuaacuauacggauguauuuagcgaucugccuuaaauugugauguguuccuucuggucugagagcccuugucacacauaacaugauaacuuugacuugguagguaccuagugagcaucuuggauugagcuccuacaggauuuaguuaagaauucaaagcaggguguauucucauucugacuuuuaaagccuuugaggucaguugggggcaggucuuauuuguuucuuaacuggugaagcugccauaccaaggccacuugcccaugaucgucuacuggguagccugauaagaaggucaguuacucaaggcuguggacucgauuccauucuugcugauauuacuagcguaaaugagaugcuuuuggauaauucucugagcaauuuaggccaggugaauacuggacaguaauuuccugaagugccaugaaguggcaggaacaugauuuauguaacaugggcucuugcuagcugggaugaacacuggagccccugccgugcucuggaauuaugagugccugccagagugccugccugcuuuuguucuagagaguuuuuuuuuuuuucuuuuuccuuuaaguuaaauucucaaguugcgggcaggggcgcaggucucuauggugaugaauggagagauguugaacuggcugguugcaaaccuuacccuagcaguucuuagagacaacugggauaaggacauuuuagcugguugacacuuggguugaaaguacugauguaaaaaaaaaaagugauguguguauggggagggacauauacaaagaaguaguaccuuggcauucuagccagauaaaggagaucuguguuuuuuaagguaggagcuuugagaaaaaugcaaaacuuguauauuucagcaugcagaaaauugcacuucacuaucaggcaaaccucauucauauuagcaagagaaguauaugagaagcaugugguugugggaugccauuaucaggaaguugcuguguucuugaccuugggcucuggaagaacaauuagccccuugcaugcaaacuugcucaguaaagaaaaaguuuuggcccuaaggccuguggaaccaggcuuaggauggaugauggguuuauuguccuucacagccaaaacacaacagucuuucucccuuucuuuccaggcuacccacgugaguacguugauaauauuucugagaguuuuaaagaauuuuccagcagaaugagagaagauagaaggaccaucuugauaauuuaaggacaugcucuuaucucuugaucugcugcauuuuguuuuugcuucuguuuaggccaguguugguaguuauauugucuucucuccacugggcggauuacauguagcaauccaaaauugucaacauaauuauuccacuucuucuuuggcacauagcucauguucuacuuaacuguacuaaauugugauggguuccuucuggucaagagcccuuaucacaccuaacaggacacauuggacaugguagguaccuagugagcaucuuggauugaguuccuccagaauguuguuaagaauucaaagcggguguauucucauucugacuuuuaaagccuuugaggucagaugggggcaggucucauuuguuuuggauuacauguaugcaauccaaaagaguuagguuuuuuaaaaaaauuaauuacccccaccccuuuuguuaaagagucagggucucacuguguugcccagguuggucuuaaacuccuggccucaagugguccuccugccuugaccucccaaaauguugggaucacaggcgugagccacugcguucagucuaauuuuuauuuaaaauuuaaaauuuaaaauuugugguauaguccgggcacgguggcucaugccuguaauccuagcauuuugggaguccgaagcgggaggauugcuugagcucaggaguuugagaccagccugggcaacauggcaaaaccccaugucuacaaaaaauacaaagaaaaaaaauuaucugggcaugguggcacgugccuguagucccagguacuuucggggcugaggcaggaggaucgcuugagcccaggaggacaaggcugcagugaggugagaucaugccacugcauuccagccuggcuggcaaagugagacccugucucaaaaaaagaauuaaaauuugugguacaauauaaauaacauaaaauuuaccauguacaguucaacaguguuaacuauauuuacaucauugugcaaccaaucuccagaacucuccgucuugcaaaacugaaacugucuaccauuaaauaacaaccgcccauucucuguucuucuuagcuuccuggaaaccaccauucugguuuuuaucucuaugaauuugauuacucuaaguaucucauauaacuggaaucauauaguguuugucuuuuugugacuaguuuauuuuacuuaacauacccucaagguucauucauguuguaguauguauguaucaguauguucuuccuuuuuaaggcuaauauuccauuguauguguauaccacauuuugcuuauucauucauuccucagucuacauuuggguugcuuccacucuuggcuguuacaaauaaugcugccauaaacaugggugugcaaauauguucuugagaacccccuuuaaauuauuuugaauauauacccaaaguggaauuacuggaucauaugguaauucuauuuuuauuuuuuugagaaacuaccguacuguuuuccauaagcagcuagauuuuuaagaaguacauuuaaauucaucguuuugggccuuggucuccacgcugccuugaguugucccuagguaagugaaguucucagucagucaccugcucuggcauaccucugagcuuugacacaccucagccacuuuccauggcucacuuuggcccuuuguagguuggugccucucauuagauucaacgaacaauuucucaggaucugggccuaaccagugguguugaaucuuagaaagacugagcugaaaugcucaucagcuggugccaugcuucucacuuuagguuauaccuccaguuguguuuggauaagaguuggaguggcaugacagucucccacagaaucugaaaauauaguuccagaugugcuucucccaaacuucuucucugccauugggguugcaccacuggaaaagugugugaagcaauacuucacucugacacccugcuacuauaugcuugaggaagaacugaagacuguaucauggaaugagcugcccauaggucgcgcaugugcgcacguuuguacguguguguguugagaugggagagggaaucuagggauccuucuauacuccauugauuaugcuaacauggaucuuauuuaauauuacaaggacauuucuuugucaucgucuuuuuuuuuuuuugagacagagucuugcucugucacccaggcuggagugcaguggcgugaucauggcucacugcagccucgaccugcuaggcucaagugauccucccaccucagccucucaaguagggacuauaggcacacacaaccaugccuggcuaauuuuucuauuuuuuguagggacaagguuucaccauguugcccaggcuggacucaaacuacugagcucaagugauccaccugccuuggccccaucaaagugcuaagauuauagagacgugagccaccagccuaaaaagacauuucuaauuagaaaguguagugugaacuuuugccguaguuggacuucucuccaugugggcccuuaaacacugauaucucagucauaugaagcuaucaaggaccaaaauaagggggcauuugccuuuucugucagugcagaaccaauaggggccaggccagguaugaccaacccauuguaugugcaguggcuugcuccaucuuucugucucugguuuauguaugugaucauuugcggauuccagcagguacauccucuccaauaccuuaccugguaagcugucuaguaagguuuauauuucagaccauugggggaucccccucuucauggcacacacugugccuguugccuaauauuccuuuauugucugcagcauccaggaccaauuuaaaugucacuuugugaaacuuccucagacccuccucuagagcaaguuagucacugccucuucugugccuugcuuugagguuauugucaucacugaaccugacccaguguauuguaauuacuucagacggucucucccaccagaguuuauccuccucugugcaagugcuauuuuuuaguccuaucugucuaccuuagaaccuucugcaguauuugguguauuguucugucuguggcaauugucugguaaauguuuuaucagacaagucucugaugcaaugggauggaguggaauuaauaguuuuaaucaugaccauggcccgaaauagccguuugacaacauccaagccacucacucucucagacucucacgcuggguuguguaaauugaauucuuucaaaugagcauaaguuaaaaaauacuuagcacuuaccaugugcuagguacuuuguaauuaagcauuuuacuuacauaaacucauuuaauuuuacaauaaccuaguggaguacauuucaguuucauagauagugaaaaagacacacagaacggagguuaccugcucaguucaaacccuggaguguagccugugaguguauauuucuuuuugcaugugguuaauaaauuaauguuguauuuacagcuuugcagagcugggaugcccuuaacacaugcagcucuggaccuauauaagcugucagguguagaagagugagcaggaaaaccuuguggggguaacugauuccuuguacaaaagaaccagauuucaguuagugaugaaaauggaggaagugaagaauccaagucgaaugauagaaaagguuaugugucguugggcaaggguucaaaagaccuaguugucuugauuagagaggaggggagcugagggaaaaugagucacagaggaggaaauaaugaagaugaaguggccagagaagacgggcuccugcaaggaggggccuggguuuuagauagccuccaagaaggacaggaaguguggccugaugggauuagcuagucucaagacaccagguagaaugcaggccaucuuuguagacugggccuugggguguccaaaccaugaaaugcauggcagaguguggacacacuuguuuguuuauacucuuucucccauccuguacaaugaggcagaacaugaaggaaaaauuaacaaacaccccaagucuccugacacagggaucaaaacauauugaugaugucuugcaaaucugauaauuucauugaaccaugugaagcuuaaaauugauacauaggcauacccuuaacauuaagugcugcugucagucugacauagcuggauaaaccaauguugaauaaucuauuaaauaugucagacuugaacaaagaacguaaaucauauuauauuauuucagcuguaauuaggugggagauaaaaucacaaauagaugaguuuagugaauauuucuuaguguguacacagugucacuggaauuucuuuccuugcucuaugggaagaaagaaauugacugccuuccaaguauugacugcuguccaggaagugggagguugaagggugacuuauguaauguucacagaguggguuucauuuauaaauucaaugagauuagcuacaaucuuccugaaguuaauggugauggaaaugcaccauucugcauuuagcuggaaauagcuagcuauccaacuuggagacuuaauuguuccucagauuaugauauguuugcauuuauaucucccuccccuccuuuccugggagcuggcugcugccuuuauugucuagaaauuaauaaugcagaccagagcuugugggugaacagggcgauguauugccagucuuuugauguuccuguuucccaacccacggaguaaacuugauuauugagaauaaacaagggacauaaacuaagguggaaaagauaaagaaauugcauuaggaggguccagugaacugagcuguagcuaagaaauggagauaauucuagucauuacuucacgggguuguugugaagggugaaauauauguuaaaccuucagaacagugccugccauguagcaaguguuucaguauauaucagguugcuuucauuguuauaagaaaacuaauuggcauuugugguggauggucaggguggugugaaugugaaauucaagagcauaaacaugguuguuuccucccagaugguugguauagugaaacagacaguuaaggguaaggaaguguaggcccucauuggggcuacacaucacagcaugcuauuaauauaagcaguguauacuggucaucuuuuauugagaggcuauggcuuuuuugugugugugcuggugguuuuuaaaauauuaguuugauucauuucaggugauuuuguuaaucuagcaaaacaucuucuugcacuuuuuacauuauaaaugaggaccauagaacuuuguguggacauugcagucauucagcagacauuuagcaaaugcguauaaugugugugaauauuuuuuuguaugaaagguuuucgacaccugagacucacuacccucagcccugaguucacaugaugggucgguggauuuccagagaggcagguggaggcgccgcagugggagcauccuggcuaccugagauguguuuugaggugccagccucuuggcuccagcuggagccaauuggccuguugggcaugagcuacauggcauguagagugagcuacaugacauguagagugagcuacauggaguuagaggugguuauccuacuucuucuacaucacaacuuugcagagcgcuucauauaagacuuuuguaaauuucggagauagugugcuuuauauagcaaggauuuccagggaccuacuagaggacaacagaaggcugacauuucccccuccaggccaguagcuugucuuucauuacuuugcauaauaacuacuuccgcuugcuuuuuuuccccccucaccucagcugcacuuaggaggacuuaaugacaucauuuaacguuaaggauaaauauaaaaccgaucuguucaugaacaccaguaaauugcacuuaaaaaaaaaugguuucacauaaggcagaacagguugcuacuuaaaagaguuaauggccaguugguuuuagaguagaucacaaaaagaaaugugacuucacccgccaacuccuuaguuaaagaaacuguguguuugcaguguuggagaaccauggaggaggauucagaacuuuaggcaggaagaacugugaaugaguagcccuguuauuccccuggccacugugcacucauggcuucugcacauuacuguguaaacuccuuucucaccaccuaaaaccuaccaaagcacccagcgaucuuccuguaugugaacucacagguuuuucuuggauaauuugccuuuccauugaccuacuuucaagagcaauuuucccuauagcuuuagcagguaacuaaaaaggggaguggugagaaaguaaauuuggaguuccaaagggaaauuacuuggcuuugagcuacuuagucaaaaacauguauugcaugcagguaggucccaggcacaguguugaacacggggguacagaagugaauaaacauugcuucugcugucaaggaguucacagucuaguguggaagaucugugugcaaguagaugguuucagugcagcguggaaaccugcagcaguagaagugacaaaagguauguugguagcacggaagaugcagugcuaguuccguguggcaaagggugaaggugucuuagaggacuccuuggucaagaagaguuuggaggacaacagggaguuugccuaguagacaauaaggcagauuacuggggcagaggaacaguggucucuuggggagauuaggagcugggaaucaaauuucaagaucagguuuuuuuauuucgguucagucucauaccugcugccugucaugugaccuuuuuuuuuuuuuugagauagaguuuuuggucuuguugcacaggcuggagugcaauggcgcgaucucggcucacugcaaccuccaccuccuggguucaagcaauucuccugucucagccucccgaguagcugggauuacaggcaugcaccaccacgcccagguaauuuuuguguuuuuaguagagauggaguuucuccauguugaucaggcuggucucgaacucuugaccucaggugaucugccugccucgcccucccaaagugcugggaguauaggcaugagccaccccacccggcccgugaccugacuuuuuuuacugagaagaaacagaaauggggauccuuaugucuucauuccuuuuguuuggcauaggaagcuggacugcauccaaaauuguuaccuugugcaauuucuggauaacugaagcuuacacagccugaaguguacacaacugguuaaugacagauccgguucaacucagaaauucacauuuguccagauucauucaguugcccuauaaucuuaaguguuuuuucugauguuggauucauuccuucucuuacuuguucaauaaauguuugccaaguauguuauaaacaacugugcagucugauagagguauaagguccuuucugucagggaacuuaaagucuuuuuguuuguuuguuuuggagauagggucucgcuguauugcccagacuggagugcaguggcacgaacauugcaaccuucaucucucagacuuaagccauccucccacuucagccuccugagugacuuggacuacaggcacauaccaccaugcccagcuaauuuuuaagucuuuuuuggagauggggcuucccuguguugcccaggcuggucucaaacucuugguuucaagugauccucaugccuuggccucccaaagugcugagauuauaggcaugagucacuguaccuggcuggaauuuaaggucuuaaaguggaaauaacuuugaaaguauagacuuguaucagauuaugaggagccagacuaagaaguuaagacuuaaugauuuauaccucucagcccagagaggaugccagugaguuucugaauuuacagccuaaggcaaauucuuuuugauuucuguguuccuugacuuuauuuauuacuguaggauaaugccuuaguguauuugaauaaguuuaaaaaauuuaugccuaaagguagguuuaugagcuuugcauuguauaaaagaguacgguauguaagaaugaggacuccaagagccaaacagccagcuuuugaaucccagaccuacuauuuauuuauuugaauuuuuuggaagguuagugcgcagccgaccuaguauuuaugagcuaugugaccuugggaaguucauguaaaugcagugucucuugccuuacauggaaaauguccaugaaaaucauacccacgugaaaguuauuacaaggauuaagugaggcugggugcgguagcucacaccuauaaucccagcacugugggaggccaaggcaggcagaucacucaaggccguucauucaagaccagccuggccaacguggcgaaacacaauacauguaucugcaaagcucaauaaggcaaagcauaguaaaacagcuugccugugucucauacacggugcuacaaaaccuuuaaacuggaaaugccaagaggcacagaccaaaaaaaaaaaaaaaaaagcuuuaagaaaaaccuuuuuccccaagccuuuggcuuggggaaagggugggcuacaacagaaaggcuuuuugacaguauccucccuauugcugccaaacacccagggaaaaaccacaccccauaucaccaaccccugccagugcagcugggcugugcagaguugaucuuccacacugguccuuggaagcaggcggugcuucaguuccucugccagguggugucaggagaacggagaagggugcugaucuuucauuccccuugcugggcagaacuaguuaguacuccauggcagagccaggaguaucagcgggguccagccuuaugcugagcuuccgucucuaccguguagcaaaaaaauaaugugagucagcucuccucccugguggcaguggggcuaaggggaaucccgucgaacacccuaacuuggaggaaauaaaccagugccagucagugccucauauucaguggaaaguugucugcagggccaaguugggaggcgaacuucuaccucauugucugcagcaggcaaugugacccagugcccugcuuuuuccacucuagugaugauagcgcccuggaggaagcagaguccacacccaccaccccaugcuacaugucaacagggguacugccugcuaagcaaagauguccagggcugggagcaguggcucaagccuauaaucccagcacuuugggaggccaggcaggaggauugcuugaggccagaaguuugagaccagccugggcaacguagaccuccgucucuuaaaaaaaauuuagcuggcggugguaugugccuguagucccagcuacucaggaggcugagguaggaggaucgcuugaacccaggaaauuggggcugcuaugaaccaugauugugccacuguacuccagccugggcaacagagugagacugucucaaaaauaaaauaaguaaauaucuuuugauguccgggauacagucaaaaaucucaagaaccaggaagaucaccgcaugaaugcgaauagccaguaauggauacaagcacugagaugaaucggauguuggaauucugacaagaauuuuaaagcagacaucaugaaaaugcuucaauaagcaaguauuuauuuauuuuaaacaacaaaaauaggaaaucucagcaagaauuuaugggccuaccaugagggaaauuuuugaggugauagaaauauauaucuuggcauuguggcuuaugcauuugucagacucaacaaauaguguacuuagagcagguacuuuuaauuuucugaguaaaguauacuucaguaaaguugauuuacaaaucagggauuuucaucccugaagauucugguucaguaggucuaggauagaguccaauaauuuuuuuuuuaauuaaugccccaggugguucuugggaacuccugauaucuccagaggaaccuaggcuaguugagaauucuucagaauauuaaucuguuagcaaucuguguaaauagaaacuaggucugguaaauuaugaauuaaccagauaacuacuugcagaauaaacagaauacauaauuagaaaucauuaaguguguuaucaccacauggaaauaauuuuuuguauuuuuuuuauuggguaguguugugaagaauauuacaugguauccuuagaagcuguaaauugugaugcuggguuauaaaaaaacuguauugugguauguuuuugccucucucacuuaaccccacccuucacuccauuccuucucaggacacuuaucuucuugguggcuaauggcaggguggauuccacauuugggaacugcuguugccugggcagucaugguuuucaucagugugucccagggcguggugcuuucugucaacauccugcucuccauagaggcugagaaugaucccugaugcagucaucacggcuuuuaggccucucccauuggccucacuuuaaccugaugacuaucauauuuccaucuaggcugcauuuuuaaaucuugucaaggaagcccagggacucuccucacugauaagccauuuccaauccaggccugggguugagucaggucaccuuauguucuuacucuuucccuugacuuagauuggucuggcugguccacccagauaaaguguagcagugucugaagcuggaugugaggggucgggaaguuguugauggggaugccuucauuccgcagcacacauuucaaggcaagcagaucauuuuccuauagcaguacuggucagagcuggauucaggggaaggcugucuguguuucccacgugggccgggugagcugcuagcauuucugucagugcuagaaggaaagucauucuuucaauguggucccagauucaaaaucaguuuugagugggugucagaaugucauuccugauagcuucucuguuuugacagugcaaauaccccggucucauuucucugcuuuuaaauaauagauccuugagauuggcccuggguaggagaccucccccaccccacuucuuucucugaguucaccaugggauucuccuaaucuagccagagcuggauuugauccuugggucacuccuguggucucuagcccuccucagugcuuacuuaguuggucuuuguuucuauugguuguuuuugcaugugucgugguuaucgucaucauaugacuaaugucagggggucaggcacaguuauagcuucuaauuguguugcgcuuuuggcaagggaacuaugugugggggaaaaauacuuauuaggaaucgucagccugcauuaaagggucguaauacuugaacaauuugcacaugauaucuaucucuacauccuauauggacugugcuuucuaggagggauuaguuagguuuuuccuuuccuaguauagaaccaggacuaguaggggaaggcauagaggaaaauacuaugguucuguuucagagagagcauucuugcagggguuucccaaauguaaauuuuuuuguuuuuuagagauagugucucagucugauacucagguuagaguacagugguuugauuacagcucacugcaaccuugaacuccugggcuccggugagccccucgccucagcuucccaaguuagugagacuacaggugcacgccaccacacccagcuaauuaaauaaaaauauuuuguagaaauggggucuugcuauguuucccaggcuggucuugaacuccuggccucaaguaguccuucugccucagccucccaaagugcugggauuacaggcaugacccaccaugccuagucaaaaauguaaauauuaggucuuauguuacugaagguauuccaggaauguuuggaugugguacagaagauguggguauugggaaaccucuaagaauauuuccaaauuuuaucuucuguuguucuuuaaaaaaaauauaagcugugaauacaaccguggaaccacaaguaauauaagaggagcugauuucuuggugccugcacugcugacuaaagauccagucugguugcuuauucaguaaaccuuugaguuagugcagggagucacucucuguuuucucagggagcccuuauuugaguaacugucauuaccucuuucccuaacccacuaccuuuaauuguccuucugugguuagaaaaacuuaguguuugaaaggcauaguaucucaagggaacuuuagaaguauaucuuaccuuugcucuugggcauuuccagaugacccuggcaguguggccacaagcaaacuggagaaggcugccaguaugugcacguuuuaauaaauggaggauaucuagcaccuccuaacccuuaccuucuccuccaucucaucccauuuucugauugaacagucacguuauuucuagucuuaaauacuuagcuuuucuaguuguguuaauggaauuguuguauguauuucaguuguauuacuuaagugucuucuaaaagacauuuguauacuuuauaauucagagaaaauucuuugguugauugaagaucuugcuaccagguccugguggaagcagcuagaauuucuuaagcaguuccugugaauguuuccuuuuuauguagaucauuucuuggaaagcuguguuuuaaaauaaagcucuacaggcacuacuguuuuacucuaaggccuuugagcucugauaucuaagacauauuuauuucuucaacuaugcccaggacagugcuuugcauucaauaggugaccaguaaguguugaguuuuguugaauauaaaauuauuuacaaaugauuuuuuguuuuuucccuuuaaaaauuaggcuuccgagaaaacuuugggcuucagagucccugcuuccaagccccucuuuguaacacucuaugaaaugaaaagcaucuuuggaugguauggggagagcugaacaaugugaggugggagggcguuggccuuuaaucagguuucuggggacagaucacucaugcugguucaugcuggcccaaggcugucuucuuucuuguuuguggauguggguuauguuccuauacugagaugugcuggaugaaaagcuaauaaauauuaaugaagcaguuacuucugucaggcacaguauuggcuagagagauagguagaaauaaauagaaaauacaguucuugacuuugagaaccuuauuguguaauuggaaagguaaaauguaaaugccuuaaaaguuaauuaacaguaauucuuaaggauccuuagauugucuaauacagugguucucaaacauuagugucccucagaaucucauggagaguuauuaaaauacaaaucacagggccuuauccccauauauauauauauauauauuuuuuuuuuuuuuuacucauuuggucugugucaugagaauuugcauuucucaguuaccagauauugcugguccauagaccacacuuggagaacuacugguguggugcaguuauucucaaccuuggcuguauguuagaaucacccagggaguuuaaaaaaaaacccaugccaagaccccacccacuguagaccacuuaaaucagaaucucagugggguaggaccuaagcauuuuuuuaaagcuccccagauaguuguaaugugcaguaagguuugggacuuacugcucuaacgugucagggccacagaacuuuggauucagagauaugauguuaccaugggcugcagcaguguggacagaccagaggaguuagccugaucuuaaagaaugauaaauaaagaaaaaggaaugauuuuuguucuuguaaaguuaaugcugggaacaagccaguugguuuucuagcuguuucuugggacagacugaugaguuugugagcucuuaggagucagcaugauuucccauucagcgugagcuaaugagugggacugaggugugggucaccaccaucaauaauaagcauucacugaccacauucucuuuuuccugauauagaugagcuuguguuuauccuaacaagcuuagauguguguguguuugggguggggugugguuguggacugugcaauagugagaggcugaacuuugaaaaaugacuuugccauuuuuacauuucaucucuuuaagccucuguuuauucauguauaaaagaaaguacuacacauaguugugagccuuuuuuuuuuuaaaaaaaaaaaaaaaaaaaaaaaaagagucugggucuugcuauguugccaaggcuggucuugaacuucuugggcucaagugauccgucucugccucccaaagugcugggauuacaggugugagccaccgugccuguuuguuaguaugugugugaauacuacuacaauuuuaggaacacuguuuuauuuauuuagggacccccagaaucuaucagugagccugacacauagugucugugcagugaauccagauugguugaaugaauuggaaagguuaucuuuucacauugacugcccaggcauuagaaaggaugggaagagcuuguuuccugaucuuuacaaaaaaugcugccaccuuggguuuuccaacuuaggcaagaaaucuguuauguucaaaauaaaggaguauaacuuaaaaaauauauagauagaagccaggcgcaguggcucacaccuguaaucccagcacuuuggaaggccgaggaaggcagaucaugaggucaggaguucgagaccagccugaccaauguggugaaaccuugucucaacuaaaaauacaaaaauauagcugggcuugguggcacaugccuauaaucccagcuacucaggaggcugaggcaggagaaucacuugaacucgggaggcggagguugcagugagcccgagauugcuccacugcacuccagccugggugacagaacgagacuccaucucaaaaaaaaaaaaaaaaauuaaaaaaaaauauauauauggaaauacauuuucucaguguguauacuagucauagcuaccugugacuuauucuuuauuuuguguauuuuuuucagacaggguguugcucugucacccaggcuggaguacaguggugcaauuagagcucacugcagccuggaccuccugggcucaagcaguccuuucacuucagccucugcagcagcugagacuacagguguaugccaccaugcccaacuaaaauuuuccaucuuuucuagagaugggggucuuucuauguugaccaguguucuugaacuccuggccucaagugauccucccacuuuggccuccccaaauacugggauuacagaugugagccaccacagcuggccuuaccugugaucuaaagagguauuuucaauugauguuuggccauaucagauuuuaguugcuauuaaauuuuauucuuaauuuaucaaguuuaauugauuauuaaaaaauugcacucuaagaauaagccuguguuuuauuucuuggaacuacuagagccuucguuacaauacauuuuagagggcuccaaaguuauaaaauaaauacuggagauuuggugcuuguuaaaauuuugaccuuuucuauuaaagcccauuggagugauguacagagaaaaggcugucuuguguugugauagggccaugcuccauccacagguccugggaaggaugauguaacuguggucuaacagcauugucugaauuuuuggccuagggcaaagaggaggagggcggguaaagaaaccugaucagaccauuugaugcuaauuucacaggugacuggucacugugugccuggcuguuguuauuuauagagcuguaaguggcuggagcuacacacaggaaccugaaaggauggucuguauuagaguguggugguagauagaagcacagcaguagaaucuagggacaaauggucacuggugagugucauugcuggaguuaaaugagacucauuaguggcuguuaugauuuccacucuuacuucauugcuauuccugagucuuuuugaaagcaaacaacaaaauagaccgaaacaaccucugauagacucuccguuauuuuuaauugagguugauaggauuuuaaucaggucaacuugcauacugauuucaaccaccauuuaaagagcuauccacaaagcuauaaauuagaauuauaguucaaaaggucugacuguuuuaaccuacugcuccuauuccccaaauuauugauggggaaacugagaucuagcaggguuaaaaaaccagcccaguuucacaguuagcagugaugcuggagcugugaucuggaucuuaaaucucucaguuuagccuuuucuguuuucuaccguauuaguccuacaaugaaaaugcacuucucugucuuuaaauuucagacguugucuccauggccuagaugaagguuauccuuuguuaugauauuuucucagaauuacuuugaaaaaugguuccauuguuauuucuuaaaaugaaaguaauaugaaaacaaauuccuucuauugauaauacauuugcccacuacugauaguuuuaggaauaaugagaaaagagggggccaauuuaugguauuggccaagaaggagcgcucagcagcacuggacugcuaugugugggcuggagguaccagcagauaacacucggaggcaguggguccugugaaucacagcuuggccucggcauaagcucuggagaccagcucuccuaaggagaacugccuucuuuggcccugcccucagcagccuguuggcagaggacuagaauaauuguuuguuuaaaaguuuuacuagcuaauuauacugcaccgaauugacaggcaucucuauuagagucuuuccagucucuugaaggcucuucuccacauuacuuguaaucuugccucaguguagacugcaguggcugauuuuuguuuguuuguucuucucuccuuucccuucccacuuguugcaaaggccacacaccaagucuggagagagagcugccugugggcugggaauuggcugccuucaucuggucagccauauguggcuacuggaaaaagugccuuugggucauucauucucaggucaccaggcccuagaguaaagcccuaaacaugggcucucuagcagaaagacuuauuaauuccccuucucuuaaguggaggcaaggagguguuucugaaccuucagaauaacccgagggaacuugaaaguacagauucccggaugcuaucuccuggauguggguucagguucaguaggucugaaaugggaccagguuuuagaaucuucuucgcggcccggcucacaccuguaauugcagcaguuugggaggcugaggugggcagauagcuugaguucaggaguuugauaccagccugggcagcauagugagaccuugucucuacuaaaaagagagaucagcugggcgugguggugugugccuguugucccagcuacuugggaggcugagguggcaggaucacuugagccugggagaucgaggcuggagugagcugugaugguauuacugcagguggggugacagagugagaccccaucucucucucuuguuuuuuuuuuuuuuguuucuuuuuaaaagaaccuucauuacauuaauugacuuccaaggucucauccagucaugaugguuuuugcauggucccuaccaguagaagauggauuucagaccacagggaauuuauuuguagcuacagucaauuuucaaauuauuugccuuacaaauguuuucaaucccagagaccuuuuucccagcugguuccuggguuauauugccaaagucccugguugguaugcacucgagaacugaaagauaauuuucuucuugauuuuaagaaaagauaauuaaggagggaaaucuaccauuaaaaaaaaaaucagacauuacaaccaaguauaacuuuuagagcagauccucuauugggaaggagcaauauguuauguuaccuuguauuugagcaguuaauuagggucagauguaguuaguucucaugcuuuggccuugcaaaaguaauccccuuuuuggaaaggcuuuguugagucccuaggaauuauuuuaauggucucuaaguauguuuaacucagucauaauauucuaguuguuuggauuuguuguguauugacauugacuuagauauucuccccugcucugggcuuuaccucuuacucguacccaaauccaugguccacaugcugugguguccccugggcaugcccagccuugccaugugugcaagguaaucccuuugacccucucaagagggugcugcucaucuuuuuuuuuuuuuuuuuuuuuuuuggcuucacuuaucccacuugacauugccaaacgugcuuugacuugaagcaccgcugcuccuguggcugucuccuuugcuucuccucuucggcucauugagaaucuguuugagauacuugucauccuuuggagauuagaacucacuuuagagggaggaaugauuuuacacugggacuguuaggaucaguuuaggaggaaacaggcccacgaugauuuuaggagggguuucuacugugguccuuguaaccacauaguuuguacugagcuggacacuggccauuugaguagaugcuuguucuccaguuauagaaugguucccagcuggcagauuucccacugggauucaguuuccuuggccgcugcuguuuguugugcucacacugauuuuugcggcaucuuuccaggcccuugagucuuuuccaagcagaagaaauagcagaaugccuugcccuccccuucucuucuccuuuuggguauuccauggcuauuagggaaggacuuccugugaaauaaaaugagggcaaaggaaaguagcaugccuguggcauaaaaaugcuguuagcaagcuugaggcauaucagagagauugguccuaagaguaacauuuacugccuuucugcuuuugaacuuuucuuucccccuuccuuugccuguuucugaggucugggauuuauccagaauuuaagaacggacuguuuuugaucauuugaauagguaucaucauucagcagggaauacaugugcagacugagaugucucuuaaagccaauuuauaguauaagucauuugaaaugauuucuugagucaguaaugcauuucugcuucaaauucucugccuggauuugugcauucaucucccauuuuaccaggugauuugcuuuauuaugcugcuaugacagccccccuccccaaccuucaacugcuauccccagauacgugggcaugcuuuucagggugaguagccauuaaacuacccaaaaugacaccgaacguugucuacacaggcuuggaaacauggagggccuggauuccaguaaaauucuccaggcugcuucgucaggcuauugcagaaaagauuacaggguccuuuaagauuaguuuuggagagaucuaggcagauggaugggugaagucccaaugggaagucaguacccaguugccacuuggaauaaucuaaaauccuggcaugaucuuuccucucauaacuugaaguacucagcuagaggagagccucuccuucgcaagacccagcuaucucuuugagaagaaaaggggguuuggauggaguccaaccuucugguuuguuuugcccgucugccauuugccuuuuccuuguugguguuugcugcuguuuguucuuuggagucugaggggcuucugaccuuggcugaagggcuucuaacccuggacaggucccgaaggaguggcaucagauaguuguguuuuaauuucacaaaucuguuauuucuuuaagaggaaaugagcaacugguagacccagaacaguaccaaggggagcuggggaguuguuauuuguaaguguagagaaagaaaggaacaguuacagggagguuuggugcaugauacacagcugaugccuucagagaauaggagguuuucuuucugugcuuuuucucauaacauuggaggaagaagaaagaggaggcauguggcuuguuggugguugaacuccagugcagaaguuaacauuccacucauuuagcucacuaauuuauuaauuaauuucacaaauaccuauugugcuacuaugugccaggcacccuucuagguacuggguuuacagugguaaacaaaaaaagguccuugcugucgugaaccuuauacucuagccaagggggugguggugaugaggacauauuuauaauggugguggugauagugauaaauacuaugaaaggaaaaaaaaacaagaaagggaagagaaugggauagggagcuauuuuaguaaguguguucauggaaggccuuauaaaugacuauacaauacauaaauaaucauuaaaaugagauuuuauuaccuaaaauauuuugaacacuucaguuguucaaauuauuauggaaugcuagcaugcauagggacugaaaauauuuuuuucucugaaguuuugaggguuuuccaaggauuuagcuucucuuuguuucucuggauauucagacucacauagcuagauuagaguucaccaucacaguugcuuucagcauugauugagacagucuuauguuguaagggucugcuuuuuacaaaauugcuauaaaauuguucugugugauugagaggcucccucucacucaaaguagauguuuggcuguuuuuguuguucuguuuuaaacaguaaugaguaccuuuugguaauuaaaguccccuucacaaaacuguagugagugaugaauaagacauaaacaaagaaucccuucugcggagcagagugccaauggccauagacauaacucaggggcuguuugaccacauaacucagugcaguggcuuuucaccauuggaaggguggaauggucugguaugguuuucuggauugcucugauaaacaggaguuauauuugcugucaguuucuaugaaaggacagcauuauaugagccaugguuugucaggggccuacugugugcugggcucuuugcuauaggaucaaaugcuaacuacaucuauuccacaagacacccuaucacagugauugguuuuuuuguuguuguuuguuuuugagaugaaauuuuacucuuguugcccaggcuggagugcaauggcgcaaucucggcuuacugcaacccuugucucccagguucaaacgauucuccugcuucagccucccaaguagcugggauuacaggugcccgccaccacgcccagcuaauuuuuuuuauuuuuaguagaaacgggguuucaucauguuggccaggcuggucucaaacuccugaccucagggugagaggugaagccagcuggacuuccuggguugaguggggacuugcaaaacuuuucugucuagcuagaggauugcaaaugcaccaaucagugcucugugucuggcuaaaggauuguaaaugcaccaaucagcacucuguagaaaugcagcaaucagcacucugugucuagcuaaaggauuguaaaugcaccaaucagcacucuguuaaaaugcaccaaucagcgcucugcgucuagcuaaaggauuguaaaugcaccagucagcacucuguaaaaacgcaccagucagcgcucugugucuagcuaaaggauuguaaacgcaccagucagcacucuguaaaauggaccaauagcacuguguaaaauggaccaaucaguaggacauugguggggaaaaauaagggaauaaaagcuggccaccccagccagcaguggcaacccgcuuggguccucuuccaugcuguggaagcuuuguucuuucacucuaaaucuugcugcuacucacucuuuggguccgugccaccuuuaagagcuguaacacucaccacgaaggucuguggcuucauucuugaagucagcgagaucaagaacccaccagaaggaacuaacucugaacacaaggugauccacccgccucggccucccaaagugcugggauuacaggccugagccaccgugccugaccugucacaaugauuuuuuaaacugcauaucuuaauccauuagugggugacagucagaauuuuauuuuauucaguuuaaaaaauagaaucaaauagaugacaucagaguauacuacacuuaguguguguauuguuucaaaaaaacuuguuuuaaguguaugugcaugcaggcagacaucagaaauuuuuaugugucaugcucuaaaaaguuugaaaacaagccuaucaguugagguuugguaucauuuauaggcaaguaaacugaaacucugagguuaaggacguugccuacuaucagaacuaaaauuugaacucagcucuuucuggcuuucagcauuugauccaauuauguuucucacagagcuuucccucucuaaugguuuuccaagacucuugagaucacagagacacugauuugcuccugacguuguucuaaaaucagaggaggaacaugcacucugaugaccagacccaaguuugacugguuucucaaaacaucuuuacauaacauagucuauuucaggagaagggaaaagaaagaugacucuagaacuugucuuuauuaagaaacaaggaaaaucuagacacucuuuuucugucauagaaagauagccuaguuuuaccagagaggagaaauucuaaccagaaguaguaucaggaucuuucucucuaaagcacuuaaagucuuuuguuggcgagacgaguagagcaagaggaaucugccaccuuguguaaaacauuuugguuuuacuagucaggcauauuuuugaauaaccuucacuagcauuuauuauaguaguuauuuuauuuuauuuugacacagagucucacucuguugccuaggcuggagugcaguggcaugaucucugcucacugcaaccuccaccuccuggguucaagugauucuccugccucagcuguaaucccaagaagcugggauuacaggcgugccaccauacccagcuaauuuuugaagccucuauuuuaguuucccccaacuuuacuagagaugggguuucaccauguuggccagggcuggucucgaacuccugacuucaggugauccgcccaccuuggccucccaaagugcugggcuuacaggcguugagccacugcgccuagcuguuacaacauuuuggcaccaguuuuaccuacuuccccagccuccuaggaaugaaguggaacuuuuauuaaggacagauuuuucagaggggcauuauucucacuggcauuccuucccucuugccuggaaucacccuugaaugaauuccugauugguucagcuagacuuuuucuuuuacagaagaaauugcucuuggugaagaugccagaaaaauaucguaaaaaccugcucucuuauccucuucucuguacuacuuuguuaccccaccccaccccaccucaagcccccaguaaaaaaugaccuuuuggcccagggcccuaucugaguauauuguguggcagaguugucucuggcugacucccaggauuguuaaugacuuccuucucugucccuaaauaauugcuugaaaagacagcuguggagagacauugcccccagcuugcaggcucauuaauucagcccuaugaaagagggugcaaaggaagaagguggaaguuacuuugccaagaguagcaggcuugggggaaacuaaaauagaggcuucaggggaagggcagcagcauggugucagagauuacacuuggaguuugugaagucugggcaggcuucaaucuaaagaaacuuuaugcacaaaagcccaaauccagggaaauaaaugaaagugauuauucacuuuucuaaaguccuuacaguagcguuccucugguauuguuugaauacaguuuaaccugaagggcacuugguuuuugugcagcucuucaagaacagaagcaucuaaguaaguagaaagucugagaaauuaacagagaagauucccuaaaagucagccuucauuacuugaccauuauucauaauucugcauuugucuauuccuccaguggccuugaagcaaaauuaaaaaaaaaaaaagacacuucuaugccccuuaaaaaaagaauaaucaaaacuugcauagacagaauaagaaucaaauacacuggggaacaaauacucugauuagcuguccgguucagcucugacgcgucuagcacucugaguuauaagggaaacgauaggacacuugguuuuuguuuuccaacaacaggaaacauaucagguuucuaagaagauguaaagucuuucuuaaaacccaauuauagaaggaauuuaugcaagucuuuaggcaaggaguauuaaagaaauuaauguuuaaugccaucaacaaguuuucaagcagaugcagaacuccuagugugggugacuuuuugguguuuaccuuauaucaagaaugcagcauuuaaggccacuuugacagagugcagcuaagcuuuuuggguuugcuuguguggacaauuuccauucagcaauggcucucaaacuucaaugcacaucagaauuacgugggggcacuuaaaaaaaauguaugcccaggcugcauccagaccaauucagucagaaucucugauggugagccccaaguaucaauauuuuguaaaacugauuccaaagguuagcuaagugugaaucagugcguuagaugaucuuuaacguuaauuaucuuagcuggauuucucaaagggguaguccuagaaugcugauauucccuguuauuaauuuaaguaagucccuguuguuucuguuaacauucucuuagaacucugagacuuguauuucugcugggacccagggcuacugcaccuuucuuggccuauaggaguguugucagaaccaaaguacuuguuaagcagcagcuuaggaucaacauuagcagaccucauuguggcuguuggagaauauagaacaucagaugaaguaggggcuugacguuuccacagcccuaaaucacauauuucagaguacguuaagauuccuuuuggaacucagaucuuuuucuggccauggauagacuguugucuuggggggaugccaguugucucuccagugagaaaaggagauguuuauguauucucuaguucccuucuggaaguuaaaaauaccugucauuguuagauuugguuucugaacucucugccccuaacaaagcugaaaugaugacagugagugaaguauuugcuuaaauaaauaucuuuuuuuucaacuuugaagaacuaaauauaucucaacguguugaaacaucagagaauuggcugggcccaguggaucacaccuguaaucccagcacuuugggagucugagcugggaagauugcuugagcucaggaguuuaagacuagccugggcaaaauagugagaccucgucucuacuaaaaauaaaaaauaaaaaaaaaaauggcugaaugugguggcacgugccuguaguuucagcuauuugggaggcugaggugggaggaucacuugagcccuggaggucaaugcugcagucagcuuugauuguaccacugcacuccagccuaggugacagagucagacucugucucaaaaaagaaacaucagagaaucauugauuuuauguaaucuagauuuuaucccauuccaaauugugcuucugugaauacacauuauggaggauaacggaaaggguguuuagggaaggggaugacaaugggaggagagggagaaaaggguggugggagagguaauauaaaugauaauuaccaugacuugaaucuugguaaaaucguauaauaggaaccaugugguacugguguucugauuaaaaaccacuuccuggcuuugugaccuugaguaagcuauaacucuauuuuucaguuuucucaccugaaaaauuauaaugauaccugccuguuaggauuguuuugaagauugagauuguucguaaaauacuuagaaaagugccuuggcacauagcaaguacuauuuaaguguuuaucagagcauagucucaacuugucccauuaagaauauuauaaaacuguaagguccagaugaugcuuuauucuguaaaggccauuaauggagaugcuugaacaucucuaaauuaccuuucccuuugcuugcucaggaaguuugcuaaucuaaauucuucaugcugugcugcugagugucaugugugauugcuugugcaaggagacccaacuggguucuauccgcacuuaacugaaacucaaguuauucccucucuagccuuaauuccugucuucuaacucuccaaucgauuucuuggcuccacuaauugaaaccuaccccaguuuucucaugcuguugagcagggaucuucuugagacugauuaugaugggagaaugaccucauaguuucugaugccaucuuccaauuuauguaacucagccccaagcaugcuuuuuaaaaauaauggcccuaaauugcugacaucuugucaucugcucagacuccuaaaucuuuuuguguucccucgacugaaugggauucacuggagcaagaugccuuugugcagucugcauuuagugcacuuggcgagugaccuccaauagagcuguguguucccuucgagcaacauggguaaugauuacagcgacaaugcugcuauuguguccagagguuuggggcuguaauuucauaaugaaauugaaaaacaugagauuaaaaaccugaauauagcacaguaauuauauuuaaguaucacaaaucaucucccuguauuuaguuagguguuugagauuuggccucuuuguggagugcagucacgucguuucauacaucugcaaaauggaaggcuucuaauuuauggcuaaaaugugggaauugcuuucucuuaaugggaaggugaggagaaugguauugaauuugaaggagcugguuugcuucauugacuagagucaagaagggagguuguacaauagcugcuuaagguaaagaaauguuugggucuuuucaugguuuaauucccagauacuuacacaugacuauagucucucccuuuagaaauuaacugacauaggcuggccugggaaauucuacaguccugcagcaaauggugcaguugcagaagugugaaucuuuaccuaaggcaggguuucugguauagauaaagacuuaacugggguuuguuucccacagguaaguuauggaugagcugugccuggcccauuuccauuuacugucugagaaucugcauguggccugcaggcucuguaguugggcugaguccuccuggaguaggaggcuggggaagguguuggugguggcugucgauaggcauuccugcaggaugguggguggagaguuagggugagggguguucuuuaauaaaggaauagaaauuagaguggaaagugguuuaaagcuagugauaccuccuucuccuugauuucuaggaacuaucaaguaugaaaugaacauagaaggaaguuaugaaaggaaucauuauuauugucagugauucuugauuaucuacuauaggcaaacacguuaaguuguuguuuuuuuuuuguuuuguuuuuuuuuaagacggagucucgcucugucgcccaggcuggagcgcaguggcgcaaucucugcucacugcaagcuccgccucccggguucaugccauucuccugccucagccucccgaguagcugggacuacaggcgcccaccaucacgcccaacuaauuuuuuguauuuuuaguagagacgggguuucaccauguuagccaggauggucucgaucuccugaccucgugauccacccgccucagcuucccaaagugcugggauuacaggugugagccaccaugccuggccaacacuuucaguuuugguuaccaucuuuaaacuucacaguagacauugauacagagguauacuuucucugugcacauauacugccucucaccccaaauaauuuuugauacagcagugcagagugucccuuuuuuuccaaagcuuuccucccagauucuuagugaaucuacgagacugaguaucugaauugccuaaggccuuuuaucacaaaggccuuaggcaaauguaugcaaguguacauacauuaccaggcuucaucaacaugcccuacucagagacauuucgguucauuagguaggggugggagagguuguggccuaggaaucugcauuucaacaagcaccaggaauuuuuauauacaauaaauucugagaaucauugccuuaggaccuucuuucucaggggccgggcuauuccaguggguguguuauguugagauuugcuuuguggagaugugaacuugcuguucagucccuuuuccuagccccuggcuucaguauaucuuucacaaaaauaccuacuuuuauucuguuuccacuggauacaaggagggcugggcuuuuugcugcuuuacccacuauuacagauagcagguugggagacaguuugaguccuguguuugcacuccaggccuacuagggaagagguggccugccuccagcaguaaacugguaacuaucuaagaccuauggugcucucuguuuccacuggaaacucauugaaaaugcuaccacuauucauguuuuugaccucucagagcaaaguauauaaaagcagcaguucaaguaaauucgucaaacauuuauugagugguggcugaggcuaaaguauuauuuuaaggggccugggacagauaaguaaaacacaguuuccauucuccaucuauccugucuuucuuucuaaugauguagacaguccugacacagaacuauggcagacuuaguguaaccugugacaugaucgugucuuugaacaagugaaauuaaagugcuauaggaaugucugggugggaacaguuaguuuagguuaggcaaaaggcuucuuaggggaaguggcuuugggcaggguguagggcagaggcucucaccuuggcugugcuuuacaaucaccugagagaauuuugaaaaaccccaauauuuagaccaaacccuauaacaaucagaucagaacuucuggaauuuggacagagacagcauuuuuuaaauguuuaaacauuuaaaaacauuaaauuuuuuaaauguuuaaacauuuuuaaagcuuccuacaugauuuuaaugugcagccaagacugagagccacugacaaagaaggauaaauaggcugucauucagaugggggauagucagagaaggaaagguauuccaagcuugagagaauaacauaagcaaagcugcagaggcagcagagugauggcuuaaguuggagaaugccacucaaagcgggggugauuggagcauggggcuccuggcaugagcguggagggaaaauuaugcugauuagguaggauuggauuaaaauacugcaucaaggaauugggagacaugauuuugcacugccuuuggaaccccuuuucaccucauauuaggauggagaauugagguucggagaacuucuugcuugcccaaaguacuaguaagccagcaggcaugcuugguucccuuugcaaggcucuuugccauagaccugcugucucaagcugugcaguacuuaagacuucucuuuuggcaucuguccuauagcacuuuucuuucaucagagcacccuaaagguaauuuagggucagaaugguaggaagguauugguguuaggcaagaauauggcacgauuucuuaucuuuuugcugggccccugugggaaugauaugggagaauugcugggaauacugggggcagauguuugcaaguaaaaguguauauguuucuguguucuugcagcugcauucguuuugugccugauuccacuaaggacuguacuuuaucugcuuauugcuguuucuaggaaguuaauuugcaggugcuauaaguaugcaugcuucauauacuucauuuauucuuucuuccuugaagccucuccucuuuauuaggcacuauucauuugucuacuugguaccuguauuuuuuuaaugucacuauuuugacaguaccaauaaagguaaagccacucaauuacgcagggcucucucuuuaugcuuuggguaggugcaccugugcaacugaggggacggucaguguuaucaagguuaccuguuauuacaaguagaagaacccacagagaucaggagagagcucauuuuccuccauuaguaggagguaggacuauacauucacaaacacgaaccuuaaaauagcucacaaaauagugucauacauguacccagccaucuuuccacucauuccuucucaaaaggaauguaguaccauauaguaguuaagaauauagacacuggagccgaucuucuugaguuccaauaguggcucuucuacuuuuuaaaucucauuuuccuucaucuuuaaauugaagauaguaacaaucucaugggguugugauaacuaaggggguaaugcauguaaagugcuuagaaaaugccuggacauaggaagcucuaaguuugcugcuacuacuguuauuaugguuacuauuauuaaucauugcaaggaaaauguaucaacagaugaauuugguucaauacugccuucuaguuuugugaccuuagaauuuauaggaacaaaaaagauuugaaagggagguugggcuggaucauagagagccuugauuccauguuuuaggauguauacacagugagaaguccuucagguuuuggucuugguaagaguugugaaucagaaaguuaacucuuguagccaggcggaguggcucauaccuauaauccaaacacuuugggacaucgaggcaggaggaucacuugaggccaggaguuugagaccagccugggcaauguagugagaccccuguuucugccaaaaaauuacucuugcaacuucaugaaaaauaaaugauuagcagaauuagagcaguuaggaggccaucuuaauaguccaaggcacaauaaggcaaggaaaugaaugagagcaguggcagcagacaugaagaugagcaguuggaugcgaaagguuuguucuauagauagauuccucuuggcuuaagaaggggaaauaggaaauuaauuaguaaucagaaauauuugcauauuagucuucuccaucuucauccuugaugagaggagagcuuguuauguauguaccauugcuggguacaggaggcagaagagcuagcgccagaacaaggagcucagcuuuuucuggucucugcuuuuacguggcucguuauaaaccaggacccaauuaguucuuuaggcaugccugccuguucucuuuccauguaauuacuuuguggagcuuggguucaugcacauaguuaccucgauuaaaaaauaaguuuuuggagcuauaaauuuucaaacacugcuuugagagggucugucaggcauuaacauucaagguuucuguggugggcugacgauagccucuagccucuggauguuuuucacauuccaggaaaugacaccugaaguuuucaguuccuuuucgcaucuucagcaauccauagacaguggggugaaaagauguaaccuaauugaagacggauggaguggaguagaaguugaaaauagggaagaggcugggugugguaacucacuccuguaaucccaacacuuugggaggccgaagugggagaaucacuugaggccagaaguuugagaccagccugagcaauacagugagacuucguucucuaccaaacaaacaaacaaaagcuaguugugcauggugguacccaccuguagucccagcuacuuggaaggcugaggugggaggcucauuugagcucaggaguucgaggcugcagugagccaugauugugccacuucacuccagccuaggcgacagagugagacucuguuuccaaaaaaaaaaaaaaagaaaagaaaauagggaagagacugcaugaguccugccaugcagucuuucccagaauuggacauuuuugugguguggucuggaagaaggaaaacauuuauggucauaccucuccaaauugaacaauugugggaauauguacagacagauuugcaggguagcugaaaagaaaugcaguucuguuauuuuuuuguuauagagugguaacuugagugaggauuaugaaacauugccuagcagaacuguuuuuuuaauugaccuucauguauaauuaagaauaucaauuauuaauguuaaauauauuggaauuuuaaaaauugugauuauuucuuuguaaucugauuugugcuauuugcccugauuaucagaguguuguuugagauuaaaguggucuagcuuggguucaguuugcaccaggaguuuugaauuaacuaggcuccaucugaauguggaagauuuucgucgugaggaugcaauggaaucguaaguguaaagggccuaguauaguggguaguaauuuauuuuacuccuuuuuuuccacuuuaaaugaagaguggcuaaacuucaacuuuugggacauuggucucuaccugcaccuccagaauguaaccucuuggggaagauauuuggagaccuggggacuuuugcagguggguaguauuacgcagagcccagauaccccugccuucuugucuggaaaucagugauucucaaacugcuuugugcuugaguauuaccuggggggacauguuccguuuucagcuccccaagccauagaguuaagauucaauagacuugaggagcugcucucaguccaggauuaugugcagaucccgaaucugaucuugggcugcugugcuuuuccagugcccacucaguauuucuggggcugcaaggaaggcagugguuccccuucacagguacgugaagcucuuaacuccauuuuuguccuuuuaaauucacauuaaagagaguuuuagauaugcaggaaaaugagaagggaaauugaccuugccugucucugggucuugugaauagaaaggaagagccugcgcuuggaggccacugggaauuugugguguuccagaagaccucugcucucaugugggcucuuggcagccucacugagagccacaaugggcuuccuuauuuaagaugcucuuaaauuuucuuuucuaacacuauaagguuaugucuucaccaguuucucagauuuuaaaaaaagaaacagggagguaaaacaaaucccaaaacauuuuuuuuccuucuuguaaagguuacaaacauaaaucauauuugagaacaaugaauggaccuuauuuuuuaucuucagaaugcugggccucuggcaucuuagaaagucucuuuacuuucgaaaggaaggagacuuguauagugagagcaucacacucuggggaucagguaacuuggcuaugcuacugggcaccugggacuucuuggucagaacaagucuccacugugagcuuuuuuuuuuaauccaugaaauguggggguccugaagcuaucaaagcguuaauguuuuaugauucuagugaugggcuucugucugcgugacaggcauuuuccagacuuuguugaucuauuucgagcuugugaggaauagcauguaccacccuucauuaccucacucaugguuccucuucaucagugcuuuauaaacuguaguguguuugugcugggaggaacguaagagaacauguggaucaccccuuuacucauuuuacacaugagaaagaugauaccccaagugauuuucucuaagguugggacaugacuggggcucuccuugcgauuugccuuucccuucagugcguucgguaaacguugcauuacccccucuucaggguauuauucuuucaguuccauaugccuuuccuuuccccugggaugcuggaguauucaguuuuauuucuaggcaaaaguacuccuaacuguggccccuaauuuuuuuuuguuauguaucuuuucuagaaagagaauuugauuaugcauuguccauauguuuacauacuguacucauaaaugaaguuauaaaauauauguaaguuaaaaauguggagaaaagggaagucuugugcaccauuaguggggauauaaauuauuauugguauuacggaaauuaguacggaaguugcccgaacaauuaaaaauagcuggguguggugacucacuccuguaauccuugcacuuuggaaggccaaggugggaggacugcuuguggccagaaguuugagaucagccuggacaacauagugggauccuaucucuacaaaaaauuaaaauuuuagcugggugugauggugcacgccuguagucccagcuacuugggaggcugaggugguuggacugcuugagcucaggaguucgaggcugcagugagcuuuaauggcaccacugcauuccagccugggcaacagagcgaaaccuagucuaaaaaaaaaaaaguguguauauaaguacacacauacacaccccucaauaaggcuagagagaaaaaaauuauauguaaguaugguauuuuuuuuuuccucaaucacaguggaucaguuuaugccuucccuggauccagggugaacuuguuuugaggaccacugauccagaaagugguggaguuaagucuguaccaccagcuuuagaaucuccuguggcacuuauuaaaaauacgaauuuugguaucucaacccagauucacugaaugagaaugccuccugguggaaccugggagucuacguugucuucauuuuuauguuuuuaccaauagacauggggucuguugcccaggcugguuuugaacuccucagcucagaguccucccaccucuaccuucugaguaucugggaccacagucacaaugcccagcaaagucuccauuuuaaaccagaggcaagucuccaggugccucugagguccagcgaguuuggggaaccgguauuuuagacaggcagggaagugucauucauggguucaugagcaugggacuucuuacacugacaucucagaaauugcucagcuguuacuguuaaaucuacagugauacaguuagcacucuggaaaaucagaugggcaguuuucauuugaguuacauaugagggacuauaaccugcauaaucauacauggaauuucuuaaaacuccuuggcauucucuaugugguuuuuugauuuguaaauccaaauauuugcuauugugccucagucuuuuuuuccucauuagaaaucuaagcucuccccgcccccuccuggugcuguuccuugaggggcuguguuuuuauuucugagcuuuucccauuuguguguguuccuuuugucuggaguaugcccaacccccucaccuuuuuaccugggcaguuccuacuaucuaaaaaauucccuauaaaugacauuauuuuucauucuuaaaaucuaaagauaaugaagaacuagcugauaaucagcauuuaccaaaauagauuuaaggguuauuauuuguaauaacucaugugucaguaaccuuauguauguaaggauagaucaguaucuugguuauuaagcauauacucucugaaacauucgaaucaaaccaguguaagucagauaaauauguaacaggaaauuuguuucugacuauucacuccaggucaauguauucccagcugccuuguggguaucaggguuaucuguuccaggaucagcuuuaggaaagccccuacucaaaucuccauguagcaagagugcaggcuaguugagaacaugugauaauuaagguuaaacaaaaaaaucaaggcagaaugacuagaaauuaggacagcagggaaagcaggggaagcgguugagcugguagaaauggguaauaccuaugauuauuucugggaucaacagauacaucccuguuguagaaguccaaagcaguccuucuuuuuggugucuuuuccugccuuugguaugauaagccccccuaacaucuggcacacuauuggggugacauugugaaguuaccucugcccacaguacuuacuccaguuugauauuuuuaagaaaugcucacuuuccacuagccauaguuuauuggcuuucagaaagugucuggcagugaguaugccaaaggucaagaauucuggcagaguuugauuuaucucugcucccuugauagcagcuagccuuggaggcauagaagcucuugacaaguacuaugagucagaaggccacaugugacuaggucccugcccaccucuccagggucaaauagaucuugccuuuuuccccagccccucccugcacuguuccugaagagggcuguguuuuucuuuccaagcccucccauuuauuuacauuccuucuaucuggaguacuucuuacccccucaccuuuuuaccuggcuaauucuuauauaucuuuuagauaauucuacauaaauaacacuucuuucaccuuuccuaaacuagaauagguauuccugcuguaugcuucuaugguccccucauuuccccuagaauaacuuacuacaguuuuucguucauacuuacuguuaucccccuggacugucuguucugcuaggauaaggauucuugcucaccauuuccucauugcuaggcauaagguaugggacauagcagguuaucaauaaacauuuuuugacugaauaaaagcauaauaaaacaauauguuaauuaauggggugacuggcagggaucuaguugccaauuucagcauugguaauuaacauggcuagauuuagcugcuagguucuaugagaaagaaugauuaaaaauaaacagaaaggagauggaaguugauacgauuaaaaacauuuuaugugccugcugauggaccuaaaacugggcaaaccuuucugcaaauaaagcucuaccuugauggucuuauugauauaccauauauacauauauauguauguauauaaauaagauauaccuauauauaaaauauuuauaccuauauaugguauauaaaugaauauaaauauaagauauauagguauauauaugugguguauauauacauaaauauguuuguguauguauaauaaaagacauuacucuccauugaaguguuuacuacauuauguacuaucuuaaaacaaaacuucccacaggugucaguacaaacaugcauuuguucauuuauucauucauucaacaguuuuguugauuguuugauauaugucaggcacuuuucuaggugcucaagacacaacagugaacaaaacagacaacaaucucucugacucaauggaacaugcauuuuaguggaagggaaugucaauaaagaaacgucuaauaucuagaguauuagaaacugguaagugcuaggaaggaggaaagggggccaggaaaugaugugaugugugcuguuguggugguggggcaugcaauuuuagauucaguggccaggaaaggagucacugagaaggcaacucuugaguaauuaccuaaaagggggugaggaaguaagccagguggguauuugggagaagugagguaggacagugugcauagcucuuuggaaugugcuccucaucccucauguuuauuacguuggccagaccagcagguugggcuuucaguggccuguuugaucagaaucugcaaauguuuccugucuuuggauaguuucccugacuaaaucuuagccugaagacguauguuaaggggagagcguauguuucuucuugccaacuuaguuuuauggaaaaggcccuaaggaaaaagccugucuuuuccuuuucaugggucagaauuuguguuuuguuauuuucuaagcucuaguuugugguggaaccaccucucucagaucuuguuuuuccuucagggcacaguguauuucucacuuaaguaguuuaugcagucuuaucacaguguccccugcauggggaccugauaacuuacucugauugauaacggaagggcuuuucugucuacuucugucuccuugauggcuuccuuaucuguuguccuguaacacuaacugugaacucauuucauuagguaaugaaauguuaucuucuguaauugcuuauuugugcagcagucuugucucugcaacuggagaggaacuuuagguucuuucugaaccuuagaguacuggcucauagugccugugcuauaaccaucauugauugcuguuggucaaagcaccugacuuuuugggguaaguaaaccaacaucuugcuuuucaguguuuuguuuuucuggauuacccaucuaugcuuuggguuuaaugcuccuuaggacuuggccuuaguaugcugcuggagagcccaagggaacaguauauuaguaagggaugaauucuuugugaauucuuaaaucuuccauugcgaagaucuuuguacagaauacugguucuguuuauauugacaguucuucagagaauuguguguugacuguucauggcagaaacaccauaaguuaauugcuguuucaaauuucauugacacuuucccccucauuuggaggucauuuccucaaaaaugucguuguccacaugacaguuuguguaugcuuaauaaaagagaaugacaaacccaaguucagcuguuguuacuggacugggugguuuuuagcuccucccacaaugggcaauaaucaguuuggggucucagcagaauuauaaauaccugcauuucauagucuuccugaaggaauugcuuuacuuggaauacuguaguucagacugcugauguaccgugcacuccuuucucuuugaugaucagcucugaagugcaccaauuggagagaacucuugaauaaaugcugucacuugucacauguggucacuuucuggggacugugcaugugccagugggggccaucuagaagccaccgaugcccacuaauauaacaaaacucacuggguuugcuucucuauaaugauguuggauugcuuugcuggaaauccuuaccaucuugguuucucuccucuguuuccuguaaacaccaaauaaaaguccuugcauacaaauguuaccaucuuuggaaaaaaaaaaaguccuuguaguuguuaacaguuacagaaaauauaaccugaagacuuggagucaaaaaacaaaucccugccuucccauacagucaguaccagcuauaagcuaauuaaacucaacuguucccaccuguucccggggaggccucuaacaguggcacaugcuuuucucuuugggacuuaacauuuuucagaacucuuuaaauuucauuuucuaggccaggcaugguggcuuuugccuguaaucccagcacuuugggaggccaaggcaggaggauugcuugauucuaugaguuucagaccagccugggcaacaugacaagacacugucucuacaaaauaaacaaacaaauuagccaggcgugguuccaggcaccugugguuccagcuacucaggaggcugaggugggaggaucauuugagccugugugguugcggcugcagugaucauuguuugcaccacagcacucuagccugggugacagagugagacucuugucucaaagaaaauuuuuuuucauuuuccauugacaccauacuaaacaacguguauuuccagaaucaaccuuuauuucccuaagaaaauguagauugugaugucccuggugagcaauaaguuaauauuggcugauaguauuugagcagcagugacagauaggaggaagacaggagggaagagaugggaguguugcugggggagugggugugaaaccauaacacacauauauggucacguacacaucuguaguuuacucaaauggcauuuucacaaagcacaguaguguugcagguaucccccagugggcacacagagcuuucaguccucacugugugaaacuucucauaccuuugauguugaauuuaaguucauuaguggcuccuauagcaugucagagguuuaccucacuugguuccugacucaacucugaaaugcugaguuuaggguggauuugaagugucaccuucgucucuacuuucuaagagucaguaaagagcugccaugauaguuaauccuauagugccuccaaugaagacuuaaauauacuuacuagcccagacuuugcuuuaucauucuccugaucuauuaguuuuauuccuguugacagccaaaauguaggaucaugaaccccacaguuacauggauggugacagaccugaguuguugucgagaaucgugcugaguuuuguuaucacauuucuugucucgauuuguagcaucucuggauuuuacuucuuuaccagaauagugguuaucaaaguguggucuucgaagcagcaauaucaucaucaucugggaacuuguuugcaaugcagauuuccaaggcucuaccaugacuuccugaaucagaaaccuuugaggaggaagccagcaaucugugucuuaacaagcccuccugugauuauacccaacuuuaagaaucacuacacagacagacguugcuuuccuuuuagucucuugagcuuguaacaguugauauuuuaacuuuuauaugagagaggacaguuauaucuuccuuuaaacucuuauuuggugcaguugauugucagaugcagagugcugaugugaggauggacugugaauaugauccacuguggcaguguuuauagucucagcccaaugccuuguugacuuaaguagcagccuugauaacaggagauaaaucugcaaagauacugugagguuacauggcaaggcuuuuaaaauacaccaacauuacauuuguggcaagugcuuugcucaauguuggcauuuuugaagucacccuuuaccucugcccccugcccagaaauuuccuugugagaaauguuuuuacguuagacaaacugccaugggggaggauagucagaaagaggagacaaauaauacgcagaggcagacuuuuuuuuacauuuguugcucagaagaaaaaaauuccaaugaagaaugaaagaggcuucauauccugaauaaaguaaaugaucuggguaggaugguacaggaauagaaugugacuauaaaaaagaaccaaauugugcagacaagaaaauaugaaggaaaaaagaauaggaaaaagacagggaaaaugcaaauucuuauggaauauuuuugcaaaucuguguacagaaggaaccaagcaacgcagaucaguucuucugaggcugggaguucuaaaaauuaugcaguaucaaggaaggcuuucuuccugagucaaguguaggaagcagaaccaaccuuuauuucucuaugaagauguauauugugauguccccagugagcaauaaguuaauauuggaugauaguauuuaggcagcagugacagaaaguuuucuuucuccugacugaaucucacaccaaggucccuuuuuauuuuuaauuguuuaguuuaauuuuuguuuuuuguuuuuugagacagggucuuacucuguugcccaggcuggagugcaguggcgcguucauagcucaacuacauccucaaacuccuaggcucacacgauucccccaccucagccuccugaguagcugggacuauaggcacgugacaccacaccuggcuaauuuuguaacuuuugauagagacacacacggucuuggucuugcuauguugcccaggcuggucucaagcggucuuccuaccuccaccucccaaagugggauuacagaugggagccaccaugcccagccaaggcuuuuuuuuuuuuuuuuuuuuuuuuuuuuuuuaaaccagcgucacaaccacagaagaaagacaagaggaagauaugaagacaaaacucaauuuuuuuuacuuagugugucuagguaaagguuuaguaggagauaauguagaaaugaaauaugauaauagcuuauuuguguugagugcuuugauguaugaggcauuauucuaagggcguuauacuuguugaacugucuacuucuuacagagucugaugagcuacacucuguuuguguauuuguuuuugguggcuuuuuugagacagaggcucacuccacuguccaggcuggagugcagcggugccaucacggcuuacuguagccucgauuucccagguuuagguaauuuacccacaucucagccucccaaguagcugggacugcaggugugcacuaccacgccuggcuaauuuuuuugaugagcuagacucuguuacccucauuugcuaguucaugaaauugaggcagagagagaaaguaagcaaucuggccaaggccacacagcuagcaaaugggauuuaaucccuagcauuuucauuccagagccuugccuuuagccaucacacucuacuguuucucuuccauagucgucuucuuucuugugauuccaaguuaaagaauugucauggaugagcuuuuuccaggaguaaagguacuuguuggacucuucaucagauuuggucgcgggaaaagagguuguugcucuuccuuagagaccuguucuuucugcauuuaaaaucugaguguaaauuuuuuuuuagcuggaaauuuuaaacguguagcaaguguggccagcuugcucuuguaauguuuaguuuccuggaccucauguugccucccuaaaacuuaaaugggguugugguugcacaacaguaucauggaaaugaaaugaaucuuaagccuaaugaguuugaauaagaugagcacaaucuaauuuuguuuccagucguuuuuccuccuuuaaacaaagaauaucaugccaaauuggaaacauuggauugugucacuguggguauuuauuuuuuacuacaugucaccaagauccagauuuguugaguguauuaguuacauaugggguaaaauucugauuuuuuagguguauuaguuauguaugggguacaaaauuaccacaaaacuuaccaucuuaaaacagcaaacuuuuacuaucuuaguuuaugugggucaggaauuucugagugacuuaucuggguaguucuugcuugacuucucuuuugagauuccaggaguaaagguacuugucagacucuucaucagauuuggucccgggaaaagaggucauugcucuuccuuagagaccuguucuuguugcauuuaaauucuuaguguaaauuuuuuuuuagcuggaaauuuucaaccuguguagcaaguguggccagcuugcucuuuuaauguuuaguuuccuggaccugcagccgaaauguuaucuggggccacugucaucugaauguuugacuggagcuggagagucugcuucuaagauggcucauucauauggcuuuuggcaggaggccuugguuucucaccacauggacuucuuaacaugacagcugguuuuaccagcgugacugauucaagagagagaaaaaugaccuaaucuugcaagucagacacugucacuucugccacauucuguuagucagaagcaggucauuaauggcagccugcacucaaggggaggagaauuaggcccaagcuuuuuuuuuuuuuuuuuuuuugaaauggagccuugcucuguugcccaggcuggagugcaguggcacgaucucccagguucaagcaguucuccuaccucagccuccggauccugaguagcugggacuacaggcuugcacuaccaugccuggcuaauuuuuguauuuuuaguagagacgggguuuuaccauguuguucagacucaucuugaacuccugaccucagguaaucugcccgccucugccucccaaaguggggauuacaggugugagccaccgcacuccggccaaggccgcacuuuugaagggaggagcauuaaauuguggacguauuuuaaccaccauaguaggccugacuccacaccuacuaaaucaaacucucuggguauaguaauuuucauuuuuaagauucucucaaaugauuuuuauacacacuuaaaauagaggacaacuggguaucuagaaguaaaugaaugcuaucauggcacuauacuaguuuauuuaaaaggccagauguuuuucacauguuuagcauucuaaauauuugagguuuguggaugaggucacuuggaaguaaaaaaaaaauuuuuuuucagguuugcgcuuaggcacuaaaucauauacuagguaauauaguacacucugcucagacugcauuuuaucuggaugggcccuuagcuuuuuuucuguugcucauucaggcagaugagccccacucuaauguagccugugguaucugaccagcugcucucagugcauauagcccaagcaggagcuguagcuccugauuagaaagaaugaaguauaugucugggcagggcaagccaaaagggauucugagguucuugucucaagauccagggugaaccaggcaccaucugaugauggucuuuggcucauuggcuccuacagcugcauacuuuguuaggagacaugagggguacagaaccaggaguuugcaaagaacaaucauuugccuucuggagcccuucuaaccuggacaucacacccuuuugauguuaaaugacagacgucuggcucugugugacaucauaccuaucuuaucuuaguguaccucagcuaaccuccugaggcuuuugguggggaaucaggccucauuccccaucauagacauaauuuccuuuuuuuuuuucugagauggagucucgcuccguugcccaggcuggaguacaguggcgcgaucucggcucacugcaaguuccgccucccagguucacaccauucuccugccucagccuccccaguagcugggacugcaggcacccgccaccacgccuggcuaauuuuuuguauuuuuuuuugguagagacgggguuucacuguguuagccaggauggucuccaucuccugaccucgugaucugcccgccuuggccucccaaagugcugggauuacaggcgugagccaccacgccuggccgaucauagacaucauuuucuuaccuucccauucacauuagcucuuagccaucugaaugcaugccuacaaggaaugcaauugguugcuuaagaacggaggaaacauguuauggaaaucuauacuucucuucaaauguuuguaccacucaccuacccaauucccuucccaccccaaucaaaagacaaauacccaugcucagaaccugggggcucacauuuuaccugaaauuccacaaguaacagaagcacacauuuaggggauaaaacccuagagagagaguaacacaauccuggcugccaucucagaacaagagagcauuguacccagaguccaugaucacauacuggaaugacugugugacggagcugacaugccccaauagguacaacagauuguucugcuuguaaccaaucaauaccacaauuaacaaauauuuauugaacaccccggaagcacccugguauauacuguccucaucagcuauuuguuagaauaacacgaaaccuccugauccucugucugccuucaggcuugccucugccccaauaaaaucaauucucuacaucaaaaccagagugacuuuuccuaaaauauacacauuugaccaggucauuuaccuugaaauguucugguugauguucagcauccagauaaagcccacacuucccagcaugaccuaagaaccugaccgugugacucugcuucccucuuacagcuucuccacacauguuccagcguccaggcacucuccacuccucgugccucccaccaugcccaccucucuuguccuucccaucuuuaugugccacauaacagcggcuaagagugccggcgucagagcucauaaggcuuugauucaaaacccaacucuaugacuuaauaauuguagagucuuggguaaauuacuggauguuucugagccucagauucuucguauacaaaaauaaaccaccagccucacaggauucucauaaggauuaacugugaucauauuuaaaauguuuagcacagugccuagcccauaauuaagacugaguaaauauugcuauugcuauauugauguauggaaagcccuuggcacacaguaguuguuuaauuaaaaaaaaaaaaagauccuugucuccgggagccucaguuuuuuuuugaucauuggaacuucucagugugacauucagaguuugauauaggaguggggauggcauugguguggguagagaacuaggguuuugagggaaagagagagaaaguugauaggaggagcauagauguaaaaaccauuguguguuuccaugugaucuuccuuccguuugaauaugacuaaaaaugucauucguuuuggggcagggaaaaaugguagacuaggauucggaagaaacugacauucugacguugaguaagucacugcuuugcgccuuuauuaguucauauguaaaauugguucaucagauacuguuuuugagagcuuuuuaaagacuagaaaacauaacgugaaauaaaaugacaauauuauaccccuaauucuacauuuacagcauauucaacauuuuuuugaaagcaacauuuuuguuuacacauaacagaugcugaagcacacagcccccuagaaauggagguugccaggaggauaaagaagaucaugaaugcugccagugucucuaaucuuugcccucauuccuugugugucucucauuugagaaguucucaccuuuccuggggguucucuggccagaguguuuuuacucugcaccacucuaccugccguugacuggguuaccuucauaaaagaggaaucugaagggccuuaugggaagaguacugcugguggacacauggaaucaggaagcauaguuugaaaucuagcacagauuaaaacuugaccuaacacucaaaagguuuucuucucugugaucuagggcucucuguggucaccauauugcaucacuaugagguuuaagaugaauguguggguaccuagcaaaggucuggcaugugauggauacaggacagucuugucuuuuccuacuuggacaccugagauaguuccccaguguacccugaauaucugaauccaaaaucuucagucaagaaggagccucuacggacuagauccaagccucccuuucugaucuuauuucuauucauuaccuucaugcucccccucccguccauaauaauuauccuccagacucaaggcccuucacgugauuuuuaguuuauuacaccuuagcuuuuccuuucuucuguauagacuuugcuguaccugcaauaagugauaccuuucccagguccaugggacuugaaaauccuguuuccaucaagcuuuuccgcaaaccaccccuccucaccaggugggagccaucguucauucccuguucccccaaugcauguuguuuugcuucuauuauagcucuuaucacagucugccuuguagcauagucauuucuguguguuuucccucuggauucggagccccuggagggcaaagacuauguuuuauuuuaugcuguauuuccccacccccacagugccuagugcaguagggguuugguaaauacugcuugaaucaaugcaugaaugaaauugccucuccuaguucuguuugcaaggcuguaaugcagaccaggugaauguagaauuuuggcuuacuggauuuaguuuagcauaggaagggaguuuuccaagaagcaauagugguuuugaaaacagaaauugccuuuaaucuuguggaaaacauaugccagcccucuccauaauagucucaauuacaggagagcaucguguuacuguaaaaacacaaauaaauaaacccaugacaauacuguguuugggagauaaaaaccacauaaaagccaucuuuccccaacucuccagcaucauaauuaggguauuucugggaggagaaaaaaaagacaccagcaaaaaacaagugauacuauguuuaagaacacuucuugcuauuggcaagaugggaguagggaguuagauuuuccauacagcacaaauacaaggguucuucccagcuccuaccaggcuugaugcuauauagauuacacugcaugauaaauuugggcacuagaggugccaaagaugguggcagaaccuggagggcagaaaaugucacccagaaggugaugcugugaaauuuauugcucugccacacuuuaccuaaacauguccuauuauucugaaugcugggucuucauuggcucagggaugcccuuggugcguccguugccaugggcuacaacuuucaacuguauuuuguuuauugcuggucauuuaagucucuaucugguuuuuuuuucuuuuaacuugagggcuccagauuuagguucuuuugagguaagaguaggaaugacuuugaaauauugccuacuuuugucaguauuaguuaacaagcacugagggcugaaugacacugaacagaacccagccauuucucagcaccucuguugccacuacccuggucugaguugccaucauguuucaccuggacugccucaguagccucccaccugaccucuuugcuccuacuuugccucccugcagaguguucuucacucagcaaccagaguggcccuuuuaaaauguacuuuagaucauaucacuccucaguucaaaauccuccagagugccucccauuucacuaagaaugcaauucaaagaccuuacuuaccauggccuacaagacacugcacggucuagugccugcuaucucucaccccaucuccuacuauccccuuagauuaauccucucugacccuucagcuugcuugcuguucuugaaccuggucaagcauuucccaacucagagucuuugcauuauuguucucuuagccuggaacauuuggucccagauauaaacacaugguucauacucucacuuccuucaggccccugagugucaccuuguuggggagguccuguccaccuguauuucuauugcuggagcaagcacuuaggaagucuuuguuggaauugugaauaagcauugcccagagauucuagcacauuuggaaaaagagagugugguuuagaaggacaguggcucuggaguuggagcaguugggcacugcuggguuugccugccccccauuggauagauggcugauguugggaaaauuauuuaaccuuucuaagccuagguuucucuacuaguuaaaugagauuaugucuaucucucagaaucguugugaagaguaagucagauaaugacugcaaagugcuuggcaaugagucuuguacacauacugggaggcuuccuaaauaccacuucucacaaauccuacuuccugcuugugaaaucauguuauauggaagaaggggagugucugaaaaugguuugaaucuuguguguaauucucaaguaccagcaaguaguugugauuauauuuaaagcaccuagcccugugcuuggcauauggcaggccuuaauaaauacccaagucuuccugcuuuuaaucaucagacuuagacucugggugugaacuaagguagcucugugggcacacagggauuuugguaaacagaaaaagaagucagcagcugagguaggggugguucacagucuugcuugugguucaacagggacugcauuuaugaaaauggcaagugagcccagggcaauuggaacuuugggccuugccagcaagugugguauuucaguuuacauccucagaguaaguacaauuucaccauuauuccauugaggcucuccuugccaagaaaaacccauuguaaauuucugguuuaaagguucugcaguuuuagggaguuguacuuuuuguugcuuuaacauuuucuuggcaccacacauuuuaagcugcacuggcuuaccuuguaaauaguauacacauuuugugaaaagcugaaccacgucauuuguuuuccuauguuccuuaugggaaauggugaugcuucugccccacuaguuccccuggguuucugaucaggcaguuuggagugagaaaaugagacugagacaaaauauagauugucagcaagagauuggagcuguauucacaaaagcacuuuguggacaugguagagccaggcaggagagaaaagucuguggccggcagggugucugugugacguggacccauuguguguaugggcuccucccgcuguaccaguggccagcucccagccaggccacccgggcgagggccucugaagcagagagcccugcacagucuggagccgcucuaacccaguguacugaauaggacuccaaagaauaggagcuguguucccuuugucaccugcaacccugcuuucagccugcacagugaaugugcacuugggggcugaauuggcacuuggaaaaaucugcaggaacuuugugugugcacagcgugugcccagcgguaugggcgaauggagcgugcacgcuggagaugucugggggcugggugcuugcagaggagggcugaccucuuuaugcugcaggguuugccaagaaugcuccgcccuugacaguguuguggccaacagaaaagcauucguggcaucuuaaugaaaggcagcaguuccuuuuuucaagaaugauaggcauucuuuucuugagcgagguccccauuuagggauggagagagaagccaauuauuuuucaguuaaaauuuauuuuuuaaaauagugaugccucaguuguaaauuacccuggcuuugccaugaagacauuuacagcuagccuucugacuugguuuuaaguugcugccuuguagaauaauaaaauaguagcccaaacugugauaaggcaucaaagacuuucauauccuaucuguguagcugaugugcguugcuccauagcuagaaaauggauauauuuucugaaagggaauggguguauuucccuuuaccuugcagcuugcacauaaucgaacacuucuuuuauugaaauuggggguuuucucccuuggacuuaauaaggagauauagauaucuauauaucuauauaucuauaucuccuuaagagggaguuucauaaguucaaaaguugucagguugaaaggauugagguauuggaaacaacaaucuuaaaguuaccuuuggaaugauagaucuuugaaaaaaacagguaguuuauaguacauuggaggaaaugcucuguuguuuugcaucuucuccaggccucuuuaugacuacuuuuuuuuugagauggagucucacucugucgccagacuggagugcaguggcaugaucucagcucacugcaaccuccgccucccagguucaagugauucuccugccucagccucccaaguagcugagacuacaggcacaugccaccaugcccagcuaauuuuuguauuuuuaguagagacaggguuucaccauguuggccaggcuggucucgaacccuugaccucgugauccaccugccuuggccucccaaagugcugggauuacaggugugacuacuuuuuuaaaugcuucaaugaaacuuaacaugaugaccuacacauuucagcugcgcauauguucuaccuguuaauggugagauacaacagagccaucuuugacuacuucacgcuguuuacucuaagaggccuguaucauuagaugacuuccuguuggaagcaguaauuuguguuuggacuugggugacugucaguaugaaucuagccaagaaaggucaugucaccugcuacacaguuugcuagagggaauacaggccaagccuuuugccucugaaaucaaaguacuguagaagguguaauagaaaugaugccuagguuuguguauucagggccugaguuucugauuaaagcuguuaacaaugggggcaagcuuuccccgugggagacaggcuucuuggaucuaaaccuuucugacaucucaaagcuuuauuuccugaugauuucuaaaagggaaggagccagccccuugaaauuaaaauaucgacuuacauuccguucuccccagacggaagaauauuagcagauugaaucaguugggguuaguacuuucuuuuauguguuaaacucaguuauucuggcuaagaucagauuuuugucuaggacggagcugaaacacaugcggaaucuuguugguugagggcuggaaacgaagguuggcuucacacagguugcuucuccaaaccguagguaagcucuucggccccgugcacagcauucacagcugcugucugcugcgcuuucuugcuccauccugucuagucucagaaguuucaugguacuaauaucuuggauccuuacaaaggacugacuuuugacccaguugacugauaacuauagaguacuuuacaguuuaccaagagcuuuccuucauguuugcucuuuacaucaaaauuacaagauggguuuuauuauccacauucuuuuuguagauaugagggccagagagguuaugaguuagccaaagucuauccaguaauugacagagccaagauucuaggcugggacaucugauuccaaaucuacugcucuucaugcuccuuuauacugcagcuacuuaccugcucaaaguaugucauucacucauucguucagcaaguucuugguggcaugggcuuugaagccagacagcugggucccaguaucugcucacuagcuuugugaccucuguuaccucuuggaaccucaguucuuucaucagcaaaaugaagauaguaauaguaccuaucuaggaaggcuguuguggaguccuuuaaacagugcucuggacauagcaaauacuccauaaauguuugccauucuucuucaucaugggcucacucagugguacagggacuccacaccagugacagcacugcuguugaggaucacuuguucugaugcaaauaugaaaauagaagacugacaauugcauaguaaagggauugcuaagauauaagcaggaugcuggggaagcuugaaggaugaacagcuguguuuucgauugccaagaacucggcucucuagcagcucacccuuguugccucuaccccuauuuggucacauuccugucuuacucauuccuugcugaaggcaguauuuaaugugcagggguuuuauggguacuuuguguauaaccucuuugaggaggaagagaaggagaguaugucuggcuaagggaaccuuaguggucauuugggauuauaagaccuauauuuaacaguuggaggacuguucaagacaaaauagauuccaagguucuggugugcaguguucugucugagcaccacaggauaucauaugugaguggcuuccaguggguugcugagggaggggacuuugugggggaaguaggccuugaguuggaccugaaagaaaugaggauuuggauuaugaguagcagaagcguggagagcugggcagagguggaguuaugauauuuaaaccauggccugccuuggguggcgggacagcccugcccggggaugugggugguccaggaggcaggugcuguccccuccugcaugagaaccugccucuggaccccaacaggaugcacacagcuuauccccacccucugcaaagcuaccuaauaauaucuuuguguuuaugguaauguuuuuugcugauuuggugggagauaaaaccuagagagacccacagcauggaugcuaggucugagugggucugugagcugcaaccuagcugcagccccuuuguuugugagcuguuugccugcauuuaaaugccauuuacauaaggagcugucagaguugaguuggcccaugauuauuccuugauguauguugaaaaaagagaagaaaagaaaacccuggcuaaugaggagcuggguuccuuuucuccauugaugacagcuuccuuucugaucugaugguccgucagaaacuaagguggugugugacugugggguuauguccccgcugaagccgucuuuuccucagaguuguaauugauggggagaccugucacuuguuaugcugaugcugugcagauuuuugugcagcugccagccaagagaguuguaggacagcaucugauugggugcagguuguggcaaaaaugauaauaaauagagagcuggugaggguagauuuugauugacccgagauuguauauuauuaaacuggagucugcauguacaugucaguuuaugaagaaccagacccauaauccaacuuuaggacuguggcaguucggguuuauuaaaugugcuuuauaucacuauuaauauugaggagcaaagaggaauaucuguaaucuuuuaaucuaugcaauaaugguuuggagggagauuaccagauacauuggacuauuguuugucuauaauuguauucagaacucuccgaagcauugauuuguuucuggcaugcugauuuggcucagcagucucauaaagcucuuuuauaguccucuuugcuuuguguuuuccaaaaauaauuggagaauaauaauaauguggcuggcgauaaagaagagagaguaagguugaaagcaaauuucuagccgaguggauagccauaaacaucuucuaugcucauaaacaccugggucugugaccuuuguguuuauaagauauuuaucgccucaugggcucucuguuuggggguuaccacuucagugccuuguaaaauuugauuguguuuaguaaguagauucugaauuuuugcugaguagggaaaaagugccccucaccuuuguuuucuuuggaacaaccaaucugccaagaggggcagaucucaccaaggacaggagcagagagcuugggugugccugaguuuuguggaaaugguacagugggacccaguaaggguaucuuuuguacuugauuaaguggcuugugauggaaaugacuuuugaacggaagggaauugugcaacacaucaaauaaacucaagcagugucgauggguuuuccuuuuccaguagaaauggaauuuuugauucaagucgaggaagcuuucuugggauuuggauuuuugccacuuccucacccuuucuucccauuuccaaaacaggccugaggaaaugagccagagaaauggucaaauucaguuucauugacuuuaauacgaagguaugacuaagugcugcaaaagcacaguugucuucuaucuucagcaguccucuaaacauuucuuggggaaguuuuaggcacuuugucaaccucuauuguccuccugaugguguugcuuaauuacucuugaaggaaacaguuggauuccugugaacugaugacagguguaugcugagcugccuguguaaacuauuggcugccuguucauguugugcacaguggaucagaggcauaugggagaaugugccaaaacgggaaucuuaagggaguuuuuuaaaaaguaaaaauuguuugcuuuuuugcuguggugcgaacauggcucacuuccgccuugacgugcugagcucaagugaucuuccugugucagcuucccaaauagcugggaccauaggcacaugccacugagccuggcuaauuuuaguguauuuuugcagagacagggucccacuauguugccuaagugggcucaagugauucucugugccuuccaaaucauuaggaauacaggccugagccacugggcccagcccccaguaagcuuuauuauaacucaacuagcuucauuauaacuaaaguaugagccagucuugagguguauaggaccuauauuuaucaaaggagacuguucuaccuaagacuuaguuucuuguccuaugagguuaauugcugcugcauuucauggaguuuaugagaugugcuucccucugcccuucuucaaucagaugguacugccugggagucauauacaugcaggacugauaaagagcggcucccacaguggcaguaccuacaguggacugugcuguagguaaagggaagcuccaucacacuggcaugugggaacuggacuaaaaggccacgaaucccccaacacuuacucucugcccagcuuugugaaauacaaaauaauuaugaguuccagacuccagagaugcuuuccaccuaguuggggaaggagaaguuuaggucagugguucucuaaguugguccccagacaaggagcacccuaauucucuggggauuuguuagaauugcagauuuuggggcaucgcccagacuaacagaauuggaaaccauggaugguguuuuacaaacucugcaggugauucagauuuaugcuaaaguuugacaacuccugcuuuagguucaucaguuccagggggaauaaaugaguaaacaaggcacauagaauuaagggcuuccuauagggcacagcgaaggagagaauaaggugcuuuauagcaggaugcuaagcuggacugucaaucaugugggaaaggggucaaagacuggaagagcagggaucaucaaggcaguguuugcuggggagagaaguuauugagccagguuuugaggacugaauaggagagaaagagguagaguagcaugaaugagcucagaugugauagggaggguucuguuccuucaagagcuuaguuaaguguagugaaaacacacacacacuccggacaagaaaaauuaauguaaaaucaacuauagaacuuaggcagguuuaugaagaagaaaauauauuccucacaaguuggauuccugugaguucaucucuuuuauuaccucuggcaauggugcaauuaauuggggccagggcucugcaccuggaaaggcuuuauaacgugagauucucaagaggaagauuuuauuugccuaaggcuacuacuuuaaaagugagagaggcacucaugaaaauuagggguaacuguaaaaagugauaagcugcucaacauagauucagugcccaguauguauaaagugcuguguguauacuggagagagggaacuggaaucuaacuuggggauggggguggauccagaggaguagagauaugaagaaauacacauuuaaguccaguaaguuuuucaugcaccuguaguccugagaggugaagccagcuggacguccugggucgaguggggacuuggagaacuuuucugucaagcaagaggauuguaaaugcaccaaucagcacucugugucuagcuaaaggauuguaaaugcaccaaucggcacucuguaaaauggaccagucagugcucuguaaaauggaccaaugagcaggacgugggcagggacaaauaagggaauaaaagcuggcuaccccagccagcgguagcaaugcagcacugauccccuuccauacuguggaagcuuuguucuuucucucuuuacaauaaaucuugcugcugcucacucuuagggucugcaccaccuuuaagagcugcaacacucaccgcgagggucugcagcuucauugcugaagucagggaaaccaugaacccaccgggaaaaacaaacaacuccagacgugccaccuuuaagagcuguaacauucaccuugacguccaaggcuucauucuugaagucagugagaccaagaacccaccagaaggaaccaacucuggacacaguccaagcuacuccagaggcugaggugagaggaucgauugagcucaggagguugaggcugcagugagcugugauugcaccacugcacuccagccugggcgauagagugagacagggucuccaaaaaaaaaaaaaaaaaaaaagucuaguaaguuuuuguuuuccuuuaaaggcagaggggagccacugaagguuauugagcagggaaguaacaagauuagaguuguaaucaugaaucuaauuaaaaaaucagugacuggagggaaguagauggguuagaaggcuagucuaguuuuaauacugugaggcagaugagaagggcuugaacuagcagaguucuagaaaaauggugauguaagcaacaauagagucauauuaguuaagggugagagggaagaaauauuuacaauucacuguggaccagccacuuaugccugucauugguagagcuuaaccaucacaauuuuagcaacacagagauugauuuuuauagaagguccaaaggauauguagcuuggagacauauucaagauuugacucaugcuggguguuauggcucacaccuguaguggcucacagcuaccugguaggucaaggugggaggacuguuugagcccaggaauugggaccaguugggcaacacagcaagaucucaucuccaaaagcaaaagauuugauucaagccugccugccugcaaagccuguacccuuuuugcucuagauucuagacuuuggcgaauagaaugauacauuuuguuuauaauuggacaguuguugaucuuggcagaaguguugacugcugggagguguuaagagaaaggaaaaagcagcauaagauauggaaguuuguuugaugaaacuguaucucaaagaguuuaagaguuuuagcacaggacagauagaaucuugccccacccaagaugauggaagaacaaaacaaagucugugcuguuuucuuuguuaaccagaguugagaguggaguccaauccaauaucugccuagugggagucucuugaguccugaucccaugagaucauacauauggcugcuacuccuguugugaggaagguugcaauuuuagaaauaaaccuggagcuuuugaagguccuauuuauuacuucagcccacuuacugccgagguccccauguuuugcaagugacaaaaauaaaucuaaaauggaaaacuagggagaaggugagagaaaguguccagagaaacuggggacuuugaguuguuuggucuaagcuacuuauuugcauuuuugucuccacuuccuagcaagcauauugguacuuagcaauggugggaggaaggcagaacuguaaaaaaaacgaagucaucauucuauccuuacacuugaguuuccuuucagcaaccucucucucccuugucuuugucccgucucauaacuuaggcgugaugugcugcuguaucugccuugcugccuucuccugaguggaagcugcagcuacaguguugguuauuacaccuggcaauuagauugugcaggacaguaguuggcuaggaauggcauaagguugcaugccucguuaaaucugaacuccacucagcauagacucuuguagaagcaagggggauuuguuuagguaaggagcccuugaaaggagccugcuuguugaacuguauguugagcagcagugaugaaaagaugccuaaacaugugucccacagcagcuacaguccaucagcauuggacacauugguagaucaccccugcuguuaacacaggucuuuucagcuuacucguuuguguacuuaacuguugagugcucuuuuaauuaggggcgacuaacaucaaaguacuauaguugugccgggccugcuaaucaacagguuucacuuauacuggggaucacuucagcuuuacaccaccauuaucaugacauugauuuuucugugcacauaaaaggaagcacuuacugaauacaggaaaaaaucaugauugcuagguggaaaaaaaaacaaaaaaccagcaagaggaacucaguuacccagggaaaauguaaacguuucauaugaacauugacagugaaauggauuugaugaguuuugaggugauuuuguuagauacuuugagagaaauugagaauucuguauuccgaagagacagccggacuugaaacucuagagguaugauuuugaccaagaccugaacuucucuuugccucaguuuuuucaucuauaaaauaggguuaguaauaauaccaaccucacugagauauugugaggauuuugugagauauugugagauugaaugauuagcuuagucacuggauguaaguacucaaauuauagcuauuaauaagugugauacggcugggcacgguggcucacgucuguaaucccagcacugugggaggccgaggugggcguaucacaaagucaggaguucgagaccauccuggcuaacacggugaaaccccaucucuacuaaaaauacaaaaaauuagucgggcaugguggcaccuguugucccagcuacucaggaggcugaggcaggagaauggcgugaaccugggaggcggagcuugcagugagccgagaucgcgccaccgcacuccagccugggugacagcgcgagauucugucucaaaaaaaaaaaaauaagugugauacuuaaugucauaaaucauuguuauuauuucugagaacugauaucuugugguccauuguuguggcagaaguauaauuuauauaggaaccgaaaccagcccucgauuuuuuuuuuuaaucgccgaucuugguugggcuucacuaucauuuucaucagcuucacaaccccucaguucugagaacccuccuugccauacaagccacuggagugucugcguuuccuuucuguggacauugucaccuuucccuucauuuugguaaggccauggaaacagagcaaucagauaaaagaccugggcauuuggcacuuucauuggccauacuucuccuucuggcuugaguuuauaugugguuugggguaguuacuggugaaauugagcuuugcagcugucuacuuaaucugcauuuccugaucugcuuuggcuggcaaucaaaagcuguaucuauuucggagauugcgcaauaagacuuuuaaugacaaguuaaaagacaaaggguuggugggauugaaccuuaugcagaaaauacuucacuauacuucgguggcuccuguuuacuggugauuuuguguggauaguaacuuaaaaucaagaaacauuuuugcuaacauauuuccugggccauuuuagaaagaaauuucuuuauuuagccaguaaguagagcuuucuuuagcguuuacauaguuaucuuuuuaauauuaauuuuugcaauccauaugaaugaggccacauguccuuuaacaauuuuagaccucuucuguuaugcauuacugccaucugucaguaugagagaaagcuuccuggggcagaaggacuuaaaacaaugguucucaacccuggggucacauuagaaucacuggcagagcuuuuaagaaauuuuagugccugggccaguuccagauacauaguugcucugggauggggcccaggcauugauguuuuuaaaaaacucccuaggugauucuaggguauaacugggcugagaggcucuccuccgaaagcacugucuuaauggaagaaccaguggcaugagaacaguucugcuuuuucucagcaguaaccuuguugucuuccauugcagugcugauuuugacaauggagccaugcgguuguauuuggguagcgguuuggaggguaacaagugugucuuuuguaucucugaauccucugcagccagucuagugccuggcauauacuagaugcucacuauccuccacuucacuucuuuuggaugacuaaauaauggaauggagcccagauguacuagccuuuuuacuuaaucccugagccuuucuccuucagugguccguaagggagcagguccacaagcauacacuuuuauuguuccaggaggaggaagacgcccagcuucggaaugcuugaggcauaaaacugauccuugguuaagaucagcagaggcuugcugugugcaacauaaauugucagguaaagaagcaauuaacguagugccauuuauuuccucuuuaagcaucuaguccuuaugaguguugugguucugcacuccaacuggaaacagguucucuauugcccuguuuugcucuuaaacacagacaccuuuuucagucaagagaauuagggccuuuuaaaaacucuucuuucuuucuuuuccuuuuuagguagcccauauugaaucagguccugcagcuauaguuauucaugcagggagaauucuaugaacacaggggagaauggccugggaguuugauaauuuguuauuuuuugguuuguagauugagaaguauauuaaguaaggauaaccccuuauaguuaguuaguuauuuuauaguuuuccuguccagaagguuuuaaucucucacacggcuguggacuggcaaaguaacuaauuauugucuccaguuuauggauaaaaaaauuuaagaugcggcaagguuaagugaccugccuaaggugauagaccugggccuugaauccacagcuuuugacuguaaaucccuucaguacacugagcuuuggauaguacuuuugcuuggauuagaacacccuauaaaugugacuaauggcaucucaggguucuguccuggcugucauaguugaauccuuuauuugcauugcaugugcuugcuugugugugugcgugugcaacuauuaauauuaagcaucuugccauuugccucuguagagcacaguugauagacgggaauauacacuugauguagucaagagagugucaucuuuuauuaagaauucugaucuugccucuccaaaaugccuacuuucacuuuuagucuauuguaagugugaauauuugugugugguauuuuauuccuaggcaagguguuuuucucagucuauguugugugucuaggaugauaauguuaaagcuuaauauauuuaguuuuggaagacuacauuuuucuggggugguuuaugaguuguuuuccuuccuccaacaaauuauugagugucuaguauguguucuaugcugucuaccuuuacuuccaucucaaggaagucuaggauaaaaauaacauuguuuaucugugaagggauaaagagucaacacccauuucaugucagcucugucuuuauuaggcauuuggcuauugagcuuucuaauuucuugacuuuugggaguguuucucccaguuaccagacagguccagggugggaaaugcuuuccuugggccccagaacuagcucauggagaggugguuguagcuucugggaauuuugaaaagagccacacccaggaaucugcuuggacuauguguucuuucuguccugccuuuacucuccucuuuucucccucuuauaagcaaagcgucuuuuugcuuccuugcccccaaucccagagagacuguuaacuuauguuugcauguaaggagaacagucagaguuaaggaucucaaacucaggaaagugguuuuuguacucaagagcucccuguguguuugcgcagcacacuuaccuccauccaggaugcacuuauccugcguagauggauuguaaccgugauagagggggaaaaagaagaggggaaaaaaaaaccccuaaaaaaacccuggauucugaagauggcugcaguauauucuucaauagaaauuugaagcaugaaguggauuuuagaacaccacaugaagcucuucuuacuuaaaacacaagaacuuaaaacuuggccaggggaaagguguagggagguggagaaaagcacuccuuccauuuaaggggaaguaagcacuugacuucaucaauugugguuaagauaaacaaagcuuaucuuuuugguuggcaucagaaggggcauuuaaagucucaugaaaugagagaaggguuguucuguuccuuauuuacuguacuugaacggagucacugaaaaccuugaugggaugucucuaugacugcucauuccuaguugucugcagcacuguggccagugaauaugcugguucccacagaggaaggcccacagcaugguuuccuuccucuucuuuuaauuuugccucgugucuuuuguagacgagagugcucugcaguaauucuuuuguagaaacugccaugccucaaaucacauuacauaauacaggcuggggaccagcauuccgugaggacuugaucaauggguugggaaacaagguugauagcauugcuguggaggagaugucaaugcgaauuugucagcucaccucacauccuugcuugcagaacuuugauuuuauuuagguguucacuuccauguggacuugaguucagggggguacaucuugauuagucuauuccagucauuauauuucuacuccuugucagugaugggcuuaggaagguccaggucuggcuggcuggacaugaggggaaaucuugugugggcacuucuagaaaacguuuccuugauuuugaugaagagaaguauaauuucuaucugguuguugucugcauguggugcuuugaaauuggcaguugccaucuuugaaccgugagccagcguaagaggacaggcccacaugcaggggacagcaaagcuguacaaaagauagauacuaucuuugaugauauuguggagcuguugaauugaucagccugaguccauuccauuuugggacuucuuguuaugugugagaaagaaaaaucacguuuuaacuauuuuggcuggauuuucuguuuccuucagucuaguguauuauaacugauaacuaucuuaccccauucauacaggaugguuugagauaaaauuagaaaauauuggaaaugcuuuuacacaaguaugacacacacaauuaacauagacauuaacauaaauauuauauuguaauguccaguguucucauacuuugcuuccauaucacuucugcuagcauuuucuccaaagcaaggggacaggccaugaggaugaaaaacagccauuuaaaaacugucuuggggguuuucaguauucuuucuguaagaauugacaugauacauaacuccuaaaacauaguauaaggcaaaaauuauucuuuccugaugaacuuguauuucuucuuauuggaaaguggcaaauaaaauaauccaguauaggaggcaucaugcuaccugacuucaaacuauacuacaaggcuacaguaaccaaaacagcaugguagugguaccaaaacauacauauagaucaauggaacagaauagagaccucagaaauaggaccacacaucuaaaaccagcugaucuuggacaaacuuggccaaaacaagcaauggggaaaggauucccuauuuaauaaauggugcugggaaaacuggcuagccauaggcagaaaacugaaacugaacccuuuccuuacacuuuauauaaaaauuaacucaagauggauuaaagacuuaaauauaaaaccccaaaccauaaaaaaccuugaagaaaaccuaggcaguaccauucaggacauaggcauggggcaaagauuuuaccaugaaauccccaaaagcaauugcaacaaaagcuaaaauggacaaaugggaucuaauuaaacuaaagagcuucugcacaacaaaagaaacuaucaucagagugaacaggcaaccaacagaaugggagaaauuuuugcaauccaucugacaaaggucuaauguccagaauuuacaaggaacuuaaacaaauuuacaagaaaaaaacaccaccaccaaaaagugggcagaggguaugaacagacacuucucaaaagaagacauuuaugcggccaaaaaacauaugaaaaaaagcccaacaucacugaucauuagagaaaugcaaaucaaaaccacaaugagaugucaucucaugccaagucagaauggccauuauuaaaaagucaagaaacaacagaugcuggagaggcuguggcgaaauaggaacgcuuuuacacuguuggugggaauguaaauuaguucaaccauuguggaagacaguguggcgauuccucaaggaucuagaaccagaaaugccauuugacccagcaaucucauuacuggguauauaccuaaaggaucauaaaucauucuacuauaaagacacaugcacacauauguuuauugcaacacuauucacgauagcaaagacagggaacuaacccagaugcccaucagugauagacuggauaaagaaaugugguacauauacaccauggaauacugugcagccacaaaaaggaaugagauuauguccuuuacagggacauggaugaagcuggaagccaucauccucagcaaacuaacacgggaacagaaaaccaaacagcgcauguucucacucauaagugggagcuggauaaggagaaagcacagacacaaggaggguaauaacacauaccaggagcagugugggaggaggcaaggggaaggagagcgucagaacaaauagcuaaugcaugcagggcuuaaaaccuagaugauggguugauaggugcagcaaaccaccauggcacacguauaccuaugauuacauagguauaccuguacauucugcacauguauccuggaacuuuaaguuaaaaaauaaguaaauacauaaauacauaaaaauucaguauguuuucuuguugucuuauuucaccaaugagcucagauccaacuuuaaugguuaauaacacuuugucuaaaauuccuaauauaucuucuaauauuuucuaguugguuuuauuuauuuuaguuauuuuaacaacagugagugaucuguaucacauccuccuggaaguaccuuggauuucauuauaacugaggaagcguuuguuauuuguuuaaaugagugucccagauagcuugcaauggagcauauuuauuuguuuacucucuuauccauucacuacacauuuauugagcucguacuaaaaauuagccagacacuuaaaucguuuucuuuggcuugauuguagagcucauaaacaaaaguacuaggaauuuagaauuguagaucacagagcauuagaauaggggaaagucauuuuucauuguugagccugaggagaguuucgaaggugacuugaagguauugauuugaggaaugccgaugguuuucaucuucuuuucccaucacuaaacuaaguauacucccuucagagguagagagccaggagaccuuuauaguagugaaaggacaggaaaggaaggcuuucauagacagccugguacuggagucaguauucaacagugaaauucugggguauagaaaauaguuaauuuauauacuuuaauucccaccugauccccacuccccaagaagguuggaauccuuguuuuuccuccuuuuggaauuugcuacuuugaaggguuuuuuucuuuugaaggaauaagaacagucuguucauugugcuauuuagugcaauuagaauuagggagcaauauuuguucugugaguuaucuacccugacagaagcucugauagaagcucagaauaguuaacugcccucauagaggcuuggggcaucauugcuggaaaugagaugccuaacuccaggacuucauccuguggacugcagaauuaaacggaaccaaagaaaauaagcaacaaaaaacaguuggaacagcuucucaguggacuuacugcugccagucuugguggggaagcaccagugcuucuuggacucuggcuacuuugaucuucccagggugcuggagaaccuggaaggacccagguugucucuccuauguccacuguaagccuugguaagaagcaugaaccuucuguaagccaggacccaacugaccuuuuaagauuuuuuuuuuuuuuuaaucaucugaacaugcuaugccguugucuuggcauugcuuugaucccagaugucucaguuuuaaagagcaccuacacuaaguggcaaggagaaauuagaauuauccauauugaugaugaaaaauaaaccucagagggcuuccaauugcacccuaauucuucucccuuaggauauugagagagugagguguagaauuuaaaguuaaaaaauuuuacaucacuuuacuuaauaauugaaaguuacuuggcuuuggcccuuggcaugauuuaaaucacaauggauuugagagaugcuuugucauugacuuaauuuucaggguuuuaacucauucaguaaguuggcuuggcagcccuaagcagcauuaguauuuugugugacauuuucaaaauauccuuugaaccuaugguaaucccuaaggcagccauguucuaaaacucagagaaggaccuccccaggggcuugaaauaccuguguuuccuccccucaccgacaacccccuacccugcuccccauagcaauguuuugagguugugugaucuggaucuggguugaacuccugcagcguuuuaaaccuuuuguuucuuucuucuuuaauaacaacaguguuucuuacccuggucaucuauugagaaguguaggugaaaguaagcaucaacagaauggugauuuugaauaugggaauggguucuugggagccacugauguaccuauagggacuggggauaugauugguaguucuagaaugacguugcaguugcucuauacaugacccaucacguggaagauccugaccucagcagcacacagcaagcauguaauagcugcagagaauaaugcugagcacuagucaacugguaagcauuacagacuccccugcuucucucucccaugggucaacugguguugaauaacagggagacuaguacuuuggacauuuuuaccuacugaaguugacucaugcuguuccuuuagaaggcuaauaaauuuuuggugauuaacugaauaaauuaacaacaggcuaagagaauaauuacagaccuauuuaggaaaucuaguucuugguuuugcuuggagauucuugccagaacuuuaccuuguaaguuagauauuuuuaccuguugcuucucagaaaaaccuacaagcauacucuuagguuuauaccuucuaucccuaacaacaacaaaaacauuaacuguaaacugccuccuguuaucugaggguaaagucguaaaaaucaaagaggaauuuugaggagaaagucuugguaacagaaaauacuaauuaguugucuguguugugagauguguugcuugagagugucugagcuucagagaauguauaauuucccuccuugauguccacaaggagcuucuaggauacuuuauuaaaagacgaguaaucaguuauuauucuucguagguauaucucaaacugcagcuuuaaacagaaucaacuagagggcuuuguuacaauacagauugcuggacuccacuccuggugguaugguaggucuggaaaagggccugagaauuaaaauuuuuagguccuccagugaugucuagguuaccgguccgggaaccacccauuaagaaucacuguuguaucugguccucugccucuuucugcacaucuuauauccaugcagcagguaugaaaaugagcuccccaaaagcauucaccuucacuguugaccugauuauuauauaauuauaauuggaucucaaccuuuuaaaaggccaaucguaucugaacuacauauuaauuauaaaucuuagugaaagcucuauuauauuaucucaauuuuuuuuucuuuugagauggagucucacucuguugcccaggcuggaaugcacuggugugaucuuggcucacugcaaccucgucuccuggguucaagcgauucucaugccuuagccuccugaguagcugggauuauagauguccaccaccacgcccagcuaauuuuuguacuuuuauuagagucgggguuucgccauauuggccaggcugguuucaaacuccuaaccucaggugauccgccugccuuggccucccaaagugcugggauuacagguguaagccacugcgcccggcaauuauccugauauuugauccugaaaaaucuugcuugaacuugaaacuuguccuagaaugucuuugaaaaguucauauuccgauaaguguauuacauucuacaacaauuaugcuaaaagguuacuucacagaaaauuauauccacacucaugauagaaucauuuggaaguuuaaaaaauauggucaugguuggacuccauccaagacugauugaauaugacccucugggauugggcaccaaguaauauacaauuuugaaaaauuuccaagggauuuuaaugggcagcuaggucaugaaccacugcgauaggccuuggagagggaggggagcagcagggcucugguaaguccuuuacacuugcuuuaaccugcugcucuuuccccuucccacuguuaaacuccccugcaccucuacgucacucuucuuuacaggcuggcuagcgucaucacauuguaggucguuuucugugggcuuaggaaaacaguccaacagacuguuacccuagugcgugcaaugaaaggccuuuauucuuaggguucaaauuauuuuacaacgaaauuguuuaguuuggagccuagccaguuucaucucuucuauacuccagguugaucuucuguuuuagaugguguuccucacucugccuucuucaccugaauaaaggaaaggcaggcaauguuuccagagcuccugagccacccuuagugcuggaggcagguuuaggaaagagcuggcucccucauugcuaaacagaauuaauguuguucaaucacuuuauucuggcucugugaaauaauacacaggaggaauugcugcuuuaugacuuuaaucugauaaacuaccugcucugguguguuacauucuguguguguuucucugccaccacugcagaauaaucucagccuuauguguagcaacuagaaugcaagguucaaaacucaaaccaagccuugaugcagacgucaaauaagaacuacuuuagaaugcucugugauaaugcuaggcacuuagcaugacugcuggggcuccuaaaaggagccaggaagcagcagagccugagaauccuauaacauuuccuuuugagcuugggccugaagcagccaaaugcuguaaccaaauaaaagccaguuuaccuuuugcuuuucuuaugucuucuuuucuuguucucgucuuauaaauuauguucacacuuuuccuuuuuucuuuuccauucaugccuuuccuccguuuucucuguacuccaugcaucugccgccugucugcuugcuugguuuuucuucuguguucucucagcuuuucacuuuuggaagagucaggaaucuuguauauuuugagaauuagcgaaacaucguggguauuuauccaaaguggaccuuguacagucucuuuuaugcucguuuuuaaucucaccaauuucuagaaucucacuaauuucuagguuuguuaagggacaacaugguguauugcuggagaucaagacacaaagaguaacagagccucagagcucauuaaugguggucugaaacaaggaaaggagaauuaaaauaauguccuuaacccaggacauaagagauacagauagagagauggcaaaauccauggcauaucugugacgguuuucuuuuuuuguagaaaauaucauaaauagaucuuagaacucugaucuucugauuuuucuuaacacaguacucuagggagaggccacuagacaagaugaaucccaucacuguuagugggagcuuagagggaauuuuaggugagggaaaauacggagauaaaugccaucuuuugagauaggucuuuugauucaguguugaagauuugugucaagagacucccaaaccauaauagauauugcaggccuucccuuuacugccuguuaacccaggcaugugacaagagcaagauuucuagagauugccauagaggaagaauaauuucagugacuuugggaaagccugaagacugauuuagggugaaaggcacaugucauuaaagaguuucauuauagauugcugguuuuauuaggagguaagugguuggagacauucguuuccuggaaucauguaggacauuuaaaguguugaaugcuauauacaacaccccagaggugaagaagauguuuaucaauuuaggugcacagaugucagucugauuauugggaagagggugaagagguuugacaguaucagaguauggacacauuugagcagcagcagcucauuguccuagaacgaauugccuccuggccgugauuuauugacauagcugauggagggacucagcagaagccaccauuuaucuguuucuucaguugaccauuggaaagccuuacaaaauuaugugcgugagaaaugucaaagugacagauuuggguucaaaagauuguacacuuuuauacauccacccuuugcccuucuuuuuggacuugaguauuuuagacaaaacuaacauuuucuucagcuuaguauaaacagauuucugcucagauuagcugagaaggcauacaccauguuauccuuuuauggaugagugauacaugugaugucuuugucaaauaggaauugcccucugccuuguguguuuggagagaugacuggccacaccucugaagcaaucagcuguggccaaauuaacauaauaugguaccuguacauaaaacuaaauauagaacaauuuuaucuuuuuguaguaaggauacuauauuccgaagaauucauguaaguugaauuauuuaaaguggauuuagggacauucauuguaaaguuaaucuuugguaaauccuuguguggugauuuuuuuucucuccucuuuugcauccccauuugaaagcccacaauuuaaucuauuuggguaagguagauucuuaugugauuaaaucacuccaguuuauacgcauugaggaguaaagucaccagacuaaacuccucaggaacaaugacagagaguuuugccauggguguuugggaaaacugcauuuacuuucugcacacuuaaacucuguuucaguccacauauuugcacgccuaaaaaaauuaacaaauuuucacaguaacaaugauacuagcguuuacuuauugcucaaaagagguauugaccgcuauagugugugugaaguuggaaacuuuaggaugauagccauaguuuguacuucgagcucacucuagugggggaaauagacaagaaaacccauaauuaguacacaguaaauguuagguauauuucucaugugaaugugugcaguaugguaacugcucguuagaggggacccuauagaauugauuaccuauaagagaccuugacugcgcuugggauaguuaaggaaggcuucaugaaauagcgacaaaucaggguuagcuccuggccugggaugauggcuaaaaggacuaaagggcgagucuuugccucaguuucuuauuugaaaaugaggauaauaauaauccaacuuuauagagauuauuaugaggauucugugaaacaaaugcacauagauaguuaggcaguccugguaauugggaagacaucaauaaugauguaaguuauccaugucccuaguccuuuauuucuuacaacaacaauccuuucaagacaguaguacuuucccuauuuugaagaugcucagagagguuaauuugcccaagguuacccagcuagaacuugguaggguucagcuuugaaucuagacgucucucuccugguuaccuuuuguucucuuuaugcuacucagggggcccaaaaugauuccagcugcuuccugcuucauuaucccccuaagugccccacugagaggagucuacaauugccugccccuccucucccugccuccuggucuugccaugagucacugcugagccauuugugucagagaggaaaaugggggcuugcuauucacauguagcaauuugcuauguguucuugcuuauuugccagggacaccagcagagaagcguucaucaagaggcgucauguuuguuaagggaccacaugguguauuuuaaaagcucuuaacucucucugguaucaucgauuaugcuuuagcauaagaaauaaagugacacugagccucuuauuaauaauacacguuuuccauuuaacuuugacugguuaaaucuggcauaaaaugcagacuugcaaaccagccucccugggauguguagcuucucuuaggcuauuuaugaugcggaucucuguugagcagcagccucugccugcagcuaaggcucuggacuagauguucucuuuuccuuuucucucuugauggcauggauuguuuuguuucacaaggcucauguucuagaugggauuguagcuggucuacuacaagcuggucuaguugggauuguagauugguauggauaaauacugaaaugggagcugguaucugacaacuggagggguuauauaugugcccccauauucugaucaagcuuuggcauuuugugcauuuggcaaaagucaguggucaauauuugaaguuugcaugaaguuagaagaauuuugggcucugaauaugagaugacuuagagauaauauguuuauuuuacagauaaagaaucaggccuaaagcgauugaugaugaugaugaugaugauagcagaaucucuaacaaugguuaagccagacacuguucagagugauuuuuguguuaacuugcuugaucuucacaaugacucugucagguagacaguauuauuaucccuguuuuacaagugaggaaacugaggcacagagaguuucagucauuugcccaagccacauagcuggcaggugauagagcugggguuuguacccaggcuaucuggauccaucaaaaccuuugcuaucuguguaucacuacacuguagcuuguccagaguuacaaagcugggcaggaauaguccaggacccaaaucccagucuuuuguuggcugaacuauauuuguuauuuaaagauucuuuuagcaguggaacucuucuuuaaauggagauauuacuagauagcacaaccaaauaaaaaaaguggaaacuuagcugcugugguuuaagugggauaggccaggcauugaccaugcauucccuuuauucagcccuugcuguggcuucugagaaagccacauggagcauaguuuuauuuuauuuauuuuaauuuuuagucccuacaacaagacucacaguagggauaugauuuuaaacccuggcucuaguuagggauaugagcuccagauugcucucuuuugggucacaauuaaaauccuaaccggcaacagauauuuuuggucagaucuggucauucucucugccuccguacccauugggggcaaacuaugaagcuuuuguagcugcauuauuguagauuugcaggauuucuguucguaaucagaaucggguauguguuagaaaaaggccuuccugaguguaugaaccccuuugccugcugacagucucugggcuggaguuaacauuaacaucugcaugcccagaggacagugaauugcuaacuuuucacuggcuuucuuuuugcuuggacauuuuacagugcuccagggucaucauucugggcaguacuuaccuuguaaguaccugauuuuggcucuuuucucacucacuagucugugaucuagucuucucucugugucugcagaguucagucccauuucuggagcaaagcaguagcucaguaaaugucaguggaguuuuuugaaucacuuuuuauuauuccagauuauaggcauauauguauagaucaaguaggcugaauaugacuuaauccccaaguuucuucuauaauaggaccuuauuuuaucucuccaaguaauggaauaaagggauggaagcuggucuaguugggguuguagauuuauaaacaagacauuaaucugaagcuuauauucuuuuagagaguuacaagaaaacccaagaucuccccccauccccaauuaaacacuuuguucuuuguaaggauaguagaguaguaggaguggggguauucaggaaagcaggucuuaaggcagaagaaucacaucaacaucccaaguucuauuccucacugccucacgaauggucugcuagccaccugcaguuguuguuguuguuguugucguguuuuguagguaaaggaaauauggcaggagagugaaguauaagagguccaggagcuugguggagguggaggagaggggggauggggaaagauaaagaggcagauaagaaacaggaaucauuguagaccagugguuuucagaguguggucccuggaccaacagcuucagugucagcugggaacuuauuagaaaggcaaauuugcugguuucacucuagacccagugagucaggaacucugaugggggugggcagcgucuuugaaaaccuuuacuucacuaacuuuuucccccucuaucuuaaauauucccaauuguuuuagguuuuaguugauucccauauuauacuucaauugugugucagugaguaggucuguauuaaaggagaacuguugaggaaacauaaagaaaucucuuuguauuccaaaaagcguuucucagaguuaaauuacauguuuuguuagugucuguugcuuuuguucagauuaagcucugaaacaaaauuaagauucucgucaaggcuugagcuuauuaauagcuguuucauuuguuuagcgcuaauuuaaaaugucugauaucuguagaggaagugcuuuauaaaaacacauacuuguuaaguguuccacuaggagaagcacugugaaguccaaaggauguggagauuaggcaaauaacugugguuuuguugagcucucuucaguguaauauaugugugggugggauaagaacacugggcuucacaggucgaagaggcuuccacuggucagauuucagacaauuugugcauucaagagaauuacugcaacugaguguaaaacacugaacaaauaaaaauucuugaacucauagugaugagagauggggugggaggagagaaagagacagacagacacucugggcaucauuggaggugacuaugaugucaacuucucauucuauaaauuguaaauuacaugaaacaaacacccugucuuuacugagaaacuguaguucuuucaugauugguaagagaaaccucugcuuuacaaauggaugcuaccaaauaaaauauagaaggauacagaauaucagcauuugcauccugcagugaaaauuugaacaggcaagugccgucaaugcaaaacuaguugaaagcauguuggggaacagaauaaucuuauuagagaauaacccacaaauuaccagcaaaggggaaaguauacccuuaacaauggcggucaccaccuuaacaaagugguucaacuuagcaucacagugguaggauagccugacaguaggagcuuccugaugugacgaacuacacagcaucaccaacaauuuaugccaaaaauguuuaaccugaaucuaaccagguguauuaggcuguucuugcauggcuauagagaaaugacugacacugaguaauuuauaaggaaaagaaguuuaauuggcucaugguuuugcaggcuuugcaggaagcauggugcuggcaucugcucagcuucuagaaggaggagagggguuggcacaucacaugacgaaagcaggagcaagcaagagagagugugggggaggugccacauacuuuuaaaugaccagaucuuucaagaacucacuaucacaaagacagcaccaagccaugaaggauccacucucaugauccaaacaccucccaccaccagcauuggggauuacaauucaacaucagguuugggcagggacagauauccaaacuauaacacaagguuuacagaaaauagaaggguuugaaaaacaaauuaauccacaccaggaagaaacagaccaaaaaugugggucauucucaagaaaacugguaugucugaucuuuucaaaaagccagugucgugaaacaaauugcugguggguauuacuccggauuacaagagacuaagggaacauaacagucaaauucaguguacaaaucuugaugggaucuggcuuaaaaauuauaacugcuguaaaagauguuugaggcaguuguagaaauuugaauauggacuggcuaucagauaacauuaggaacuuaaugucuuaggugugauaguauuuugguuguguuaggaaaauaucuuuauucuuaggaguugcuuauuaaguauuucaugaaaguaucauaucugcaauucacuuucacaugguuccaugagagagacgagugcauagauaaggugauuuuggcaaaguuuuaacaauuuugaaucuaaauaguaggcauauggguguuuguuuuauauuuauauuuauauucagcauagagaaagcugugaauucaggaaaaguuuauauguaauuucugagauuucuagcucaugcaugcauuucuguuugagaaugccuuaucuagaauuuuuuaucaagaaaucugaaugguguuuaagaauaucuuaucuagaaauauguuggcaucuuaauauuaugguuugguagauaaaauggauuuuuuuaaaaaaagacuugcaaagaaguggaugaaaugcuaauauaagaaaauuagauuuuauaaggaacaugugaccagauaaacuuguccuaauuauugugagucucuuuaaagcacauaccuuaggacauuguguguugacgcuuuuacuguucauaacauauucuuuaagaauucucucagagccuuaagaugauuuguuuuugagaaacaucugaagucuccuguagcuuauucugauguuaugaaguaagugacuaaauuuugaucacagaagugugugacagggaaguagugggauauucuuugccccucuuuguguccugugaugcugguggaaauuucaaaggaagaguuucaaaaguaguuuacuuuguucaaacucucuagcccuaaaccaucagugacaccagugaguguuucuuauuuuaccuauuuggguguguuagauguauuuucacugggacuauucuuuuggucagagagccuaaaguuaaguguuugagcuucugguccugugaucucagcaacuggacuugauucaggugcuuugacucaagggcacagugguagcaucaccaaaaauagaugaauggcagcagaucccuaauggcuggcucucugcugguugcccgucucagcucaggacuuccgagagguauaaaaccucacugauagccaggcauaauggcuaggguuuacucagagaugcugggggcuugaguguaguauugcucuguuguaggcugauaauggaguaugugccaggugggggcaggaugguauccaggcagugugggcaaagggcugcaguuagucccuuguuacacucagugacaggugacucugagcugucuggaaguaagauaaagugauucaaggauaggauccauaccugaaagagagguauucagaauagcauuugaagucagguagacuucagcucuuccaauggaccugcaagagguggucaggaaauaucucauagaugaauuaaagaaguguuacaugaaaauguaaaggggcaaaccaaauaaaauggguucauuaggucccaggacuaguggaggggcauucauguuggaauggagaguagugagaauuggggagggguugcauaggggcuuguucuuagggcagaguuuuucaacaacagguauauauaagaggucaaaauuuaggaagucuguuagagaagauuauaaacuccaugaggacaggagacaugucugcauuguucaacacuggauacuugauauaaugccuggaaaauaguagaugugcaguauaaauuuccguugaaugaguaaaaauguuaaguggcgaauaaaggaaugcauggggaugauacagacaaagcaguaaucuguggugguugauggcugaccugguuguagaguaccagggggaaugugaauauuuuagauuuccucagaggcuaguuucugagauguuuuguuuaccagugugguaaccuucucauggcccuagcucaaaugguaaucaacuagucuuugcagcacaacugugagguaaacaugcuguguccauuuuagagaagaggaaacugagauucagagagaugaaggaauuugcaugaagguccacaacuaagaagauaagaugugaaacuagauauuucagcucuugaauacaaucuucuuuuuacuugagcgcucaaugcuggggacaguucugcuuuucaaguggccugauaaauaguaucuuuguaucaugugagaguuauuaagacugugauagaaauaaauaaggaaaaauucacauaccagccaauccucguuacucugcuuauuccccuauucaucauuuggcugauugaauacugaagaugauaaagcugaaucgguagagcaaugugugauuaaaaaaaaaucugcuauuccacuuaaugggcuacaguuauuagaaagaaauagaaaccccaguuaauguuaguaugggcuacuuauuuaggaaaggagauuuuuaaaugaaauaagccuuuccuuuuuauuauauugcuggagacaguuuucauuuuugcccaccugguacuuaaaugguuauugcuauaaggaaaccagucuuacugauaaccgaaugaaauaaauuaaacagacacaugcaaacaaauccaaaaugugccugagaaagauguggucuucuagcuuucagucauucagugagacauuuggcagagaugggugcagcagauaaaacugucaugguuuucagaagucauuccaagacaccagagaggaaacaugacagacacuggaaagagacccucuuucagauaugaguaauauauauuuuauacucauauuaauauuucauuggagagaaggucaaaaucuacauuuaaauggaaauauuuaaaaagcagaagcauaauauuugacuaagugaaacacucaggguuuuucaagaacacaagcugcaccccugggaccucagcucucuagaucuguuguuucuuagagcacgguagaauguuugaauuccuuuaguuuuaucgguagaucuuagcccuggcauuuaggaaucuuaaucccucuacuccccuuccauuugaccccgaauuguguuacauacuaccuaacaguguguucagugcacaguauggccucucucaguccuauaaaauuauuuaaauuucuaaaaauucauuuuucugguccugugaaauggacauaauaggauuguggagauggacauaaauaagaugcuuucaauuaugaguaauggaaaacccaucuaacaaaguaugguggcaagaagaugggaauaggaggcccaggguuuauucagaggcuguguucauccuucguuucccucugcuauucaaaguguguuagaauucaccuucaggcuucugaccucaugauuauaagauggcugccauuguuucagaauaauuucuucauggcaucuaaaacaagaagaugggaugccaggagcaaaagaaucuuccugguaccuuuuuccuccuuuuuaucagagaagaugauuuuuccucaaagccuacagaagacuugccuuuaugucucauugaccagacuugggucacauuaccacuccguuaucccugcccucaaacuggcaaagagaaucaagaagaccuugauuggcguagaucacucaugcuugauuuccugaggcucgucucauugccucucucagaaacuuggggcucuauuuuuauuagcuaagaagggcaaugguuauugucugccacagugaugcucuugugugaaguaaaggugcauaaaaugcaugucuucccuggacuuuagugcauccuugguuuguaagugacuacgauuacaugaaucagaaauaaaucaggaaaaggaaaguugguaauuuuggccuauuccugcagaaaucauagcagggaggggaguguuugugaacgaagggaggguccaguucucuaaagcugugcuggugaacuaccacugcauaggguggcccucugcugacccuagagcaagcuggaggugagacgaguuugucaggacaucccagauucuuucuucuguacucuuuccucuucucuguuuuccaccaauccaaucaaaggcagugcugauguagucagcacaacuccugggaugcaggugccuggggcugcaauucuguucugacacugacuguggacauucugguucugggcagccacuugagguaacaauaaugauacacaguuccugcuuuuaagagguucaugaugaggagcuucacugcuccccuguugcuuuaugacaggaugaggauucagacuaaaugaccacuucccucuuuucucacucucaaguuuuaugauuucuuucaaguuuauuugggauuuuuuuuuuuuggucugugccuuuuguuaauauauucuacaugcauuuugcuucuaggcauauugauauucacaaaguuuaccacugacaguuguagucugagaguguacagaaaaaaacguaguugaccacucuaugauuauucuggacucugugacucucuuaaugcaagccaagaccacauuagccuuuuuggcagucuuauuacuuuguggcuuuuguuggguuugcagucauccagaauuucuaagaacaauauuuggaagguggcuuugcagagacuugagccacugaacuucucuugucaugugcuuccuuuacuucacuccuuucuuuaauauaugccuggcauugggcccagaauccauaauacgauauucauaauaaauaccaacaucuuuugagcacucccuaugugucggguguuacacuaagugcuuuacagguauuguuucauuuaauccccacagcaacuuucuuccccuuuuucuggagacagagucucccucugucgcccaggcuggagugcaguggcacaaucuuggcucacuacaaucuccaccucuuggguucaaguaauucucaugccucagccuucugaguagcugggauuacaggugugugccaccauguccagcuaauuuuuguguuuuuaguagagacaggguuucaccauguuggccaggcuggucucaaacuccuggccucaagugauccgccugccuuggccuccaaagugcugggauuacaggcaugagccaccacacccggcccccacaucagcuuucuaaucuagguguuaauaauucccauuuuacagaugagaaaacaauauggagcaagcuaagucauuugagcaaaguuauauaguagcaggugguugaggcaggacuagaaucuaggcaaucuaguagcacagcccaggcucuuaaccuugaaaugcaccuuaaggcauuuuauaaauuugucuuacuuuccuuaauuuuuccccucuccccuaccccccaguacaugcauaauugcuuuaaauauuauuacuuguccugucuuucaagcuggcuuaauagaacauacgacguagagaucaaaaguuacagaguacuaaagccguagaauaagaguuucuuuauucauuaauucauccuuuaauuccugauugacucaguuccugagguauuacacugagcguguggauagagagaggaaaaagaccuagcauucugccuuugaggaguucacaaagucauaugguaaauggugggccugagauucuugucccgcagcaaauucugucauucuuuguagaucauggggaaaacuuugcauuuugcucuaagugugcugaguucagaguguaacaucuacuuugcuccgccauagccuuuaaaacaggauucaucucugagccucagcaccaguacaucucugggaaucuaccuggccuucuucauuauguccugcuucccugaccuacauuuuuuuccuuuuucagauugauuuguuguucaaaaggccggugccccuggaaugaggaccuacaagcuuacuuuuauacuagaaaauaaaagacuagaagaaucaagccuuugcucagaucauacuuugugaggugggcaagaguagaaagccgaacacuugaacgugagagcgaggagggagccacagaugaagguugaggacagagaaagggaagcuggagggcucuaaacuugcagaggccugaccuggcacuucaucugucgccucugaaaacagcucugcucuugcucuugcucuauucucauccaaguacuaggcgauccuccuuuuaucacuucccaguuucuuccuuuaguuuccucuaaggucauuccuccuuugcacuggauuuacuuuggaguaacaguuguuggugggagguucugauucugcagagagagaaacugaggcaugggauagagaacagccaucuguacuuuguccuguaagucauuagagacuggcagagccuugucauagaucccgugguuugcuguaagccacagguggcccucauacccucauaggaauagggaccuucuuccuuccuuaacaugauuggauuuuguuuuuaccugaaaauacgagcuacuucuaacagaaggaaagacgauugcagccuguacugcauugccccuaucuguaaccccauuaagagguuguaaauaguacuauaaugauaucucagucauuuguuuugauguauccaggcuuuuaauaaaucagccgcagcuugcuuaauaggaauaugagagcagagcacguugcugccagcagcugcuaguaaauuauaaagcauucaucuguuuuacaagggaauuaaauguuuguucucuuuaaaggguuuugacuaaacaagggugugugcguguguguuugugugugugugcacacacacaguggcuuccugcccaugcccucccagguacaguagcaaccucagguuccuggggaacaccuguaaccaaagccauaugaauuagagugcccccagguaaacccugucauuauuggucucugcucugcgugcaucucuaaagcaauauuuguuggauuacauuugucuuccacgucaaaggauucugugaaauacaagucccauuucccgcuuucuccuuuuuuucuuaagacugucuagggaaggagcuuuagauaaacuauacauccagcacaacauucaauugucugcacaauugaguuagccuacuuuauuugacuuuuauguuuacauuugaaguggacuccccccgccccccgccaccaccuuuucgacacccuugguuuuauugacuaaauaaucuucagaagacaagacaucagaguuggugcuuuugguggaaauuaaaccacagcagguguuucaagaccagcuuuggcaacacugcaagacccugauucuacaaaaauaaaaaaaauuagccaguugugguggcgugcgccuguagucccagcuacuggggaagcugaggcaagagcauccccugaguucaggaguuugaggcugcagugagcuaugaucauaugacugcaccccagccugggugaaagagcaagauuguccaaaacaaaacaacaagacgugggguccagcuaaccaauauucaagagcuguuggcuacuuaucuugugaccuucaacaaguuauauagguuuuuaaaaucuauuacuuuauuuuuuguuacuuuuaaauuuggaaauaauugcagauuuauaggagguugccaaaauaauauagagagauccagggugaccuucaccuaguacaauauauguguauagcucuaugucguucuuugacauguguacauuauguaaccaucacugcaguaaaagcacagaacuguuucaucaucacgaagaucucccuauugcuuccuuuuuauaacaacuucuaccaccuucccuauccuccccuccacugucuuaccuccuggcaaguacuaaucugccuuccaucuuuauaaauuuuauucauuuaaaaauuauauaaauguuauuacacauuuguauuuauauaaaauauaaaauauaucacauaaauaugaaaauaugaaauauauacauuaaaucauacaguacauggcuuuuugagguugacuuuuuaaacucacuguaaugcuauccaucaaccuuguugcuugcuuuuaugaauguuuauucuuuauuacuaccuaguaguauuccaugguguggacacaucagaguuuguuuaaucauucgcuuauugaggaacauuuugauucuuuuuacuuuugggcuauuauaaauaaagcugcuaggaacaauuauuuacagguguuuuguguggaaguaaauuuucauuucugugggauaaacacucaggauuguaauugcugaguuuuauaguguuugguuuuuaagaaaugucagacuuggcugggcgcgguggcucacaccuguaaucccagcacuuugggaggccgaggcggguggaucaccugaggucaggagauugagaccagccuggccaacauggugaaaccccaucucuacuaaaaauacaaaaauaaauuagccgggcguaguggcaugcgccuguagucccagcuacucgggaggcugaggaaggagaauagcuugaacccaggaggcagagguugcagugagcugagauugcaccaguguacuccagugcaacagggugacacucugucucaaaaaaacaaaaacaaaaacaaaaacaaaaaaacccggagguugcagugagcccggaucaugcuacugcacuccagccugggcaacagagcgaaacucugucucaaaaaaaaaaaaaaaaaaaaaaaaaaaaaaaaaaaaagucagacuuuuccagagugacuguaccauuguacauucccagcagcaguguaugagggaaucagcauccuugccaggauuuggaauuguugcuguuuuuuaauauggcuguucugauagguguguaaugauaucucauugugauuaauuuggauuucccuaaugguuagugauggcagacauuuuuaugugcuuauuugccauuuguauguccucuuugaugaaaugucuguucaugucuuuugcccauucuuuuggauuauuugacuuuuacuguuaaguuuugaaauguucuuuauguauucuagauaucaguaucuugucugauguaugguuugcaaauauuuucucagucuggagcuuggcuuuucauuauuauaacaggaugcuuugcagagcaaagguuuuuaauuuuggugaggucaaauuuaucagcauuuuauuuuauggaguaugcuuuugaugucaugucuaagaaacucuucaccaaacccauagguccugaagauuggcuccuaugucuucaucagaagcuuaagcuuuacauuuuacauuuaaauguaugacccauuuuaaauuaaguuuuguguaaguaugagguuuagguugaggcuuauuuauuuuuugccuaugaauaaucuaauugcuucaacacuguuuaaaaggcauuucuucuaacauugaauugcuuuuggaucguugucaaauaucaguuggccauaguuuugugggacuguuucuagguucucuauucuguccguugaucugcgugucugucccuucgccagucccuuacuguauugauuacaguauaacuauuuaguaaguuuugaaaucauauagagugauuccucuuacuguauucuuuuuuguuaauaguuucagguauucuaguuucuuuccauguaaauuuuuagaacaaucuugaacguauuuacaaaaauuuugcagggauuuugauaggaauuaugaugaauacuuuuauuuuuauguuuuguagagacagugucucgccauguugcucaggcuggucuuaaacaccuggacacaagcaauccccccaccuucgccucccaaagugccaggauuacaggcguaagccacugcgccuggcccauaugugaaaucugcauaucaauuuugggagauuugauaucuuugcuauacugaacuuucccauccaugaacacuauaugccuuuccuuuuauuuagaucaucuuugauuucuuuccaucagcaauuuguaguuuuuagcauacagguccuauacaucuuuuguuagauuugcaucuaaauauuucauuuuucugagacauuauacauaacauuguaauuuugauuuugcuuuuccuguguucauuguuaguauauugaaauacaauuuguuuuugcauguuggucuucaacuuugcagaguugacuucuaggaguuuuuauuuagauuuuuugggauuuuuguaagcauaucaucuauacgagcaugucaucuauaaacagggacaguuuuauuauuuacuuucugauauaccuuuuccuuuuauugccuuauuaugcugguuggagcuucaguacuaugcugaauagugguagugagaguggacaugcuugucuuguuccaaaucugaagugaacaagcauuaggucuuucccuacuaaauuugauguuaguuguagguuuuuggguaguuguucuuugaagcugaggaaauuccuuucuauucuugguuuuuauaaauauguauugaaugcuuuuuugcaucaacuaugauggauuauguugauugguuuuugaauauugaaccagcuuugcaucccuggaauaaaucccauuuggucaggauguauaauucuuuuuauauauugcuaaauuuuguuuacuaauauuuuguuaaggacuuuuguguuuauaagagguaguaugugauuuuuuuuuucuuugcugguauuuuuaggguaauaguagcuucauaaaaauuggaaagugucugcuuucccuguuuucuuuucuuuuuuuucgagacagaaucucacucuggagugagauucagauucagauuccuaggcuggagugcagcggcucaaucucugcucacugcaaccuccgccuccugggcucaagcgauucuccugccucagccuccugaguagcugggauuacaggugccugccaccaugcccggcuaauuuuuguauuuuuaguagagacaggguuucaccauguuggccaggcuggucuugaacuccugaccucagaugauccauccaucucagccucccaaagugcugggauuauaggugugagccaccgugcccggccccugcuuuucuaauguuaucauuuauugcuaaaaguuuaccguuaguacugcuuguguccccuaaacuugguauguuguaauuucauuuucauucaguucaggucauuguuuaaguuauuuugaggcuuccuguuugacccauagauuauuugccaguguguuuuuuaguucccaaguuuuuuuagauuuuccuguuaucuuucuguuauuuaugucugcuuuucuuucauuguggucagagaauacacuguauaugauuucaguucuuuuaaauuugcuaagguuuguauuauaucccaggauauggucuauguuauuuguucugaggucauuuaaaaaaaaauguggcuuaugcuuuguuaaguguagugugcuauaaaugucaguuagauccuagccuguugauggcauuguugaaaucuuuuacauuugcugauuuucugucuaguugcucuaucaauuaauuguugauaaaggggcauuuuagucuccaacuaccuuuugucuauuucucuuuucaguucugucaguguuugcuucacacuuuacaacuccauuuuuuugccacaaauacauuugggauuacuauauuugcuugauugauugacuuacauaucauuuuuaaugucccucucuguuucuacuaauuuucuauguucugaagucuacuuauuuuauucauguagguacuccuguuuucuuuugacuguuuucauuguauauauuuuucauauuuuuacuuuuuacauauauuuaucauuauacuugaagugaguuuauggauagcauauaguucaugcuuuuuuauucauucaaccaaucuguauuuuaauugguauauuuagucacuguaccuuuaaugaaauuauugguguguuagaagacccaggcagcucaucacuuugaaguuccuugcauccuaaggucccuagcaguucugccuguucucucuaccuucaagaaucuuuuaauguucauguuauauauauaacacccaggaauuguuuuacuguacuuagcagaaaugauaggaaaaguacaucuguuccaucuuucuggaacugcuucuuuacuuuuaaaauuaaaaaaaauuauugauacaccuauaccacaauauugcuguaagugagaugaaagugaaaaaggauucaacauuuaaauucuauuuggacaucaguuauuauaucuaagugauauaugaaaucauguugcucuagaacaauauuaacagauuuuaugagguucccuuauaggaaugaaaauuuauacguguacucuuucuuucucuuugacaccacucuacccuuuucuccuucucuaacauauuccauuaagaaauuuuacucaaacuuaugcuuugcaguuggaauacccuaauaccgauuauaaguccugaaucauuuauuaaguaccuuguaauugcccagcacugugcuaccaaugccuuucagugacuuucuaaauucacccuguuagguauaauuaucuuacuguguagcugaggaaacagaggcuuagagaagucaagugauuugcuaaggucacuuagcuagggaguguuaaaacugggacuugaauacaggucuuagaguuuaaaguucaugcucuuaaccuuuauguuuuacuuccucccuguauucucuuguacuucaucaaccugaauucuuuagagcuuuuugaucuguugggaccuaguuugaauucuuaagcauuuuauuauuuuuauuugcuucaaugaaagguaaaagauauaaccuagauuuuauccauugcuaguuucuuuuagugccauagugguuuuaucugucagcgugucuguguguuucuuaauguuccuagcaaaauuuaagaugugaucuaguaacuguauucuuccaauugauucaucuuuagugucacuuuaauuuuauuuuugaaaaauuaacguuaucuucucauuucucuguuggagugugauugagugauuaauucagcaauuauuuauagagccuacugugugauaauuauugugcgagaugcuggggauauucaguaauuauguguuucuuuguucuuguaauuguucugugacuuuaguuacaucuuucuucagaaucuuucaauucacaagucaucuguaagauuucacucauuuucuauuucuagaguguaguccagaaaccauauguguuugugggaguuugguuuaauuuuggggaagauauugauacuucuaaaguuagguacaccauggucuacuguuuacuuuucaaugcaaauagagacuuuauugaugaaugcuuuccuucucaaguacauguuuugagauuggugaaaaucuacagaaaacaaauaauuuuaccccuuacgcugaaugcugggaaaagaaagggucuugucuauaaauuaagagcauuaccuaugagcuucacaauguacgugauggaccuagucuguguaaaaugaagauucuagaagcagaagaaaauggcuucaaaagcaaaucagagguuauaguucauggacaagcuaaguacuaaaccaaucuuauuguugugaaauuaacauuuucuguuuuaucucugugguaucacggaauuuuauuauuggacaggcuaauagagaucuguuugagcagccuauucauuuuauagacaagaaaccugacaccuguagagguaaaaugacuuuuaaggccuuuugugauuuagccuccaaacuugaagaccugggcccuuguuacuguauccucuggacugcauuuuaguaauauuuuaucauuucauuauagucucauacuuacccaauauucuuccuuuacaggguuucaguuuucucaacucaagagaguagauaaggcacuuaauguaguucauuucuaguuggagucuguaaagguuuaugaauugcuuuguuaauccacgucacuuuguaucuuagcuuucuagacuuuaaauguugguuguaguccguauaacugccagacuuaacuuauaaugaaugccuucagguagguagauauuuguuuguguguguuccguaaagaacaaacaaggggcuaagaauuaucaacucuugcugugagggccccuuagccaggcuuccacccucugccucuucagucuuagggacuugucaaccaacuucugcuucagggccucagggauggugggugguggggaccuuagguuggcuaauuuuaccauggcaugacuuccauuuuuaagaguuauuuucuuggauugagacacaguuagcuugccuguggcuuccccgcagugauucuucugaguggauggaauaaaucaaguuucucuguguuuccugacuaaauauugcagguuguuugugccauuccucacuuuuuggauuuuagauaauucacuauucuacaugcuucauuuuuuuuauguuuccucaggugagccccaacuuuuaacugaguacuuuagaaauaggcugagucccaaggggucaguggaacuuucuuguuccaccuagcauaggccugaaacagaggcucagucuugggacuccuuccuucagccuggaaggaagaagugagggagaaaggaagaaagugaucaccaaggcaggccuggugccuagaagcugagcuuugagaagcauacuuuaguaacgcauuuucuguguccucuccucaguuaacucgucucuugaaucuuuauuauuaaaaauuaacaccugaacugguaaucucaguuccugcggucccucucuguauuucaacuuuacaucagccacuuuuuuuaguauuauaaacaggagaucuuuuagaccccuaggcuuccaguuuugauuggccgucaccuucuagcucccucaucucauuacagacuaagcuggaugcauuaacuaguugcauagucuuggacaagucacuuaaguauucucagccuuaguuuccucaguugugcagugggucuccucacaccuacucacuuaagaaauaaaugaaauaaugugugugagagaguuuucugaacaagaaaauauuagcuaaauaucaucuuuccuuguuguacccuuguuucuacaggacacaguuggaucagcggauucagugcuuuuccugggaucucuuacagguucccuccaugcuuguugcccuugacugaugguauauuggaacauuuguacacaguggccuugaacuauagugggcacuugaaauggcaacauuuuguauucuucuaggaacuacuguuuuucuuugaaaagccaggaauuucacggcuccagaggaggggaugcagaagcuauuucuuuuuauuuuccccuguuaaaucaguauaaugagauucuaugugcauaguaauccuuaagcucuuugccuaguuccuuuugcccuaggcaccuuggagugauggaauuguagucagucagacaugugcaguguauucacacauacacuuagagggcuccucgucugcucccccuagcuaagcagccccuuugaaaugucuaauaaaaucccugcucuugugcgcugcauugaaacaaagcaggcucacgcaguccuggaaaugagcccugagagguauuauuucuauaugucggucuuuauuugccuguuuugacagugucguacaaugaggguccugcugcugaugcagcagaaucacaaggagccgucuuugcuguguaaauucucccucaaaggucuggcauucgaccugccugcuaaacccucuuugaaacaaugcaaugacaaaauauuuucuucuuacugauaauaggcagauuauaauugcuauaauugcuucuaccucauucucugaagggaggaaaguagggcuauggaaugagugcuuaaaauuuuuauuuaucgucuuagagauauagaugguucauuuauuauacagaaguuuacauagcagccucuaaguguacguuguuucucaauaguuggaauuaaauucguacuuuuggacuacuguuuauuaagacauucccgggaggcugaggcaggagaauggugugaaccugggaggcggagguugcagugagcuggguuugugccacugcacuccagacugggugacagagugagacuccgucucaaaaaaaaaaaaaagacauuccuccuuggugaugaauaacaccugugugccaaaaggauuuuucucauuggcucugauuaaggggauauccagccaauaaccguagcaagccuuagggugaauuuuuggcaaucuccaggucuagucauugccuuaugggcagucugauggcaccuugggcauugucuuauugcccugagcacagguguuaggggcauggagucugaugagccgugcucugcugucuacccccagucuguucuccagacccccuaaccaaacuucucauagaggugaccaucacaaggaccugguguguggcuagaucagugacaauuuaugaccacuucuggggaaauagcucagagugcacguccuucgugugguagguccaaaauauuaucuuuguauguucaaaguagcauaagcuuuaguugcugcuguugguuucaggagaaucaccuggaugucagugccuugggguuauuaauaaugguaaaaaaccaguaugaggguggagcuuagaaguagaccaagacuugugagucaugcacugcuuuuuaauuugcaagcuaaauaggugcuaaaacucaccuacccuggcugcugagauagucacuuucuccugguccuccucuauuguaaagagaagagguuggacuuaaugcccuucaaggucuuuucucucugacuuucugugaaacuccaaggugaguccuaaauuuuguuuuggucuauaaauuuaaaugcuuccccugcugagcugcuuugggcugagaauagaauggauggaauuuacaccuucucucucucucugucccaugugaugcuuugauuggcugcuaacagaagggaagguggucagaaggcaaggaagccuuggcaaagaggaagaggagugaaaguacuaaagaauaggaacaacugggggucagcccuggaauaaaaaagacuucacagggcaguuacuaggcuugccucacucuuuggaaucaugagagguuugcuagguauguacuguaaggcccguguggccagagacugagucuuggauuuacucuuuuugcccugacauugccuuguguagcacuggauaucauguagguacuaauuauuucuucuuuacuuaacuuccuggaaaccgcugcaauugucaagugaauagaagugaauaggacuguuauauuaaacauuauagagaaggguccaugcucacagcaucuucaucauuccaaauauugugcuuguugaagcagagaaccuugucaggacagucauuguaccaacauuuacgaaaugaaagcaagagcuauuaaccacuguauaagauuugaggauauugugcuuucaaaggaagcaaagaggguuuaaaauuacuccagugggauaucucuuuagccucacuuaaggauuguuuaaaaggaaauagaaauaaagauuguuucaaaagaaaaagaaauaaaguuagaggugaauagaugguauauguaagagcuuuauguuuuggucauacuaaguuuauuguuaaguuacaacaaaaaaauuguuaacuaucaugucuccaguuuugcaggauaauuuucuuuuaauguauuccaaaaacugaccucagaauuugaugaaguguuagacaagaugacaaacagagagacuguuaguaacgggcagaagucauuagucucagacucauauucauuuguuugugguuauugauucuagucacuccuauucuuaucuccauccaaaaauaggcauuaaacccuaaucucuuguggauguuugcuuuguagauuuaggagaauaagaacaugugaccauaccugguuagccaucucaagauuuguuaugagcuaguugacuucaagagccagugagcuggguugugcaggauacuuguuacuggauaauucuacuucagauagaugcucuaguugcucugcuaaaauccucuguucugucaagccugucagagccagagugaaaaaacaaaacaaacaaaaacaacaacaacaaaacccuaguagaguaccugaacucuaaauuacagaguuuaaggacugaaaaugaccuugaggauccagaguaggacucucaaacucacauguuccugggguagacagguagcagagugaaugaauuggacaacuauaagcaaugggggagacugaagagacauucaaauuuagaaaauuuuaaggacauuauaccugccugacaaagagguguuuuuuuuuguuguuguuguuuuuuguuuuauuuucugucucugaugcuugaaucaggaggacaaagagcucugaugcugauucagcugcaauuuugaggacccuugacccuaacuaucagguuaucuauuucugguuuaaggaugaugaccugaguuacagguaggaaaaggcauuuaaccaaggagagacagcuagugagggcuggagccuggggcucugagguguagucugagguucuuucucuacaccauggugauaucugaaggggaaggcaggaacaccuggauuucaaucagggauuuaaaaaaaacuuucuauuuuuuuagagagguauaauuaacauacaaucaaauguacucaucuuaagggauaacuugauauauucuuauguguguguccuuucaugucaccaccacccagaucaucccaagauucuccuugugcucuuuuccaacaucccccacaccccugcaccggaaucacaauuuaccagggaaccauggcacuuuuccuuccacuugcagagcugguccgucugucacuggcccaguuccuccccucaccucccucuccucagauucaauuguaaagagcuauagcaaacacaagggcacauguugcuuaauuuuuuuuucccacauaacccaacagaaucuuggguuucuuuaaaguaagcucucuaauuaugccaaugccauugacucaccaaguaggaugccaggucccacaggguguguccuucacaggguucugaggguacugcuucuugcaaugucaacugcuuuauacaaaagcauauuuaaggucacaugauauuugccaaguuauuaauuauucggaggcuacuuuuccucugaaagaacuucagauguccgaugucaugauuuuauuaaaucaaagacccauauuucauuguaauggacauggcacucaaaaccugggaaucgacucauugaaaauguagccaacacaacacugaaaacaaagcccaccucacaggcaaugcagcuuccuuaaaaaaaauagcugauucccaggcugaagcuguuaagcagauuuuuaugcagggcuucaaguuacuaaaaaagcaggauucaauaugccuuucucuuugauuuguaggagggggugggaaguaaugcugcugcucuccccuuacccccuucagaagggcuuuuaccauauucugaaagcaaugcuugaaggacccauaaauggauuuuggcugucuccuagugcagggauuaacauagaauuauagaagugugcugcauggugguugggaaaauagggaggaugccauucucuuuuuggagggacauggugcucccgucucuugccuguggauguucccuauaaagcagccugucacugugaaaaaugcacacacuguaccaucucacaguuauaaagguuaaguaagcaucuugagcagugccccacugcuuuuguacuuuccauaaugucagccgauaaaggauuauugaaaaaggcuugcaaggagauaaaaggcuugcagguugagguuaaacaauugaaauuuucuguucccaguguaguaaauuaccaauggcagauuuaacguuuguuaauuauuagagcaaaguacuaaggauuguuuucuuuugccuaauuaauuaccucaucuggaguggaauguuaauucagauaaaugauuauuucuuaauaccucugaagcuuuccuuggaaucuccuagaauugccaguccugaagugugguuuccucacauucuggggaagauaggggauaggugaccaacgugacuacucucuuggccuuuuucccgucucagaagauggcaggauaacuuguuuagacuuuuggugauggaguugguuugcuguucuaguuaguagaacaugagugugcuuccuggaauccugugccucauaaccaaguuuuugaguuagucucucgugugguuuugaauuuaacauugaacauucuuuuuaccuuugguaauucucaauuuggggcaccugccgugaacauuaaagaugguauccuuuggaaaggacacucuaguuucuuaacuugcuuuuuaccuuuaaguuauuuuaccuccugaugucuguucagaaugcuagaggcagguuuuuauucuuucuuggaucuaaacuauaucaccucuaauaguugugaauagauaauauucaaaaaagguaaaaucaugacucaugcagauauaaaauauccacaugucaaaaauuuuacuuauuuuaaaugagggaaccagauagauguuacaacagguaccaaggagaaaugaaagaaccacaaauuuauauggaauaaaggaaaugaaaacgaacccacaaaugaacacaaaacuuuugggggaggguuguuccucuaggggacagaauguauuugcauagcuauagacacuuuucagaguuguaaaaucgcccagucagacacaaagguaagugucccuguaggaugagaccauuuucugaaaggagggccauuaaucucuuuugcuuuuuuuuagggucagaaacuuccccuuagacaguuguguaugagguuuuaauccaguuacuuaggaugacauuguaucuucaaaguagauuagagaugaauuaugugacuuauuuuucuuuuuagaaggaagcuuaaaggugacuuggggagaugggcugguagaucugggccauuggaggcgagcuacaacccaugugaccaguuacccugcacagucucuacuccugauaaggcacuuauuuuaugagcacuuuucauaaugauaugaaaaggcagcgggauucugucuaagauuaucuggagugaaagcuggaggcugauauuaaauggauaguccuguuuucuuuuggugcugccaagcugagcuguuuaaaaugaugcuuggaaaaaugccuccugagccaggaaguugucugauuagugaagagauuuccgagacguuuggcucagagacuaccccaucauaccacacauguucuuuuccacauucaccugagucuuccaaagauacgaggacucgggguggugauaggguguacauucuuacauacacauauguguauauuuguauauacagucugucuauccauggguucuguauuaguugauucagcuaaccaugcauggaaaguauuugaagaagaaaaaaaggauguuugauucuguacugaacauguacagacuuuuguccuucucauuauucccuaaacaauauaguauaacaaccauuuacauaccauuuaaauuauauuagguauuauguaaguaauguacagaugauuuaaaacauaugggaggaugugaguagguuauaugcaaauuuuacaaagggacuugagcauucguggauuuuaggaucuugggggaugcuggaaccaaucccccacagauacagcgggacaacuguauucauauaaauauauaggccagagauuggcuuuaggggagucugcaaaguuccauaauuauaugcauuuuucuuaggcaguauugugucugucagauucucauagucuccaaaaguuuuaugauucuucaaaaguuuaagaacugcuuacagaaaccaugcccccaguaauuauucugaaucuauguguuaccacguguaugacuuagaagaagucuagaugaagguuccaccuaauuacagaauccacugcuguagccacagcuggauugaguuauguggcagcccugccccagagcuggggaggcugcgugugugccccuccacaccugaguacauccugggugugcugaaaugaagcccagggagauacaaagcaccauaaugccauuaaggccagcacccguuggguaggggagaggcugaccauacagacuucugacuucugcguuucauucccugcucugaaaccuguccgucucucaggcuugcaaucugccuuccugucucucugacagaccugugacuugggcuaugguucugauaccaggaaauaaugcaggggugggagucuuagucccaagcaaaauaaaucacugcucccauuagacauuacaauguuuaaacccaaguacaucugucugccuucaaaaccaagauuuagagcaugucaagcaggugccaugccuccaauaacacauacuuuguuccaacauuuaguagauuacugugagauuuuaaauucaaauucucagacauucacuuuguuuaggaaauaacugcaauaaagcaaauugucuccuguucuuuuuuucccccuacggugcagccaagugagagcaaaucaauuccuagucaauuuuuuguugcuguuuuccuccaugcuagagaagagaugaugcagcucucuccuguugcagcccugugcugggugugguucccucuccuuaauuugucaucugaaagcaauuuuguucaauuagagauuagaauuaaauuucaguuguagggcuucugugcagaggaaaugaugcauuaaugaacacacagaugucaucuugcagccaugaugcuugcagaacaguuucuucaggauucaaauaauaaaaggggccacagcagcaggagcauuguuuacugguuggcauacuaaguggaggcucacauuuauuugcaaaccauuuaucauucuguauacugagagggagaacauacuuuauuuaaaauauuugaaauaaugacucuuaaaaucggauaacagaagcauuaaugccaggugccaugcaguaaauugcauaaugcuguuggguuggcacugacacugugauuuguguugcuaaugaucuauccaaauagaugggaguugagaauaaaaagagaauauuccuggaaagagacaaggcaacuagugaauuaaaaguguagugagaaagggaaaaaauguguaggaucguauuuuacuuauuggaagacccaucugcucuucuguacacacauuauguaaguuucacucucuguauuacaaauaaccugcaggguggauaggaaguucauauaucugccuucagcuguuuuuuucacucacagacgugaaugaacagaaagauuuaugucuuguguguuggauauuauaggaugguagguuuuuuuuuuuuuuuuaagggcguuguguauuuagacugugauauucugugcacugcuuugcuugaagugagugauggcugcgacuaagaaggcagcaaguggggagugggaguuuggggagguggaaaaggguuucugugagacaauauugguuugucuggucuuugggccugggcuacacacaugcccuuugacacuuaugguuaaaguguuuauuuccgaauggugcccagagcuauguucaguguguccugagucacuguugaauuuuuaaaauuugguagucucugugcuguccagaauuucuuagauguguuuugaauacagagggcucucaguaucagguggcauccacgcuggucauugauguugacagggaugaaaucucacuuaaaacccucuaauuuccuaguucaaggacucuuccuuauuccucuuccccuguugcaaaaggacccucugauguugguuaaggguuaauaguucuguccuugaaauguuuucuuucugcgacaucacauuuuucuuuugcuuuauccauaucuugugccaaggccauucucuuucauucucauuuccuuuuuaaccccuguguguacugcaucaaguccuauuuugcugucucuucgaauuuagagacaucaucagugcauaucauccauuauacaaaaaagccaguaauagcccaauuuuuauuuccuguccaaauuuuucuccucaacuucauauccauaucucucuuccagaaauuuuauuagaagcacaauguaucuaggauaaaauguacccucucccuaacucuuccuuaccuuuuauaauggugcuuacguuuuccaugucuuccuacuuaaaauuguauucauguuuguagucuucucccugacuucacugcucaugaguucuaccuuuuucuugucuguuauaaguccuuuccuuuucauuucuuuugcuaccugccuuguccagaucuuccuuacacaucaccugcaaguagcugaucauccucuuaacugaucugguaguuaauggugucuuuugcucccaagccugccuaguccucugcucaucuacuuauuucugccuacuacuccaaagccuucauuggcuccccauugcccaaaaaugaauuccaaaccucccaguccuggugauuaaguaguucccucccauacccaaacaacccagcccugucuuuuacuaacuuuuccuuauagguguguguuuuguucucccuguucuccccuguaugccuuucaaaacccuguccuugcuaaagcccagcuuggaugccuuuucuuggaaaccuuccaugauugccccccuggaguguacuuuguugcucuagguauaaaugacuacugcacuuauguuaaggcaccugucacauacuguagguauuuaaggaccuccucucucugcuggaugaucaucauuuugauagcauauuccuuuuguuuucaacagagcuuuuucuauuaauuuuaaaugcaauauacuguugcaaguaguaguuggaaaaaaucacagagcaagcaaaguucuggaauacaauuuuuaggucuuccucaacauuccugucacaguagaugauguacacuuacagcagaagacgaugguuagaaagguaagagccuagggucugagucagcuucaacuagaaugugagaacugagauagaaggaauuauuuccaccuucccggggauuuucuagcauagccuauggguugugguuugcccagcaacaccuuaaucuaguugcuuauguuuaguaagcauuuacagccuggguuagccggcugggguucaagacucuuggccuuuaggccagugcuugaugcuucugucagccuggaaaaaggacccauguaucacucagugguucuuuagccaacuugagcaaguaaagaagucuaggaggcagaggucuucugccagcuucagccuuuaggauuguuagggugauguggggccugcucuggugugucucguaaagaggaugaaggagcagugagaauuguguagacuagcaguauccuuucaucugcuuuguugugagccagcuuagguggucuuuucucugcuauuaaaggggaauucugacuccuugaguugaugagauggaguuugggaggcagauaggccuugaggacuuggugggaguuuguaaucugggcggccuggcugaauucaucacaaggguggauuuuuaaauugccuuuuuugcucaccuacucaaauugagucacugagcaguauacuuguagaugcuuuaacaaguagauuauauugaaucacauuuaauaggaagaugacuaacacaagggaguuguuuuauguuuuaaaaacugcucacguuccugaacugcagaagcaccuguucuguuacuuuuuaaaauauggucgugaauauuuuucccuuuuugguuuccccagggcagugauguucugguucugaggucuaguacagcauuuccuuuuuggccuuuuguccuugcuuaaauucucuuccaauucuucccuuccaauccacugacccaggauuagaguacuaaaaccucacuuguuuuuccuuauuuuuguucaucuaacuuaagagugcguggcaaaaaucuuccuuuguuuuuaacuaagcucguuaccuucacccugguuucauaaugugucacccucccucucucccccuauuuuuuccuccuaaauuaaaccaacaggagucauuugaaauaggcgcagugccagaauuagcaaauaaaaauacaggacacauagauaaauuugaaucuagauaaacaaauaauuauuuuuuaguauaaguaugucucaugcaauauuugagaauacuuacucuaaaaaaucauauaggaaauucagauuuagcugggcauccuguauuuuaucuaguaacccuacauaggcauauauuugaaauaaaaauaaaauuuuacauuaaagaaaacauuauaaagaagaaaaauuuaaguuuauuguguguuaaauauucccaaugcuuuccuuacugaaaaauguaagacuguggacaaauuaugaaacaguuugugcauaagauuuauaaguuagcuaccuaaugaaaagcuucuguuggcuauuggaaucagccauuuauccuaggauucagcuuuaucucuuugcuaagaagaugcuccugauuuugaggugagaauauuuagugcaagcgguagaccauuguuacauaugauauaucacaagcaccugugucaaaaacaaauguugaaguauucaacaauuuuuuccucauuuaaauugugcccagcucucuuagcucaauuucuucuggcauaaagauucuuaacacaaacaauuggaugaugaagacaguaaauucuugauugagcgaaguuuuuauccaagacuagcuucccucugucacccagguuauauguggaguacaaacuaauuaugaagcuaaaucuuccucagaccacauaaguaagucuacuccaaagcuuaauaaaaugauucugcaauauuuguuccaugcuuugcuuuuuaccaagccugugcauacguucugauuugauucuccugacagucuaugagagaacagugaugauuugucuccucauuuuauaagagauaaauuugaaauuuugauaggugaaauggcuugcuuaagaucaagcaagacuuaaaucuugaucuuaggccuuuugggccauugcucuuuccacuaccuguauugacuuuugaauguaagugauuugggaauuaggcaguuuaggaguaauuguaccaguguuccccucugcuagcuuggaagaugaagagcuguuuucauaccugugcauugugcuggaagagguauuugccuuugguucagugcauaccuauaauacacauugggucuucuuuugaggaacagcugccuccccuguacaaacagccuuucugaaugaaggggaucagccaccguugaccugugaguuugaaguauugcacuguuaauguuugggcaggauuuuuuugaacaugugguuguaccacagaguuacgcaagcgaaauauucuuggaaaugacauucugcacaaccguagggagaaauauugggaagcuggcaagagagucaauucuaucaguguuuauugagcaccuauaaugugcauuuugugaauacuggaugauguggaugagaaaagauguaaguccuacucaggagcccuuccugccacaguaccuucauuagcaucuccugccuaucagugcuugaaauuccuggcucauuuuugauauauuuuauuucugauuugaggcaucguguccuuuauuuugauaaaauauuaucuaaauauuuuauaucacauaaauuauuaaaauaaaauauuauuuuuuguuuguuauguauaguccccuaacaaaguuugaacuuuuugaggucaaggaucauauauauauauauauacacacacacacucauguacagaagaaguucuugaaaaauauuggauaagcaaauaaauuugugguauucuuggggaaucuuggauuaauaaauggauagcaucccucgguuguuguauaccuauauucaaaggauccaugacucaaugaugggguaaggaggcuaaaagaggcaaagucaaugacugaauugaacauggcauaucaucucaaauuauacugggaaacaacauuauugucuacuuguuaaccaaauauaugcaguugauaucauucaggccuugcacaaguuccuuaguguauaaucuugguccuuagaaugaagugagcagcagguacauauucagagacucauaguuugauggcaugggaacuguaucuuuggagauauaauagaaaaaacugugccuuaucugauuaaaaaugauuuccuaaaaaguacuuggauaauuccuaauugucccaguuuucauaaaugauuuggaaaaugcuguuugagacugugauuguuaauauacuguggaagccuauuaacuucuuuuuagaauucaaaagccuuuaauauauggggcaagagaacauggauugacaaauggauaagaguaacuaacuuuauuguaaaucacuguugauauuuggucccugccuuuguucuuuuguuuuacuuucuuuccucauaggacucauuaccuuuuaacauauuaguaagaccgggggaauuuguucacuuuuuuccuugauguauaacaaaucauauugcuuaaguuaaagcuaaaguagauauuuagguuaaaaauuauguagauauuuaaguuaaaaaugugaauugacuuaaggaauaauauuaagagaacaauguagcaaaaauugucauauauauacauaucugugcguauguguguguaauauauauauauauauauguauucacguuauauacagacauacacacagacauauguaaguaccagggaugaaacaaaaaaaaaaaauaaaacaacauguguuaaguacuguguuaguacuaaagaugacagaaaaaaguacaacccuagauccuuggccagagaugcuuacuugucuuacacuucuuacaguccccucuuuacuacacgacagguuaacuuaaucaggacagacuguauaaguuacagggcccagugcagaaugaaagcauggagccuguuguauagaaaguaggacaaaggugccauuaaaggugguaaaauauaaaauauuuuucuucuaggggaucucucucaacuuuuuaugguguuuuaaauuagcuguuuaauguugcuuuaagugaggaaaaauucaaauuuuaaauugcuagcaugaauuuuaccauucaugguucuguugugcaaugccaguuuuaaaugcagauaugagagcauucaacuuguauguagaaucacugaauuuauacaguuuauguuaugccucauaggcacauaauguauuuuguuuuuaccgcacaguggaaacacugcaugaaaugaacucagagguuuuuauuucacuuguugauaugcacacauuuaaccaacacucucuaccuucagauuacaaugaguaaggaaggacugaaagggacugucuuucccuuuccuccugugucauuuucagugugauuggcuaauacagggaaguaauauguguaagaaaagguauguuaggauuucuugccauucauguuuguuuuagaacacuauuuccagcuuucugccuuuaaauugaaguuuugauuugaagggaaaguauaggcucccaagguugucugucuuuccucuggcuucgucguaaccauaacacacuuauaggguaguccccccuuuauccauggggaauacauuccaagaccccuaguggaugccggaaaccacagauaguacuggccccuguauauacuaugcuuuuuccuauacguacguggcugugauaaguuuaauuagggacaguaagagagcuaacaacaauaacagagauuuaacaacaauaacuaaaacaacaguuauuaaccacaguacuaaaagcuaugugaauguggucucucucucaaaauaucuuacuguacucuacucacccuuuuugugaucuguugaucugauaacugaucugagacggcuacuaagugacuaauggaugaguagcaucuauagcguggacaugcuggacaaagggaugauucauguuugggugagacagagcaggacagcacagggccucaugcuauucauaaugccucaaaauuuaaaacuaugaguugcuuauuucuggaauuuuucauuuaauauuuucagauuguaguugacuaugggugacugaaauugugaaacuggagauaagggggacugcuguacucugauuuuuacugaacugucacauauugcaggcucacuggaguucuauguuacugggacauacaaacacuaugugaauggggcagccaggaauucgcucgcgccuguugcguguauuuuuucuacucauggacauguuccacuguguuauccgacuuaacuuacaaaacaaaguucaaagauaagauuauagagcauuaaaccaagugccgagcccuucugagugcagggcccugagcgauugcacaggucacacacccaugaagcuggcucugaccuuaauagauaaggaagcacagcagagacauaagcugggccugaugcccuguguuuucacacugaggaaagcaugaauuaucucuuacguuccuuguuugaaacucaggcuucaaaaguaggaaagguuagaacaucaauccauugugccuuuccaccuuuuaucuguaacuugcugaaauguuuucuuccuccuccuccuuuucuugucauguuggauauguccuuaauauaucagugucaaguguugugucugaaugugaaccugaauucuauucuaagugcugaaauuaaaacaguguuucucuguuuaguuucuaauguauucgggguacuagaguaucuaaaacagcauuuuaagaggcuuuaacauuuuuugccuuuuuuucucccgaauuauacaagucauuuuucuuuuucugauuuguugucuccugagaaaguaggccucccuuuuuuuuucuugcauguggcagauuaguauccugugguccauugcaaccacuacagugguugguaggaaguagaacuuguagaaggugcaguuaaaacuacuauuaaaguagcagggaaccuucuuugcccucucagaugaggaccaggaaguugacuuucacauuugagguggcacuugauguagccuauauucuuuuuuuuuuuuuuuuuuuuuuuuuugagacagagucucacuuugucacccuggcuggagugcaguggugugaucuuagcucacugcaaccuuagccugccagguucaagcgauucuccugccucagccucccgaguagcugggauuacaggcacgcaccaucacacccagauaauuuuuguauuuuuaguagagacaggguuuuaccauguuggccaggcuggucucgaacuccugaccucagcugauccgcccgccucagccucccagagauauagucuauauucuaaagagacucucuucuaaucaagugguuaucaucugcuaauacuuugaggaaaaaagauuaauguuccaggauuuauaaguucagagaacuagcuuaacagagugcagugcuucacagaucugucuggcuguggaaucagauugacuuuagguugcugugguagcucugcagcauaggagcugggaaauuuaguaaccuuacuuggugguucucagcccuuauugguaugguuaaggaacuuugaauaaacaccuguagagauuugaauuuaguugccguuggguggggcucaggcuuuuuuuuuuuuuuuuugcaucccagaguuagcagucaggguugagaacacuagcuuaucucagaacaucaauauucucauuuauaagaugagagaauuagacuguaugagaucgucgugagaucuaggcagaugaacacagcacuuggccagucaaugugagugacuguuaucguuaaccacccuuacugauucuuugcugagauuggaagcuagauuggcauucauuucuuaagcuggaaaccugugcugauuuguuagaaaugcugcaaggaacagaaaugauuaucuauccuaagggaaugacucagaucuuguuagaauaccaugcccaacuucucaccucccagaagagugugucacagaauagcuggaauuacaccuacuuuauguaugaagauuaucccuggaauagauacaucuuugaggaagaaguugauuuauucauuuguguaauguuuauugauacuuaauaccuaucagcacuucuagacuguggccuggaggaauccauagauugguaauugguuggaaaagugaauguaaauuauaacacagaagaacaaguguuuuguuaaggauaauggaaacuuuaaagcuaaguagaagauagccaagcugagaggccugggugggcuagggaagaagguuauuacuggcagaggaaguugcaguuuuaaagagacuuagaggcuggacacagugggcucaugccuguaaucucagcaauuugggagaccagggcaggaggaucacaugagcccaggaguuuaagagcagccuuggcaacauagugagaccgugugucaaaaaaaaagaacaagagacgugaagacacacuuggcaugacugggaaacuuaaaguaguuuagcaugucuggaguauacuuacuccagaggugggaguccagaagauggugauaagaaagagguuagaaccauaagcagggucccagucauggaaggcuuuauuuggagauugaaauugauuauuggauagccauugaacauuguaagcaaggaaguggcaugcuuaaacuugcacuuuggagaugucacaauccuacaacaggcugaaaggcuggagacauggaggccacuugggauguuguuaauggaaguccagaugaggaggucugaauuaagguaguagcaguguagucacagugagguggacaacagauggcggagauuaagaagguggaauuuguaggugucagccccaggcauugcaucuauuuuuuuuuuccaaguuguggagacggaguuuaucucugucacccaggcuggagugcagugacgcgaucucggcuuacugcaaccuuugccucccugguucaagagauucucaugccucagccucccaaguaccugggaucauaggcaugcaccaccaugcccagcuauuuuuguuuguuuguuuuguauuuuuaguacagacgggguuucaccaugucggccaggcuggucgcgaacucuugaccucaggugugagccauuacguccaguugcauugcaucuguuugauguuggguaucuaggauguacaucugucaacucgugaugccucccugaaccuucgaugauuaucuauugacuauaaucuacccccaacccuuuuuuuuuuuccauuuucaucuuucacugaauuccucuguggauccauugaucacgcuuugcauauuuauuccuucucccccaaccccauucuuccuggaugagcuuuuugcucucuuuuaaaccauugcacuugacugucuaggcauuugccaguauaucaaauaaguauguauuugaaagucuaggugagccuuucuuaaauacuggaugcucagucuaagguauccauuguguuuauggaauuacuuucucuccuguguaucuaaaugguacuaguuugauacuuuucugaagauaauugagaaaaaguaacuuugaucuuuuuuucuucugugguucagaagagaaauuauuuguuucuugcuccuaucugagccagauugcaaauuuagugcuaagauuucuggcauuaagaggauuauuauuauuauuguuaaauugauugucucauuagauuaccaacaugaggcucaugggacuuaaaagauuuaugcccauauccugguuccauuuuuguguagagccugugggaugaaaauggcucacaggucuguuugugacacaaguagcuugauagauggccuaugguucauguguagaaaauguuggcgacuauagauuuauuuuaguaucauuuuaggaagcacaaaaguggugucccaauugaaccuuauggagagagcaucauuacuuuccaucacagguucagacuuugggaccccagggcucuggaaauggaacucuuugaagaggucagagccucuaugcacccucucagucaacucaacugcauguagaggagggaaagaauguuguuauuauucuuaauauucuuauaguagcgucuaauaguacauuaguaaauaguuauucacaaaugguuguuccuauugcuuagcaauuucugauuucagauuuguguuuuggauauaugugcauacugaccuucugccuuuuaauaaaucuagaauucauuugauaguacaaauuaacaaaaccaguuguaauaaaaauauugaauuuuaacuuuaaaaaauaugcaguguggccaggugugguggcucauaucuguaaucccagcacuuugggaggccgaggugggcaguucacgcggucaggagaucgagaccauccuaacgaacacggugaaaccccgucucuacuaaaaauacaaaaaaauuagcugggugugguggcgugcgccuguaccucgggaggcagagguugcagugagcugagacugugccgcugcacuccagccugggugauggagcgagacucugucucaaaaaaaaaaaaaaaaaaaaaaaaauauauauauauauauauauauauauauauauauguauauauaauauguauuauauauacauaauguauuuuauauuuauauauauuuugagauauauauaaaauacauuauauauauacauaaaauauuuuguguauauauauauauauauauauauauauauauauauauauauauauauauauauauauauauuuucaguguucauauaacaaauuucuuuugagagcuaccaaggaccagacuuggugcugugggauauuugauaggugugagacagucuuuuccucagaggguuuguauccuaggaguagggauaaugauaacugcauaagccaccugauugaucuggaauuggaugcaacuuuuacuacaggaauugacauaaggauuuagacccuuuuccaguacauugaccuaguaguauuaacaggacuguggcaacuuugaacuucccuaaugagaaaaacauguguuggugagcagguauuaucacaucuucccuugcuuuucuguuuaaauacaguauccuauucagauaggcaaaucucugauguuuuguugagugaagucuaugggccagaucacauaauagaugauguguuuguugguugcccacugauuagcuugggacuuguuaccuagagguccauggcccuucugaagucuucauuauguuguuaguuucccaaaaugauccgcugacacuuguucuaaauaugguuuauuuuuugcagcuuaaugauuuacuuauuugccaaauacugggauuugguuucagagagcauccuuuucuaccuccuuggguauauaggccuugauuuauaaugucuaguuacucugucaaugaaucaguuagugaccauuuugaguguuaagagcuuugaguaaagaagugugugaaaagccuucugccaccaggaagcuugcuucccugugccuagucuaaaccaaaagucuucaaacuuuuuugauugugaaccccaguuggacaaaucacuuagaguaagcaccucauuuuaaaguuuuauauuuauacuacuguacuaauauauagaucagaaacauaccgaauuagaaaguaauaaagaaugagaugcauauuuauuuauuuacuuaaacuuuuauuuuagauucaagggauacacaugcagggguguuaccugaguauacugggugaugcugaggcuugggguaugaaugaccccgucacccagguacuaagcauaguaccuggcaguuuuucaacucuugccuccucccucccacuucugauaguccccagugucuuuuguugccgucuuuauuucuaugaguaccuaguguuuaguucccacuuacgggugagaacaugcaguauuugguuuuccuguuacugugguaauucgcuuaggagaaaaacacauuuaaauagacauuauaaugcagucuuaccccucaguggaacauccuacagaccacugguguagacagaaagugcuagaggggugcuugggagagagaaaucaucccugaggcacguagugaagaaugaguugugugcaggacaucaccagagucauggcaggccguggagaagauauaguugguaccaucuuuugguguaagcagcagggagccauggaucuuccuaggaggagccacaagguagaaguggccaugccauagaugccugcauagcauagugggcugggguagacgguggggggcauguguguaaagagagaaugugagggagacagguugguauccuaauccuaaucccacagcagaauagaaaggcaaagaggauggugguggcagguagggugaggagguagugaauauguggacauuuccugcaugaccagaacugcuaaggaggaagugagucuugaagucugcuggacaaacaaugguuuguaguaggagaacccuaagguggagggagcggggaggggaaggacuggccacaucccaaaaccuuauuauguccaauuuuacugcagcuguuuuaugacugcaacauuuuuguucaggaaaucguuuauuuacccccacaccuuuucuuuuagacuaaaugacaagaaccagugcucacauccagggucaaagcuaaucuuugaggagguggaaaacgccuccuuguuucauugucucucuugaaaguggugucucccuuucacucuccugcaggagagagauguccagguacugccuaagcagccccagugaaaacggaugguucuugaggcuuccagaggucaaucuggcauaagaaguaaagaagaagccacaugacucggagaggcagaauuucuuuccuuggacaggauagagcuuuuaauugaauccaaaucacaucucucauccugugaaugcuggagagcaguacauuuuuaacuaggaagagcaucaauuauguauuagccacgauacuaauuuacccugagugugugucuuagagcuggcuuucaucucugcauagccacugauguaaugccauuguguuucuauacucaaccagucgcucuuaagauaggguguccugcuauugaaaagaguagaaaguagggauugcuauugcugaggcucuuucuguguucuuacagcugagggcccuuugggauaccaccuuagggugggagagcuguucacucaccguugugcuuugagaugcagacuggggcuuguccuuuuacucugaugcugcugcuuuaucaguuauuugguauuauuguguuccaggauaaaucucuggaacccucaguuauagauauuugagacuuucuguguguguguguguguguguguguguguguguguguuugagacagggucuugcucugucgcccaggcuggagugcgguggcacgaucucagcucacugcagcuucccuccauccugggcucaagucauccucccacuucaucaucccaaguagcugggacuacaggcaugugccaccaugcccggcuauuuuuuuuuucuuuuuuuuuuguagagacgggauuuugccauguugcccaggcugauccugaccuccugggcucaagucauccacucaccucagccucccaaaguggugggauugcaggcgcgagccacugugcccagccugagauuuugaacauuugccuccagaaaauguaggcaguuucuguggcugcuuauuuccucgccaguaauauauuuugcuuguuccuagaguacuaaauguaaugaugaccaaaguggacugagcauuuccuagaucuugacacucuucuaagcacauuauauauauuaacuuauuaaauucucacaaaaauccuaugagguaaauacuauuaucaucccuauguuacagaugaggaaaauguuaaauaacuuaccuagugaguguagcauaggcucugguguaaaaagcugauucaaacaccugccuugccacugugaaucacggcccucaguccuuuccugugaaaaauugauuuuuauuuuuuuugagacaaggucuuacccugucacucaggcuggagugcaguggugugaucauagguugcugcagccuugacuucccaggcuuagacaauucuaccaugucagcauccugaguaccuuuuaauuuuuuagagagaugggauuucccuauguugcccaguguauuaguccauucuugcacugcuacaaagaacuaacugagacuggguaacuuauaaagaaaagagguuuaauugucucaugguucugcaggcuguacaagaagcaugguuggggaggcuucaggaaaucuucauucaugguggaaggugaaggggaagcaggcacaucuuacguggccugggcaggaggaagaaagugggggugggggugccacacacuuuuaaacaacuagaucucgugagagcucacucaguaucaugagaacagcaagggggaaauccguccccaucauccagucaccucucaccaggccuuacuuccaauacuggggauuacaauucaacaugagauuuugauggggacacaaagccaaaccauaucacccagcugggaaaauggauuguuaauaguaccugcauacagaauuguggugggcaugugauuuuggcaggugauaagcucuucauuagcauucacuaccacagugaacaccaccauccuccuccucaucaucauaauuaucuauccagaggaucaugugagaugcuucaaaccccugacuaaggcaaucucaaaggauaauuugccucaggugucagaauuguuuagcuguacuugccuuuccuugcaaauauaauggcagaaaaagaggaaaauuuagacauuuugagccuuuucgaagcgggaaaucagguaagauauuuucagauagauaauuuguuuucuccuugugcucuuaucacuuccuuccucuuucucucccaccucugagaacccuggaugaggguagaugaaguagaggagaggguggugacaauggugguaaaagaaaaaguaaccaccaaacauguacagaaccacuccagcauuuaauuaaagccugcagcccuuugucagccagaagcuccucucauggugagagaggcagagagccuugucacugucucuagaauuauuuguauaauucagcagcuguuucccucagaugccuaccacacgagguuggauuauaaagacguaugaguagaaucgccaagguucagacacuuguguucacuguugagcugagagccacuuaggcuguucuuguacaaaugcauuagauuaugguuaagcagcuuauggacauaaaaacacauuagaacuuuacagcacucuauaaauuauaguuuuugcagcauucacagccacaaugcuagguaauuacauucauuaaucuacuaguaagagcacauaaaguugccucccaaaccuuacuguaugugucaguacucagcugggaaggagaguuuuuuuccucuccuuuuuccccgucuuucccuguuccauuaagccuugugugggaagauuuuugauguuacauugagguguucccuaaaagaauccaauaaacccauuuuuuuuuuuuaaugguuaggcucuggcaggaggccuuguagguaauauuuucauguugagcugcaccuaguaacuauuuuuguaugcauuuauuuucuuuuuggaaauggacagaugucucauuuggaaagccagcaaguuaaagcaguugaaaagagauuaaugauagaaucagugguaaaugcuuuuucaggacuucuuuuugccucucucugguagcaguuaacaugaugguccuuuuaauuuuggaucuaucaggaguacaaaguauugcucucuucccaugccaaacuuuccuaaaguuuccaucuuuccauauggugauaggaaaugccuccccccacagcccugucucagaacuuucucuuauuugcaugucucauaaauuacagaaggcagauuuaggaagaaaugcuggaacuuuauauggugcuaguauuucaaggagcaaauuguacuuucuucgcauuauuucucagguuaaauagaccaaguggaccaggcgugguggcucacaccuguaaucccaacacuuugggaggccgagguggguggaucacaugaggucaggaauuugagaccagccugccaacauggugaaaccucaucucuacuaaaaauacaaaauuagcugggagugguggugcacgccuguaaccccagcuacucaggaggcugaggcaggagaaucgcuugaaacugggagacggaaguuguagugagcugaaaucaggccacugcacuccagccugggcaacaagagcgaaacucugucucaaaaaaaaaaaaaaaaaaaaaaaaaaagaccaagugauaggcugggcgugcuggcucaugccuguaaucccagcacuuugggaggcugaggugaaagaauugauugcuugcucaggaguuugagaccagccugggcaacauaaugagaccccaucucaauguaauaaauaaguaaauaauuuuuuuaaaaagugaaaagaaaaaauaggccaaguaauacagccaucuuaaaaauaaaaacaaaaauggaauagagaaguauguuaaccugcaaccccaaggcaacacuauaaguccugggucaugcucagaccacauucuaggcuucugcuuucaguucuguucacaugaaugagaacaugaaugcuagagccacgcaggucuguguugaguccugguauugucuuuucauagcuaugugaccuugggaauauuaauuaauaguaauaaaaauaauuaauuuggacugaacuccuaauacauccuaggcauuacauuaacuaauuuaauccuaauagcugcuucauaaguuaggugauauuauucgcuccauuuuauauaugagaaaacugaagcuucacaggguauuguaguaauuaaaugagguauuauaaauaaaauauccaguauguugcuuggcacauucaaugacacucauuaaacacaaucuugaggauauauggagaauagaucccaccauuguuccuccaaugccaaauguaaccuuuuagaaugacaguuucccuuuuuaaugacuuaccagucauuaauuguaucagucaggaagaggaauuccucacauuuauuuguaauuuauuuacugccuguaccaggaaguaucccaagcacuuuccacaaauuucauuaaacuuucuauuccuguauuccaggagaagaaauggaggcucauaagggccaaggcauuuguucauguucguaaagccagaaggugggaaagccaguucucggacucagauguaaccgccaccaauaaagaguagggauagcagugaaguggucuauuuuccuggaaugaagcuucuauggugggaaguaaucuaagcaacugauuaaggagccagcuuugugcacuucaaagcagccucagcuucgggguggagcauagaguuccuuuuuuuuuuuuuuuucuuuagcaggcaggaagauauucuuauucccaaagaacugagaaauauuugagacuauccauaguacucauuggugcuguaagguuagauaacugcugagaagaaaacugauugcucuguguaaaucaguaugcugaugagggaaugauaaaacugcaggguaguaccagcgucagcaucuuguuuccaacccagcucuucucucucuugacaaaacagcugucauuuuggauuaauguugaaaucaccagaaucugcuggucaucagagcagggccgaugccaucuuugggaugaagugugcuggcaacaagauagaaacuggacaugggaaaaaggaaagucucccucaaacaugcugccauccaaggcccaguuuaaaccacaggcucaauuuuugcucccaaacugauuucccgacuaacccaucugcucaugcacacacccucccaaccucacacagcaggccuggccuuuaucauuucagguccugcagagcuguucucucucacugugguacugaugccaguuuuaacagccgccauguguauugacuccucuaccgauuacaaauauauacgcguuugccaguuuguuuagugagugguuuucauaggcugugauggggauuucacuuucaugaauauaauuugcugagccuguggugacaucaauaaauccuucugggauggggaaugguugauuucccuacauccagaugacauccuccagcccacuuccuuaugggaccaacagccaaugucauaacacaugcuucuuugugagagcauggaaggaaauuguuuaaagugugucaucugugggcacaguuucuaagguagauaccugugaggauguauaggcaugcuuuagacauggacagaaugaguuauguacuuaguaacucaaaacucugcugagcucauuguggacagcucuuacagauaaacuaaaaugcagcuucuuaaaaaaugagaggacauuugcagaaagcauucuuacugcuuucagcaaaucuaugugccuuauguuuuuauauagcagucauuuucucaaaucagacaucccuauugccuauuagauaaacacagaaagcauagauuaugaguuuaaaaguaucgacagcauuucaagugcuaucagagaacauuuaauucaguuuaauuuugugauaaaucucacguuuaauccucugguuacccuguaaucaugucucuauugaucuuuucugaaugacugccugcaguuuaauaaacuuugccauuaacccagagcuucuaaaaggagagauugauuccauuaucaaaucugauagaaccaauaaguaccuaaacaucacuaaaucuaucuauaggaagcuuuggccuagagacaagccuguggcuuguuuaagaaacuagguaaaaaucuggauaucuuugcaugaccuaauugccucacagcaucugauucccuugugcaaacugacacugccuuucaucuuucaagucaauguaguagccaacugaaaggacagucucuuuucuugccucaaccguaauuguagggucuaauuuauucucacugcagauauagcuugaggaguuuauuuggucuaugucucaggucaguggguauaucuuaagcacuuuucugugucucugaaaaccugcaggauaguuuguuuuauuuuuaccuauaugaugccaagggaaagaaaauucugucuggauaaauccugaaauagaagacugggggugaagauugagagagagggaaggcaaguacagagucauagcugugugaacaagcucuaagacuuggaaaacuuuccaugaaacccauauauguuucucauguagugauagguuauuugcaauauguguugaacaggaauuucuacuuuuugugccgcgaguauuuauagcuuucaucauuauucauuaauauuuauugagucacauaggcagaacauauggaauucagggucuagaguauauuuacagcuucuuauuuuuuuaaggucagaaaggugucauucccugccacuuuucaccucuuaaauaaaucggugaagguugucaauuuuacagaaaagccaaagcuuuuauuuucugucuagauuuuuauugacaaugugaauuuuucagaaggaguucggcuauuugacuuaggaggcauagccuuucccuaauuacacuucgguggggaaguggaggugcacagaaggauuuuuauaaugagacaauacuaaacuguaauuuaaaauuuccuuccaacaaaagacccuaaucuuggcacuuagaaauaaaucuguaaugacgugguguuaggcaguggaagcaggauuagagccaagggacucuggguguguugccaguugcugauuuucucacuuuggaaagucacuuguuuacccagccuuaguuuccucauguauaaaauaaaacugauggugccugcuuagagagcuauuagagaauucaaugaggugauuauuuuaaaagauacuguaaacuuuuuccaaugcugaguuguugugcagacauuaaugguuaugaaaaagauaaauuaguccucgcuuuauauucagaaauggucugaccuuucaguaaauuauguuuaguucuuaaaucaaaacccaguuaggacaagagagcuugaagaguacguauacauaagagaagucucacagagauauuugaaaggcuggaaaaugugcucuggaggcaaacccuccacugaauugaugaauucuaaguuacaucuguugauauuuuuugugugcuaaauagccucccaguaugguaacauuagagaggcugaaggaaccuaagaggaggacccuacauuuauagguauugagguagauuggucucugcccuugagaagccaaucaaaauuagguugagaaaggauguagcaauuguucguggaauacuaauaggcauauaugcacuuguucauguugauucucuaugucacugcucuguaagagaaggaaugccugcacaucuucaauaggaaguugacaacaguuucuggaaaguuggaagaaaguuacagaauuauuccuuuaguaguaauuauuccauaguucucuagaaacaugacaaaaccucuugaaaaacuugagucauaaaaggacugccucacauauauacacacacuuccugauaugcuguguaaaacugcguuuauauucagagccacauaacacaaauuuugccagaaguugcuuuuuauaccacugaauagcucuaaacuuuaaauugucuuucauaaaauuguuucuugucugcugaguggacagaaugucucucucuuccccacccuucauaucauuuuguuuuccuaaaugggccacucugugaaguaguucuuuacuucuagccaccaccccugccucuagaacaaugcaaccaaccuuaaccaaagucacauaucaagaguucucugcugccuguuaaugcagauuugacuucuuugugugugugugugugugugugugugugugugugugugugugugugucagggucucauucugucaccgaggcuagaaugcauuggugugaucauggcucacugcaggcucagucaguccuccugccucagccuccugaguagcugggacuacaggcauacgccaccacacccagcuaauuuaaaaaauauuuuucuggagacugggucucacucuguugcccaggcuggucuugaacuccugggcuuaagccaguccaccugccuuggccucccaaaguguuggcauuaaaggcaugagccaccgugcauagccagauuugacaucuuaaaagccagagcuagacauacuuauugauugucuuccuggggccaggugcaguggcucacgccuguaaucccagcacuuugggaagccgaggcgggugggucacuugaggucaggaguuggagaccagccuggccaacauggugaaaccccgucucuacuaaaaaauacaaaaaauuagccgggcauggugauguaugccuguaaucccagcuacaugggaggcugagacaggagaaucaugugaacccgggagguggagguugcagugagcugagauugugccauugcacuccagccuggguaauagagcaagacuucaucaaaaaaaaaaaaaaaaaaaaaguaauggaaacucagagaagguugcugaagggaagcuagaaggccuccuccaggacagagaaguaaucauuuuacacuuaucacuuacgguaacuacaauagaaucagugagcuaguugcugaauacuucuagagacauuguucacuuaaagugaaggugugauaguaugugaauaccuggggaagagaagaaagcgaaacauuuuuaggaaagaaaaggaaaguaugugacuuauuacuaaucaggaucaauuugaagaucugaauagauuuucacuggcuaaucagaguuauucuguggaauaucugcaaccucugcaaccacuuuugauuuuucugugaauagugagguacugagauccaguaaauuauaauuuggccuugauaucaagccaugaaaaagauguuuagaacuaacauucauuggccucuuucauuuuuuuuucucuugggguuaauaaggcgauuuauguuauuucuaggcaucuguucauccccucuuuagcauauaggggaauagaaaugguuuauccgggauauggaugugguaaugugucuuagucuguuuuuguguugcuacaaaggaauaccugaggcuaggugcaguggcucaugccucuaaucccaacacuuggggaggccaaggcgggaggaucgcuugaggccagaguuagagaccaaccugagaaacauagcaagaccuugucucuacaaaaaaguaaaaauaaaaacaagaaaaaggaauacuagaugcuaguaauuuauaaggaaaggagguuuauuucacucaugguucugcagacuguacaagaagaauggugcuggcaucugcuuggcuuaugguggaguucucauguggcuuccacucaugauggacggcaaaggggagucagugugugcagaggucgcaugaugagagaggaaacaagaggauggggggagguaccagucucuuuuuaacaaccagcucgugugggaacuaacagaguaagaaccucucuuaguucuauuagaguucgacaugagggagggcauuaaucuauuuaugaaggauccaaucccaugacccaaauagcuccucuuaggccccaccuccaacauuggggauauauauauauauauauauauauauauauauguaugguuuuuuaaauuauuauuuuuuuggagacagucucacucugucacccaggcuggagugcaguggugcgaucucggcucacugcaacuucuaccuccuggguucaagcgauucuccugccucagccucccgaguagcugggacuacaccuccacgccuggcuaauuuuuuguauuuuaguagagacgggguuuuaccauauugcccaggcuggucucgaacuccugagcucaggcaauccaccugccuuggccucccaaagugcuaggauuacaggcaugagccaccaggcccacccauuggggauauuucaacaugaguuuuggaggggacaaauaaacuauaacagaaauaauuagauaauguguuugaaagucuuggauggaaguccgagaggggaagagugauggaguaguacaauucauagcauggcccaacagcuucagaaugagaggacauucagggcauccuaauuucacaaguucauucuccuuuaaguuuuuguuuuuagaaaugggcucuugcuuuguugccuaggguucucaaacuccugggcucaagcaguugucuagccucagucucccaaguagcugggacugcagccaugcacuaccagguccaguucuaauucauucuuuuauaaacagguuacuguguguccucuacucuguucucugcuaggaauucuggcaugaugaagucauagccauuguccuuauggagguaauucugaguauuaccaggaagauccaguuaccaauauuuugauacacuguaauaaguacauuaauucuuuuccuaucuuuugcauacagugcuuaaucaaaaaaugaauaaugguuguuucaacuuacuuuaccaucagcagugugcagugguucccauuuuuccacacccucacugacaaguaccucuugucuuuuugauaauacccguccuaacaggugcaagaugacaucucauugugguuuugauuugcauauuccagaugacuaaugagcacauuuucauguacuuguuggcuauuuguaugucuucuucggaaaaaugucuagucagauuuuuuuuaaaaagaacauauuacauguaaaaagaauaaugguuaauuaaagcaaguaucauuagaauuacacauccucucaaaugugugcguguguuacuuuaguggauuagauuuaagugggagaaaaagcaaucgaaauuugaguguucugcuugucuuucuucaguuagcauaccaggcuucugcccuuggagaggccugagaauuguguggugcuaguuucucuucuggcugccauuacacuaucuucuguuguaugguucuuuuugccuuuuuggacucguccuuuguguacguuauugcccuaagcccucacugaugagauuuucugccucagucaugcugugcucagcuuucagaauguuguuguuacggaggaguuaauuuuuuuuuuaagguuuccuuuucgucaugcuguauuucucagauuaucuggagggacuguaauccaauuuuaggaauccuucagggcugagagccuaaacuguuuuaagcaauagcaucugguugccagggacucaacuacuuugagcguguuaaggucuaacggcagccaacucucaauuaucugugggaaugggagacuccugggauguuuucaauucacagagugugcaaaaaucucacuuaaacggauagucgugaccucaucccacagcugaguuuaggagagcuucucagugugugguuuuguuuucuuuuuguuuuguucucuucucaccuuugacaguggcacugcagcauugacaggugccuuuuauauguugaauuuaucuguaccugaucuauuuuuuuaaaccuugucccucucaucuuuauuuagauuccauauguguaucauuauauacauuaaguauguuuuaauaaacugccucaauucuuuuacauuuuaggagcaguaaaauuuauuuauauuuucuuucuuugcuuauuggcuaacgugcucaugggaggggauguagccaaacaguaaucaggcuaccagauagaaagauaagaaaacuuuacaaaagguuagccucugaauaauaauugagaacuggcuguuaaaaaugaaaaaaaaaaaaaaauacgaacucuaccuugucacugaaaaugaggugaaggccaggcagugcuccucagucaagacauucguguucacaacugaguugucuccaguggaaauuucauggcuacuuuauggccuaaagccagugcucccagacguggucaucccuugguuuuaggauucuaaaagaugaguuucuuuuaaugaaaacugaauguaaucuaguuguuagggauaauuauaugccaguugugcaugacggcaagggccccugguuuuuaaaaaccagcuuuauggagguauaauuuacauuccaguaaacugcacaaacuaacaauauacaauuugaugaguuuugacauguguauauacccaugaaaccacugccacaaucaagacagcgaacauguucaccccaaaaguuuccuuaugucccuuuauaaucccuucuuccuaucucucccaggaagccacuagccugcuugcuguugcuaucaauuaguucauauuuccuaggauuuuauauaaaugggaucauacauaauauaaucuuuuccgucugauuucuuucacuuggcauacuuauuuugagacguauucaugccaccuguaucaggagguuauuucuuuuuauugcugaguaguauuccauugauugguuacaaccacaguuuguuuauccauucaucuauugauguacauuuggguuguuugcaguuuuagaagcauugcacaucugcuaggagcauucauguguagcucuucauguagacauguacuuuaauuucucuuagggaaauaccuaggaguagaacgguuggaucauauggucgguguacuuagaacuuuuaaagaaacuacuaaacuuucuuccaaagugguugugcuguuucauauucucaccaguaguguauguaugagcauccucugcauccuugcccacucucgguagggucauucuuucuuauuucagccauuuuauauguauguagugguaucucauugugguuuuaaguuguauuucccuaaugacuacugauguuaacuauuguuuuauguauucauucacuuuccagacagauaucuuuuuuuuuuuuuuuuuuuuuuuuuuuuuuuuuuuuugagauggaguaucucucugucauccaggcuggagugcagugacacaaucucggcucacugcaaccuuugcccucuggguucaagcgauucuccugccucagccuccgaguagcugggauuacaggugcaugccaccaugcccagcuaauuuuuuuguauuuuuaguagagacaggguuucacccguuagucaggauggucucgaucuccugccuugugauccaucugcccuggccucccaaagugcugggauuacaggcaugagcugccacaccuggccccagauaucuucuuuagcaaaguaucugaaucuuuugcuuauuuaaaaaauuggguuguuuccuuuuuuaguuuugagaauuuuuuuuuuuuuuuuuuuuaagauggaaucuugcucugucgcccaggcuggagugcaguggugcaaucucggcucacugcaaccuccaccuccuggguuaaagcgauucuccugcucagccuccugaguagcugggacuauaggcgcguaccaccacaccuagcuaauuuuuguauugaccaggcuggucucgaacucccgaccucaggcaauuugccugccuuggccuccuaaagugcugggauuacaggugugagccaucacaccuggcccaagaauuuauuaaauuaauauauucuguauacaaaacuuaucagauacacauuuuaaaaaauauuuuuccauucuguggcuuaucuauuuauguaucuuuuacucuccugguaacucacagaacagucacuuuauuuucuugacaguaucuuuugaagagcaaaauuuuaauucuugaaguguaauuuaucaauuuauucuuuuauggauuaugccuuuggugucauaguaagaaaucuuagcuuaacccaagauuacaagaguuuucucuuagaaauuuuaugguuuuagguuuuacauucagguuuauaauauaguuuguguuaguuuuuucuauuuagauugaaguguggauuaaaauuuugcauaugauuaccuauucuaucaccauuuguuuaaaaaacuuauuucucuguagaauagcuuuugccugaaaaucaguuguugauauaugugugggucucuuucuggacuauucuguuccuuugaucuguuuuucuaucuuuaugccaauauagugaugcaauuuuaauguggugugaaagauggcacuacagagcaccugacuugcuccuccucuaaccuacuuuacuauaauaguucacugauuagccuguuucccuggauaagcagccugaguuuaggaauucuuucuuagauauuuccaacagauggcaauguguaugcacauaguagguguuuugauauuuguuuuuaaaagaugugaaucuuagggauuaauguuugaaugccauccuggaugccuuguacauuccuacagauaguagucuucucuacuuucuaaaaaguuuaggcucugaaaaucuguucauaaaguccauuugcucaaaaguccaaaguuggggacuguugugaacauaucuaucuaguuacuaguuuucuaauuuuucauuucuuaucacuggagacucauuauugguagaaucaguguuuguaaaaccauucaaaaacaaguacaaaugguauacaauaaaccagcaagggacuugacagaccaaaaugacaggacacagccauuaugucauugugucauuggggacaggcaaagcacuuuuuucuuuuucuccuggcuuguuauuuucuuuaaggucucuaagaucagauaacuaacagaagaggcucaguuuaaauugcaagccccucacauacauauacaugcauuugggugcaugcagacacauauaccacaaauacuuuguaagugauggacugcccucagguuaguuugcuuggaaaaaucaggcggagacuuucuauaacccacuucaugcaaggcagacaaauugugcccucauuuucuauugucucuggcuucaucuguaaucagcaaauggagcccugcagcuuacauaguguuucaucugcuauuuguuacucucccuuaguuugcacaacacugaaccaucucauuuugaaauucaagaguggcgaggaggccuuugguggaagauuguaauuugggagaagggaaagucaagagcaagaucgccuauuuugaagaaggcgggguguugaaggaaauugccuuugucagucucugagccucuccauauaugugcuacugugacccugcccuccaucaccagugaccuaaaaaucacauaauuucaacuauucuccaaaccuauucacaucuguugugcauggcuuguacacuuacccccucuauugacagccaauaugucuaaaucuuuuugccucucagccagccucuuguugguggcucccuggcuuucuugccuucuuuccugcuucuucuaugacugucaaaugaaugccuuaaagcguuuuuuuuuuuuuuuuuuuuuuuuuuaacagauuucuuucuuauccuucugcccuccugccuuucucuccuagugcuuguguaagggaggcaguuuuuuuuaucuuuacccuguuagggucucuagcugaggcugaguauuaaauugauguaaaauagauuaacagaagaaaagcauauggauuuugacacauauauaggagcccccacaggaaagugaagacccaaaaaguggcaaaucuugaauccuuauuuaguagguugaacagaguggccguuguggaaaaguaacuaaaauaaaugauguggcuaaaggaagauaagaguuaguaagaucuguugguacaaauuuuucuggacuccccaugucuagaaacgagaaaauuucuucuuuccuacuauagggagaucaucuuucacaugagaguuuuuucccaucucagguguuucuggugauaauguuucuuuucuccuaucucuuuuguuucuauuuuucaagugccuuuagcuuuaaaauaauccuuaggccuaaauagcauguuuugggguggcguguucugccacucuucauuugcucaugcuuuccuugcagaauauggacuacaaucaucuuauuuucaaaaaauucuucagguaauucugauggacaguuucucuugugaaccacuauccuagaucaugguagacgaaugaaucaacaggccuuugaaaauugccauucauugaucccaaaaaguuuuuuuauauaccagauaauuucccuccccauauuauagcaauacuagagacugcccagguuuccuuaaggaaguucuuaaauuagugcuacugguugguuggugguggaggaaagcauugguggguguauauuuacaaacaauuacacaggcauguagucauguacacaacucuugugacuguugauaagaugauuaguuuaugaucagucuuugucuuugauucuuaaugcuuauaauggauaguuuuugucauuuuucuccaagacagucugaaaaaauuaaauaguuauuuuacuuuauaaaugguaagcagucaguaccuguuuauagagggaaugaacaaagaguggucugguuuauucaggauuuguaccaaaaaaucuauauaguaauuuauaaauaaagguagaucuuugaaaaaaauaaagauaaucucuagucucugaaaauauaaaccuguuacauaauaaaaaguuguuauagacucuucauuucuucuuaccucuuaagccaccaccucuagacacacuuugauccucucucucucuucuuccccccccccgaguggaaaaucucaauauuaauuggagcuaagaugauuguacuacugcugcuaagacuucagcaggucucuuacaagcuaaugucacggcaugggguccauuugcucuguguagcuauucugcagugcagugagaauuccuugauuaauaugcuacaugaaaauaaaauggauuuggaaaaaauuauagcauacucucauaaauauuaauucacauuuguauggaauuacacauaauuuucaauauacuuuggaagcaccuucaguaugaaagauuuggucuccaaagagaauggcauaauuuuuuuaaaagcacaguggauacauuauuaagcaucauuuguuuauuaaucugauccucuacaugcauaugaugcagggcaguagguggguugugugacaaagaaaggagcuuuauacccuguggggaguuuuuauauuacacuuagaagugguacaauuuaaucacauuauauagaagcagcccaugauggaacucaccuggcucccucugcuaguguugccauuauuccugagugucucuuuauggcagcuauuuugguuaaaugugagacuaaacacagaacauuuuugagcugagcagaugccuggcauagcugacugagguuguggacacuggacaaaggaauucaauucagcagccauucauugaacauuuacuauguguuaggcauagcaugcaaggcugugaaaucaauggccaugugcgcuugcuuugaucucgacuuguccccugaaacacuuuucaccacauccucauugccucaggagagcuaccucuccgauggcagaggguuaaucgucugcagugguagcagcuggaaguuaggccagaagcugcuuauuugccuuguggacuguuaucuuugauaucuucuuacucuuaaggauaaggccuuuccccuuuucugggguuucuugcuguuugcugugauccuucguguauaccagcagugcacacuagauuccuugguuuccugcuucuaucacccuuucuggcuugcuacacuguauguuagagacagcuuagacuauuuuaaagucaguauugugcuuuauagguuuggauguuuuaacuaguugacuccuuuauuuauguauuuauugacuaauacauuggccaccuacuauuugccugguuuaugugaaguacuuaugugaagcacugggauuacugagaugaacuacuuagucccuccccucuuucacauucuuucaagagauuaugcacccagcugccucaaggccuuugcacaagcuguucucucuguucagccuuucagaucuaggucaaauagcagucauuuucucagcucuaacccucuccucuggacuauaucauuucccuuaguuuuagcacccauaaccuauccuuuagcguuguuaacucaguuugcaaugauauauuugugugauuugauuaguauuuguccuguaaauucuaggcucuaugaggguggugacuuuuccccacaccauuaucauccuaaacauaggucagugcuacauugguacuuggcauguacugggcacacaaaacauaauuguugaaugagugaagaccugagaauagaguacuuuguauuacaagaaaggucucccugagugggcaacacugcuaagagucacugaacuagaaaagggaggaguguguaagagaggccuuuugaggccaaggcaaaucaguguaaaggccugcguuaguuuguccaggcugcauuagcaaaaugucauaaacugaguagcuuauaaacaagaaacauuuauuucucacaguucuggaggcugggaaguccaagguggaggcaccagcagauucugugucuggugagagcuuguuucucauggaugguaccuguucucacaugguagaggggcaaauagacucccuuaggcccuuuauaagggcacuaauccccuucaugaggguuccacccucaugauccagucaacucccaaagucccccaucuccuggccaacauggugaaaccccgucucuacuaaaaauacaaaaaaaaaaaaaaacaaaaaaaauggcuggguaugguggcaggcaucuguaaccccagcuacucgggaggcugaggcagggaaucgcuugaacuggggaggcggagguuacagugagccaaggucgugcuguugcacuccaaccugggcaacaagagcgaacucugucucagaaaaaaaauauauucuggggagacacaaacauucagaucauaacaaggcucaaggucucagacuaauaggaauggcugauuuggggagagaugucagggaguaccaugcauguaaaguugggagugcugggauauugcagcagaacagugagaaaauuggaugugaaagggaggaaagagagcgguauuuuaaggagaaaugaguaaaaggaaauuucuauuuugguuuuguuuuauuuuuaaauguacauuuagauaguaaaaaauuuaauuguucauuuaaaaauaacuaaaauaauauaauuggauuguuugaaauacaaaggauacauguuugagguaauggauaccccauuuacccugaugugauuauuacacauugcaugcuuguaucaaaacaucuuauguaagucauaaauauauaugccgacuauguaccccagaaaugaaaaaauuuuuaaaaaguucauuuaggacugcagaaacugaggaagugugguaaggcuucaugagggggauuuucuguguaagaggauuagauccacuaguuuccaaauaacugagugccaaaacauuuucauuuuauugcuuagugugugcaucauuucucacagggcagaggauauuugcauguaugugguuuguuugauguucugagagcccauuuugcacguggucucagaguuguagugacuuacuccacuucugauaaugaauaaugucaguguccggacacuaaaagcccagucuguuggaaccuugguguguacugagcugccuggaggcacagaacucuuaucaggucauguggccugaaaugcuuaccuguaguuucuacagaugcaguuccccauucaaggacauugauuucccauuuccuacccaccuccccucauccccaaccacacacaggaauaaauuaaaaguugcuguugaucuuggugauaauauuguuguuacauuuugcaaagaaaauggaaauaaaggaugcuuagaggaacauguaaaaaaauauaaugcauuaaggaaacauuuuaaucauaugaauagacaguucuuucuugcuggcucacauccaccuggaccugauaaauucaguugggugcuauuucuuuugaauugagcaugcacuuagugcucauuuucugaaacauaauugauguaccaacuugggaaaugaguguauugcacuuccuuggggaaggucauugugugcuggacccagcaccaaaucgaacagaaagcugcuaucccagggagcagugaaaucacuuuugaugcauauacuuguguuuuguuuaguuuucugcccaguaauaauagaaaggauauauauauuugugauggcauuaaggauucaggaaaauugagaagccauguuucuuaguuuugggucuucucauaucccacuuuccuaucccucucccacuuaguaguaacacccuuuaguauuuagccuauauuuugggugugacccuagauaccuuuguaaccaccacuucccuuuccuucucuucuuuucuacagaaagauguagcacuuaagccucaggaacguguggagaaacgccagacgccccugaccaagaagaaacgagaagcacuuaccaauggcuuguccuuucauucaaagaagagcagacucagccacccacaccacuacagcucagaucgagaaaaugaccgcaaucucugccagcaccuugggaagagaaagaaaaugccgaaggcacucagacaggugaggaagcuuggguucgcucuuuccuguggcggcaaaaucccuuccuuaggugcuuccuccacugugguuuuucguaacagguggagaagauauccuuggugggaugcugaagugguuguccaacaaagcugugugcgugccuuuaaaagaaucuaaaacccaaucucagcucuuucuaugaggauuugaaacuucagcauggugcccuuucagucagaugugcuuuaugcaacaaagcuugaugcuaagugguacugguauuuagggcagaccugucuuaacaguugucaagauggacuggcuugcaggggagagaucuuugcaauuaggauaaauggaacagguggauuucaucacauacauugugcaucucaugguucuaaggugcuaaaaugauugccugugugugagaaaugccuugcuaagauuuauauuuuccggggaagcucagauauuguggcaucugggagggcaauggcaaaaaaugaauuugccuuuuggugucuuaguuguucuccauaggcuauaauucaagacuaucuuugugaucuguugauuguaugaacgucugauaaugaggcuuacuggccuguuaauaauuagguuucaaugauccacaagaaaguauggcucuuggcauuugggaagccuuucugccuguggaaauccccacaugagauggauuaauaaugagauaugaagcuguuuauagcaguuuuucugcacaaauccagaggcuucagugccugucaaguuaguuaccuguguccuggguguguuuuauuuauuuuuggcaggaccauuggguaggauugacuaucacugaagaaagcagaggaaggaauugugguguacagagcaggugcugcuaauuagagguggaauagguaauuuuugguuugcagauguuucucugcagaggcagggagaucugggaucaaacaaaacaaugguucccaaaccacacagaucuugagaaucauauaaugagagcuacuaaaccuaaauuucuggccccucuuuaggaccuaaugacauuuguaguuuuagaaaguuuccuauuugaaaacagucagccugguuggaagucacucuuacaaagaaucaagaguguauuugggugaugguuuuuaguuaaaagauuggaaagaucaaaagccucaauaugauguagugggcaguuuggugucagaauucugccuuauacguagugaagcauauaauccugguaaaacaucuggggugauggguuucagauggacccagaaggcuuccaagguaaugccuaaaucugacaaccagcacaguguuuccaaagguacacuuguguccugaaacgccagacuggaguuauaauaguaauuauuaacauuuaccuaaugcauacuaugcuacauucagugagggaguuuuuauaguauaaccuauaauuuguacaacaacccugccuaguagguaauaucaugguuacuuaacagcuauggaaacgagggcucaaagagauaaagugacuugucugaggccuugucaaugagggaaggagccaggguuuagacccagauaucucuaguuccgugguuuguucuguuuuccauauuuagaugaaguuuuauuuauuuuuuucuugauagggaguuggggagagggaggaaagccuaaguucuauaaaaggugauguuccugugguauuugugacuccuaacucaugccucugugugagauaugugagaaaaguaauuaaucucaguggagagagauugcaauguaaccaccccccucucccucaggcccccgccccagcaggguaagaaggaagccuucuuacucugaguuaacaccaagcugcggauccucauccuugaaucuuuuucuucuagacgugaucugacuuuucuauucuguguccucagaauuauucuuuguauuucuuucuacuucuucgagacuuucaagguccucuggugacagaguuuuaugaucggaaaagaagacuaagacguaacacaucuuaaauuugaguagcuuuuggucuuaauggccaacucucuuguacuaaugguauuugaaaucaaagcuaucuuuguuuuagguaacauauuugaaaagcaaguauuuugacucuuuaugaaucauggagaaggaaagcaugaauuguaucuuuggcccuauguaaaacuuuuaaaaacaaggaguauuuucuuaccuucaguguugaugccaaaauauguuauccaaucaaguguuauauuucuaguaagaaggaaugcagaaggugauaauugagauaaggccauaauacuucucauuuuuaauauucuuagaaucacuugugcuauuaugaaaucccaaacaagucaccaucugguaacagcccaucuggaaaaugaagggcuuggacuugaauguuucuuaggcuccucccucugggucccauaguuuuuuaaauuuaugaauaacacaaauacaguguuguaaaggucuguaaaggagucuguaggucugaagguaaugccguuuuggagucagucuguaacugauaggcucugugaagacauuuauuuauuuuuaauguuuuuuuuucuuuaaaauuuuguuuucauguaauaugaagacauuuaaaggagaaggguaagaugcauuuauaguaggagggaggggagugguccauugugugucaguccagacaacugccaucuguuaugugaucauugguaaaaggugacacaugaguguuuaaugaccauaguagauguucaaaaagcuugucugaagaauacucgugauugcuuuccuaucauccuagaugccuguaaauaucacaauuacuuuaucgccugcguuugccucuuaucagguaaagaaacugaaucugaccaucuuagcugggaggggaccuugagaugagagugagcuuugaggagcauuucuacauuaauggauugucauuuagugccuguuauugagaacuacagaugaaauagggaagaggcgagaacuuagucuuuauuucugacuugguuagaaugaauuagguuugcaucuuauuaggaaaugguacuuccugagcagacaacuuaaugcacagcuuuccuguaauuaugggaagauguuacuccuuaguagagaggaaagaauaggauuuuuuuuucugagacuccguugaaggcaacugaucuuuuuacucggagggugcaauuauaauacuuuuauaggaaagauguauaguucuaaaaccaaacugcuuauucuuucacuugccugguuguaaaacccaaguucuugugauguuuuuccauacuaccaaaagaaagcuuuuaaacugacacuuauuuguuggauuauguuuuuaaguauaaauacauacugccuuagaagaugcugagguggcaccugucuuggcaaaugguugcacuuuuugauaugagaaauuugaauacuuuucuuacuucccaaagggguuaaaauuaugaagaaaucaauaaauuaccucuuauacaacucuuauacaaaauagcgcaugucuuucugaccucuguaaaugaacuauuuguucaugauguaagcacuuagacaugauauaaaaaaaguuuuaucauuuacuuacaaggacaugguacuuuuuuuuucucaauggagauuugggggugggaaaagcaaaagagguugcacauggccucuccuuaaggagcuuuauucucuaauugggagaccaagucacaaugaaaccacucaggaacacaaggaagucaggugucgcuaaaccgauaagccaaauuauaacuuccugagaagcacuuugggaaaacuuaacccuucccagggcauugaguuuaauuucaguauaucugacuucuagaccauggagaauucuuaaaaaauuuaggacuuuguaguuuaaaacacacagagagcaaaaggguuuuaaaaauagaguaccaaugaugaaaaguugaugagcauucagagaacucucagauuuggcucugacuggauuucuaaaucuccauuuaguccauuagucuguccuuucucuguaguaucaacugagccagaggaaauaggcuuaagugagcuagaaggcauuuuuagguuauaugaacucuucuaacagacaccaagaugaaucaucaaaauaaauccuguggucucccuccuuaacugaauuuuaggugccaaaaagccauucaucuuagggcagaauuuccuaaagaaagaggcaaccuguugagauugcuuuagucacaggagaacaucauuuuagaggaaaauggaggaauuugugaauauuucaggagccuguuaguagacucuaaccuugcugguaaggauggcuuaugugggaaugucuuaugugguuuaaaaaucuuuauacaaguugaucuggguagguauuucuuuuuaggaauaaaaauuugcucuucucucucugaaaauccaguauggugggagauuuguaguugacauuguaaacuguagacaccaaaagugucuacugcuuucuaggaagaagaggaauccaucccagugccaggcauuuaaaauuagagugauuacuagaacucugcaugguugcaucugcuucauguauugacauuguaccuuggucuuccuuggaguaagugauaguggugcuauagacuuaagagcccaggugacugagccacccucucuucccaccuguccugauggaacagucuaucccagcccaugcucuuuccuguugagaguguuugcuaccagaggcuggucccuuauuucagcacgacuuagacuuacugcuuuugucugaagagcuuucucuaaauuuguuacuaguagaaauuaacuugcaaaggaggauuuauaauggaaaacuuugauuaaacggauccaguucaagucucguuucugaagaucugcuaauuaguuuuggauggaaaucuaggccaaaaaucacacagguauuuauccagcuugacucuagagccuacagguuucuggaaaucagagcauuugagacacgaauguaauuugggauuuuacugucauaaugaaaagacaugaacuuugcuaugugcucuuucauacauacuuuuguuauaauauuuagaugucugcugguaccuugaacuaguauuaagaaugucaguuaaaccguuucuaccucauacuucaaaauuucaaguuuaccauguuaauugggauuucauuugcuuucgaaaaauuuuguagucaugugaagguuacaagcuaagguaucaaauaaaauucuuuauauuuuuuuccuuuuuaugaauuuaaguugcauacuacuuuuuccccuugccuaaaguauagaaauaagaaaaacuguaaggaaagauggagggaauaaaagauuggcuuaugaucucucuuuggaauauugauugacuugaauaagagugagaugcuaguuuuaacaucagguaauugaagaaccccaaucuaggcuugucuguguucaggaauuacucacguauuguauuggaaguauugguuuguaacugggauugguaaaccugacacuaauauaauaaugaguuauaugaaagguguuuugcuuuuguuuuaucuugagcauuuggaaacagguuuauucguguuuuucauuuugugucuuuugacucuauacuuuguugcugugagcccugaauguugggaauagugagcauaaacaucacuuaacuucagugagauacaucuuuggaauguuaugaccaguaauaauuuuauccuaaaugacauuuguaauuuuaaauaaaaauuuaguaaaaauugacuaugaaaaggacauagcauauguauuaggauucucuggagagcaaguaccaguagaauauauauguggguagauaagaggggauucauucggggaauuuguucacaugauuaugggggcugagaggucccauaacaagccaucugcaagauggagacccugggauucacaguauggcucagaccaagucugaaggccugagacugggguaguccucaaguccaaagccuagagagccuagaguuuagaugaucaagggcaggaaauuauaucccagcucuaggagagagagagagaccauuucgccuuuccucuguuuuuguuuuaucuggacacccggcugauugcauggugccugcccacauggagggcagauccuucccuacuuaguucacugagacucacaugccaaucuccucuggaaacacccucacaaacacacccaaagguaaugcuguaccaguucucuagguauucuuuaauccagucaaguugauacccuaaauuaaccaacacagcacauuaacuaccaccucauaaaauaaaaccugcagagagaaaauaagcugaaugggaaaaggaacugcaaugaaaagaaugggccauaauucagcuugggugauccugauaccuacaggaguuguuccauaaaacagugaccuuuuauauuucccaaaguaagaaaauuuuauauguguauuugugcaugcagaacuuuauuaagggccauuuaaaucccauauauugauagaggaguuaagaaagauaaagugacaggagugauucucaacucuggcucccauaaauuucuacaaugucagugauugaagaaugagggagcacaucuuuccuuuaauaaggccuagccaguacacuuuugguaguugaugaggguaggacagaacucccuuucuuuauuugaaacuguguauuuuugugcugauuaaauuuuacauuuuucccucuugugaugauauaaaguuaucugcauguggccagaucucagcuaaagaacaugaaauaagccucuguacauucugcauucuaaucucuguucacagcaaucuuguauccacacaagucuguacaugacagguaaugagugggaagugggaggagaugggugucugugugguuugcacugguggugguggggaacugagcagaugguugugauagccacaugcugcgugauucccgugggaguugaugguggugacaggcgacucacaaugugcuauuuacaguuuggguuugcagucuuucggugacaucugaaugcucuuuagcaacugcuuucauuacugccuuucgaggagcuguuaauugaaaaugaaauugugggugggcuuuaagacaggcagacgcaggcaauucugugugguaaauguugcuugagaacuguuggaugucuucaugcccaauuuguaauucauuuucuaagacuguaaaagccaaaggugcauuuggagauucaguuauguauauacauaggcagaguugaaugucacaccuugcccaaagggucaaacauacaguuauugguaugggugcugugguucacgccuguaaucucagcacuuugggaggcuaaggugggaggauugcuuugagcacaggaauucaagaccagccugggcaauaugaugagaccuugucucuagagaaauaaaaaaauuagcugggcauggugacgcaugccuguugucccaguuucuugggaugcugaagugggaggauugcaagggcccaggaaguuaaggcugcagugagccauguucacgcaacugcaccccagccugggcaacagagcgagguccugucuccaaaaaagaaaaccacacaaaacaccuauuugucuggaaaccaaccuaggggaaugcuuggcaaucccagcugccugcucaugucuuaccuuuguguaguucucuuuaaauguauacaacugugugagguucuuauguaaaaucugcugacaucuuguaguguucucugugaguuuaucguaggacuucauccuccuuucuuccuuuagcucuucauaaaguuacuaugcaggaguaaaugguuauuuguucucuugaacuuugggauacauuuuuccuuccguauccaaggaggauucuuuccaggacuccccauggauacuaaaagcuguggauguucaaguuccuuaaauaaaauguuauaguauuuuuauguaaccaacacacauccucucacaaacuuuaaaucaucucuaaauuauuuauaauaccuaguacaguguaaaagcuaugcaauuuguuauuauauugcauuguuuaggcaauaauuacaagacaaagagccugugcauguucaguauauaagcaaccauuguaggccacauuuuuggucugccauugguuggauccauggauacagagggccaacuguaucauauucaaguucuuacauauaacuuuguuucuuguaaacauuuucauaugauacaacucuguuaaaggcaguuggagcccagaggcaaacaagagaagaaggaagagagaggguggauuuuauuggacuuugacagugguugaugaucuugauucucuuauggcugcccccagcugcaggauugugauuuguuucuuaucuucagaguuguuugcuaaagcauuaguagcauuacugaaaugguagcuuuuguaaauguuuauauguugaauuguuuuauugcccauagcuuugcacagaaaucuugugcugaacaaggaaugaccucccucuuggaagugcuguuaacucucuuuuuaauuaaauaugaauauagauacaauauaacugcauuuuuuuaguuuucccuugaacauuucagugaauacuaucugggacaaaaccgugcugaauuauacgcuuucacuacuaucacucuuugcucuuagagagcccccgaggcuuggggugaggagacacaccccuugcuguacuuaacccucagucccauuagaccugcuuugccacaggaacccagcuguuuuaaugcauuugaguugcuguuggguccuaaugauguuuaaaagaaccugucuugguauucuaaaugaacucuggagcauugccuauugaugcaaguguugaugauuuuauaucaggcagauauaacuuuguuauuuacucuggggcuuuuuacaccuaggggugugcauccucacaccagugcucacaaagacacacacaggagcagaaaccaaaauagcucacaaaugugggcaaguccugugggggaccaccuuaugucucucaggaggccugaugagcugugccauguggccuucuggaacauuauaccugcauucauugaucacagcucugcagaagcugccacuucuccuaugugccugccugcagugacgcugauguagcaggucauucuguaaucacuguuugcaccugcauuugcucaggaaguguuugcucauacaucuugaaaucauguauuacaaaccuggacagguccuaauugcuggugaugguucugagagguugagauuggcuauaauuagauggagaagcaauuagcuacauauucugaguagggaacauacagaauaauguuucucaaaggguggucuuugaaccccuaugucagagcaacuguggaucuuuuguuaaaaugcagauucccagguaaucaccuuggcauaguccauugggugggggucaggguguggcaacaaggaacuggaguuccuucagugacuccaguacaggugcugcaggagccauauuuuuaaauaaacuguacuuauuuuuuauuuucaauuaaaaauugcaauauuguuagcaaaacuugggaagaaucauaaaauuguaacaacauaucuugcggaaauuaauuuuaucaauaauuggaucauauuuuuguucuguacauuuacuaauugaguuaucuuccaaaauguauuggcaagaaagaaauguuucugccagaugauguagacauuauauaacaaaaaaugauguuuucaaaauagcuacuuuuucuagguguuuacuagaauggaccugauagaauaauuguauucuaguauucucuccuuaggcccacuggcucacucaaauaauagcuguuuauaaagaugcuaaccggaguuuuuuauuuuucauuuuuuuaaaguucuaauuucuuguuuuuucccaucuguagacaaugaugaugagcucuuaagguuuauacauuuuuugaacccuucaaauuacaaaaguuggugauauuugguacugggggucaagugugaaagaaaucugaaaauauugcccauaucaguggagacuaaaggccauuuguuauuuucuucauuaccagcaaagcuucaguuuaauaaaaauauuauaauugaauuuacgauuuugauuccacaaauucaaaaagaaauauuuuccuuucuaaagccaaacagaauaaaaauucucauaagaauuuuuguuuaaauagcaaaaccuauucuuaggauuuaacaauugccugagguuugucaacaguagguagcauucuuuuuuuauauauugcuaugaggccaaaaaugcuauuuuccuggagauuagugcaaaauaaucuaccgaauaguugcuaaugaaauuaucauaugagaaagauuauuaauaaugacuuuugauuuuaaaaaauacuaucaucaaauuuuccuaagaaaugaugaugagaaaagcaguuuugaaauacaaagcugggugguagugggccuggugugcacugcuggaagguugcaugguacuuugugaaacuucagcagcccacuugcauaauuuaucauuaccuguccccuaccucucucuacuuaauucugaaucuguauuucucagauaaacauggcaguaggaaggauagggaaagguguugaggggaugugauuauauggauguuuuugaaggggaguauauuggugucaugggauccuugggaugucaucuugccagcuggaauccucuguggcagggguaccuucucucugaguauugcucaugcucacugggcacugggcuuguucugcccaguuggcccagcaggcugcacuuggcucaugcuacuggcccagaucccacaccugccaagggcgagccaggcguagaguggcaaggggugugugggugaguauauuaguucuuuuccacgcugccaauagacacauacccaagacugggcaauuuauaaaaaaagagguuuaauggacuuacacuuccacauggcuggggaggccucacaaucauggcagaaggcaaugaguagcaggucacaucuuacguggaugguggcaggcaaauagagcauuugugcagggaaacaccuguuuuuauuuuauuauuuuauuuuuuauuucuuugagacggagucuugcuaugucacccaggcuggaguguaguggugugaucucagcucacugcaaccucugccuccugguuuaagcgauccuccugccucagccuaccaaguagcugggacuacaggcaccugccaccacgcccagcgaauuuuuguauuuuuaguagaggcaggguuucacuuuguugaccaggcuagucuugaacuccugaccucgugauccgcccgccucggccucucaaagugcugggauuacaggcgugagccacugcaccuggccugaaacuccuguuuuuaaaaccaucagaucucuugagaguuacucauuaucacgagaacagcaugggaaagacccccaugauucauuugccucccacuggguucuucccaugacaugugggaauucugggaguuacaauucaagaucagauuuggguggggcuacagccaagccauaucagugagugagccugggguauggccacugcucacagccaggcaugccugcugcugcggcagggugggcagccccaggcaccagaacaggugcuggcuccaugcaaggcuguggcuggacaagauguacugcauguggcuuccacugugggcaccccugucuggaugagggcaacaagguggcacccagaagcuuggagauaccaggaaccacagagccccaaagagggugucacagcccugccucagggagccccuaggucugggcucccuaaagggccgcagcucuucucuccuucucauuaacugcaacguggcgagcaggggggaaaguguguuucagcccuguuuguguuacagcucaucagugcugccauucaacaggucucgaguucaugucccaugccuaggaagaaugagguacagcagacaacuggagugugagcaaggcagagaggagcuuuauuugauccacagaacagcucccaggagaccucaaguggguaacuccuuuccacaggcaggucaucccuaugaguguccagcucucaguggagaggcgagccgcagugguagcuccuuucugcagcugguaguccgaugucuguuugagccuggcugagucucggguuuuuaugugcuuagaagggaagaaguacauguugauugguccaugggcaggccuggaaaaagcaccauccgauuggccaaauggucaucaaugaagucuucacucugggcggcagacuccaccgggaacuggcacccuggccgcuaggcuucagguugucccuggcuugaagguggaauuucacuggggaccugucccuuucugcccugaaaccugucugccucccaccaucaaugugccauccauggcacucaggcuguugaugccaagggacaccuguaggcccacgcugagccaccuucaguccuaccuuggccucccucuugugcucaugggugcccaaaaucuggagggggugcugagguggcagggggcuggcgugucaaugccacccgagugcaugcaugccuggccagguugugacagcacucaggcuuagccucaauuuuccucugaaaucagagugggcuccagguauggggagaagccagguauggggagaggccagguagcgagaguaggcacuuccaagacugcucgggcaggggcacuuccccaggcgccugagagcucagggaugccugggucuggagccacagcugggcagcugcaugugugcccaggagcaugaaucucccucucugccaacucaguggaggguggggcuccugccuguuccuggccccagccggcuccucagagcauacagccccggcugcagccagcaucuuggcagcggcugcuccagacaggcugccacugccaucacugggaccauguagggaguauauuagggcugccccaugguucuccagauagacuaaggagacaaauugacauaguacaguauuagaaggaaagaauauggaguuuaaaaaccguuuucauggucauucugccccugcucuucucuucccccuuucaaacugagcagacccauauuucuccuuucaucucuguccuugagccuaccuucagcucuuuggcuuucauuuuacucccuccuuccacccagugucuuuugcuagcuucuugacccagccaggauugcaugggacaucacuuagaucugcucucagagucacaaaaugccuuugcuuccuguuuccuuguuccuuuuacugugcugguucuuuucgguaaacuuuuagauuuaucaucucuagauuagugcagcauuauuuagcucauugcuauuguacucugguuuaaaaaauuucagugaccauccacagccaucuaaauaagauugaagccucuuaguauaggacauuuuaggcccugacuaauccugcugcaauguaccuucccaguugccuuucccacucucuguaaacaccaagcugcaacuacaacugcuauuuggaugaacccuguguuuucuccacauuccugugccugugcuuuggcuauuuucuuuguuuagaauauucuuuuuugacauauuugucuuccauugacuaguucagacccacuucuuccuugaaguuuuuaugaucuuuuuccuuguaaguaauugcauugucuucccaacucuuaugauccuuuguuuauaacaagggucaccccagaauuuaucagcuaauuuaggacauuacugggaaugaaagggggaaccauuaauaauuaccuuggaacaauaagcauuaaucaggacuuccugaaaaacugggauauauagucacucuguaauucacuuuuggccuuuuucauaccauacucuguuuugaguuggagguauacauuuucuucuuuccacugaaauguugagcuccucgaggaccucacugugugacacagcaaggggccuaggcuuaugucacauauugggaaacaacacccuuaaaaccacugcuauccuuuacucgaggauacccuucucauauuuauaguuuccauucaugucucuuuccagucuuuucuccauaugcuagccagagugaucuuuuaaaaauauacauaugaucauauuauucccacaaguaaauccucucaacugcuucucaggguauucagauugaaaaucagacucccaucaucugcagugcccaguuauccagugcuguuucuucagcuucaugucaugcuucccuugcuuacuggcuccagcucccgaccuuccauucccucccacaugccaaguuccuucguacccuggacaccuuaugcuauccucuuuggaagaaaugguucccccucuguuuuuugaaugaugagauccuucuaguccuuuaggcuugaacugaaaugucaucuuucauaggggcuuuucucgaccauaugguuuauuuaacucaggaucugccauuugucuucuguguuuugcacucaccuuuuuaacuuccuaacaccacauuuauaauuauagauuuuucuuucuauguccuuccuuaugucugcaccuucugcugcacuccaagcucuacugaggagagauaucaccuccaccacaguguuuguagcacauugccuggcacacagaagguggcacucaauaauuaaaguugagugguuugaauaauuuuugcaauggaugacauugcuaauuccacacuccuguuacauuccaacuuuaauuggcuacaaaaaaaagcacacacacagacacagacacacacacacagacacacacacacacacacacacacacacacacacacacaaacaauccagaccccaauacaguaugacuguugucuucucucucuggggauaugcaauguaaaauaagauacugaugagcgcaugcugcacaccaagcaaaaauuuaucccaagcaaccccugcgcccugcguggaccgugucugcuguucucccauggaaucuaucagcaguuugucuucccaggguuguagccugucaggaugguagaauugcuagugcagccaggaaaagcugaccuaggaaaaccauagccuuccaucuuuuuagagguaauccaaaagagacuagacaagcagaaagacggagaggaaaguuggugggagugaggugaaauucacugaguacucuuuuauaugcaaauauuuguguggggcucuacuuuuuuaccaugaguacaaacucuuuuuaguaucaaugcaugaauagcgugucuuuucacugaaaaauuauugucccacgugcccucgguuuaaaauguuuugaucuuagaaaacaguuuauuuccuuuuaaaguggcccaauuaauucauuuuccacauauuugcucauugagcaaacaucaacugaacaucguuugugugcaaaccuuauacaagaaacucugacauaacagggaggauauguuuaaugauaacucugcccaugauguguuuauggcuugcuagauccauucugacccaccuauugugaagaguucauggagagcucuuaacaacaagugaggcugaggcuggcagauuaaaugcaguucaaagggagacaagguugaacaucuccuagagagggaauaccuucagagauacauauuaaaguucuuuaaaauuguuucuuucuuauugugccauuuuuguugaccucccuucuguccuuuuaagaaacuuuugagaaaaaugcauuauucuaccgaaagcaucggcaaauguuggaaauaguauuuuguguaucaguuuucuuggcugcuuauuuuuaaaaauaaaggcuuaaauaagguucgcacauuuuucacucaggugcaauuuacugggaauuaccuggcgcauugguuuuaugcuuaauauuuacagauuauuaaaaucucaguggcuuucaaacugcauggaccaagaaaauagguguauuuucuagaaaugguuuugcuuauggacacugacccacuuugaaacgacuuacucuuggaacucuuaguacaggaaagucuuauguuucugucuagagguggaacuguuuaugauaaauagaaauagcuuuccuuuucuaucauuucuguuuucuuggaaguagauuauuuuugaugcaaguagaccuucagaauuugaauagaaauuuuuauuuauuuauuuauuuauugagacggagucucacucuaucaccaaggcuggugugcaguggugugaucuuggcucacuguacccucugccccccgggcuuaagugauccuuccaccucagccuccugaguagcugggacuacaggcgcacaccaccacaccuagcuaauuuuuugaagagaugggguuuugccguggugcccaggcuggucucgagcucuugagcucaagcaauucucuugccuuggccucccaaagugcugggauuacaggcgugagccaccgugccuggccuuuugaauaaaaauuuagacuucagauuuauauagugaguauacugaugggagauugaacaauuacgugaucucaggaguagauuauagagcuguuucuaauuuacuaucaaguuauuuuuuucccaaaagauaauuuauaaacugcuuuuuuguuuguggaaauccuguuuguuaggaaguguuacaaaugguaguuucccagugaauuuaucaaaaugcuguuuauucaauaacauucacuccuccaaggauacuacucacugucccuugacauucauucauuaaauauuuauuguucauguacugcuauggacagacauaauuuugggugcuuauauuagugaacaaaauaaugaauacaucugcccuaguggaaguuacauucucuucauauauuaaauucucuuaguaguauacagcuuccauuuaaauguuuaacccagaccuuucuucucaacuucuagauucauaaacucagcuccuuaucagaguuuugcugccuagaucauucacaaacauuucaaacucagcauaucucacuuugaaaucuauaauggugguccccaaauugcucuuccuccucaauuuccuuccuuacugugugcaccaucugcuaagcauccaagccauaaaucuguucauacuagaaaccugcaagucaaacuccucuuccccucuuccccccauucuuacauccuauagauuuuuauccuauguauuucuuaucugacccucucucuucaauguuuucuauccuuccugcgagugcaguaguucagguucucuuucucuuggaggugugaugacuagcuucucaucugacuucucagccucuaaucuugccacuguuaaauucugcuccucaaauuccuccauuauuguguucuugacagcaugcaaauugaaucgugucauuuguuucaagaguuuucauugacuuuacuuauagguuaauuucaacuuucuuuauaugguauagaagcccacacauuuuuuuguuuuguuuuguuuuagagaggaucucacucucuugcccaggcuggaguguaguggugugaucauagcucacugcagccuccaccucauggguucaaaauguccuucugccucagccucccaaguagcugggacuaaaggcaugugccaccacaccuggcuaauuguguggguuuuuuuuucuuucuuucuuuagagauggaggacucacuguguuuucuaggcuggugcccacacauuuuaaugccuuucagagcauucccuuuuuuuuucuuuuuuuuuuuuuuuggugcuuccuaaucccaugccccuaucacaucagacuuaaucuauuuucuauaaugucuuccuucacccacuccuacaaaucugaauuuuuuuuuuccuucagugagucugaucuuaguuacaugugagaaauguaguccuacuaaaucagaaauggacuauacuaccucuuagaauaacaucucuugaaagggauccccuauagcuuuaaggggccugcugguuuuuuguuaacaugggugaauuguauagugguaaaaucugagauuuuagugcacccaucaccuaguaauguagguuauaacuacauauuguaguaguuacaauauauuguuuuuugucccucacuccccucucacucugcccucuucugagucuccagugucuguuauacuacucuguaugccuuugcauacccauagcuuagcucccacuuauaagugagaacauaggguauuugguuuuacauuccugagucacuucacuuagaauaauggucuucauuuccaaggacaccuuuguuguuguuguuguuguuguuguuguuguuguuguugcgacggagucucgcucugucgcccaggcuggagugcaguggcgcgaucucggcucacugcaaccuccaccuccuggguucaaacgauucuucugccucagccucccuaguagcugggacuacaggugcccgccaccacaccuggcuaauuuuuguauuuuuaguagagacaggguuucaccauguuggccaggauggucuugauuuccugaccucgugauccaccugccucggccucccaaagugcugggauuacaggcuugagccaccaugcccagccccaaggacacauuuuuaaacuaagaaaauguucaguuuguuagaauuuaauguggcauagggaaaggaaaaugaauuuuagaggaccagucuuuuacaaaagauuacugcaaauuuuggugguuucguucaaaaacguaaaaaagaucaauuucuuuuuucauaaugguaguugcuggacccuuguauugguguggccauuggagauuacagaagccuuuuguuacuggaaauaauuuucaggccucagaguuguaagucaagaauugccuauacugaacccuuuggagucuuuucauuguuacgagguaacuuugcuuaugugugaauuaaugcuuaggcuuucaaagcaagaaaaacuagacaugauaugaacuuugucauucugcuaaguuaauacugaaaugaaaacuuuuacugauacaaagacauuucuguuaccaguaaauuguguagacuuugugaggauuuugagaugugauuuauauuggcuuauuuuuuaaaaagcuggcuuaaaaagugaccacaagugugcuaaaagguuuauuugagguaaccacaguauuauaguuccccuggcauaauuauuccguauuuuguuuccaugagucaaggcacaaagcaaggauaaucauaaugauuguaggaaacagcgcuuagagcugggauccuaggauuuuaauacuaggaucuuuuacuuguugcagcuuccacauuccuuuuugaaaagcuuuuuuuaaacaauauuuuuuagggcacaggcgaacuauuuuagcagaaugaagcaguaauuuaagaaaaaucuuuauauuccuguccauuuccacauucuuucugaaaggcuacucuuggggguagaaauacagcuguggaugaaaagauugagguaaggaauacuuuucucuuaaauucuuguagcuugggucauuaacuauugucauauaugucgaccuaguucauggcagccagaggagacaagguauaaaauugacuggguugugauucagagggggaaacaauggaaaauauauugaacacuuuuacauuacugagaccccuucuacacuuuuuuccucuuugguuuuagacuguauaaaguauuguguugguacuguagauacagcguguggcuauugauauugauauaagaaaaucuguuaagguuccucuuucagcaguuauggggaucuucauucagagcaauaagaucauuucuccuagguguuacauguuggcagacugaagaagacaaagacgucuugucuucacauuguuuuauggccacgacuuugaauucauuugaucacuuaagagguaucgcagacacuguagcuaauuagaaggaagggggcaguuuuauugugaauauguucagugaagaagauagcaguguuuguauugcacaggcuguaugaacguguauuuuguuggggagagagagacugagaaucuggauucuuggguuaaaguuucuaccuugcugcuggcacuuuguccuuaaccaaguuauugcugcucuuugacccucaguuucugugauuguaccagaaugcagauguuguauucuucuaacacugugaagauguuauacaugcuggaguacuuaaaauucccucuuccuuaaaauugagaaaaaaaaguagauuaaaaaaacuaggaacuaccuggacuuugauaauauuaauauuuuagauaaaccagcacugaaguaugugauaccuacaaagaacaacaccucaagaguuucugcuuugugguaaugacucacuuugguaaaauuaugcugugcacaugguuauuagacuacuguagauaccaguggguacauuagauugaaaaacguaaaugaaguggucuuauguauacaauuuuuugcaguugccuuuuguugggaagagauuaauaugagauaguguaacuuuuuuguuuggggugggcgggggugggcaugccuauugguggugaucugaggauuguaacuuuagaucuuuuacauugaaauuauagaaauuugauuguuauggauaauucauggugaaggaauguaaugaaauuauuauuauuauuauuuuuaaugacuaacccauguuccuagauguauucauuuuuggcuuagcucuccucuccucuccucuccuguccucucucuuucuuucuuuuauuuuuuuuuagagagggggucuugcuuugucacucagguugaagugcagugguacaaucucacugcagucugaaccuccuggcucaagcaauccucccguuucaguccccuaagcagcugguacuacagguaugcaccaccaugcccggcuguuuuuguauuuucgggggaggcaggguuuuuccauguuucccaggcuugucucaaacuccugagcucagagaaucuaccugccauggccucccaaagugcuuggauuacagguguaagccacuguaccuggccugcuuuucaguuuuucaguaaguaaauugugaggcauauauguugauucuucuggcuuuggaaaauccuucccuauacccuauuuauguagacugaaugaaauugauaagauacaguauuuucuuccuagacuguucaacacuggcgugaaaugguucuuguguaggacuccuugcccucuuccagguagcucucuuuauucaguacauguuuuacaugcauucucuguguuucaaaccugagagaugucagaggaauauaagagauggucccuauuuuccagggcuucaccucuggguuaauuacuuugggacaguuuaaaguaaauaaacuguaaaaaaauacucuuggaaaaguuggugaaugauacgugcuuaauuuuucacuaaucucccucgugguuuuuauaaugccauguguuuuucuugggaggguuuccuuacagcuguauuugugaucuugggcuagaauuuaugagcugccaccaugaaggucugccucuggcuuuggcaucagagauggcgaguugugugguuuguuuucuuauuguuaaugugagaauuuuuccuaaucaaaauaaaugccuauguguuuuuccugacuuucuuguuggauugacuaaggaaguugugugaauuauaaaaauuucuuccugaaaugaaggacaaaauuuccaaagcaggaugcauugagauugucugaagaaauguaugucuucugguuuuaguauuuagacuugaaguuuuuuuuuuuuuuuuuuuuuuuuuaaccguaauaacuaggaaaaguagaaaaguuaaaagaaacaaaaaacaucacggugggaaauagaaggagaaaaccagacauuuaugaaaaccauucuggaucucacagaugcuauuaagauuaguaaacguuggccgagcaugguggcucacgccuguaauuccagcacuuugagaggcagaggcaggcagaucaccugaggucagaaguuugagaccagccuggccaacaugguaaaacuccccaucucuacuaaaaaauacaaaaauuagccaggcuugguggugugugccuauaaucccagcuacuugggaggccuaggcaggagaauugcuugaacccaggaggcagugagccgagaucacaccacugcacuguagccugugcaacagagcgagacucugucuuuaaaaaaaaaaaaaaaaaaaaaggccgggcaugguaggucaugccuguaaucccagcauuuugggaggcugaggcaggcagaucaccugagggcaggaguuugagaccagccugaccauuauggagaaaccccgucucuacuaaaaauacaaaauuagugggcaugguggcacaugccuguaaucccagcugcuugggaggcugaggcaggagaaucucuugaaccugggaggcagagguugcagugagccgagaucacgccauugcacuccagccugggcaacaagagugaaacucugucucaaaaaaagaaaaaagaaaaaaaaauuaguaaauguugacuagucucagggauauuugagcugcacucaguaggcuacuuugcauuuguaaaauucucacacaucaaauugcaucaucuuuggcuuuuugauuucaugcacgcagucugugaaaggcuaagccagguaugugguuacauauaaacuuacuaccaacuagcgcuguccuuuuucuacuccuuaagagguuuauuggggcaauaaacuguuggcauuauuacucaccuagcauaagcugauccuuucuuugacuguuuuuaaggaagauguuguuuuaucugcuaaaacagguagcacgagauugacuucaccaaagccucuucuaagacuuuagaaauggcuuaagcuucgcugcuuucuuagcacuuuuacuguauaggcccugguaugugguauugauacauacaguaaguauaaaugugagaagagaaaccacauuuucaugcucuuaagugauccaugcuguuuucacuucucagggugauuuuugguuguagccaacucagaaacucucaauuuaauuugagauugugugaauugcuuuccuagucuguacaccagaaagaaugcuucucuccuuacacauuucgacacuucuuagugaagaucauuuacuuauagaguguaugcauuauauuagcauauggccuggguaacuucagacuuguuaacauagcgugggaaagguuacugaaagcaugaggaggcaguauauuaucucucaguugauuuuguacaccauuuugaauauuuucuguacauucccuuuccucuaguguugguuucuuauacuuauaguaaagggaaacugauguugauauuguucaaaaaagaaaugaagugaauuuuuguauuuuuaaagaauaaauuaacaugcuuuaaagugcuuaaccaguuguuacaauaucaguuaucacagauugguaugcguugguccauguuauguauuugccugaaucaacccuaagacugguuggcuuauuucugccuuuucuuuuccaaaagguauacuugacaugaaguagacugugccuguuugauuuuaaguuuugaauauggugggagguauagauuaaaguuaauuucuuuugcauauggauauucaauuuuucugaaggcauuuuugaaaaagcuguccauucuccaccuuugcauugccuuuguacuuuuguaaacaaucaguuguccauguaugugugaguuuauuucuauacucucuauucuguuccuuugaucuauuugucuaucuuuaugccuauacuauacugucuuuauuacuguagcuugcuuuguaguaaguuuugaagugagauaauguuacauaguuuuggcuuuuuaagauucuuuucacuagcguaugacuuuuagaaucagcuugucagguucuauaaagaaucuggccaagauguugguugagauuauauugaucgugugaucaauuuggggagaauugacaguuuaaaauauugaguuuucaacucucgaacaaggucuaucucucuauuuagaucuuacuuauuuccuucagcaauauuuuguacuuuucaguauauaagccuuucauauauuuugucagauuuauuccuauguguuucauauuuuugaugcaguauuaaauggugguguuuuuuaacuuuaguuuccaguucacuaucaauauguagaaauucacugauuuuuguauauucacuugcauucugcaaccuugcuaaacucacuuauuaguucuaguaguuuuuuuuguaggucuuacuggauuuucuacauggaugaucauauuuuuagugaauagaagcagcuuauuucuuuccuccuaaucuggguaucuucucugucuuuuucuugucugauuucucugucaggaacuuacaggaucauguuuaauagaagagacaagacuggacacuccugcccuuuuccugauuuuagggggaaagacagaaucuuuugccauuaauucugagcuuagcuauacguuuuucauagugcccuuuauuagguugagaauguuccauucuaaguuugucagaauuuuaaucaagaaugcauguuauauuuugucaaacaccuuuuuuuugucuaucaagaugaucauaugauuuuucuuuuuuuguuuauuaauauaguaauacauugauugguuuuuaaaugugaaaccaaaaugcuuuccuugguaaacucuauuuagucaugauauauuaacuucuaaauagauuguuggauuugauuuguuaaaaauguuuuaaagaauuuuuacaccuguguucaugaauaaaaauuggucuguaguuuucuuuugaucuauuugucugguuuuauuaucagagugaugcuggccucauaggaaagguagggaaauauucccuuuuccucaguuucuuagaagaguuuguguagaauuguuauuauuucuuuugucuuuucuuuucuuucuuucuuucuuuucuuuuuuuuuuuucuuuuuuugagacagaguuuugcucuuguugcccaggcugaagugcaauggcgcaaacucagcucacugcaaccucugcuuccuggguucaagcgauucuccuaccucagccuccugaguagcugggauuauaggcaugcgccaccacgcccagcuaauuuuguauuuuuaguagagaugagguuucucccuguuggucaggcuggucucaaacuccugaccucaggugauccgucugccucugccucccaaagugcugggauuacaggcaugagccaccaggcccggccuguuauuucuuucuuaaaugauagguagaauuugucagugaauccaucugggccuagaguuuucuuucuguggaaagguuuuaaaugaaauauucauguucuuuacuaaauauugaacuauuuauguuauccauuucuucuugagucagcuuugguaauuuaugucuuuucaaggaauuuuuucauuuuaucaaaguuguugaauuuauuggcauaaaauucauauaauauuccuucauuauccuuuuauaucuauagaaucuauggcaauucuauaucuguugauagccuccuuuccuccccucuucucucucugucauaucaguaugacugggaguuuauuaauuuuauugaucuucuugaagaacaagcuuuauuuucauugauuuuucucuguuguuuuauauuucauugauuuccuucuuucugcuuacuuuaguuuuacuuugcuuauuuuucuggcuuuuaaaaguaggagcugaguuuguugauuuaagaucuuucuucucuucuaauauagccuuuugaugcuauaaauuuacccccaaauauuacuuuagcagcaccccaaauauucugaucugugguauuuucauuuucauucaguuuagaguacuuucugauuucccuugugacuucuaauugaaacacuccaaauauuuuagggguuuuccagggaucuuucuaguauugguuuauuacauuaaaucagucaauuaauuaauuaagagacaggaucucacccugucauccaggcuggagugcaguggcgugaucauagcucauugcacccuugaauuccugguuucaagugauccucucauaucagccuggcuuuuaaaaaucuuuuguagagauagugucuuacuauguugcccagcauggucuugaauccuugcucucaagcaguuuucccuccuuggccucccaaaguguugggauaacagguaugagcuacugaaccuggccuggaauugguuucuuauuuaacuccauugugauuuaagacagacaaacacuuuaacuggguaugguggugcgccuauagucccagcugcuuaggagauggagguaggaggaucacuugagcuaguagcugaguuuagccugggcaacauagugagaccuugucucucuaaaaacaaaaaacaaaacacaccuagaaacaacauugcuuguaugacuuguauccuuuuaaauuuauuggcacaauuuuauggcccagaauauggucuuucuuuguagauguucccugagcacuugagaggaacguaauuuucuucuguaguugguaggaauguucuauaaaugccagucagcccaaguugguuuauaguguugcucaguuuuauuauauccuuacggauuuuuugccugcuuguucuaucaagagagguauauugaugucucuggcuauaauugugguuuuguuucuuuguuccuauuguccugugcuauuuugaggcuuuguuauuugguacauaaacauuuaggguuaugugguauugauugauugaucccuuuauuauuaugagaugaccaccucuaucccugguaauagucuuugcucugaaaucuaucugucugucugucugucuaucuaucuaucuaucuaucuaucuaucuaucuaucuaucuaucugccugccuaccuaccuaccuauaucugucagucauguaucucacuuuauuaucucuuuuaauuggaguauuuuccauucaaauguuagguuugagacuuucauguugccauuuguuuuuuguuagucgcauuuuuuuuccuuacccucuuucccugcagccuugagaaugaauaaaguauuuaagauuucauuuuaugucuuuuguucccauauuagcuacaauuauuuuccucuuuuuuuugugguugcauuagggaaauacuauauauacacuauauauaauaaagauauauaaauauauauaaaauauauauaaagauauauaagauauauaguauauauaagauauaucauguauauauaguauauacauauaaagauauauauaaagauauguaagauauauagcauauauaauauauaguauauaucuaucauaucuuuauauauauaaagauauauaacauauauauuauauauauacaguauuuucccuaaagcaccacgaaaaacaaggaaauaaaaaauuguagcuaauaagggagcaaaagagauaaaaugauauguuaaauacuuuauucguccacaaggccgcaagaaagaggguaaggaaaaaaaugcaacuaaugaaaaacaaauggcaacaugaaagucucaaacuuaacauuugaauggaaaauacuccaauauauuuauauauauauauauauauacauacuauauauaucuuuaauuuacaguggucuaccuucacaugauguuauaucacuucaugaauaauacaagaauauuauauuuacucuucuauuuacuuacauuuacgccuuuauagccuuuauacugucgaugacaugaguuuuacuuuuguauuuguuaaaaaggcuacaaaacauuguuacuauuucugcuuaaacagugaauuaucuuuuaaggauauuuuaaauaauuaaaaaaaaaaucuuguauauauccccauguuuucacaggauccuuagggugucacuucgucagccagaaaccucuguggccagcguugccucugcuucaguuuuucucauuccugcugggcucauuccacccacucugcccgacaggcugcgcucagcuugugcuaccaaccucgguccuacgccaagggugagccacaugcagaguggcaaggauugugugagcaagugagcgcagggucuggccacugcacacagccaggcuuaacggcugcugcaguggggagggcagcuccaggugcccgcacagguaccggccccaugugaggcuguggcuggaccagauguaccacaaguggcuuccacugugggcaccaaugucucuggaugaggggaaugcaguggcaccugaaagugcagagaccgccaggaaccacagagccccaaagagggguauuaccgggcuaccugaagggcugcaggucuucucuccuuuucauugccugugguggugggguguuaucccauuuguguuacagcugucuuagucuugccaucuggcaggucccaaguucuugucucacauccaggaagaauggguuauguggacaauuguagggugaucaaggcagaaaggaacuuuauugagugacagaccagcucucaguggagaccugaagugaguagcuccuaucugcaggcagguagucccagugagucccugagucuggcugaguccaggguuuuuaugggcucagaauuuaggaagugugugcugauugguccaugggcagccaugggugggccuggaaaaagcaccauucuaguggccaaaaggcaucaaggaacuucucacucgggguuauggacuccacucagaacuggcagcccagcccacagacuucaugccaucccugccuugaaggugggauuucacugcggacccacccuuuccugccuugggaccugucugccuccugccgugaucaacaugcuguccacaguaaggcugucugugccaggaggcaccugcaggccuauacugagcugcccucagcagcuccagccucccuccugugcuuacacccaaugucuggaggggccugagguagcagggggcugguauaccagcaugacccugagugugcacauaugccgcuaagucauaacagugcccagauuggccacaacuuugcuccaugcugcauuaggcaccgagagagcagggagaggccagagaagcaggagcaggcacuucugagccugcagggcuucccgagcccccaagaacacauggaugcuugggucuguagccacaucuaggcagcugcagcugcagcugcaccugggaguguggguuccugucccgccaacucuguaaggugcagggcuccugcuaggaucaccuguuccuggcccuugcugguucuaagugaacaggccuuccccacugcagcggguguccucgcaguggccaauccagacgggccaccauugccaccaucaaugugguuaccauuucuuaugcccuucauuucucuggguagauccuauuuacaucugagcguuuuucuuuugccugaaggccuucuuuuaacauuucuuacugagagaauuuacugaugaugaaaucauucagcuuuuguaugccugaaaacaucuucacuuugccuuuguuuucaaaauuuuuuucugggaauauaauuuuaguuggacaguuacuuuuucuuuuaguaauuuaaaaguguugcucuacuguuuucucuuaguguuugccaugacaaaauuugugucacucuuaguuucugguaauguaacuugucuuuuuuuuugacugcuuuuaaguguuuucucucuagugcugcuuuugagcauuugguuacauugugccuuacccuaguuuccuucauguuucuugugcuuuagguuuguugagcuucuuugaucuaggauucaucauuuuuaugaaguuuggaaauuuuggguuauuauuucuuuaagguuuuuuccccuucucuucugcuuuaccuuuucagggacuccaauuaaccagauacuagauaguuugaacucuuccuagaguuuccugugcuacuuugauuuuucuucauucuuuuuucucuuugcauuucaguuuggauaguugcugugucucagguucaccagucuuuucuucugcuaugucaaaucuguuguuaguccuauucaauguguuuuucaucuccgacagcaguuucauuucuaaagauuugguuacaguguuuuuaaaaauacuuacaagucucuauuuaacuguuugaacuuuuggaauacagguacaaugauuguuucaguguccuuguuugcaauuaaccucagugccacuucuggguuguuuucacuuuauugauuauucuacucauuaugggucaugcuuuucugccucauuguguaacuggugaucuuuggaugccagacauugugaauuuuaccuuguuggaugcuagguauuuugguauuucuauaagucgccuugagcuuuguucugggaugcaguaaaguuacuuagaaaaacuuugaucaccuggaguuuuguuauuggcauuuguuaagggaaaucuggaaaagagcuuagucuaggccuugguuauuccucauuacuuuugcaagaccuuuuugaguauucaaucuaaucaucugugaaguaugaguuuuuuagucucucucaugggaacaggcacuguucagaguccugugcgagucccaagaaauguucucuauaauucuuuuggguguuucuuuccccagccuugaguagcgucccccugcuuucgagccagucuguacuguguugcaggugaacccucuguagaucuccagggcucucucucuguguaauucucuucucucuaguccucuauccuaugaaccccagcugccuugauguccucagacucaacucugucuccucaauucaucgaguuggccugguucugccccaguuucaucuccugguauugcacccuggaaacucuccagacaauaaggugggucaguuauagggcucucauuuguuuccugcaucucagagauuacugucauuaguuacuucaugucugguaucuugaaaaccauuguucauauauuuuucugaguauuuuuuguuguuucaggcaggagacuguaucuagucacuguuucuccaucuugaccagaagugguucucccauauuucauuuaacaacaucaugaaaucucuuucagccaagcucaagaccauaauuuguccuucucugccuucucuuuugacccaaugccuuguucuuucagucuugucaguucuuacuuccuaguauauuugacauucuuuuguacuuaaugguaaaaaucuuuagguaaacaucaucauuauuaacuuacacuaaaaaauaguaaaaucauuggaauggagggaauauugucagaauaguuauaaguuuuggugcccuaucccagugccaucuuuaaggugaguauucagggaauauuucuuauacaucuuaauucaguguaaaauuugcauguuuuauauguugauagagcagaauuauuucaggaugaguauauuuguuuagaucuuuuaaaaaauguaucuuuagggagguuugugcuuuuccagacugagccagaaugcucguacugcauuuuggauuuacacacacacacacacacacacacacacacacacacuacuuuuuuacuuuccaguuuccccuguuacuuggugugcugcuugaaaccagacuugccauucuuacaucuccagaaccucauaccaugccuggcauaguggcacucaauuaaggucugaugauuuguacugaguaagcuauaguuuuaggcuuggagcauuguuaaggcuuugcauagaaucucugcauuauacagaaucuuaacugucucuacauuacaguauaauccacaucugcaucuuugcagcuugcuauuauacaucuuugguuugcugugaaagagcugucagagaaugagcucuuuauugcuuagaauuacuaguuaacuauuguuuugccauugaucagaaugucuccuuuuucuguucugcuguauucauugugguauuuuguuguaaucagagauagucuuggaggugcaagacuuauuggaucuccguuugugccauugucgcaacaucacugacuuggugaggaucagucagggguuucuuccuucuguuuuugucauggcagucuuacuuuuugaaacauuugucaccuucucugauccugccuccugcuuuuccccaucugcacucugaccuauacuguuuuagaaggaaaagauaauaaaggucagauuuuauaaaacucuguucaagaaauacugcauaaagggcucuucaagauaaaagacuaccccgcuugucaggcagccugcuaauuugagagugcugacgacuuaccuugaugaggcaaucuucgaauugaugacucuuuuuaauuaauugucuuuucauugauaaaacagaauugcuuuguuuuccuuuuacugcccaucucuuccucacaaaauauguuuccucuccgaacacacaaacuguguuuucagaaucuccccugagucuggaggucuggacaguaguguguuugugugcuuguguguguauaugugugcacacacaugcacagcuugugugcaugguaucugugauuucugugugugcuuauauuuuucacuauuuuggauucauccaguucuauaaagacauacuugcuugcuuugcaugguucuggcucccucugcagccccaaauggaaaagugcuuuguugucuuuuguugcugaaaaauccagcucucggccuucuuucuuugaguagagcaucccagcugguauacaaguauagauuggauuucagauuuagcaaugcauuguguuuugacaaagcuuauugaagauggaagucauuuuucaggagcgcucuaagaggugagaaaauggcaagggaggguggggaggaaagggagaaaaugcagaagaggcagacacaauugcaacauugauuugguaaauagaaaguuaauguagcuacagguauugacaguaaacuuuggcuaagauauuggagaauugcagauuggaaggcuagagcuauuucagaauuuccagggccauuuuauuggauuauacaccuuagaaccuuaacacacagcuucuguugauuaguacaguuuggccuccagugugaguuuggcuuugaacacucagugugacuuuggcuagggcuuggcaccuguggacuucagcuucuacuuuaguaaaaugaaugaguuagaacaaauaauuguuacauucaaauccagauuuaugaguguacgauaguggcuucacauuauuuguuuuaaguuaccguugagaauuugguucucaguaaucuagagcuacuauuuuagcagaauuauacaugggaugcagaauagaagcuuuuaagcaacagucaaccagauuggucuauaauaacuccaggauaaauacaagaagaauuucuggacacauuuugccccagugaaguaaaauuauuuacauucaaggauggauuuggaaaugcagguauuuuucuguugaucugcacguugguuacacugguguguucaguguguaauuacacuuccaugcaguuauuuuuguuuuuguguuagauuucaauaaacuauuauuuuuucuaacagaucuuaaacuuuaaugcuucuuuagaguacuaaucaaaguacuguuacauaaguaauggcucaugugugcgcacaggugucugcucugugaaguaguccauuucaaauuauaccacauuaaauugugucugcuuuaaaggguuaaaauaaguacauguauauauuuagauauauaagaugacuucuauuuaauagauaauuagaauguuuauguaauagauuuaugcuuucagagauuucauauucacaaaguaaguuuuggaaccuugaaacauggauaggucagugucauuugguuucuuuuuucuucguuuaauccuuuucaggacuucggcucccugugaguuguuaauguauaguguuuaugaauccaaauaacauucauuaacuuucuuggaaggucacaguuauguugguucuguucgaaauaaguacuauaaauuuuuuagaauaaaaaaggaaaguauuacagugaguuuugcuauccacuugccacuuuccuuucccuuccuuuuuuuguuuuuuguuuuuuguuuuuugguagggagggaggucucccuguguuguuuagguuggucucaaacucuuggccucaagcaguccucccaccucagccucccaaaauguugggauuacaggugugagccauugcacuuggcccuuucccauuuuugugcuugacuaguauaagugucauuuuuguuuucuugaaaccuuuguucuuucccaugugaauacacauaggaugacaauagucacaaaacucuuuccguacuuagaagacuaaaaccagaaauuguugcuugaacauguaauggauaauuguuaaaauucugcacugguuuguacuguucucgaauuuuuauguaaaggucuaguuuagagauuuauuauuuuuauuguuuagacuuaaaaggaaaacaguuagcugcggaaucuaguuuuuauccuggagcgaaacucauauaaccuuguugauuuuagugggaauuagaaaguucagacucuuuuuuuagaggucucccaaaauuguuuccacucuauguugaaaggaacucuaaucuacagaaguggaggugacaguaaggagggcaggggaugcucuucccaaaggaguuucuacaaugcagcugaguuagagugcaguagaaagagcgagaucucauaguggcauguuccugucacagcauguguauagcagucacagacucugaacccaaagacuguauuucuaguuggagcagacauugacuccuuuuucugggcugaaaacagugaaguguauugguuuugguagcuuggguuauaagaaaccuaaauuaguuugaaguggaauuauccugaugaaagggcaguugaaagcccuugacacuggacagaggauugucuagugucuaaucuuggcucaaaaugcaccagacauaaugagagucauuaugaacugcugaucuccuaccccuccccucagcagacccuauuagacuugcaaaaauagcaaacacuguguguguuuggcauggugccugcuguguaguagaggaagaaagcguaccuuguuugcaccacaaccagauacuggugcaucauguuacagcucugcuugguucugagcuccucuguucaaucucgucuugacagaugcugucguugccaccccuuagcaagacaaaugcagccacucugcaggaguuggcuuuugcccagcugugcuugccagggccccaaacugaugugcguguguaccuguggaaagguaacaggcuguggguguguuauccucugccauuaugugcauuaccuuuugaguuuuugccauucccgaaggaaaaguuacgguuuuguuuguucagauaaaucugaacccucaauuucucuuacugcuuuuuucacaacagauguuguuaggcacccacuaaagauccccaggaagggucccugccccauauaagcucacuuucucuguagguagaaagaaaugcaaacagucacauaaucacaaccuuaauagcuauguguauaaaggacucugggaaaaaaggacggaggggaucuuuggaggugcaugccaggagagaguugucucauacgagcuaugaagguuaaguauugcuuaggagguguagauauauguguugccaggguccaaggugaaaaaggagaagugguuugaaaugagcuuggugaaccuagguuugggccugguuuugaaggcuacuggcaauagggaaucaucauagaauuuuaaacuaggugaguagccuuuucaaaauuuuuuuaggaagcauuauucugguuucagucuggagaauaagauuauauaaaaagugcugagaguuggaaaagugccagccuauuauguugggagaaggaagcauggagagguuuuagaugugaccauuaguucagauagaguagugaagggagauaggacuuaaccaacaggaagagaaauuaaagagaguaagaaaggaaggucuaagguuuucagcuaauacuccccaggcauaguauuuauagggaaacagggaagguagauuucaguuuggggcagacuggauuuaaaauaccugcggaauauguagguauuaaugaguaaauuucagugugaaguuuguacccagaguugagaauagagcaggcugggcacauaggguucugggauaauugauguuacaaauuagagucugguuuagcgguuagagccaugagacccucuaauccaaguuugaugucccauggcaguuugaugcaggaugggaccaacauuauagaccuacuguuaccugcuaaaaaaggcauuuaguauauuucacuccugaguccagaaagccauuuaccaagagcauaucugaauuugugcggcagggaauaauauaacaaugaguucuguguauucacaauuuaggaauuaauuucacaagaccacagguuggaaauucuuguccucuaaugggauugagccuuuguggaaagagugucaccuguauuuuccucaucucaguagaugaaguaguuacuguuucuuucccacauucagccaauagcauacauuuuguagaaagcaacuaaaguuuuuccuccaaagcuuuaggccucuucucuuucaguuccucuugguaagaccuggccuguauuggucagucugccuguucuuucuacuuggcuuacaccaucugcccauugggaccuacagauuuuuuuuguuuuguuuuguuuuguuuuugagacagagucucucucugucgcccaggcuggagugcaguggcgugaucucggcucauugcaagcuccaccuccuggguucacgccauucuccugccucagccucccgaguagcugggacuacaggugcccgccaccacacccggcuaauuuuuuguauuuuugguagagaugggguuucacccuguuagccaggauggucucgaucuccugaccucguaauccaccagccuaggccucccaaagugcugggauuacaggcgugagccacugugccuggcugggacauacagauauuuuuuggcugcuuauaaguuuuuguucuccuaggggauuucugggacacuuaaauaugauuauauccaucagugaaugaacaauccauagaguugacaucagugguaaauacaguaaugugagagucuaaaacgugagccaaaguuccauuuaaaagaucuaaaugcaaauuaucucacuaaacuugagaauuauugaucaucucugucccuuucuccuuuuucucucccuuuucuuuccgucguuccucccucucuuuucccuuuacccucuucucuuccuuuccccgcucccuguucucucuucucuuucccccuuuuuucuuccccuccaucuuacuuucccuucucucucuucucauuugauauaacugacagauuugagcagaacugugaggcucuuaggagcugugugugauguggaguggccagaugacuuuaugugaguaugcacgagggacuguaaagaggcuguccagaggccagccucccuccagguuguuccuaacccuggagagucaucauauguuauuucucaucucagacugccacagaauugaggagggagauugaaggcagcucauuaaaccacuuuggccacagauaagaguguuaagagauuaagaaguagauuuaucugggggagggguuuggucccggaugaagccuuuuccugccgucggaaaccaaagauuuccuugucucuuuuguucugauccauggaaugguguggcuuagcugccucuaaaucuguuuuggcaagguuguuuguaaggagacauggcagggucugucuggagggaacagaaaagagaguacauauugaauguagaugcuugaaacuagaucauaguuuaccuaauugcagaccuugaagaaacucuuggggccacuuggaugggggugcuucuggaaguuugucucuggggguaugugaguauggaccucuuccacacugagaagagggcagagcccagucaucaguuuucaugucccugaguacaauauuaggcuucuuuuuauuauuaucauuauuucaacugguaacaauguuuccccucaggaaaugucuuuaccucucugaagagaagaccgugaugccagcuguuaguuugagaaaugcugcaggguccucuccuaccugcuguuucugugcucuuuccauguguuguggugaagccccuaccucuccagccauggggccuuguucuucaucauuuguuccuaucuucaguuugggauguggcaaggagaggcagagugcacuagagaaaucugauacuguaaugugcuaggagacagcaugaugagagguuuugggugggaaguccaugcuaaacaucuuaaaugcuucagaaacuucuuuacagaauucucugccuuuaggauucuccuguucaauaaauauauuuuucaccacuuuagaaauaaucuucuuaaagcccuuccuugaacucaugcaucuguaaugacugcccaugaccagcaguacuacauuguggaaugcaagaccuaauuagucuaagcaugaaagaccuuuuaguuucaucagcuaagcccccuuguccucccaggcauuccucuuuccaggugcugucuccuucugcagcuucccguaggccucuucccacugcucuuucugcucuucuauaaaacuccacauuuaaugccuacaccuuaccaaacuccaggaaacuuccuugacucuugcgggcuauauggaucucuacuuauuuuaguuuuugcuguugcaggaggaaaguaugauuuuuaaaauacaauaauccuuuuguaugucuacagaagaaugugguuuggugaguuuuacauuugaugcaugauuguauccaccauugugagauuauaaauaaaucucaagacaugaccuugcccugaacccaaaacuaaacaugaaugaaacuauagaaauaacuggauaaccucugguacauagagggucgguguuacagggagauaagcaguacacccuaaccuagggaagugcaaugagcagagaggggauggaguauguagguggagaaguggcuaagugucuuagauagacaagguggaaccaaaguacauagagccuggaagcugcagaaaagaacguaggcuaagaaacaagaucaauuauaggugguugaguaggugaguaagacagaaaugugugaggugauuggaagggacugcuacgauaagccagcugugcuuacaauggugaagauaaggaauggugacuugggaagauguauuggagaaaaaugauagggccugcugacugagcagcucaagcuuuaugggaacugcugaucauguuuuuaacugcuauagauauauuugauuuaaguaaaucaauuuguaaagauuuagauuucauaaugauaucuuagaccauauuugcacagcaagugaaacuuaaauacucuuguaucccuaucacaucauguuaucuuuaacauguguaucaacuuucuuaccuauaaaugcuggugacaccucccaguuuucuaggcuuaauuuguagagggcucaacaugugaacaaugaauuuggugcaccauucaagaaguaaaauucaaucauuuuuuucuccuauucauuucuaaggauaggaaucuuugccuuauagaaauauuuuaaaggagcccccuuaaaugucacacucucuuuaggcuuaaacuauucuuauuuccaaaauguaacaucagaaguucagaaauucuuucuacuuagguucucugugccccacacaaccucacauuuuugccugagucuccccagucuugcugcaggagcugggguagcuucagcccacuuacauccugccaggggauaaacuugauaccuuuugcuuucaugaaacacuaucugugugaagugagcucuuugauccacagucuuuuaugcugaagcuaagggaggauuaaggaacaccucugaguugaugaauauuugaugagguuuauauaauuuaaaauuacacucuuguuaacccuuucacucaauggagagagaagagaaacuuguauaaucgugguuccuacuuaggcauaagguacugugucuucucugggugcauccuccuuaucuauguagagcagagcaugggaacuuaguaaaugucaauugaugauuggcauuuuuuacagcuucauagagagaaauaucucuuugcuucauuauaaccauacugagugagaugcugaaguggaauugggaucacacaguaucuguguauuugacauugcauguauaauggugaacaaggcagauauuccacucaucauaacaacaacaguaguaaucauaccaccaggaagcauucuuucagugcuuacuguaugcaaggcucuauucuaaacucuuuucauccauuuuaauucuuagaacaaacuuauaagguagaugcuauuauuaucauuucuauuuuauagguaacacaacccaggcacaaagagacuaacucccacaagguuucacaacuuacaaauagcagagucaggauuugaaccugggcaggcaguucucagagccugcguuccuaacuucuggcuggaccccucauggugagaagggcagagaguugacaaauccucugaaguauggugaguucuguaggagucugcaacagggcgaauuaaccuagggaagaggaaggcugggaaggcuuuccugagaaaaugucuuuugggaugaaacaugaaggaugaguaggugcucucuaggugagggcucauggacaaaacuauuccaacauguguaguggccacaggcuggacagaauaaaauaggugauuuggaggaacaacagagagaagcccauuagggguagagaaagugagagagugugugucauggagugaugccacaggggccaaaucaugaaguccuccguaggucccacuuccaggaugugggucauggaaauauaaagggcuaaggacaaacggagcauucaagggguagaaccauggguauaacaugaugagauguaagcuuuaacguguuucucacuagugaugugucuaagucauagagggagacaguagaggacaagagugcagucaggcagcugaugcuguaauccaggugaaggaggauggcagccuggaccaagguaguagagguaaggauggauagaagcuuaggagcuuauuaggaugcagauaauaggaguucuggaugugggagaugagggugagggaggaaccaguaacaaugccuauguuaacagucagaagaagguuacaauguaaccagacuggaacaugaacaaauuaucugcaguggagcuuauuugcucaaaagaaggauccugcaagagaacauggauggcuugugucauccaaauauggauggcuuugcccaguuagagaauaauuccugcugagagaauacacaugcacgcaagcauguacacacgcacacacauuuguuguagaggguuauacccucccaaguuaagguaauuucauaauugaggucgacccucucgaugugguaccauugauaagccccagcacuacaguucagcuaccaacacugaguuucucauugagucaaagcgugggaugaucugacagcgucagcagcacugcacaacagugggagggacggaugaaugccacaucuauaaggaauugccacuuggauucaagaggaaaagggguaauuauccacauggguaacaauuucaguuucauuucucccuugagcuaacucuauucaccucaaacgucuuuccugucuagagaaccaccaaaagugucauucugauuaccauuuguaacuagguguuuucugcuuaacauuuggaacuggguggggugagauaaauuccaagaagaugggaaguuuuuauauugcaguuuauacuacagcagcagcuccagucugcccuacagaccuucuagauuuuuuuuuuuuuuuuggcugugugacaggugccuguggaguuuauauuuugauauuugaucaaacuuuuuaaaccugagcuuguaguaaccauuauagucgucaugcuugagaauguguauuugcuaguaguauagaguuaaccucaguuuaugggggcagggauuacuuugugaggaauuaaaugugguguuugaaaaacugggaagugaagaucuucugcaacacaggaguuucuaaaggaaaaacaauugggccagacuggaugaacugguuagauuaaaugcuaucuuccugacucaggguuauuauuuuugguugcuuauuuuauuuuuaauuguugaagauuuauuguaccaugcuuugcucaggacaguguguaagguauuuagggaaagaccugaaagagacaggaagcaugagcccuuccaucaggcaccugaauaacugaugguggacauauugagaauacguagaaaauuuguaucuuauggucauauugcacuucagacuuuucacaaugcccuuguaucucuguuacuugauucuaguuuucuuggcucagcaugcacaguuguuuucuuuacuuguuuauggucugucucucccacuuaaauaucagguccuugagagcagauacuuguucucagcuacagcccagcaccuagaucaauaccugacauauugugggcacucaguaaaucuuaggaggauaaaugaacaaaaaaccuaucuucugaauaucagugauaaucauauaaaacaggcuugguaugcuaccauuuauguacuucugauuuuguguuuugacagguuuucaccuaagguuuguaguaguugguuuuccucagagaaguuuuugggcuauuuuucuuuuuaagaaagggugagugaugucauuaugaaguugaagcuauaggacuaaucauauacuugcccugcaucuauggugacuuuuuuuucuacuggaaagaaagcccgcuauuaaauaauuauuacuuccaggucugagggagacuguccagcaucugcaagaguuuugcuaggaugcagggcuuuguucccccacugggcugugauuccauccauggaguaagcugcauugugguagcaagucaucuugacaguggcaaguauagcauauuucaacuggugauuucugcaugauuugcaugaauuucuguaugacaggagucacaacaaaacuguuacgugacuugugucuaaagcuaucagucagcuggagcugugaaaaucaguuugcaugugucaacaauuuaaucuucuaauaugcuugccaauagaaaacugacacuagaauuauuuuucuguauuuacugacuagaaagauaugguuaucaagugcacugauugaaaaaucuuuaaauuccagucuuuaaaucgggaccauauguguguucuuucccuagccaaaucuauuugugcauucacccacacauguguauacauauacacacacaguacaguuacauugauauguguuugcguuauauauguauguauucacacagagcaugcauaugccucaugcauauucaugagcuuuaaaugugcuuauagauuaagauauaaggauguuggggaaguuucccuaucuguuaacugagaauaauacuacugccuaccuuccaagcaccuuguaagaauuaaauuaguuaauauaaguaaaguucuuagaacaaggccuggaacauaguauguuuccuauaaauauuagcuuuuauuauuuuagaguaugucuucauucugucagcuucaaaugggcuucaaaauuuagcuucagaggcaguauggcaaagccucagaauuauugcauaauucauuugaugaauuuacuguuauucuaaaaugccugcaaacaauuuauaugucaugcaggaaauauugguauuuguauuucuaaaucaaagccauuuauuaaauaccuuagucauauugauuccuguuauaguaaauuacuucucuuucuaugucaucauuaucuccuagggucuaucagggagauauuuucagugaauuugucuuucauuaucagacuaaaacuaacuucacugaaaacaucuucauuugggauuugaaagagaacaaauuuuccauuuacuaagaaaaaaauagguguuuguguauugguauaaaaauagguauguauguaagugaucaaauagaaaauaaugcaaagggacauagaagaauuugggaauggagguaacauacaccuagaaaaacagugacaagggcacauacuauuuugaagcagguuuuagcagguaaugaugguacucacugugggaggaaggugugaaucaucagucaaaacgaguguacaaacuggugauaugaaaugcugcuuaacaguuguuuuaaauaauuagauuuuuguuggggauaaauaguucauuccagacaaaaguacuagggacucuauagcucaucuaacuucauagauuaaaaugaaggcccagauaauuaaagugaagaccucagaguuaguuaauggaagugcaaguuucaaaaccaggcugcgaugugggggagacaguguccuccaugacagcucuuuaacagauggcauagaaacucgacuugugaccuugaggggcucacuucagcucucuaagaauaauuccagcccagagcuacaccauauauagagucuguagacuauuccuaauaaaaugguuuucuugucuuagagaagagaaacucagcacauaccuacuuugagucagguuugggcaugcucgaaaagggggcagcguuuuuagauggagacugcuggaguagacucagggucucuuucagcauggcugccugugugauuugauucaugugcacuuuaaaaaccuguuuuaucuaaguguaagacuguagaagacauauauauuuaggguauugcauugauuuuuggaaaccauuuguguaggguacaguaucuuugaauuucacuauaguaaccgaguuacaaaaugggccacugggucugcugggcugagaaccaucaaacugaauggucagcaacuuuguucaugcuucaucuacuuuuucuuuucaaucauuuggggacagauaaucuuuuggucgcuuuuuagacuaacuuugagauucagaggggcaguguauucuuggcuaaaacuuuuuguacgaggcacacuuucuuuuaagguuugugauuuuacccuuacguaucagauuucaugguauccaaaugcaaacauguauuuaacaguugguagggaugggagaguuugaggacagcaaagcagccuacuuugaugaaagggucagauagauuuuaggaucugcacccuuucuuagcauccuaagcauuuugagaagcaguuguauguagguaaaaacaaacaaacaaacaacuugguaguuggugucagcugaacugcuuuuuacugaaucucugcuguacuagcuguguggcucugaggcuuacuucccuagucugcaaaguaaagguaaugauaccuguuucacaauuuaaaaaauagauuuauugaaauauauuucacauaccauaaaauuccacuaauuuaaaauauauaguucagugauuuuaguauauucacagagaugcagccaucaccacaagcaauuuuagaacauuuuaucacccaugaaagaaauccugaacccaaaagggccauuuccucccuaacuucccuaacucuaggcaaccacugaucuacuuucugucuguguggauucaccuguuuuggacauuucauauaaauggaauuauauaauauguuguguuuuaugacugccuucauucacuuagcauaauguuuucaauauucauguuguagcauguaucaguacuucauucuccucaccccccagcuuuauauuaaaguauaauuggcaaaaaaguacauauuuaagauguauaaugugaugauuugauauauguauauauugugaaauaauuagcauaaucagguuaauuaaacaccuuaauccaaauccauugccuugcauaguuaccauuuuuuguuguuguuguuuguuuuuuuggguuuuuuuuuggugaugggaacacuaagaaucuacucuucuaguaaauaucaggaauacaauacaacauuauuaacaguaaucaccgugacuguacauuagaucuugagaaaguacuuauuuucacaaaguuuguacccuuugaucacaucuucccauuucccuuguccuugcccuuggcaaccaccauucuacucucuguuuuuaugaguuggauuuuuuuguuuuguuuuguuuucaagaugggcucuuacucugucacccaggcuggagugcuguggcucacggcagccuugacuuccugggcucaagcaaucuucccaccucagccuccugaguagcugggauuauaggcucgugcccaccaugucuggcuggcugauuuuuuauucuuauuuuuauuagugacagggucacacuauauugguuaggcuggucucaaacuccaggccucaagugauccucucaucucugccucccaaagugcugggauuauaggcgugagcuaccacacacagccgaauuugauuuuuuugaauucuacauguaaaugagaucauacaguguuuguauuuuuaugucugacuucuuucacuuagcauaugucuuccagguucacccaaguuguuacaaacugcaggguuuccaaugguguguaguaaaggggauccuuguaucguguugauaggaauauaaauugggacagcauuauggagaaccguguagaaguuccucaaaaaauuaaauauagaacugccguaggcuuuaucaaaucugcuucucaguauauaucuaaaggaaauguaguccaugucucaaauagcuaucugcacuaccauguucauuauggcauuauucauaauagucaagacguggaaacaaccuuaaguguccauugauggaugaauggauaaagaaaaugugaugugauacacacacacacacacacacacacacacacacacacacacacacacacacgcacgcacacagagacacccucuguuauauguguguauuguauuauggaauauuauuuagccauaaauaaugaaguucacuaauuuuuauugccaaaucauacuccauuuuaugaauauaucacauuuuguuuauccauucaucaguugaugggcaucauauuuuugugacagugaaauaagacgaaguauauaaagugcuuuaugaugucuugaauauagaagcaacguguguuuuguuguuucuuuucgucugguugguagauuucuggugaauuaucagccgccccucuugccuugugaggcaaggaaagcagucuuauugaguagaccaucugucugccaguucucucauguuaguccucaacucauggaaaauccuggugggcacucguuugauacuagaauucacacugcuuuuuucagcagccagaaguguuugaguguuaccagcagugcuuguugucguuacagaugcuccguacaaaacuguaaaugcuggguuuaaagggauugagggagggagccauugcggcuuacacagaugucaacuaaucuaguguugauccucauucugaaccugagcauugacaccaauaucaagcugugggguaguuauguugugugcaaggcuuggagggaaauagugcuuuggcaguucagugcuugccgacuucacaaaacacagaaaauugcugagggcuuaugugacagaaaguucauguuacacauaugggcaucuuggcgagaaaagccacugaucgucucaguguaaggauuuggaauuucaaaauccuaaaugauuacuaaaugacaaguaaaaucuugauugagauagaucguugcuaacguccaaagagauuaucuaaaagcauugauuuuuauuuuguuggcuguggaaauaccguggaauucauuuauuaaaaguaguaugucuaaguuucuacuuauuuuagauacuguaauauaaaauuauaaacaaggcccaauuguuguuacccacuaggcagauuuuuuuauuauccaaguuucuguuucgggccaugaaacaaguuaaaaucaaaacuuucgcugguugccauuuuaaagauaaauuuguuauauaggcuuucuaagcuugguugccuugcuccacaaagacaaaacauuaauaauagcuuacauguauugagcagugaaucugugcuaggcuuuguguuaaccacuguauauuuggauuaucucauugaucuaagguagguacgguuguuauucccuucuuauagguuaggaaacugaggcucagagagauuaaguaacuugcccaauguuacacagcuuguaaguggcauuucuguuuaaagcuucccauuuuauaaaguuuuguguuuuuaaauaugcuuuagaauuuuaaguuuuuacucuguuauuauuucgcgaaguccuaugucuacauacacaucaaagcaauucugugguucuuagggaauuauuuaauaaaugaaauagccauagacuguaauuacauuaugaguggcaucuuuuagcugugcccagcgguagcccaguugcuaaucuuuaucccuugaguagucaaguagauaagaaguggauaagcaaguggagugguggccacucaagcaggccuccaccagaauaauuccaaauaacuucacacagugaauugcaacccacucaauccacuucacuggauagcauugcucaaaagauauucuuuuacucuuuuaucuaccuuguuggcaagcauccccaagaggucuuaugccuguggccuacagaucaaagauauuuucucaaauacugggaacuuugcugcuaguuagaauuaagcaaauaaaaacauacaccuccagaauguaagcaaacuaguuuaaaacacuccagccauuguauuacuuaugcuuuaaaaguuuccccacaaaaccucauuaaucauauaaauauuuugacaaacagaaaggggacagagcagacuuauuauuuuccaucuuguaugaauggcuagacuuuucaucugugcucuuauccuaacaugucuuuaacucuucugugcuaagauuuuuauuuaaaaacaaggaaauugagacucagugagaugaacugcuuuauaucacugugguaagauguguuaauagcauuugaaaaggaaaagccaaaauuuucuuucauuuauuuauuuauuuauuuauuuauuuauuuauuuauuuauuuauuuugagacagaguuucacucuugucacccaggcuggagugcaauggcaugaucuuggcucacugcaaccuccaccucccggguucaagugauucucuugccucagccucccaaguagcugggacuacaggcaugugccaccacaccuggcuaauuuuuguaauuuuuaguagagauuggguuucaccauguuggccaggcuggucucgagcuccugaccuuaaguaauccgccugccuuggccucccaaaaugcuagaauuacagacaugagccaccacgcccagccuauuucuugauuuuuauuagucaccuagccuuauuguaauuugcacuuaucuaccauuagaacaucauaaacccaagugaugaacagaauggauguaacuuagugcguguauguaaugcauaugauguaacauacauaaagacaaauggaaaaugccugcaagauaguuucccuguugucucaugccucagcaguaaugaaacauauacugagugcuuauugugggucaguuacuguguuaaauguuugucacgaaucaucccauccaguucucacaaucaaccugucauguaggugcuauuuuuguccacauuuuuauagauaagguggcugagacuuagaaaaagcuaacaccacuugccuguggucauagagcuagcaauuagcaaagccauugcuucuaaccagugugcauuuugccuugcacaauaaacuacauuaaaagauuuacuuuaguuuuucuaccucccaauugaagccacuaucagauauauagucuaaacuuagauuugauucuguuuagaaacacuuaauguuccuaauguuaucaggaaauuugcuguucauuuuuucaagaucugaguagaaugucacauucuccaugaacuuuccaugaugcucuucuuccaaauguuucuguagcaccugguuguagccuggcucuuaggauuccccugucugugcucuggacuucuuuagaagcaccuugucugguucaguuacugccuuuguuuguauugcuggcacauuccuuugugcuuggugcauaguagauaauuaauagauauuuguuaaauugaacuggaugcuuaauaaauguuuggaucuaauuaugaucuuaacucugguguguacuucagguacuucaggaaggucauugcagcauuagaugacuauggagacccucaguguuuuagacugagaugacuugccauuccuacaagagaucaauugaaugaauaauuggggcugauuuuucccuaaguauugcuuagaacauauacuguuuuuuuucuccucaaaaauugccaguuauauugccauacuggacaaaauaaaacuguuagcuauauaucuauaucuauaccuauauaaauuuuaaaaacguagcacaaaguuucugcaccauacuuugugagcagcucuguguauuccaaggcucagaaaaucagacuuucaaagcuaaauuuuaccaauauauaucccauugaaauuugcaugagcaagcagaaauaauguggauguuggaguuagguaaaugaaucaaauccugguucagccacuuucuagguaugugauuuugggcaagauauuuaauuuuuuucaacauaguuuuuuuauuuuuaaaauggaaaaguuaugcacuggcagauuuggaggaugaaauaauauguugggagacaguguguuaaguuacuucucaaaaaguucuauuauaauuauagguugcuaauuuuuggcauauuuucauuuuaaaacuuuuauucuaauuucauucuuaaacaguguaagcauauucacaguagcuuuucugaucaccuuauacccaagcacugccacaugacuucugguccaguguuccaagugaaggccaaguaaugucaagguaugcuguauacggauuuucuaggagugugaauaaagaagaggaauggagccauccauggauggcaaagucaugccguugcaauaaguacuacauuuacauauuuaguacagaucccaucuuagaaaggguggauuuggucgggugcgguggcuuacgucugugugauuucagcacuuugggaggcugaggugagcagaucgcuugagcccaggaguuugagaccagccaggacaacauagcaagaccugucucucucuuucucucuuuuuuuuuaaaggcucccugcucaugaggaauggggagagggaagaaaggguggauuuggagaagguuauagcagugaguauggcuguaaauuugcaaggaauaacuuuuuuuauuuccaacagugauugcuuuagauaaauauuuuauuguagauuucaauauuguugcaauuguauuugacucagcaaaaauaguuuuuauaauuugucaacagaacuucuuuaaaauggcuuccuaaguuguuucagcuaauuaugagguauggugaucucaaccuccuuccaaccacugguccacucuugagucuucaggcuuuuuuuuuugcuucaagaguagcauuguaaguuuuuagucuucagagaacaggaagaauucuaguuucucaguucuuguucugaucaggauuguauuuucuuuucgucaguuugugcucugaaacugcagggccaggcagaguccaugcuaccugauaaagcaucuggaaccauggaaaacugaggguggauaugaugagccucucuaauaccagagauaguggacagaagccauccguuuugcauuuggcuuuuuugaggacucaguaaauccacacagagaauuagcuaaggcuguuugagaaacagccugugggauaaugaacacuuuuaugcuuuuuaaaaugaccacggggagccucaucagaagaggcgauuccaggauuccaagauggcagcuggguuuuucauuguuccugugggacuugcacugugaagugugauuguagcugauuuuuccuuucaacaggaauucauuagggguauccauuagcuaaugaacuauugauauaagaaaaaaggucaguuauuuuagagaggaaaaauguggcuuuaacucucgauuauuuguguguuggguccauuugaaggcuucuuccccuggcucaaaaucuggaaaacugauuugaaagaccuucaguuuuauuuagaaagaaggaaaaacagauuauuucaguuacuuuauguuuugugauuuuuacucgauuuaccuaaagagaaagugcucagauuuaaauucuagguaccuucguugcuaauuauuuuuuacugcacuuuuauggccauuuuuuauuucuaaggauugaacccuuuuuuuuguaguuuucucucaagggcuaauauuuauauuuuuuugcuuccaaaaacuguuaaagucugaaaguguaaauuuauauuugugguguuuacuuuguccuuuaaauguuuuuguguacccauacuuuuugucauaaagauggaaaaaugauauuaaauuaaccaaaugaaaguaauuaaugcugaacauucacuaaauuauuaagauguuaaugugauuccaaaugcagauaguucaugggcagcagcauguguccugggacucccccucaaagguuggcaagguuugggcaauuuugagggagggaguuaauucuuaaguaguaagcuuuuucguuuaccucuacuauuuauaagcuaauaugcaggaucauuguaaauuagugaaaagugcauuccauugaacuaguaguuguaauacuggguuaaauaucuaaguugugugacuuugggcaugaguuucugccucugugggucuuauuuuucccuguuaucagaacuguagcauuggacuagaucauguuuccuuguguguuuuuuggaaaaugugacaauauacuaggaccuacaugaagucacaguauaaacacccaagggacacaacaggcauaucuuccugccuuucauaucuauucacuugaggcuuuugguaagacauuaauuuuauacuuaagcaaacauauuaaagacugaaaggaacucauauaucuucauauaguguuaaagauauuaacacaaaaaugaaagaaauauuguccauacagcaggccacagauagauaucccuuguuuugugaucagucuuuucugcuauggagggcacuuuggacacauuugaggaucacugcauuagaugacaggaaauguguuucuuccuaugcucaaguuguguagccaugacauuugaggauauuuacauuuugaauuucccuccucccuccccuaaauuaguggcauguucuagagaaggguucaugugcuuuauuuacauaaaaccuaucucaauguuguuugauaagaaucuguuaagagaucuuguccuaaaaggauggcacuuaguguuggaacuggagaaugguggggugugaggaguuaaaguaauucccuaagcacacuagacacgccugaugccccuuucaagccagucugcuuccacguggugauucuuucugauucccauuaucacugugucccccucaccccugccauuuagccuagauucuggcagaauggaaauccacguuucugaauuuaguaugauuuuuuuuucuuuccuucuauucucagcaacaauaaguacucuugauggcagcugcuguauuaagcccaagagcuuaaaagauuaaagaaaccacuaacagcaguaaggaggaaguuuaagggccuguuuuucugaagguuuguguuuucauucugaugguugaguagaaaauuacaaacagguuguguucggcagcuggaaugcucuccaacaucuggggagacccagccuucuguuuauuucccauucauuggaaggguggccagccaguagcagaaacugcaggcagagauacuagaacucuuuggguacauaagccguuagaaauucuuuuuuuguagaaauuucuucauagaaauaccuuguucucuauuuuuucauaagcuugacugagcacuuaacuucaggucaguugcugaggaagaggucugaagguaauauuaguacccccccaacuacuuucagcuggaaacaagaguuguuugggcccuuacugaguuccuacuuuagagucaagggcuggccuuccccugcaucugucugcauauaccucacagcugagcagauaacauauuugugcagcuauucccuuaugauuuccucucuauuagagagagguggagccuaugacagacugcagaguguuugcuccauucuuccccaccccguagcuuuacugagguauaguugauaauuaaaguauuuacauauauuuaagguauauagcuugauuaugagauauauaaguauacauugugaauauucaaaaucaaacuaaucaaucacuccacauaguuaccgcuuuucuuuuuauagugagaauacuuaguaucuaccuucuuagcaaauuuuauuuaugccacauagugacuauaguuaacaauauuauauacucaaacccaguuauuuuaauuuuuaauuuuuuuagagcuaggaucucgcucuguugcucagguuagagugcaguggugcuaucauagcucacugcaaccucaaacuccugggcucaagcagucccgccaucucagccucccaaguaguuaggacuacagguauauaccgccaugccuggccuaauuuuuauuuuuagagaugaagucuagcuuuguugcccagacuggaaugcaguggcaugaucauagcucacuguaggcucgaacuccugggcuuaagugauucuccugccuuggccccccaguugcugcgagaauggugccuuguucucaaaaccauuuuguaaaaaguaaugugcuggccaaauaaaacagaacgccaguuuguuauuuuuggacagcuucauuauuuuguacaugggaaaagagaaguucgaaguuuugccuuaugcaaggucauaaagcuggucaguggcccaaccagguuuagaaccuuuaucuuuggggcuauuugagaaauucaagugaucccaguucaaucauuaguggcauuuguggucuucagucugcacugagcaaggguuucauguuuggugucuaauauuuuaggauuauuagagcuaaucuagccuuuggagaagccaaauggauuuuggggguugucuguaagaacccaucaugauggcuggaacagcucuuaaguggaacuucuacauaaaucaacuugcauuuguucuguaacaccaugugaauuuuccugaauuuccaaguaaauauauuuugcauauugcuuacaaauugcuuaggcugucuucaugaauaaugaaagcugugcuguaggaagcuggauauuaagaagggguguuuuuaaaaacaguauuucauuucuuuugcuuauauuuucuguagccucaaggguguguucagaggugguagggagggagggugcuguuaagguuucucaacaccuguguuccuuuacagaccauuaucucuucugcuaucaaagaggacuugccaguuaggucaggaugcauaaaccucuggacagugccuucuccuaugcuuaucuuugcuauaugucuuguuguguguuuagcuuccauaacaagguucucuacuucuccaguuuaagaagaaaucaucuguugugcugaaccucuauucaucucaguagggaaggcaccagcuucaagaggcugagaagagacccagagccagcaaaugagacaugggguuuuauuaggggcuuacauacaggggagagaguccagugguggcagacuggacaacauacuggcaccgcucaguggcagagggcugggcaggaaaacugcagccgcuuugcaaacagcaugcaguuuauauagcauuuucaauuaacacccuccccuuaacaacuuucaccuggcaacuugcaugccaacccaaaguuuagggccucaauucccuguauggcccauguuccguggcaugggcagggggcucagauguuccuccuagacaaggaaugaaucucuggauuggccacugugggacucccuagcucgacacacacauucaggugcaucugccauacagugucauuuuaaggguaugcucaaguuauugcucucagagguguuuacccuacuauuaucauuugacaauaauaccuauaugugacguacauugucuagugacaguccugauuuccaguagcucccacaacaacuucauaaguaucauagccccacuuuuuagguaaagaaagcagagguuuggggauugugucuucccuagucgacacaccuugacaguguagaaccagcauucagaggcaaaucucacuuaggccugguguucuuuccaacaugccucagcugcugcuuugccuucucuuucucccuucaccuggcauuuugaccacacuaauugugcuggcaucucauuccagggaguaugggaugagaugccagcacuagaguauggcuuucaaaacauuuuuugucccagcucacaguuacaaauacaguuuaugucaucaaguauacauacauaugcacaugcucaaaugcacauacauaccugugcuuacauguacucauauaaaacugaaaguuuaauuauauaugcaguaaacucuaauauuuccuuuucuguuuuacacuguuaauacauacucaccuguaaccguuauuacucacuaaauugguuuuacaaucaagaucaccugcgguugaaacagugcuauagaguggaaaucuuuacggugaguuaugugcucucuccccucaaccccuuacgagauuuuuaggauaauccaugggagcacgaaaaaaacgguugaaauuauauuuugauuuauuuccaucuuaaggaagagauuaaauguugcuguuacuuaauauccgaguugacagugcagcaucacucgggcugugaaacagucaguccagugcucuguagaguguggcagguccugaaggaagagugggaguuccuaaaguggcacacuccuucagccuuucguugugugaugugcuccaguuuguauggcucauaaagcauguuaguagguuauauuauuuacuuuuggcaaagagaacaagugguuuuauuuuuauuuuucuuuugagacagggucucauuccauuguccaggcuguaaugcaguggugugaucacaacucacugcagccucaaccuccugggcacaggugauccuccuaccucagccuuccaaguagcuggaaauauagguguggaucaccacgccugacuaaguuuuuucuuuuuguucuuucuuuuuuuuuuuuuuuuuggagagacgggguuuugccaggcuggccucaaacuccugcugaagcaauucgccugccuuggcccccagaaguucugguauuacaugugggagccaccgcaacuggcagagagcaagugauuuuuaagaguuucaucaaagaaacuguggaaugagagaacauaaacacagggcaacagcaggaaaaugacagaguugacuuuuuuguuuuaaugagcuccuuaucaaccgcaucgcuggguacaaacagcgacuauauagucauaucuaguagggagucagacaaaaaauugaagcuauuuuaacaagugagaacuuagguuuauauccaugauuguuaaugauuuaccuuguccugaauggauguuguacccugagauauuagcuaauaucauuauguuggauaaaauauuaaaaguuguauucauuuuaucuuugugucauuccuuauguuuauuuguauauuuuaugauauaugugauauaucugugccuuauaguuacauauauauuggggaauauguuagaauuuuuuuguacugauaaagauuccuaauuaaaaacauuuggagaccauuucuauucuggaggacuaaguaauuauuaauggguaucuuggggucuagaugaagagaaggaaaaggugaggacacaggaagggagugaaacagggaggguguuuguguacaaauuagauaacaacccucccaaguggauucaguuccaggggcacaugguuuggugaguggccugugccuucgugcagguuauaaaaagucuccccuuucuccuggcauagcagcucuacacuagggcacaugguuuggcaaauggguugugggcuggaauucagcacccuuucagcccuucauccuucugcaaguguagccuacacaaguaaguauauguaacagcccugguggugagguacugaaaauaaauaaauaaaagggcgaaggacaggcauucauggauguagugagcagcaacagcuaguccucacucuuuuauucauucauucauuccuucaccagaguauuuauagaacaccugcugugugccagccaucuucaacagcaggaguuggcaaacuauagcccaccggccaaucccgaccugguaucuuuuuuuguaaaucggguuuuauuggaacauaccuguaccccuugguuuauguaucuucuguggcugcuucuuagcuauaauggcauaguugaauaauuaugacagagacuguauggccugcaaaaccuaaaguauuuacuuucuggcccuuuacugaaaacaggcgugaaccucuacucuagaauauaaaucaggacuugcuucuggugccacugcaugauaacuuagccauggacuguuuggcuucuaucucauguucccuacuugcaagaaaauacuuccaucagggccaaguggaggugcaguagagcaggggcagagcuaaaagcaacacagcugggcacauuuacuucuuaggucucuacacaaaccauguaguguaaggaggagacaaagggcuaggaguccagagacugacacuguguggccuucucucugggccuguuucagauagucacucugcaacuacaagauggcacuggauuagugauucucagacguuuuucugcaccaaaaucaccuaaaaggcugguuuaaccgacugcuaggcuccaccuccaaggugucugagucgguaggccugaggaaggccugagaauguacauuuuuaacaaguccucagguaaugcagguaggcaguaugacuggauuguuuuugugguugccugccucuuuuuggcauuggaaaggggaaagccagaguauuccuugaggaaugacauuuggagagaaccaaauuuuagaugcuucugugauauguacaccagagcuauucuggacuagauuguaaauucucacauuucaccuaugcaaaaggaaauacuuucuggucuccuauuaguaaucaguugucucaaauuuugcccguuaccucuggaaauucuggacccucaagugaucagucuuuuaaggcaguguggaagaacagcaccuauuauggcaguugauuuuucauggucucuacccuguccuuccuaauauaacugcuauucuuuaccuuccuguuuuucaaaacucucguauuguuccuguuguguuuuuucuaaauauuuucuugguuacaauaaagugcuaauauuuaaagagcuuuugggagccugcuggugccagaaacuauucaaguuacuuacagaauacucucauucaguucucucaaaaauccuuggggaaguuuuauuuuucucauuuuacaaaugagcaguaauuacaaauuuggagucagagaagcuaaguaauaugugaucuggacaauuucaauaucuauguauaucaaaaaccaagcuuccuaggucuuugaccuccucuccaguaucccucaccuucaccugcuaaguauccauucucauuuuggaucucggacuuuguuaucaccuaggauucgcccaggauuucacuuucucggaucaugaccuuccacaucauacugucacugcaucucaggagucuguuucuuggaaaagcuuuacgucucuuauccuuuuucuuuuccaacagaaauaccuuucugaacuauuucucucucuuaaaccucuuuuaaaaucugcacacuucauacuaaauuguauugauuaugcuucuaguucccuaguacauaauaaccuuuggaaaaauuguuuugucuuacuaauuguuucuauagaacucuguacugcaccugguguauagaaggcacuccauaaauaaugguuuaacugagcuagagaauauauggccagggucugaguccgagucugucuugcuucacaguauggcugcuauagucaggucugccacagcucuaggccuauuuuuuuuuaaucugucuggaugaagaaggaauuguuuaguaggugaugucauuugugggaugcuuugucuauuucugcguauccagcaugcuuuuagugauuuuucauuuugucagacugcauuuucucuuuucaacuagaguucaaacaaaauaauuuuagauaacauccuaagaacauuuggaaacaugacauuucaggucuauuuucccucuuugccuuaaaaaaguauauacagcuauaauuacuaauugcugcgcucuaaguagagacagaugauacauauguuugugacaauuuuccagagggagagcuaaguaaccaggcucauuuuuccauaaugugaauguuauucacaaacuauuaccauaauugaugcaccaaaccacuguagaguaaauaauguguugugugugggaagcaagcuaguagucaaugaauauuaaagaacaaaaccucauuuuaaaagagaaacuguaauuaaaaucauucugaauucaugcugcacaaccaguuaaaauaacuuggcugccauuuaucuguguaauucuguguauaaagggaguagguauaugauuuguuauauagaaguaaguauuuacaugcacauuuuuaugaaaagacacaauaucgaacuucagaaucagucguuuuccaaaaacauuuguuggagagaugaacaugcagaguuaaucagugaaauauauauugacaggaaagaucaccauuuccguuaucuuaucuuuugcuuuucuagguguuuuaugucuaccuggaaugucgugucccuuuccguggaccuaaucagcuucuguauuuucuccaaagcuuccuuuucaucagaaguuguucuuguccacuuuuaaucccucuuacugcuuucuaggugcucaucaacuucugugugugguauauugauuugcacuuuugggauuuguuguuuuauaagaggaggucauaagucauuucuuguguguaucauuagucuucucaacgagacugccuaggauuucagucucagauuauucuauguguguguugggcguguauguauguguaucauuccuuccgguguaccuuguggagaaugguuugcuguccauguguucgcuaacuccucaguauguauuguugguuaccuguuuucaugcaccagauacugcauuauuuuuguaaaaucuuuacauuuuguguuuggcuaccagugucuccacagagucuugaauguaacugguaaggaucagaucuguugguguagaguuuuugauggaacacucaaucagcaaucuguaguauggcuuauguaaaauguauaacucccucuaucucugauaaguucugaagucuaaggggaaagugcuucccugucucuugaauuugaguguuuugggugaguccauuuuauagauagacaaggugauuguaucagagcuuacuuuuauauuuuaaaauggaucauaguguaccuauucuuaggaaccuuuuaggaaaaucucuuuaacauugauccuguuguuaguuguaaucucaguauauucugauaauuuccuuugaauauguaacuguuccuuucauacugugggcaucuguugucuucucuuuuuauagcaaugaaaguaugaacagauuccaauguggguucuuagcucaaaauucucuggcucuaaugucaggccaauuuauuuagcuaguuuauacaacuggacauauuucuauaauagaaaaaugacuaaauguuucuuaacauauuguuuacagagauagagcccauguuguaaggcuauguaacucuuccucucaaaagaagauuauugguuuuagcauguuuuccucccuuuaauuuaaucuuaagcaggugaaccuuuuugagggcuuuuuggaaagcucugaggaaaaaaaauaagaaaacucauacaaccucaaggaauucuaaguaucaaggagcaccucugugaaggugauugguucaagcauugaacacuauuuucuauccuuccacacauggcagggcauuauucauguauccagcucugugauagcuuguuuuugcuugcccugaugauacguauggcaagggaggaauauuauccaggaguggacacuguagagaggggaaggaaccuuggaacugaccuuuauagaggcgguucucauccucaacucuucuuccuuacaagauggcuugguaucccuugagaucauucucccaccuucaaaauccuggaugggccucuugccugguucccuuaaggacucuaaaccacuuagcuuggagcuggugccauuuaauucuguucuuggcagugggcccuggcuucuuuccugcuaggcccuguaccucuuaggagcagagaagaggucagaugcagauaauacaggcaugauuucugccuccugaaaugcucagaugauaugcacuucuccgucccccuaaagauuuaaggaaguacacauuuaucaugggauguaaugaguaggaaagagcauggggcuuucuuuuucugcugaauagcagauuguaagauagaaacaguuuuguuuacaauucagcucuaucuuuguacuuugcauugcaguugaaguuauuuuuagcuuuacuguuaagcuaaacgucugaguuguuucauuugcaaauucuuucuuugagggucaggggaggcuuuuguaaaauguucaggucugagagaauuuugaguuagguaaaggugagugugugcaugcaugcauguauguguaugugugugugugugugugcacagcucgugcauaaaugccugugugcuugcuuggguagggacuaggagggcugaaaaagagagagaaagucauucuuagcagaagaaaagcacguacaaaggguggaagacguacgguuuuugacagaugaaugaauccuucuaaagguuuuguaagagcugugaccagcucuguuugcugagaaaagggaaaguccuugagcacccaucauaccucuucagacucucuuaaaaagcauucagauguucugccagaggaaaugauguguuccaacuacagcugcaguggaggguucuuuuugugcagcugaagcaauuccuccacauagauugucccauuuuaacaguaaacugucuguuuaaaacaaaacaaaaaaggugggugggaaauggaaggagaaggaguuuaugccaggaaaugaaaauaaguugcugcagaagccuguuuugguugugguuucagaguuaaggauaaguuauuaauaauaauaauaagagcccacuugauaguuuguuauaucucuguguguguuuuuaugaacuuuuaauuuuccagaaaacauuaaagauaaauuagagaacacacuccuguuggaggaggugaccaucuugcagcuaccaaaccauagaaucuuucaccacuuaacaccuuccaaggaaccggguagacuucugguguccucucugguccucuucccuuccuuauaggaugucaggcuuuggacuuaaucagaggauaauuaaggcucuaucauagcaggugaaguuucugaguggaagucuaagaagugauguuucuauaagugucuuuagcugacugagcuacuaagcagagguuaggagguugugauguaauuuaaagugacauugugguuaccuuuuaucaagcucaauugugagccuggagcuauguuaacugcuucacagcuaugagccuauuuaauucuuacaggaauccucauuuuaagauagguuugauuacccuccguuuacagauggggaacuugagguagagagauaagugguuaguuugcaauuacacccagcauuuggcauggcugggauuggaaccaggggccuucagucuucaaagcucuuacauguaaccacugagugaugcauuguacucucuccuguaaaguagccuuuucucccugcugccacugguucauuuccuuuuccuuuuuuaagaugcuuuaaaaagaacaaaaaccaauaacguaccuccuaaauugagguugaucucccuccuuccuauccaauaaguaauguucuagacucaugcaaauauuagauauuugggagaaaaaaugaauagaacaugucccuccucucuuuagcucuaagaaaauuuguguguucuuauuaauuccuacuguuccacuauccuaccauauuaccugauacauauaauacaguuacagucuucucagggagacucuucuaugcaguggcaugcuggagccaggaaagcuuguaaacccagcucagacauggaccagcugugagaccuuggugaagucacuuuacccuccgggcuuuacuucuuuuaucacuguaguguuugauccaggucaguucgcagccuggaaggcacagccuuuuccaggacacuaaauagggcacaugugcuacccauuugcgugcacacuauccuuaggcauuuguugaagagaugguuaauaaaauauaaacucauuaaaaagcauuacuaaauucuuacauuuuguguuucuuugaucagugaaugacugcuaaaauuuaguacguuaucaauggggaauuuguuaucucuuuuugcauaaaagggguccucgguuuucgugaaguuuaaagucccuccccagguagaauauccauaaagccuaugaaugagucuuaacuacuugauuacccagauucuagcuuuuuggaaucuuucauuaccuuacuuuuuucccuucucggugagcuuuuggacuuaggacaaacggggaacgaucacaaggaaauggauugacaucucuacucuuucacaaucuuuccugaagacaugauuuuuuuuugcuaucaugucucuaaguacaguuggucaguugucacucugucaccuuaccuuccaaccccauaauuccugugaaacccuggacaccucacucuuuuugcagaccaugagcuccucuggccucacuccuuuccuuguccagcuugcaguacuugaguaauccccucaccccucaccaccuuccuuauuaguacccccaguucccugaagcucuuguccugcccauuuccucccagcagcaugucacucaucugcccucaugagccuguguuccccuuacaagaaucacaucucuaucuguacuguuauuauagaucagugaacuucaacaucugauagcuuuuucaguguugcccaucagugcauuuaccgaguugcuuuuucuauccuuuuggugauaguuccaaaugcuccccacuguccccacggcuauaaugauaggaaacauuaauacaaaacuugguuguguuggagaaagugugcuaagaacuuuacaugcauugucucaucuccguucuugcuaaaggaucuaacuuuuccuuccaaccauccagcaacuacuagcgaggcaucaacugugucuaugcauggugccaagccacagacuguagcuaugauugaugcagauugggugcuugcucucaagagaccucuaauucagagggagaugcacagaaguaaacaggcagcaauaacauuguccgauaagugcuaaugaggggagaaguucaauacgcuauagaugcccccaacccagacuuaggguugaggauaaggaaaacuugcaggaaguuacagcucagugccaaucuaaaggacgagagacuaugagggaggaacauaagggcauucuggacaaaaagaauaccuggcugcuggaaagauuucagggaauugagaggggccaguaggaacagagccauucuucucagagaaauuagaggucuuauuuuuggugugaauuccauagacucucuuuucuaccuccucugugaucuguauccucacuugguuacuaacuggaauuagaauccccugcaauccuucacuguaugcagaucucguaagacacacuuucugucaaucucagugugaaguuuuacuaugcacuuguauagcugcuccacugaaauacuauuagacuguuaaggugaguguagaggacaaugcuucuucaaaauuauuacagggaaguuuauaauaauggugacugacuugagguagggguaggguuuuucaggagggucuuucagugguaaucacgccuaaaauuuugaaugcuuaaaugaagcugcugcuuagcucaaugauaaguaauagcagcuucuuuuuccaugaggacauuuauuaaaugauguuuuaggucucagcaaauguuacgccuucagacaccuuggcucaggaaagccugaugugccuccagugaaggauuuguagguccacaucuucgaugcuucugcaacacagaguuagggaaaugaaacagugggucauacaugcuccugauccauugccaacagcaaagggacuugagcccccacauaccuuuugacccuucuggucaugauaaagccacccacuagcuauaaugcuauagucagcaguagaaauaagagggagcacaaagcaacugaaugguaaaauauuucagaccuuuuuggaccacuuuggaagauggaagcugauaacaucauacauccaaauuccucugcauugcugucucucucuuuacagguggggaauaguuuacagcaaucaguagaaucuacuuuugauuccaaaugggucuuaauuauuuuguauuugggaaauauuuuuuacuuggcaauagagaugugccauaauauuauuuaauauuuuggaaaucacuguuucccaugugccugaacaucucgagcacauuuacccugagcguggcagugccugggugucucacauccauguaugcucaaaccaugcuccuugauuucaccccuuucucucuguuucuuucaucucguaaacugagugcugaugccauuucacacuuuuucuuggaaguuuaaugaguuaguaguaguauaacaaaaauaaaaauauuuucuuuacguuucugaaaagaaauaugucuauaaagcgucaaucauuuuuccaagcuguuaguuccugcugcugaguacuaggagcuguucugucagcaagaccacguaagggggaauaguaagagaaagcugucccaauuuucuuucucugguacaaaagguuagaagauguuguuucagcuggagaacuuaagauggauucuuauucacuauuugcuaaagagacuggacuguuuuuagugugauaauuuucuguaggcguggagaaaggucaccuccugaucuuguuuuggagaucaugggguuaaaucuguggcaguguccuuuuccuagacacagccucuugucaaaauaauguuuggccagguguuaaucuguguccugaggggagugcuggaauucauuauucaucccgugggaguaggggucagaggagaagguuguccuucugggagguaccaggggacauagccugccuccugccuuuacugacaugugccauuugugaggagggcaguugaaguccauuugaggaauucucuugucagccggccaacacagaaacacagagggagugggagggagggagaggcaggcagcuuggcaaggcaguccuggagugcaguuuccggagcaagaucacacacaguguuuuaggagcucagggaaggugugcaggaacauaaaggggaagggggccagguuugaaagaguggauuuuuccuauuuuuuccaccuuuuauuccuccugucuuugaauacuugucauccuuuggaaaacucagcaucggaaagaagccuuugcugacacacugcuuuuucuccagcgcuauauuguggguuuuuuguuuuugcucuuuucauuuuucuuuuccucugagggcaggaggugagacaaugaucaagucaagcugguucuauguuaaguucaaguaugcagagaagguaagucaauaugguuucuuuucccaggggaaaccugccaccucccuccagucuugucauguugaugggcuccucuggccacuuggggaagugaaugaagcugagaaguuguauuugugaauguauuuccuuuggcuuaaugauccuuggaugaagcacaagcucuuugcuugcaaucugacguugccgcugaccaaguggaagcaaucuucagacucuguuccggaggcaugauuuagaguuuaaagaggggaaauaaugaaacuacaauaacaggaaaggcaggauauucugcuuuagauugaauagagaauuuucaagguauuauuuguuacaaagguagauauauuuuugguucugaaacaaauugacagucacuuccuauuaccuguuggcuuagaauuuuuuuccucuuucaguuaacuaacugcuuacucauuuguagucuuacuugguuguagaaagaauccccauaagguugucugaccauauaugagaugaucucuuuacugucugucaggggauuauauuuuaugaaugaauuuugguuguaccuaaaauuuugauguuaaacaguuccacuguauuuuaacauaccauuucuggacuuuuaggggaaaaguguacuuucuaauacaucuucacuuaccggggcuguuugacaucuuuuugguuccacauccauaugugucacuuacucuguugggaauuuacaggauuagaaaugagguuuccaggagaggauauagcucagagguagagcauuggacugcagaucaagaaaugagauuuccaggaggauccuaacgugugccucccuuuugaaaucuucccuccuugauuugauuguugaaaacguuggcauauugauuguagaguuaagcugaggcucuauagaauggaacugugauguggcaagauggaaaauugugcgacugucuuuauacuccuuaugauuauaugcauaagcacauuaaauaugccucuuccauucaccuaguuuaaaaaaaaaguuagaacauuuucaacuccuuuuuacugcauuuuuuuuuucuguguggacuuguuucugcuguguuuuuaagacagcaaaauuacucuuucuuuacccauguugaaauuacaggauuuuuauuuaaaauauccauuuuuuauuuuaaacucacuugcauuguuaacuauuaaagcuauuauaaguaaaauauuaucuauucaugcacaggauugggaaagauugugguuugggauuuuuuuuucucaguagauuacuuuccuuugagaagccgaccauccauuguuugcuguuaugaauuuugauaacugaaaacuguacucugccuucuuaugcuuucccuuuuaucuugaauguucugucaugggaaccugaaacucaagaguuaaggcacguaaauaaacuaaugugaaaaggggaaaagcauuuccagaaaugauugucauaaaaagaaaaagaaggagaacguuaaguuaauugcuucauuugaauuaccaugcugcuauuccuuuagcaaccaaacaagcagagaaugcuuccauauggcaaggcacaaguguaauguaaagcuaaguaauguaaggcucuauaccuaauugaaggauauucgucuugauuuuaugaggauagaagaaaaagagaaaucucauucuuguucuuggcaugguuauggugcucaagaucucagugauucucugcagaacuuuuguucuuucacaaugauucaauuuaaaaauuuucauuggagauuuuuguuuuccaaaacucaucaagauggauugaguuuuaaccuagagagauaauaagucuuaguguaaacacagggacagcauugauaacaaaacaaacuaaaaccaucuuuuuuguauuccucuaaaaagccauucuuacaaaggcuuuuugauuuggaauuucccucacuaucuuuaaaaggacaaaaaaagaaauuccucucuugauugucaacuacugaccauuuugauuugauauaagcuuguaauuguuggaaagauauuucugcugugauguuuguccaaaacuauaagaaaauacaucacacaaucucuucaauauccaucuccuaguuuaucauuuaggaagaugauuuaaucagucuucaguagugagaaagaaaaauuaagaauggcaaguaacgcaugaccaaaaacauuggcauaagagaauacuguucacuugugaucacuggaaucaugaucccuuucaaaaauuaaaauauauaauaaaacaaacacuguuuuuuuaaccaccaccacacuaacacacauguuccucuguaagaauuuccaucuaaauuauuuaugaguugucucuuucuugaauuagauuggugccuagcuaucuuucuuucuaaaagagugcuuacuucaauuaauuucauccuauacccccuuucucuuuuuauucuacauauucucccugagcaauuuccuuuuugguguguuuuucuauguccuauaagugaugauuccaaaagcucuauaucuagcauaauaucuuucuugaguuucugagguauauauuuaauugguuagguagauaucuguccugaaguucaacagauuccucaaaugcagcauuucuaaaguauaguuaauuucuucuuccuuaaccaaggauuuucuuccucuuacaucuccuagcacagcuaaggcaucccuauccagccagucaucuuuguucccaaaggagcuguuuuaguucuguucuuaucaucucccuucuggcuuauuagaggagccuccuaaucgaucucccugccacauucauggugcuuccagugcuccaaaacccugcuagagguaucuuaaaaggucagucugagucuguuuugcugcuuguuaaugguuccccucucccaucuaagcauucucacuacaucucccucaacagugcuagcccuugaccuuguauauacauaauacaccuuauuguaauuucuuauucaccugcgucuucuauaguaacauaugauccuagagauacagaauuacauuguguuuuugauuuugauuuuucuauccagaaucccugcacguaauagauauuuauucccuguuggguguuguggcucauccuuauaaucccagcacuuugggaggccaaggcgggagaaucccuugaucccaggaguucaagacaaaccugagcaacauagcaagaccucauuaucugcaaaauuaaaaauuaaaaaauuagcuggugugguagcgugugucuguggucucagcuacuugggaggcugaggugggagguucaccugagccugggaggucgaggcugcagugggcuaugaucccaccacugcacuuuagcuugggcgacagagcaagacccugucucaaaaaaccauuuuuccccccuaaaugcuacugaguaaaucugugacuuuuucccaggagucuggccgaccugaguuugaauucugcuucugccauuuacugguaguauaugaccuugggcaauauauugaaacucaauugaauuguuuucucaucuauuaaaugaggaguauuaucaccuaauguauuuuucaguuaaacuucuuauuuugagauaaugguaguacguaauaauaguacaauaugcaguuuuaagaaauaaaauguaaagaucccauaugcccuuuaccuaguuuccucaaugguaacauauuguaaaaccauaguaaaauaucacaacaaggauauugacaucaguacagugaaaauacagaacaaccacaucaccaaaagucucucuccugauggccuuugauagccaugccucuuuccuucuaccuucacaacccccaucauuaacuccugauaugcaaucacuuuucuccauuuuuauaauuuugucgucucaagaauguuauauaaauggaaucauacaggaugcagcuuuuuggaauuuucuguuuuuacucagcauaauguuuuagagauucguucaaguuguaugcuauuaguuucugaguaguauucuaugguauggguguaccauaguuuauuuaaucauucuucuguugauggacaucugaguuguuuuccuagaaguacuaugaacauuuguuuauagguuuuguugugaacauaaguuuucuuuucucuaggauaauuguccaagagugcaguugcuggguaguauguauaguauuugcgugguuaauuuuuaagaagccaccaaacugucuuccuggcugacucuacuauugcauauucucuuuagugcacuguauuagcgauuccguuuacuugcgcauucaccagcaugcaaugauguuggugguguuucugguuuuuuauuuuagccauucuauugguguguacugaugguguccagugauggguuuuaauuugcguuucccuaauggcuaauaauguugaacaucuuuucauuugcuuauuugucauuugaguaucuucuuuuguuaaaugucucuugcucuuuaaaugucuuuugcccauuuucuaauuggauuuaaaaauuuuuacuguugaguuuuucacaguuccuaauauuuucuagacaguaagucuuuauuggguaugugguuugcacauauuuucuucuaauuuauagcuugucuauucauccucuuucagagucuuccucagaguagaaguuuuaaacuuugaugcaguccaguguauggauccuuuccuuuauauucuugcuuuuauugucaagucuuaaaacucuuugcuuauccuuugauccugaagauuuuucuuuuccuuuuuuccuaaaagcuuuauauuucauauuuaaguccaugauccauuuugagauaaauuuuuuauaagauaugaaacuuaggucaaaguuuuucuuugugugugugugcgugcaugugugugugugugugugugugugugugugcacguuccuguauauguccaguuguuuuagcaccacuuauggaaaagacuauucuuucuccauuaaauuguucuuguaccuuuguccaaaaucaguuuacuguacuuaaaugggucuguuuuggguuucucuauuccucaauugauuuaaugucuguuccucuaccaagaucaaaaagucuugauuacuguagcuauucuuuuucaaaauugcuuaagauaaaauaguaccuguguuuuuucauauaaauuuuauaauaaccucaucuguguuuacagaaaaucuuuccgguguuuugauaagaauuguguuaaaccaggauauugguuuugggaauuuuuuuuuuaaguacuuuguugagucuuucucuucaugaagagguuugucucuccguuuauuuagaucuuguuugaucucuuuuaucauuuuguaguuuucagcauacaaguccuauaugaauuagauuuauaacuaucacuuuuggggggcacuugaaaugguauuguauuucuaauuuagauuuuacaugcauauuguuaguauacagaauacaacuuauuuucaaauguuguuuuuuguauccuguaaccuugauaaauggaguuauuaguuugaggaacuuauuuguaguucuuugaaauuuucuguauagacaauuaugucauuugcaaaugaggacagauuuauuucuuccuaucugauaucuaugcuuuuuaaauuuccuuuucuuggcuaauugcacugaguagaacuucucaugcggugugaacuaagaguggugagagugaauauccuugucuuguuccugauauuuggggaaaaaugcauucagucuuuugcuguuuaguacaauguuagcuguaggauuuuucucuauguucuuuaucaaauugaaguaguuccuuucuauuccuaguuuucugagauuuuuuuuaucaugaauggauguagaauuuugccaaaugcuuuuucuguguuaauugauauaauuauuagguuuuucuuuuauagccuauuaauacgguagaguacauugcuugauuuucagauauugaaccauucuugcaagccuggaaaaaguucuauuuagucaauguguauaauucuuuguauguaucgcucaauuuuauuuacuuauauuuuguuaaggacuuuugcaucuguacuuacgagaaauacuggucuguaauuuucuuuuuguaaugguuuuauuaugaggauauuacuggcuccauaaaaugauuuaaaaguguucacuccuuauuuguuugcuggaagagauuauguauaauugguuuucauucuucuuuaaacauuguguggaauucuguaguggaaacccaucugggucuggaaacgucuuuuuuagauauuguuaauuuaagaaauuaaauuuucuuaauuuaaguuauugggcuacuuaaauuacuguuuuucauauuugguggguucugguaguuuuucuuuguaaggaagugguccacuucaucuaaguugucaaauuuaagugugcagaacuguugauaguauucuuuauugacuucuugaugucuguauaguuauauuccuuguuucaucccugauauugauaauaaugucugugucuuuuuucugugucagucauacuagauguuugucaauuuuauugauuuuuuucaaagaacaaguuuuguguuccauugauuuuucucucuuguuuuccuguuuucaacuuauuuuuuucuauucuguuaucuuaauuauuucuuccaucugcaagcuagaaaaccaggaaagcuggagaguguaguucagucugacucugaaggccugagaaugagggguccaguggcguaaaucucuuuucaagacugaaggccugagaaccacaagggcugauguuccaucuccaagggcaggagauuuggaugucccagcucaaacagagaguaaauuucuccuuccucugccuuuuuguucuguuugggucucaauggauugaaugagguccacgugcccaaauagggcaucuucuuuaauaagucuaccaauucaaaugcuauucucuuccagaaacauacucacagacauaccaaaaaauaauguuuuaccagcucuuuaaguugacacauaaauuuaacaaucacauguaucuuuuuuuaauuuuugcugccuauauuguuuuauuuaaagagaguuucuuauggauagcauagaguugauucauuuuuacaaguuacuguaucauugcucuuucuucuguccuagugacuuaagauccuuucuuuuagcuauuuuuuuuuaaaaauagaacuuccuuuagccauucuuuuaggguaguucucccaguaacuauuuauuuauuuauuuauuuuuauaugagguugucuugauuaccuguugcuuacugaggaauguuugcacuugauguagaauuuugguugacaguuucuuuugucuuuuucuuucuuucuuuucuuuuucuuucaagccauugaaaaauguuguucucuuucuucuggccuucaggguuucucaugagacauccacuauccuucuuuugucuagaugucaugacuucuuucucccuggcugcuuccagauuuuuuugcuaucuuuagcaaaguuuaacuaugaugugucuugguguggguaucuuugagcuuauucuguuuuguauuaucauagcuuuuugaaucuguagguguuguuuuugccaaauuugagaauuuucacccaucauuucuucauguacuuuuaaagcccuauuuuccuuuuccucucucucugggacucugaagacacaauuguuagaucuuugguuauaaucccacagauaccugauacucuguuuuuuguuguuguuuuguuuguuuguuuuguuuuucagucucuuuuuuucucuuuuguuuagaugaguaauuuuaguuguucuuucaguucacugauucuuuacucuccuccaccuggucuugagcccauccguugaauuuuuuuaauuguuuuuuuuuuauuuuuauuuuuuugagguggagucugcucggucccccaggcuggaguacaguggcaugaucucggcucacugcaaccucugccuccuggguucaagcaauucucgggucucagccucccaaguagcugggauuacaugcgugcgcuaccaugcccagcuaauuuuuguauuuuuaguagagacaggguuucaccauguuggccaggcuggucuugaacuccugaccucaggugauccgcccaccaaagugcucugauuacaggcuugaaccaucucgcccagcugauuuuuaaaaaaaaugcauuuuacucugguaaagauguauuuaaugaaauuuaccauguuaacgguuauuaaguauacaguucaauacuguuaaauauauucacauugcugugaaacacauauccagaaguuuuccaucuugcaaaucugaaacucuuuacccauugaacaacuccauuuuccuugcuccucucagccccugguagccaccagucuacuuucuguuucucugaauuugacuacuguggauaccuuaugaauauggaauauacaguauuuaucuuuuuggcacuggcuuauuucacuucauaauauccucaaguuucauccauguuguagcaugugacaagauuccuuccuuucuaaggcuauauaauauuccauuguaugaauauacggcauacuguuuguccauucauccauuggacauuugaguugcuuccaccucuuggcuauugugaauagugaugcuauaagacccugcuuuuaguucuuuuugguauguauguagaagugggauuguuggaucauaugguaguucuguguuaaauuuuuugaggaaccuccauaguguuuucuauagcaguugcaccauuuuacaaucccaccauuagugcacaaguguucuaauuucuccacauccucuucaauacuuguucucuguuuuucuugauaguagcaaucucaauagaucugaggggauaaugcauuucucuaaugauuagugauguugagaaucuuuguuggcuaccuguguauuaucuuuggagaaauuucuauucaaacuuuuuuucauuuuuuaaucaguuauuuguuuuucauuguuugguugcagaaguucuuuacauauucuggauuuuaaccuuuuuucgggcauaugguuuggaaacauuuuuucccauuccauagguuucuuuuucacucuguugauuguguccuuugaugaacaaaaguuuuuaaguuugauguaguuccaucugucuguuuuugcuuuuguuaccugugcuuuuguugucacauccaagaaagauugucaaauccaaugucaugaagcuuuuccucaauguuuucuucuagcaguuuugugauuuuauacuuuuaugucuuacauuuaggucuuuauccauguugaguuaauuuuuguauaugguguaaaggguccaguuuuauucuuuugcaugugagcguccaguuuucccacaccauuuguugaauaaacuaucuuucuccauugaacggcuuugacaccuuugucaaagauuguuuaaccauguaugugaagguuuauuucugggcuugauauuauauuccauuggucuguuuaucugucuucgugccaguaccacacuguuuugguuaccacaguuuuguaauauauuuugaaaucagaaaguuuaaguccuuuaacuuuguucuuuuucuaaauuguuuggugauuuggaguccuuugagauuacauaugaauuuuaggaugcauuuuucuauuucugcuaaaauugccauugggauuuugauagagauuguauuuauggaucauuugugguacuauggacauuuuaacaacaguagguauaacaauauuaaagcccauggucaaccacaaacauggaaugccuuuccauuuauuuguagcucuuuuauuucagcaguguuuuguauuuugggagcaguguuggaagucuggacuccaguacuugucuuuacaguuucccucuuuucugauucuuuggcuaaagacaacaaacuuuucuaggggcuuguuuugguaugugucauugacauuacuggguuucuguuuuuucaacuccaaaucugaugacaucauauaucauaucggauauaugagaccuauaaaaugaaaacuccuggagaacucaccaccaugucauuuuugggggcccccagguuuuaagccaguacgucaucuucuuuucacuuuucagagucuguuuauauuuauuuuauguauaauguugagggauuuuaguuguacuuaguguggauaauagggaaaaguaugucuacuccauuuucuuggaagcagaaguucccuaagaugcuuuuaaaacagugguuaaauaacauaauguugagaguauuugcauggugcaaggccugagugcucaauagagggugauaauugccuuuuauuaucuucaucuuucuccuauuugaaguaucagucacacuuugcuauagaggcagcuccaguuuaaguuuaccuugcuuuagauaaauuguauuaucacuaacacauacauuugcaucuucauacccuuuauugcaauuccaucaagauguagauuccagaaacaacauugucuuuucaguauuuuucuuuuuccaggcaauuuugacaaugcauuuuuguaauaagacuggaauuacuaauucugguuuuauugaaaaacuguuagccauuucagccagaagaagaucauggaggaaacaauaaauuuucuucaugagcuauucaauccaacgagauacugaauuaagugcaggaaaucaguacacuuuuuguuugauaagaaguguuccucugaaaaaccauucuuagaucauuauaaauauuauugguuggaugcaguggcucaugccuguaaucccagcacuuugggaggccaaggcaggaugauugcuugagcucaggaguuugacaccagccuaggcaacauggugaaacccugucuuuauaaaaaauaaaaaaauaaaaauuuagcuggguguagugguaugugucuauggucccagcuaauugggaggcuaaagugggaggaucucaugagcucaggagauugaggcugcaaugagccaugauugcaccucuguauuccagccuggacggacagggcaagacccugucugucucaaagaaacaacacacacacacacacacacacacacacacacacacacacacgcacacacgcacacacacacgcacacacacccauuaccagucuuccugggaauuuuauucuauaucugucuauaaguuuaaaguuauguacucuagcuuagccuuuaacuucagaguuaauuugaaauuuauuuaaaaacuauuuuuggaaauuuacauaaucaugaugacugcauguaaacuguuaguaauauuuuauagaguuuccuuggguuuucuguuagaaugaaguaauaaauuugugucagaaaacuauuugggaaauuuagaagaaauuuaagcuaaggaacauaagcuguggagcauggcccuaagaauccuuuuauucucauuugauaaacaguagaauccagacagggaagaaccuuauuuucucugccuuugcuaguugguggaggaaaacuugcuguuugagacaaguaggacuugaucuuucuauccuguacuuuuuucaucauccucaaagagggcuuauuucaguggauagaccauucauaguuuugacagcucaaauaacccuuaaggaugagcaacaacugaaaaguuccaagggcuuuauuuccaauggaaggauuucaauuacagucauuuuuucaaguuaguacaaggagguaaauggaaucacaguuucaaauguuaaauuugaagacuacaccauuaccaguguauuuuggaaauaaaagaugcagccaaucuaaaucaaagacaugauuccagauuaccucauaagaguaugaggaagacuacaggcagcaauugagccacuugauauggaagaguaugcagugcaucaaaugugacuuucauuaagccguguuacccuuguuugcuacugagggcaggaggcauccuuuucaacagccuguaauagcuucuuguugaaaggcugccugcuauacagaugcagcagcagagagagaaaagagggauacagauucacauauucgccuuguuuuuuaaaugccauuuuugccauuuuuggaguugguuuccagugcuuagaauagcuguaaguauauaguaguuauuuacuguauguuuuugugugaguaaguaagagaaggaauuaaugaauuaggcuuuauaaacuggaaguuuuuguugugcacacauuaagcuaagcuucuaucccuucucuucuccacaugguaccaccagacuuuuccccacuucacccccucaucuaccauuuuuuguuuuguguuuuuguuuguuuguuuuuugagauggagucucucacucugucgcccaggcuggaaugcagugaugccacuggguuccagugauccuccagccucagccuccugagcagcugggauuacaggcaccugccaccaugcccagcuaauuacaucaaccuuuuaaaacuuauuuuucucucuagaauuuguuugugugcacuuaaagaguaagugggaggaucucaagacaguacagaaagaguuggacaucuaguucaguuuugcagagggagugcagagaaacuuccuuggaguuauauaauugauuuuuggaaccucauuuguaggauaguuguguggagaaaggcauucaaauugcauucacuguacuucuuaggccaagguagaucugguuauguacauacuuguuauuugguagaauacugcuuauguuggcauuaucuuuuccauacuacauuuaugaacuggaaacaguuaaagcuugaaacuguuaaaaaaaaaaaguguacgcuuacauuguauguauuagaagucauaugauuacacauccucauccucucaccaguccuuucauguagagcagcgguuugcaucuuuggcuauacauuggaacuaccuugggaauuaaaaaaaaaauugauguccaaguaucaacucuggagauucugauucaguugaucugggaugaagccuuggcgucaauuuuuuuaaaaagauccccaggaguuuacaaugugcagugagggcucguuuuagaaugguauauugauuuguguuccaauuguucuuucuugcauaaaucacaucuguaauucauugaccacaguugucuaugaggcuuauuaaaaaugguauaacaacuuacacauacaugaauaauuggaaugcagaaucauuuuaacuucccuuucccagucuuucuauagucaguuuguauuuaauucaacaauuguuuuuugagaggcccacauuuauuaaauguuuaucuuguccagcuuaauuucucuagaaacaaaaucucaccuucauuuuguacuuaucacugguuuacaugugguaaauaaaauuagcagaaacagguuuggguaugguccacugugguacacgggugucuuauagagaugaguauucauuggcuaugaaauguucaguaaguuuuacaaaggaaacgaagaucaucaguugaucuagcuggucaguuggggucaguuaaaagagcauuauuguaaaagauuugugguuugccugauuuuagaucaguuaacauucacccaugagaagguaggauguaugucauuuuuauuuuauaagugaauauguaacuguauuuuuuuauuuuguauuuaaauuuuuauucaauauuucaaauuaauuaauuucuaauguuaauaccuaauauacauagauauaaucaauaugaucacuguuaucucuagagugaagacaguuucuugccaacaauuuuuauaucccauuauaaccauccagaugaguucauuaugggcuuucaguacacacuaucagcgcuuaagagucuugaguucauucuggucuuugauuaucacaugucuugaaauacacaccacauuagauuuguaaauaaauuguagaaaaaucuuaagacugaaauuuagauauuaacaaacauuauuuccucuugagauaugcuaacagacaucagagcauuaguaggucacuaaagagugaagaugagucagacccaucaaaauacauauacucguucuaccacuugauauguacacacuucgaguugguaauuuauucccaguuguuugugacgguugcauuugugcuuaucuucucuuaguuucacaaggguagcuaaucaugaguuuuugucuguuuuugcugaacuuuaccuacugucuuauuaaucuuguuuauaucagugugaguuucuuaaggacaaggacucguaggcaccaacacagaaagcaauuuuaggaauauacugucugaauuaaauguauuaaaucagucaacaaauaggaaccuuuugagaaaugguccugaaaacauuuuuguuugcuuuuuuuccuagagaggaaauaaacggguuuauaagcugcugagugcaaguaucauggucugugccuuuucuucuugacugcucugcuauauucucuuucagaaagcugaguagcucagcacagugaauacuaaagggaaugcauuccuucucucucaggggacugaagcaguguuuaacaccacuguaaaauccucagcuguggcuuucucugguguagaauuugucuaagaaagauuaaaagaacaaggaaagcuuugugugcuguuucucuuucuuuucuucaccccuccugcuccaggcuauccugaggggggaaaaaaaacguggaguauuuuccuuggaccucuggaguaugcauguuauguaugugugagucuuagagaaaaauaaaggcaaaugcaaggcaugccugcuagugggagucaucacccaugggugaaaugaagaaaacuacaugagugcguuugcguuuauacggccacuuuuuccauugaaugacccaaacaagaugccagugacaaagcauugguccuacaugugauaaaacagcggccuggccauuugcuuaauugguggagaacucagguguguuacucuuggcagaggugaaagccuucauagagaauuagaagggguauaauuugggcacuguacucagaaucuuucuugguauauuguuuaagagcuucauugcagugacugccauucagcaagaaauaagagaugacuuuuaaauauuuggccagauuuuauaguggcaaggacagaguuuuagagcugaagagccauuuaguucaaucccaucaaucugcaaaugugaacaguaagcccagaaucacauuuaguguuaguggccagaagggagaccuuggcuaugaacauuuacccuaccggaaacuaauggcguaaccagauuugaaccuuuucuuccauucuguacuagguugucuuuucuuuguuaggaaaagccuauuauaaacggaacauugacaugaauuuuaauuuuugcauauuuucuuacaacauuugcccuuacugcauuuuauaacuaauuguauauacuuuuauauuuuccuuuuuguacucaugauucuaauguuucuauguggcauuucucacaaucucugugggguuuuauuauaauuugcuaaauuauucccuuguuugggggcauuuauauaaacuuuuuuuuuuuuugccaugaaagagaaagccacagcaaacaauguauauauguagcucuuuauucucucaaguuauuguuuuuguucucaucaucugaguuauugggggugacuucauuacagcaguggaaaacacaugguaaccugccagcaucagaaggugucgcuuuguacugugugugugugugugugugaagguuauguggguaugacuguguaggaaagaaaaaaagugcuacucuuuguagaucaaacaauugaugagucuuaauguaggauuacguguugccuguuaaauugcuauuucugcugagaaagauaaaggcauuuuuauuaguguaguugauuagcuuuauuaauguuggacaaaaucaauguuaugaaaaugaaaucuauaguuuugggguaaaauaaaauuuaauagguaggugacccauucauacacuuaugugaaguaauuuuugaaaugauaacaugcaugaaaauuuacuaucuauacuaaauguauauucaaagauauucuuccucuaggguucuaguuauaaacccuuauaaacccuuauaaaauacuaugauucacauauacaacuuauaaaauacugugauucaucagacagcucuaguuucauuuuaucuauugacucugauuuaaauuaucacucuuuuuuaugcaggaauaugugguaacaaguuauaugguaagaaauuuaaauguaaagauuuugaccuaacguugauucagauuguagagcugucaguugaaaagggaaacuucauguuuagaaauuugaguucugcugggcgcaguggcucacgcuuguaaucccagcacuuugggaggccaaggcgggcggaucacgaggucaggagaucgagaccacggugaaaccccgucucuacuaaaaauacaaaaaaaauuagccgggcaugguggcaggcgccuguagucccagcuacuugggaggcugaggcaggagaauggcgugaacucaggagguggagcuugcagugagccaagaucacgccacugcacuccagccugggcgacagagugagacucugucucaaaaaaaaaaaaaaaaaaaaauugaguucuaaaauguuugugaaaaauuugauagguucuuuaauaaauguuuauuuccaacaaaaauuuuccugguggaggaguuauuaggaccagugagcaugcauuuuuuuuuaccgucuugauuguauuaucauauuagcuucaagaaauguuuguuucacguuacuuaucuuuguuugucaaugaggucagacacuuucccccacgcugagaacaguauccacugccucugagguggauagucucuagaaauccuuucccuguccuggagcaguuugccugaaagugccauaguugguagcaaauucccuuccacuccucuuccugccuguuaacacuuucuggaaacccagguccccaugugcuuuagcacucucuguaaucauuugugggccucugcagaugagcagucugggagcuguggaugaggggcugggcaacuucugucaugugccauugcugugagaucuuuucuucaccagaaucugggggugauuuagaauaaugguuaguuagugacaugaaguuuuggaaaguuuuuuguugacauuuuuaagaagaagaaaaacugaugaugaacuaaaauaaagcuguucuuucagccaugucucugaaaccauugagaagguuuccagguacauuuugggcaguaaagaagauguggacugggcauuccuguaaucccagcgcugugggagccugaggcaggaggaucacuugaacccaggaggucuaggccacagugagcuauggucaugccacugcacucuagccugagcaacagaggaagacucucuaaaaaaaaaaaaaaaaaaaagaaaggaaaagaaaacgugcccuguuuuucuguuguugagccuuauuuauuuuccuugcucucagcagcucugugguuccaucacuuggcugccuucacggugccucugacuaguuuuggaaauagaaguggugguacaaacaacgggguggaguugcaggauacauuguggugauauagucuuuucauucucuauauuucagccaauaugaucuuuucaaaacacagguuacauuauagcauucuccugcuuaagauccucuagggcuucuuauuacgcuaagaauaaaauccaaauacuuggucauggccuaugaagccguauguggcucccugcccacuuccauucccacuguccaucuagguccucaggauucccuuaucaaacuuucuucaguugcucuaccacacauccccaugugguggguuccauucuguacuguagcucuuaacucaaacauuagcucuuuaguguggucuuaucuuaccaaccaucuaaguuugcccccuuuacuuuuuuuuuuuuuugagacagggucuugcucuguggcccaggcugaaguacaaugaagaauaugauucacugcagccucgagcuccucgguucaagugauccuccagccucggcuucccgaguagcuaagacuacaggcacgugccaccaugcuuagcuaauucuuaaaaaaaguuuuuuuuguagagucagggucuuacuauguugcccaggcugguccugaacuucugggcuuaagcgauccucccgccucgaccucucaaagugcugggauuuuaggcaugagccaccgugcccagccgcuuuacuuaugucuuacucuguuauuguuuccucuguaucuucuuaauaccacuuauaaacaucugaaauuaccccuuuguaaauguauuugcuuauuuauuauuauuuucuucugacuucuuucauugaaugaaaguaaguuccaugagagcaggaccuuagggauguuauuaacuguuacauccccagcaccuagugcuaugccuagcagugaguaagaacauuaauauuuguugaaugaaugcuugaauggccaaaacaagccccuguuauguggcaggagcugugcuagcaguaaaaaauuuagauaaguugaauucagucucugcaaacaauguuuuccauaaucuggaauuguuguuuggaauucuuuacagaaauucacauccaggcucacuuggaaaaauaaucuugcugauuguaauuuuucucguuaugguuguucuuggcaguaaagucaguuuccaggugagaauguuacugcucuuggccaaaggccacuguaaacuuuccaguauuccugagggucuucaggccuuacuccuugaauaagacagugcuccuugcuugaagaacuaaguuuucugagaguagaagggaacaauagaaaguguacacaucagcauuaccaguuuauuguuuucuggacaguuauccaaauuugcuuaaggacuuaauuauuaccagaucaaauaauguuccccucacuuuuuagucuaguauaugcuguaugcuacccugucugugauucugauuucaaagugagaaacaaauuagcaagcaguuguuuggugaauuuuaaaugcaguggugacccuugcccaaucuuucauaaaaauuauuuuauauuuaaugaguuauaucuugggguuccacaaauaguagguucgauauuuaggauuaggugcauaauaccuggaguuaagcuuugcagagcuggaauuuggacugugugucuuggccagacccuggaagcacaaggacaauguugagaugaaaagauugagaauuuaaaaucuguaagaauuuaaagccauuuuacaucacaccauaauuucucuucgcuggauuaagacauuucacagcuauuuauaaaggagugauuugcuacuauaauuuaauucacuugacaaucguaggacauuggauccauaguuaugucaagcuagauuagaugcaaaauugguaggaagacuuuuguagauuaaagacauaugacagugaaaugcagaauuugagcuucuauugaauccuaguucgagggaaaugcugugaaggucauuuggggacaacuggggaaaucugaaaguuggacugcauuagauaguauugaauaaauauuaaauaaccucuugaguguguuaaugauauuguaauuauggaggacaauauguucccuuucuuguucuuuuugcuuucugauagggucuugcuauauuucccaggcuuuuauagagcaguggugucaucauagcucacugcauucuugaacuccugggcucaaggguccuccugccucagugucucuguagccgggacuacaggugugcgccacuaugcccuguaaauuuuuuuaaaauauuuuaauagagaccaggucuugugauguugcccaugcuggucucaaauuucuguccucaagugauaccccugccuuggcuucccaaagugcuaggauuacagggaugagccaccauguccggacuuuaaaaacauuguuuuccaauacgucaugacuauuuugacuauuugauugguuuuaaaauaucuaguucauuuucauguuguuccagaugaauucacuuuuauauuguaucaguugaugccauuucaaacuugaaagguaaaaguagucacuguucuucaaaccaaaaugacuacuaagaggugugcguguguaugucaggggagguggagggaaauuguggauaugaaugaaaauaaugaguguaacuuugaucacacagauaauacaucuacagccuuuacuaaagcugccuuuacaguuucuggcuucagagaugugguaagugccucuugaaagguugauauauuacuuuuaacaacauaaaaaugauauuugccuuuuuuagagucucuuuuuuguucacucagauuuaaauguaucaucuaacagucuucucuuugugcccauguucuuccaugagacacuuagaaugucuaaaaagaugaguuugguauuguucuagccuucccuuuguuuuuaagggggacuuugagucuaucaagagugugugugucagcuaagauuguauagcuggcuggugcaggagcuggaauuuaauguuguuuuuuucuggccucucaguacaucacauugucacuuaagugagauggcaagcauuucaggugcucuuacauauaucugcaagcauggauaacauuuaaugccagcucucauaauuaugcaucacuuguugaauuauuuauuguacauacccuacuauaaauuguaaacuccucaagggcaggauuuuugucuguuuuaugcauugcuuuuuuuugugguauguagaacucugucuggaaggugauaggcacucaacaaauauuuauugaaugaaugagugaaucaaaauagaaugaacuaggaauagauuaauggcugcucacuuugcaggauuucagggaaauaauuggucagcuuuaacaacacaucccccucuaacuagcugaucuaaacugaaaaauuagacacuggcuuccuguuuaauuucccguacucgugggagugauaauacauuaagcucacuuaggucagugauuugacaacuuagagugaaugauuucaacaaccccuuuccuaggagcacuuuuuguugggggcagggaggacggguggagugcuacuaaguugaagaaaaguacagauggaaaggggcaggaaaaaagaaagacaaggagaugcaaagacaaacuuugagcguaucaugauuuugagcaggacaacuuugcugguauguggguuaagaaauacuuuggaauaaauggcauggucugaucugucaaacuuguucaugguccuguggucccaagaaucuguaccauguaauuuguaacuccagauagucaagacuugaauuugguaacucuuguaauucuugguauuguguauggaugcucauguacaguuucaggagaguaagcuguuguucccaucuuauguguggcuuauuauaucaugaguuauuacuguuugucaguuauuccuggguaacgcuguuaagaaaaugcuggcacuucaagggguuugaggaaauguugaggaucagauuuauuuaauaugugcaaaauucuagauuagguagaaaguuguugaaaucauggaucuaaagugaaaaauugagcuuuuuagagcaccuauuagagaucagacaauuucuaguguagagccugacacauaagaguuacguaauaaauauuuggugugugggaugagagggaaggagagaggaggaauguugugagcagcuacucauugaaguugugaaugcagccaagcugaugguuccauagauuguuuuucucuauguugaggcuuuaaaugguauccuuaauuuacugcuaccuuucagaugaaugcaacuggacaucaaguagacuaggggaagaagaguacaucuguuuucccuagagaacagggaccccccgccccgggccauggaacugguaccuguccauagcccauugggaacugggccacagagcaggaggugagcagcaggcuaacaaacauuaaggccugagcuccugucagaucagcggcggcauuagacucucauaggagugcuaacucuauugugaacugugcguuugagggaucuagguugccugcuuccaugagaaucuaaugccugaugaucugagguggaacaggugcaucccaacaccaucgcccucccauccccaggucugugggaaaaauuguguuccaugaaaccggugccugaugccaaaaugguuggggaccgcugacauacaagaagaguaauucaaaaaacagaaauagcaauacaaaguugcagucugaauuugugcaugcuauuuuaccucuuggugccucaauuuccuuaucuguaaaauaggguuacuaauguauauuucauuggguuuuuuggguaggaguaaaugagguaauugguaaaaaggaguuuagauacagcaucuacugaaauaucagccaguagaaguauuuugcggucaauuuguuuuguaugugcccagagggaagggaaauaugcuuaccaauuuuguucauuguuaccgucuguauagaauuuugacuauuugauugguuuuaaaauaucuaguucauuuucauguuguuccagaugaauucgcuuuuauauuguaucaggugaggccauuucacacuugaaagguaaaaguagucacuguucuucaaaccaaaaugacuacuaagaggugugcguguguguuuguguguguguaugucaggggagguggagggaaaauguggauacaaaugaaaauaugaguguaacuuugaucauacagauaauauaucuacagccuuuacuaaagcugccuuuacauaguuucuggcuucagagauguaguaaauauccacuggaauguuagcucuuaaagcugguggucauauuuauauagguuggguaucccuuaucugaagugcuuuugacagaaguguuuuggguuugggauaauuuuggauuuuggaauaucugcauuauacuuauaaguugagcaucccaaauaugaaaugcugcagugagcauuucuuuggagugucauguugguguucaaaaacuguuuggauuuuggagcauuuuggauuuucgauuuucagauuuguguuccucaaucucugugguuuaaggcugagagaauagaucuaaucagcagucaguagagcucauuaguagaggagagaggagaguuuucuuuuaagaaggcuauggggucuugugaagagacgagauagcuuguauuuaauucaccugacagucauuagcuaguaaaaaugaaagagagucugggaacuggaacagagagcuggaaauucagcuccuuccaggcagaucugccuugaaauuccggggaaaucagaacaggaaccucuucauuucuucauuucccuucacugcguaguaguuuauuuugugcuuuugguaaaaugauucaagguccaggagacauccugaggugaugcaguguaggaaagcauuucagaaagguaagauggaagacagaucugggcacagcaaugugaauuggacauuucguucauccuuugggcuuccuagaauuagcugugauccauaggacuguccuguccauccugguguucucucagaaucaggagcagcucacugugcgaaaacccaucugaggaaaacaagaaugagcugauggucacuguaucccaaauugacacacuaguuagguagcccuugggugugaacuuccuuaaaauauuuaaggaaagagacugcuguuaacauacucagggaacaauuauauguuguuuaccacaugacaagagaagaaauaaacguuagacauauuucugggagcuuagauaaguugaaauauggaggaauuaaaugcuauaugguaugauaauauaaaucauuugaaaguugaaaguuuuguuagagcuaagaaaggccuugaaaccauccgaucucaauccuguaccuuaaaaauugggaaacugaagcugaaagaugggcagugauuucucccaaaguuuuguugcaaaauacagggcuugucuugauaucggaauacuuucuauucuaagacauuuuuuuugucuuuaagauaaccagauauguaucugaggguagaacauaccuccucuguacuauaccuuugaaguuuuuguuuauauauaugguuugugcauacuuauguaaguguugcccucaaaauggaaaagauucaauuaggcaagaauaucagguguugaagucauuuuauccaagagcuaugaagucucauauuagucaguugggcauaucgucuucaugaccuuuuugcuaguguucccaucuguuguaucauugcugauuguguccaugugagacggaaaaggagcauuggacucuuagccuaggaaccauauaacaacuauaauuuaaagcagauguuauuaaccuagcauaaaagaugugagaagucugaaguguuagagccagagaaaaggugagauuaaacucaaaucuucugaaucuaaaagccuuguuccuuccaaaauaaagauaagcauauccuucuacuggaaacuuuacagacuggcaagaguaagaauaaaaagagcaggugauauaugauugauugugccauuauugauaguuacugaucuguugcauaguaauggagagcuugauuggauggugauccucccugugugccuccugaguguauuuggaacaucauccaggaaggccuuuuaaagaagacaauacuuggagaagguuuugaauguuugaaaagaagcaugggccagguguaguggcucauguccauaaucccagcacuuugggaagccgaggauuauaggaguuuaccaguccuccagugggaggaucccuugaggccaggaguuugagaccagccugggcaacguagcaagacuucgucucuacagaaaaaugaaaacauaagccagacaugguggugugcgccuguagucccagcuacuuaggaggcuguggcgagaggaucgcuugagcccaggaguugaaggcugcaguaagcugugaucgcaccacugcacuccagccuggguuacaaagugagacccaucucagaaggagaagaaaagaaaugugguuucacuagaguuauggaaucagguuaaaagacaguauuaccuuuaauguaaauugguggcacaucucugcaucuuagccucaacucagaauauuauugguuuaagagucagagagcuuagggguaaaaggcucuaaaagccucugaauuucaggagguugguacuuucagcggucugucuccaucucucagcacuacuuccucuaugggcuucuugugguucagagacaaagacgaugacuguucugccugcucagcaguccugggagagagcaaggcucaucguuucuguguccaacaacaaucuugcagcuuccacuuuacaguccuccuuugguuauguggcuauucuugacugauugacuggauauauguauagucaucccacuauacccuuuaguggggcgacucucauggcccucucagcauucccgaaacugcugggacccugaggcaggugggguuaauucuucaaaagagacuucagcuacuguuaccaaagagugaauaaaagggcugagguggcaaaaacaauaauggguuuuugaauauauguuacuaggcuaggcacaguggcucauaauuccagcacuuugggaggccaaggaggaaggauuacuugagcccaggacuuugaggccagccugggcaacacaguaagaccuuuuaaacaaaaauuagccagguauagugguguguaccugugguaccagcuacuuaggaggcugagguaggaggaucgcuugagccugugauguacagucuacagugagccgugaucauauuacugcacuuuagccugggcaauagugagacccugucuuccugucucucugucucugucucugucugucugucucucucccucucucucucuguauauauauaaucccaguauguuuuuauuucuuucuacagauaggggaaggugaucuauuugaaagucuaaugcagaauaaaguaguaguaguuauccccuggcagaguaaaaagauaagcaaaacuugggacgucaacuuacagcaagagcuguauggaagagaacagugugguguguagagagaaaucauaaagcuggcugcuuugggccccaagaaagucucgcuugugaugguuguauacauggccguguggagcuucagauauaagaaaagaauuaagagauauguauuaauaaggcugggcauggugcaugugccuguugucccagcuacuugggaggcugagucaggaggaucgcuugagcccagaaguuugagguuacgaugagcuaugauuguaccauugcaccccagccugggcaauagagugagacauuuuuuccaucagcucaguguauuaaauugguuuucuaaguuaaagguucacaacuucauuaucguuacuaugcagaauugcacuugguccugaaaucugucugaauuucugaauaauaguuucuuguccucaacuuguguggucucagguuuuaaaacaaacuaagguuguuacugccaauuucuaaccacuguugcauuuguaguaauugagugccagugguuggagguuuagagaagguuuaagauuaacugauuccaaaaauaucuguguguguguuuguguguguuuccauguugucugugugaauauguuagaauaggaauagcauauguuuugauuaggcauuuuucuuuguucaacauacacuuuggaaaaccuagagaauuucagugggauuauaguauauaaugacuauauucugauaaaaucguggagucuuaacauuucggguaacagauuaucugcuauuuacugguauguugauucguggacagaugcuucucugucuucagguaggcuccccagguacacuuucuugcagucccuucuaccagguagacaugcaagaauuaacaauaaaugccacacauguguguuuucucuuuuuucugcuugugagagguguuuaaacuuuguggaaauuuauuagaaaagauccauuguuugguaguucugauagcaucaacucgcccuuuaucuuucaugaugcauugagacuuccauuacuuuguagcgccugacugcuagaauuguucccagaguucaggggcuuccaaaugacaaugggcuguaccgggcuuuguggccuuaauaagcccucuguuacuggaauuuuaaauauuggcauaccuaucagagucuggccgugugucaggagaauguuggcuuuagagccaccacugauggaucacauguuuuuuucucaagagagcaaacaagcacuuuuuguuuaggcuuacuaauguuuggcaaagaaauauagcuguaauuauauauccucguucuuguuacucucuccccaucuaaauuuuacucucccuaccccuaacuuuauauaaaagcaacuaggguuggaucugaaauaaaugucaugaaugaauaauaauuucuuucauuuacacaguaauucaaccuguugaaugcugacuuaaugcuuuacuacacucuaauuugacuggaagauuuggccuucgugaaugcaaagaagagguaaaaaauagaaauuaaauaccgacugacuaugaaggaggacauuuuucagaaggguucucccuccuucuauuucucaucuucuuguguuugcccccugcuuucugugauacuuaauacuuaggaguuguuccacaaaucauucuuuacuuuguguacccagcaguaucccagcagcaggauucuccagggacaaggccuaggucugccacugaggguagucugcuuccuucaucagaauugccgcugcuggccuucuggaccauuagaguucuuucugguuguuauccacuuuucauuccuucucaacccauagaauuccagguggugagucaguuuuucuguaugaucaugcuugacaccccaaaaucuaccugaaaguuugacagaugcauggaagccaggagcauuuuaggaagcuguacugcucuucugagauuuucugccuacuuacugucugagcauucaaccugucucucucaaauuuucucuuucucuaagguggguccaguaaugcgagucggcagcccacuuugcuguucuuggaagcgaaguacuuuccaauagaagucaguuuuaaucuucuuucaccgugaggaaugaaugaccauuuuaauaaauaauucauuccuacaguucacuccguaaggagcuucuaagcucccuccaugaugguuucugauccugccaggguacugcuauuuuaucugucaaauguggguuguuagagguacugugucauaagaggcagugcaguucggaacccuggaacccccuucauaaauuugcaaaacacagugcauggggccugcuauggcaagguaugcuacauggagccucagcugucugcucccucucuucugucagcacagcuagcagucagagacaaauggcuaacccucuuugagucucuuggaguaaagccugguuguguucugcguggauugcauccugugcagauuguggauagcaagggcuuccuugcaggccuguugggagcauugauugagaucauggguguagaaagccuggacuauagccagagucaauaauuauuaguucuuuaucuugagacaaagggaaguguuaaaauauuuuuauaucaaggaaucuccuacaaacacuguccuccccacugcccacugccaguauuuacaugaauuaauuuucuccuuaucuucuuacucucgcccacccgcuucccuuuccuuccguuccaaaguuauacuacacuuauucaggauagaaauuuccuuuauaaaaaguuguaaaaacuucaaagugccuguuguaguauauaucuuuaauaaauacuccccugcuauauuuguuaaacuauaauuaugagcauacauuucauaaaaauaaagcccauuuacucauaaacuguauguuuacaugaaaaaauacacauuuuauaacccacuccagaccuacuaaaucugggcguuagaaucucaaucuuggguuuuccaaccuggcuccuuuuucgaaauaaccuggaacacuuaaaaaaaaaaaaaaaaaagcaaacuccaggcucaaucccagaugauuuacaucagcauauuuucaggguuggcccugggcaucauuuguuuaagcuucucuggugauuauaaaugugcagccaggguugagauuuaacggucuauccuaagugcuucuuaaggucugaaacuauaacuauuaagugagcuggcuuaauuuauuuaaucuuugcagcaaccuuaugaggcacagcuggcauuaucccuauuuucagaugagaaauuauagaggcuuggagaagugugagguaauaauaccaagaaugagaguuacuuguucuccuaugucuuauaaucaaauaguauauauaguauuaacaucuacuuggggaugcaauaccuuuucacgugauggucacaaucuauguauuacacauugguuuuggcaugaaauuaaacugaccaucucaauaugccuuggaaccaaguguuugugugcugaauccuuuugaaauauagacaccugguguguuaguccauuuguguuccuauaaacgaauaccugagacuggguaauuuauaaagaaaggaaguuuauuuggcucacaguucugcaugcuauacaagcauagcaccagcaucugcuugccuucucgugaaggccucaggaaguguuuacuaauggcagaagggaagggggauccaaugugucagaaggagcaagagagaugccaggcucuuuuaaacaaccagcucucacgugugaacucacagagggauaacucacucauucccccuggagaacaccaagccauucaugaagggcccacccccauggcccaaacaccucccuaugcccagcuucaacauugguugucauauuucaacaugagauuuggagaggacaaaacauccaaaucguauuaccugcagguugacauuauaaauucauuuuguuaaacucaguggaaaugagaaucagguugaaacucgggguuuauuacugacuuauaaacccaggugugcuuugaaugcauuggaaagcaggagcaauuuaacauucugugauuuuuagagguuuggcagugaaacccuuugguauuuauuuaauaaauccugccuucacagucauggauucuuuuugaauacacccaauuucuccugcuucccaacucuuuuuucaagugacuuuguuaccagguaccguuguugcagaggagugauuugauuauucuuucucuguagaaauggugaugauguggggcaaaucuaccucaaacuguaaacuauacucacuuuuuccacagauggggucuuguuauguugccuaggcuagacuugaauuccuggacccgggugacccuccugccucagccucccaaguagcugggacuacaggcacaugccaccacacacccagcuauauucacauuaaaaaaaaaaaaucaucuguaauucuaagagcucccuguguggagccuuccaaguggcccaccugugugggaaagcugcccugcaauaugggcccaaaaauuuuccuugguuuucauguaucugagcaaguugcuuaaaggugccugguucuguguguuugagauuauuuauuccauuuuuacuaauaguuuagagaaccaugauugugcauacaugcaccuguuuguuuaguaaauauuuauugagcuccuaacauaugucaugcauuguuguaaguaguauugaaguuacagcauccaaaccaaauagacaaaaucucugcauucgugaagcuuuauuuaauggggaauauagaaaaaaguauaaacacauaaaucuuaaaaguauuuuggaaggugagggauacuauuuagaaaaagaaaacauguaaagaagaaaucccccuuaccauauuuggggaaugguaaaauuuuuaauaaggugguuaggguagaccucacugagaagaugacguuaagcaaaugguugcuggagguaaggguguaagcuauguggaugucuaggaagaacacugcagacagaaagcacugccagugucaaguuccuggaguguuugaggcuuuagcgaggaggucugagugcuaugugauauguuuacuaccuaccuauaagaguuuuauggauuuggagaaguuuucucugcaauaugaauauauagucucacaaaugaggauaaaguuuauagcaaauuaucauggauuugauuaugucauggcacuugaaggaaagagagggugggcugugaaacucccuuaaaaauaacccauuuuugaacucgacauaaauuuucaggguccuauaauuuucuuaucaggagugucucacacugauugcuagguguagaaaaauguauguugccugaaucugaaggcauggauuguaggccugguuauaccacaguuacuugugggacuuuaggaaacaugcuucaucugguccugcuucuguuucugcuaucuuacaaugaagauaauuuucccccuacuuuuuaaacuuauuugcagugaagacuagauaaaaaaggauaugacuaacacauuaaauucugaaguaccacauaaauaugacuuauuuuugcaaaauuuaagagcacagaauguugguuaucaaagaguguuuaaaaugaccuuucucuguuuuuuguaaguguuguuugagagcacagugaugaccacuuaauuccuuuccuggagcaagacauguuucuuguggguuugauuuguacauuaucacugaaaaacuucaucagugacaacaacaaaaaagcccaaaaggaaccuaaugaaaauaguagugaaguuuuacacauuacauaguuaccccccugccacacacacacacaaagaacgaaaaaaagaaaagaacuuggugaaauaugguacuuuauauuuuaaaaggccuaaaucuugcuuguggaagugggcuuuagaaaguuugcagcuuuugaguuauggagaggugguggaagauggauuaucuggaacuggauggaaaguuguucuaccaggaguggcucauaaugcacuuggcaaaccgaaguagcugugguggauguuugaggugugugcacaugugcauuuuguguaucccuacacagcuuaauucgacuggaugcaguuuucugaauucaccuguuucuugcaggugaaagugcacacaaacaugcaagauucacauugugcucaaaguguuccugcuaugucaagcacauugaaacaaauuuauguuuucaaaguaagcuuuauaacagagcugucuguacaggggaugauucaguccgauacagucagggaaccguacauagaauagaaugacuagaguauaaucugcaaaggauggaauggcagaaguagucagaagagguaugcaaugguuggaucaaaaagagcuuuguauccagcgucacagggccucaaauuguacuguaaucauaugucuuuuaccuguucucuggcauuuaaauauucuuguaaagagcuaagccauuacugauaaaaugucuguuguguacaguuguacaaauuaaauucagucacaaaacugaaagaacagcagugggacaucuauccuagugaaaguuagaauacacuuuuguggucuuuaauaacagaguugauuguuuaccuucuccuuugguuagaagacugguauggggauuguuuggaaugaagagguaggagagagaaauaauucaauucuguauucucccaucaucuuuauauuugaacugagaaauguguguuucuaucauucauucaaauuauuaaacaaaaacagagaucaaaauaauaagaacagaugauuaaagagagucccaucugccccauauccaaccuuucucucuucaaccucauuucuacucagauuagcagauggcaccaguuuugggccauggucucucauuuucugauuacaagggguuguucuuuugcccgccuccuuuaaaacaacaacagaaaaauugguaaugacugacuguaugcccauuggccggggcaccaauuccugaggacuagacagaagcuuggcauucaacccagccuucugccaggaugguucugccuggcagcaaaaagccugguugaauuaagcuugggcuuuuagauccuagaagucuugucuauugguggcuggaaaaauagcuaguacuagcagagccuaaaaauaucagagaaaaaaaagcagaggcucuuagaaguugcuuuuccuuuuuguuucuuucucagacagagucucauucuguuacccaggcuggagugcagaggugugaucucagcucacugcagccuugaccucuagggcuuaagugaucuuuccacuuuagucucucgaguaccugggacuacaggugugugccaccacgccuaucuaauuuuuguaguuuuaguagagauggggaaucaucauguuguccaggcuggucucgaacacgugagcucaagcgauucucccuccuuggccucccaaaaugcugggauuacaggugcgagacaccacacggccaaguuuuuuucugauaaagacuauaaagggaagguagggaaaggugauuauugccaauggugguugguauagugcugagugauacagaaugcaggauucaugaauucuaauuuugcaugugaccucucuguaaaggaaaaugacccucuaacuaaaugggaaaguaagguuucacagaugagauagaaguucaaggugaaagaacagucuauaagguaauaccugccugucugcagagaauggauucaaggcuccugaugcaauugaauuauagccucauugucauauuuuuuuuuuuuuuuuuuugagacugaguuucacucugccaccaggcuggaaugcaguggccugaucucuguucacugcaaccucugccuuccaggcugaagugauucuccugccucagccuccugaguagcugggauuacaagcacgcaccaccacgccuggcuaauuuuuguauuucaaguacagaugagguuucaccguauuggucaggcuggucucaaacuccugaccucaggugaucugccuaccuuggccucccaaagugcugagauuacaggcgugagccaccacacccggccuucauugucaucuuugaguuaaaugcauuuuggcuuuaauaaaaacaauaugaguaaauucugaaccuauaauuugagucccaauaguauuuccuaacaagugauauaaguaaacacugagaaaagaguauagugcuuacagaaugacagcaugaauucagcaauuccuguuuagcaagaggucugggccaauaacuuggggaugucauagacagaaugcauuuggcuuucagcaaaauuuuuggucugcucucccauaaucucuuugugaacaaguagaaaaauauaggcgggguggcauuaugauuaucaguauucauaauuaauuuuauaacuuuuuccaguggugauuaaauuuuauuucacucuagagaugacuuucuaagauuaucauaaauaaucuauccuuggcucuaucuuauccagauuuuugucuuagacuaggaugaagauacaauuuuaaaugguaccaaaacuucuugggucauaaauaugguagaugggaggaacaggacacauauagauuuuaacucuuuuggcaguggcgaaaauaagauuugcuaggacuaaaagugugauuauguuugaaaauccaacugugaaaauagagaauugauagagaugagacuuacgauuuuuagacgacacuuacagugagucagcagcauguaguuagcuggcaauaaagcuaaugguauuuucaaguaccuuauaaaauauguuuuauguaccggacuguacuuuguauuuggggaagaggggauagaaacauugaagguaagauuugcccagagucacagauacuguuaauguucacauucuucacauuuuauuuguacaucacucuuagucuuuaaaaucaaaauaccuaaauagcugugaaaauucaguggauuaaaagcuacuuugggaaagacaguaaaacuuuauucaaauagggauuuucauauaauguuaauuuuuugaaaaaucaacaauuuuaagaaaaaaauaggauauaugaaaaacuagauaguuaaguugaaguuugagcaucuuucaaagaguagggaaguuuacauauugcauauuauacauuuaaaaaucaguuccagacauauuuuuguucauucauauauaugaauauauuauauaugacuauauuauauauauucauauauauuauaugaauauauuauauaugaauauauuauauaugaauauauuauauaugaauauauuauauaugaauauauuauauaugaauauauaauauauuauauaugugaauauauauauuauauaugaauauauuauauaugaauauauauaacauaugaauauauaauauguaugaauauguuauauaugaauauauuauauaugugaauauauauaacauaugaauauauauaauauauaugaauauguuauauaugaauauguuauauaugaauauauauaauauauaugaauauguuauauaugaauauauauaauauauaugaauauguuauauauguauauauaauauauaugaauauguuauauauguauauauaauauauaugaauauguuauauauguauauauaauauauaugaauauguuauauaugaauguguuauauaugaguaucuauaauauauaugaauguguuauauaugaauauauauaauauauaugaauguguuauauaugaauauauauaauauauaugaauguguuauauaugaauauauauaauauauaugaauguguuauauaugaauauauauaauauauaugaauguguuauauaugaauauauauaauauaugaauguguuauauaugaauauauaauauaugaauguguuauauaugaauauauauauaauauaugaauguguuauauaugaauauauauauuauauaugaauguguuauauaugaauauauauauuauauaugaauguguuauauaugaauauauauauuauauaugaauguguuauauaugaauauauauauuauauaugaauguguuauauaugaauauauauauuauauaugaauguguuauaugugaauauauauauuauauaugaauguguuauaugugaauauauauaauauauaugaauguguuauaugugaauauauauaauauauaugaauguguuauaugugaauauauauaauaugaauguguuauaugugaauauauauuauauauaugaauguguuauaugugaauauauauuauauauaugaauguguuauaugugaauauauuauauauaugaauguguuauauaugaauauauuauaugugacuauauauuauauauauaauauauauaugaauauauauucauauauauauuauguaugaauauauauucauauauauauuauauauaugaauauauaugugaauauauaauauauuauauauauauauauauaaaaugccauaagccauagagauucagaacuaauaaaaggcaaguugcuugcucauuaaaagcuaauaaacuagaaggaacuacaaaaaguuuuaagguuaagggaugcaaaauugauuagcaaaggcagaucagaaagaguuucugacucaugcuucauuggugagaacagcaaggaagaacugggaaugagaaucauugaguuuuggccgacuuagaggcagaguguuuuaaaacugcuuuuuggggccgggugcaguaguucaugagcugggggaaaaaaaauuacuucauuuucccaccucaguuucaguuuccucaucuauaaaaugagauaacaacagcguggagucuacacaugaauuaaugacuuuauuuauuuauuuauuuauuuauuuauuuagagaccgaguuucgcucucguugcccaggcuggagugcaaugacauggucucgguucacugcaacuucugccucccggguuugaguaauucuccugccucagccucccaaguagcugggauuacaggcaccuaccaccaugccuggcuaauuuuuguauuuuuaguagagaugggauuucaccauguuggccaggcuggucucgaacuccugaccucgggugauucacucgccucagcuucccaaagugccaggauuagaggugcgagccaccgcgucugacuuugaaauauuuuuuuuuuaagauuacacagcuaaauggaauucucuaggaagcacauccagcugcugaaccugugauauuuuuuucuuauggaacguugauugaacagcuuccaugggugaccugguuuggauuuccguagggccuugcuuauaaugcugaauacacuguuaguuuuuacuuuugugucacaaaaguaaagguucauaguuagaucuaagccccuugggggacaggaacuguguucuauucauacuuugaauugcuagugucuggcauguaguagugauuaauauauuuuuuaaaaugaaugucaaguauuaugacaggcacugguacagaaagaucaagaagaaaugaccucuucccuugugagaggcucacuauugugauagaccaaccucugaacagaggaauuaccaucuagggggcuguuauaacaggcaugugcuguucgaguucaggggaaagaugcacuugcucaaagagggaaguuugggagguguacgggaaggaggaacccaccuggaucuuaaaggcugagcuggcugcugaagaagagaggggcacuugggccuggucaccagcugugcaaaaucaacaagggcaaggaaguggcugaugaagccugaaacagggagauucccaaaugugaucugugaccucaaaauugaaaauuuuaguuaguguaauuuuaguauauuuuaugugcauguuccaaaguuuuuugaaaauugguuuuauauguuuagcauauggggcaauucuaaauuaguauauuugauuaacguuguaugcuaguccuuugaaauucugcaguuggauuguguauauauuguguauaauguuaccucuuuuccgacuucaugaaccuaacauuuaaaguggaaacaaaugcacgcauguguuaguguuuagugcagcaagaaagcacggcccaccacuuccaagaagugagucguugcauagggugccccguccucagaacauugcucauuguucauuuuuuauuccucagcuccuuaguucuacucaaagucuaauauuaguuuaacuaccaaauggcagaaaccagaguacguuguacauuuuucuugaaggauacaacuggaaaaaauuuugcagaggcucaugugaugcuauuuuccuuccguggugacacuuagaauucguuucacauugccuuugagagaaacgaggaggggggagaagccuguauuugauaguuuuguauguuccucuaaagaaagagagugcuugaaaaaagaaaggcaggcuuucagauguugucugaacaaagcuacggaaaugugagacgagagcagcaucuggagauuuucaaacacuggaacaugggcugcacguuucuuuugcuguuggaggagugaaaagcuguuuccugucauuucccaucuugucacuuccagaaccaacaucuugcuacuucuugcaccagcugcugcugcuguuguuuuuuuuacccccuccacagacagaugguaaaagagcuuugauaauccucgcccaacuuccccaguucuaaagaaguuugcggugugguaccuuuauacaaugaucacaugcccugauaccuacuguagccuguuaauagaguugggaacagagcagaaggaugugcugcagacuuuuaaugucuauggcauucuuugucaugucucaugggaaaugcugugcacaagccccaucucuguggaugcuucgauuuagcuucugagguuauauuuagaaaagaggaaguuguggggaguaccuuugcuuccauaagaauuugagauuucugaucaagauuucucuguacauugaauccaggaugggaguugcucuugauauucuuguucguaucccuagguuuucgcaaagcagaauuaggcauauuggauauaccaucuuuucacagggcuguuuauccuuaauuacuuuuuuuacaccuauuucuuccaauauuuuucuugcauuaccuagugcaaacaggaacuuagaaguuaaugcagaaaaugccguaugcauaggaaagauauuugaugcagacaaccuugguuuuguuuuaaguuuuauuaccuuuauuauuacaaacuaaaaaugauaaccucaaugagggagcuuagccuuucugucccccccuaaaucaugguugcuuuccuaaguauaaaaguaacauacucauuguagaaaacuuugaaaguagaaaaucuauuacagaaaauacaaagucauccauaauuccuuaauaaccacucuuacauuugguauauuuccuuguagcuuuuuuuuagaguuaugugugccuguauuucucuuguauacuuauaaacuuacauuaauauuguggccauuuuccagaauggaucuggugguaguaguaguggugaugauaauggcauaaccuaaaauuuauugaacauuuauuaugugauagucacuaugguacgugcuuuacauauauuacacauuucauuucucacaucaguucuauaaaguaaggauuauuuauuuuuauuuuagacaugagaaaagugaggcugagaaacaucaaguaauuuucccaaggucacacagugcgcaauaggugaagcugggauuugaacccagauagucugucuucaaagcucaugcuguuugucauuugcucaucuauguuuaaaaggucugaauauuuuuuaaauuauugauacauauagccuaagauuuucuauuuauucagacuuuucagucaugagaguacuuacugcgcucucaccaucuucacauaucaucaaauauguuuuaccuuuauagguguuuggggugaaugauugcucaguuuuuacauuggccuuucuugauuacuagauugauugggcauuuuccauguguuauugaucauuuuuauuuaaucuauaaauuguuuauguucuguguggcugcuuuuguucaacaguuaauuuuuuuguauacaaaaucaucauguguuaaguauauuaacucuauguuguguuuguuuaaaacaugucuccuucuguuaacuugcuuccuuauauuugaagaaaauuguaugaauguuuuaaauauguacauauucauauuuuuucuuuauaauucucucccacaaaucaguuauuuagccuauguuuuccuuuauuuuaugguuuuuacuauuuauaacaauuuuuaaaaucaaaucugaaauuuauuuuaauauauagcaugcuaugagacuuugaauuuauuuuauugauggguaauacuuuuuguuuuuguuuugcuacuuccuuuaaaaaauauuaugcauuauauauuccacucuucugugguggcauucuuuauuauauauuuguuuauuuugucuaccagcgucucuucaagcaaucuuucugugucaguggccuguguauggguaugccuacagacauuuuauggauaguaaauuuguaaaaugugcaagaaguuuuuugucuuaaaagcacccagacucagcaucagaaggcccauauccaaaccucaguauaaccucaugauugacuugugacaugaccgcauguaggcuuaaaugcugucaggaaaauuaaaggaaguaaaacgugaauugagaaauuuggagauuucugaaaauuuugaaaauugagauuuugcuguuaauaucacagccguaucacuaaaauuuccacaauccuuugaauuugugaaaucuauauaaacaugauuuaaaguacuuaugauauuguccuuuuuuucauauuacccaaaguauggaauuuguggcaaauaaauaaccagguauauauggcccauauagauaugguuuuuauccugcacuucuuuugagauagcugggggcuuuacuagagagaagaaauaaaacaagauaacuuuggcaaguauagaugaaguuugagaggugucuuauuucauuuuguguugcuauaaaagaauaccugagaguggcucaugguuuuggaggcuggaaauuauaagaguauggugcuggcaucuggugggggcuuuuuugcugcuucauuccaugggagaagguggaaaagcaagagagcaugagagcaagaggaagcagaacucacuuuaauaacaacccacucucgcaauaaccaacccaacuccagugugaaugacguuaauucacucaugaaggcagugaccccacgaucuaaucaccuccuguuuggcccuacuucccaauaguguugcauuggggauucaguuuccaacacacaaacuuuggggacaugguuaaaccauaguaagagggaaguuuaacauuuguuuaacguugguaucgaaaggaacuauuuacguugcagccccgaaaagacuacaaauaauauugguuaaaauagaagugggcuguauucuuuugccauugcagcaagccuuaguagugaccuagauucaaaauguuacuuugauuuuauuuaaagcacugaaguauugcauuuuuccucgugguuuuaugcaccuacuaagugcagcuaccaaugacaaagaucuucuauaauaaaaaugauguuuccuuauuuuugggucuuuuuucaaucugaaaaauguuucuuuaaucggauucucauaauaacccuaugcagccauauaaucuaugguauuauuaucuccacuuuguauaucaggaaaaugagacucaugcuaaaauacuugcccaaggucauaugacuugaaauggugggacuagccucuggcuuagcucuagugagaccuaaaauaauacucuuuugguuuggugaguuccauccuuucuuuuuuuaaagaauuugcauaucuaccuuauccacuuuuaaaauguuuaaagaauuuauuucaggugccuguccagagugacacaugucaaaauguuuuuuaaacagauaaguacuauucaaauacaaggcuuuaucuuucuuacugccugggguaagauaccugucuucccugucccaaguuauaugaugcuuauuuaaaaaguuaccugugagccuugcuuauuaaaguaugccucagcuaugucaugaggauauuuuuuuuuaauuaauuuuuuuugagacagggucucauucuguugcccaaacuggagugcaguaguguggucacagcucacugcagcccugaccuccugggcucaagugauccucccaccucagccucccaaguggcuaguacuacagucgugugccaccacauccagauaacuuucuauuuuugguagagacuggggucucacucuuuuguccaaguugaucucaaacuccuggucuuaagcaauccuccugcuucggccucccaaagugcugggauugucagcauaaggcacuacgccuggcugaggacauuuuuaaagguguauacuucaccauauucucuuuuccucuacaugaaguuuagcaauguucaagaugguggccacuccaucccccuugaugacugagugacugugaugagccgagcaccugcugacucacaacagccauagagacauaagagugugaacaagaaauaagccuuuguuauuuuuagccauggagauuuugcaguugauacuacagcauuauguagccuauccugaaugagguaggaucauaauaauauguuuguuaugcaucacacaaguuuuuggguuguuucaaucuaaagaucugaaauuauacccaaacuagauauucuccaguaucaccaaacaggaucuauccauucuacagugcucaccagauugcuucugucauacuucaccuggacaucuguggauucuggauauuagaaauuggaaggaaaagcuuguaaggggaucucagugcccagggucaaagcuucauuguugggcagccaaggaagagauuugcuugacuuacuugaguaauuuuugacacauacuugauuuggucaucaggcauaaaggauggccagauuacuaguaacuuauuggagauacacuuuuaaaauaggaguuaaggcuacuuauguguugaucugaaauuaagaaaagggcaagauuucucccuguggccugauuuucaaccaugacuaaauaaagccugaggggagccacugaggauggaaaaggucacucagucuuuuuugcugaugaaaaaaucgaguugucuagcucuggauugacauccagcacugacaugcuuuaggaaacaaaucuuuugauggcaaaacucucacuagccucaccucuccucuccuuuccucucuccucuccucuccucuccucuccucuccucuccucuccucuccucucccucauuuuucccuuuucuacucucccacuucuacccucauuuacuuauuucucaauuuagcucaucagggcuuuuuguuacaaaaaaaugguguguaaguuacuuagcuguaacuuggaaacuguuuucccaugaauagaugacagaauuacuacaugccaaauuaucccagaauagguggcuuaaccaauuguauaauuaaguuacuuuaauaauuaccaagaggguccugagccccauggaaaccuucacugcuuggaggauguauaaauggaaggugggcagcaugagucuuuuggacugguggccggaacaagcaguucuuagcuuuuuuuaaaaucaucuuucauauuucagagcaauucuuugcauaauccagauugcuucugucauccuucacuugaucaucuguggauucugagcuucaggguggccaugcgaccuuucagcccuugcuguggaagguggagcuccuaccaucucugccuguguuggggcuagacgaaguuucccucugacugccucaaucuuuucacugucauguguccugggagccuccuacacaguggagaggagggaguaugagucucaggaaccauugaguuuuuucacugugaggugggacaggccuaaauuucuccccuuaggccugccauucacugagggugugcagucaucaugcuaaguucucuuucuugcuccauuuucaucuucacucaccccuuacuuucugcaaagcguugaugguguuggguucugacaguuaccaguuggggcauuugugaucuguggagaaggcagagauaguuaaugaguaggcacauuugcuaaccuccuuggacaggaauaaguucaaagggguggacaagcaggauuggcuggaggaggcaggucuccacauuguucucucuugccccugggcccuggcguccaggguaauuuuugucugccuuugugguucauauuuuuagcucucuguaagaggcccccuugguaaauaugucaguucauuguuaaaccuagacaugaguuugacaucuauuuugugaaacaaaccauguaaaaauaugggucuuuaugguguucaguguuccaaagucaggaauuuuuuaguuucuuuugucuucacuucuuguuauucucucacuugcuuuacuucuuccagccuuuuccuuuuccaccucaucuccugcuucuuauuuccucaucucuuuuuccuuaccauuuuuuccucuuccauuucucccuugaucuuuucauuauauucaauucauuucauucauugaaugguguuagaagaggcuuugucuuugcagucagaaggcucaggugaagcuucauauuucaaagcacacuaugcugacacuaagaaaacaucuugcccgggcacuucaguugaagaaaacuauaugaugugaucaguaugugaugauggcuuuucagaucagauagcuggguuguauuuauaauuuauuucucuuaucagugaaaaagauaaaugauaauguaguaacaggauuuucuagaguuuggguuguagagaaauaagugcucaugaauaggaccgcauaugugugcauguauguguguuuuggggguauggagaaagaggaggaaaagaauauuuuauagagaaaauuuccauaugguuaccuuuuauaggaucuagcacauuucaaugaaaacacacuuugcuggaagaauucaauucucuguaaaguuuggugcagcaaggggugaaaauguggggacacagcuggaaacuuauuugugcugcaggcuugcagcuguaccuaccugugaugcgaugaauacuauuugauuguuaaugucuuucuguuacugaaagcuugcuuccuuuccuaaagcugaugguaacaauuuacugacugucuaaaccuugaggacuaacuugggcugggaaaaauaaauccugucuccugaaauuuacaucuuauuaaaacucaaagcagccagcagagaugagaaggaucuccagccugggagcuggaggugggaauucugcucaagucaagaucgcuuuuagcuuuccuacauucuccugugaagaaccauuggauugaaugaugguggcaaaacuggugugacuucauucaguuuaucucuaucccauuuccccucuccacauuugacugucagucuacuaaugagacccaguuaugguccuuggaaggggaaauggaagguggacauagcugugggggaugaaauggaggaguuuuuaauaucuuagcuugcaaauuuacugucugccauagcugaagaccaucuaguacccucuuuaacuuuugccacuuuggaguuuccucucuaccguuacuuauucagcagguuuuuguuuuuguuuuuugagacggagucucucucugucaccaggcuggagugcaguggcgcgaacucggcucacugcaaccuccgccucccggguucaagcgauuccccugccucagccucccaaguagcugggacuacaggcacguaucaccacgcccggcuaauguuuuguauuuuaguaaugauggauuuucaccauguuggccaggauggucucgaucuccugaccucgugauccacccaccucggccucccaaagugcugggauuacaggcgugagccaccgcgcccggccucaucaguuauuuuuuaauuggcuguguuuucuuucccuguaaacacacuuguucagaaggaaauauaauaucacuauaaugagcagaaggcaaguaucacaugccauaagaaaguaacuauaaaaaugaguguaauacaauuaaaauauuaugaggcucuaguuagauacuguucccuauggaagauuccgaacuugaggccugcacucacuucugucucaaguagaaagggagcuuaaagaggcauacacuuuacaucuaaggaagcacuaagugaggcauuguucuuaacuaauuagacagauuaaaaaggaaaggccaaaccaugccauugucuuagcucuuguuuucuuugauuuugaagauggaaaaagagauaacacuuaaaaauaaagcuugccuacucagacauaauuaagguauugucauucuuuuuugucuguccugguucucauugcaauauuuuguucacugcucaaugaguauuuauuaaauuaaugaagauuucaauguuaaugucuaguuucauuugcccuuccucuaaaggcuguauucuuuuuuugcucuugcucucugugauuuuuugguaguucucuuuuaugugcuuacucacacaugagugcuuucucuaacacacugguccuguguuuugcuucuuugugugcauucacguagacaugcacaccucuucaaaugacacaugccuguaggcaggauaacagguugaguugucuuguuaauuaggcauucuuuuucuggggcugguacaggauguuugagaauacugucccccagaauacucaucugguacacuggaacugccauggacuaguuuuccagggcuuauacauacaaguggcuuccaaaaaagcauuuucagacaagcugcuuguuaugugaauguguuuuucuuuuuagucaaccacaauauaugcagcacaaagcuguugccauuuucuuggaaugagaaaauuaugagcauaauguuucuuuuacaucucugaaaaacgcuaauauccagcuguuguggugguugcaguugucaguugcuuuuuguaacccgacaacacugucucaaggaugaagagaggaaauuuggugacuagucuuuccugcucacucuccugaaaguccuauuaauuugcuuuuuuaaaaacaacagccaaguaucucaguuggagaaggcaaagucuuauugguccuuauauucugugcuuggauuaguauccacaguaaaccacacacauuuuguuccuugcuuaacgugagccagguguuauacuuuaaagacauaaucucacuuaguccucacaaaaacucagugaauacauacuaucauuagcaccauuuuuacagaugccaaaacaaaaaauugagguuaaauaauugcacaaaaucuggcagccauuaaaugacugagcuggaauuuaaaagcagaugugucuaaauucugagcuuacauuuguaaccacuguauauaauguaguauaauaacuuccccaauaauugacagaguacuuuacucagaggcuuuacaaggacaauaaaagaauuaguugagauaacacaacccauguugugagaagauugucuuuuugauucacaguucaugcaaagaaauaauauacagcagacugugaauaauacacaaacgaaaugaaauuucauucuugaaugaauuaucuguaucuccuuuuaagaaaaauugguaaagcauuuaacuggucauggcucagggaaaugucucuauucuguuucugucugaauuuuauucuuuaaauauucacuuuuuuuuuuuuuuuagcauccaguggccaccuaguuguuguuguuguuguuguuguuuuuucccccugugcuuaugcuugugccuugcagggcugcauuucugcuugcugugaauucucaguucacagcugcaguuguucaaacuuuaaauuuaaaauucagucuauguuucuaguaauugcugcugggaaacugaaacaggacuacuugguuucagagugaggcuguugcuucauauuggaagaaagguuucauuagcuuggaaagcaaaucucgggauaucaagaaaacaacaaaggcuguaaauuaaugcagaacucacccuaaaaagggucaaugaugaaagaagggagaaagaagagacaggaguuucaguggucaagggaauauuuucuucaugauaacagugaccugaauuggacagaaagcagaagggagugugucauuuuaagaaggucaguuugacagaccgcaauauuccagguuucuauuauuauauauaauugacauuguuagcuaagggauggauuuucacuauuuccuucuguaguaccucagucccuuuuaaguaauuuuuuuuuuccugacuucaccaccaggaucgugugaugguuuaggaggagauuugggggauagagaggugauucugaagauaaacccacuuuggcugccucuguggucuaaagccaguuuggagagcgcacuacagaaacagggaauucacaggggaugagucagagagagggacuggagcaguuugucuuguuucacuugcucuuaucacacaguucacuccuuucugcucauacauuguguaguccaccauggagagaaagggagaagguugcacaaugccuugacagauuuuuuuuuuuuuuuuugaaacggagucuuacucuguuuccugggcuggagugcaguagcucgaucucagcuuacugcaaccuccaccuccccagcucaagcaguucuccugucucagccucccuaguagcugggauuacaggcaugugccaccacgccuggcuaauuuuuguauuuuuaguagagacaggguuucaccauguuggccaggcuggucucgaacuccugaccucaagugauccaccugccuuggccuuccaaggugcugggauuacaggcgugagccacugugccuggccuccuugacagacuuuuuaaugauuguagggauagagaaugguauacaaguaaauauacuacuacuguuuuugaacuggcacagugaugaagacuaagccaguaaugcuaugaaacuucaaguauuaaauuucuaaauauuuggcauuaggcaccaaucuaaguuacaguuuaaugcuuuucaucacuuguaacauuaccaaaucagaggaaugaaauaauauuuauccaaauaaaagauguguuaacuucgccaaagugaaugcacauuuuucuuugauuuccccauaauacaucuuucuuuuucggggaagacagagguugggaaugggagggagggagauuauugugaaucucagauuauauugaucagaaccaaguuuagcuuguucugguauguaaauuagagauuuguaguuaagugaaauugauuuugcugagacuaaauuaaucacaguccuuaaucacuguaaccuuuaaacauugcagucuuggccacagcugcagggcagagcagugcuccuccgagcuuuaugcugucauuucaugaaaggcugaaugcccgugacuugugcaaacaagaauucccauguacaggcuucagagcugguucccugcccugcaggggaucagcuggagcaucucccacagggccaagaggcugcuguggccucuucaacccaagaagauguucugcucagacacaaauauuuucagucuuccuccagacaucaucaaacuagccaucacugcgaaaugcucacaggaaaguaguuguuagaauuaaaaucagaaacaaccaguuauauugugauaguuuuuucuuuaauuguauauguuuauguauauuuauaaauauauuuauauuuauagauuucuuuuauauauuuauauuauauuuauauauauauguuuuacugaucacauuuugaacuauuuggaagggugauguugacaauuuugaaagauagugaggcauggagagguuaauugacucuucagaacuaauccugagagccuagaaggagggucaagaauagaaacuggguuugguuugguuuugauggucauuucaguucuuugguuuccguuucaugaagcaucccagaaucaaaccaucauuaagccugccauagaaaugcaaauuacuuucccacuuuaguuggcauauuugaaaauaguuuugugugauuuuuuuuagccccuuuuguagucuauucaugaaguuuauacauguaggacucuuuuuuuuuuaacgccuuuaacuaccaauccuccauuuuuccuuuaacuuuucuauauucgcugacuuuuauguucaguugaaggaauucauacacauucaguauaauaaagugcagcuggaucaaucauuuaaaaaaaucagugaacaucuguauuucacaaaaucacacuuuaucaggacugaaggguauaccaggaucuaacgaucaacuucaaccacucaguuuuguaaaugaagaaaccaagaguaguuaggugaaauagcuuucucaagguaauuuacuauagccauucugaggcugcacccuagcuaauuugauuccuguuuaacacucuucucuaugacauugacuguuuucucuguaaaagagaucccgguuauacaacuauuucacaauccgauuccuuauaaaaaagcaaguagugcucaauaaauuugacuuaaguuguacuuuauaagcuaauguaaaaggagauuuaccauaaucugccguggugaguugcuuauaguaggagaaagaauaucuuaaaacuuacuuuacaaaaaauaacagaugcuggugagguugcugagaaaaaggaaugcuuauacaauguugguaggaauguaaauuaauucaaccauugugaaagacaguaugucaauuuuucaaagaccuaaaaacagaaauaacagucaacucagcaguuccauuacuggguauauacccaaaggaauauaaauuguucuaucauaaagauacaugucuguguauguucauugcaguacuacucacaguaucaaaggcauggaaucaaccuaaaugcccaucaaugguagacuggauaaauaaaaugucauacauauauaccauggaauacucugcagccacaaaaaagaaugaggucauguccuuugcaggaacauggauaggagcuguaggcuauuauccuuagccaauuaaugcaggaacagaaaaccaaauacugcauguucccacuuuuaaguggaaacuaaaugaugagaacacaugguuacauagaggggaacaauacacacuggggccuuuuggaggguggaaggugggaggaugaagagguucuggaaaaauaacuaauggguacuaggcuuaauaccugggugaugaaauaaucuauacaacaaacccccaugacacaaguuuaccuauguaagagaccuccacauagaccccugaacuuaaaagcuaaauuaaaaaacaaaaacaaaaaaccaaaauacuuacuuuaaaaacaauuucugugguuguccuucucuuuuuuauuguauauugguuuguguagguccauuuaauuuguuuacuuuucguaguaggaauacaauugucagugacaucuaguagauugaacauaggcucugaagcugaagccucagguccaucuuuggcccugacacuagcccuguuaccuuugucauuuuacuuaacagcucucugcccuaaaccauaacaccuaccccauagaguuguugagacaguuaaauaaguuaaugaaaagucaggcucuuagaauagugcugggcauauaugaauguucauuggauauuaucuaauauuguggucauuaucaguugauuucuucuuaauuuaaaaaauuuucguaugugauuucaugugguuuuagggaaugauaaauguaauuuagacuuuuuauuccauugggucuguuacagcuuuuuucucaaugaaacugauuugguuaccucaguucuaaugcuggcuuugccucugcuuuuugaucacauuuagaauacagcacucaguucuggguauguccaagauagauaggggagaaagguaaaagagaauauuaaugcaacuugauugugcagcuguucuuuccacaaauauuuauugaaugacugcuguuugucacauguugaugcauagggacacggugcacaccugagauuccauuccuguagacaggacauuugccugcuuccuggcacuuauaccucuccccaaauugacaccaagcauuauuuuagaaaggcauuuaguagaaugcaauaucagcaaaugaaaauuguagaguuguaucuugaagaaacuugaccccaccccccacucucaccugcauccccacauagagccaggacaucucuuaagacccaccuuccuggguuugcucauaguuggcacuuaaaacauucuauugcaguuaccuauuuuugauggacucugcaagagagagacugucaguucacaagggcacugauguuugguucuucauuuuauuuacaguaugcuauacaaagggauagguuuuuguuguuuugaauauaucuugaguacuccuuuggaaggauagaguccaaaggcaucuuaccugagccagaauucauaggggugguucccuaccguuucuucuuuccuguacacacucaccacccucaaauuuccgcucaguagaggaugcuuuaggaccuuuuuucuucuuucuuucuuucuuccuuuucuuuuuuuccuuuuucuuuuugagguagggccucacucuguugcccauguaguggcacaaucauagcucacugcagccuugaucucccaggcucaagugauucucccaccuuagccucccaaguagcuaggauuacuggcuaauuuuuucaguuuuauuuuuggcagagacaaggucuugccauucugccuaggcuagucuugaacuccugagcucaagugauucucccaccuugaucucccaaaguguugggauuauaggcaugagccaccaugcccagccuagaaacuuuucuuuucuuuucuuuucuuuuuuuuugagauagaguuuugagcccaggcuggagugcaauggcgugaucucagcucaccgcaaccuccgccuccuggauucaagcgauucuccugccucagccucccgaguagcugggauuacaggcaugcgccaccacaccuggcuaauuuuguauuuuuaguagagacgggguuucuguauguuggucaggcuggucucgaacuccugaccucaggugauccgcccgccuuggccucccaaagugcugggauuacaggcgugagccaccaugccuggucagaaccuuuucuugacuccacuuaagcucuuccauuugaacuuucuuuuaauuaucuggauuuuaacuuuaucagaauuagucugccgguaauccuguuuuuagcuagaagguuaggcuuugagaagugugaagcuggaugggagggaaggaggccagcaaagggaaagggacuagcuggguugaagaggccccaucugcuauuccagauggggcauccugaauucaucacuccuaaaacuuugcucuauguguuuucuaggcugcagcauccagacagcagcacacccuucacauguucacuguaguaaaauaacguggaaaggguagagguaucuggcagauaagagagguuauuucguaaggcugugaugcccagcacauaggucuguacaucaccuccuuccugcugcuccucaaucugccuuucuuuggucacugcccccugcuaguauuuaauucuguugaauuuguucaaauugacuuguuuaagaagguuacccaaaucugcauacagccuucagcauugcuuugaaucuccuuuaggaaaggaaauguagauucaaauacacagguuuaucucucugaccuuuagcuaauuauuagauugagauaaauguguguaagugacaaauugccuuuaaugacauuuaaucugcauccugacauuaaugucugguuuagugucccaguuccauagaggcaaagagcauggacuuuugucuuaauuugaccuauuuaaaagguguuuguggugagagucaaccugugauuaacuuaauagcauguuuuacaugaaaagcaaucaaauauugauguaagaagaggcuacuagaugacauauuuuccagucugucauaauuggcaaaaacaucagagaaaggagagaguuguuaguaacuaaaacugaaugaaagccucauagcugccccaaauccaauacuggugagcacauugauaguaucugaagaaaggaggcucuucuuguuguuuauugucacagaggccauucacugaacuuugguggguguuagacuaauagauuuuuuuuuuuuuuugagacagagucuugcucuguugcccaagcuggagugcuguggugcgaucuugccucacugcaaccugucccucuuggguucaagccauucuccugccuuagcccccaaguagcugggauuaacaggugcacaccaccaugccaggcuaauuuuuguauuuuuaguagagaaaggguuuuaccauguuggccaggcuggucucaaacuccugguuucaagcagucugcccccauuggccuuccagagugcagggauuacagacaugagccacugcaccuggccuaaacuaauagauuuucacaccuuuuugauucacuaaaggacaucauaggggcuuauuaaauaagugagcuauuuuuagggagugagaggucugggaaguggcauucuugguggauuuguugugugcuagucaggugcuaggugcuuugcuuuuugcauucucauuuaacuccuaacuacaaaaacauuuguacaggcaacccucuaacucgugauaccaucuuuuugaauuaaauuaauuuuuuuuuuuaaauaaggucuugcuuucucgcccaggccggagugcaguggcaugaucacagcucacuguaaccucaaacuucuggggucaggcagucuucuugcuuuagucucuagaauagcuggaacuacaggcacacgccaccauaccuggcuaaauuuuuuguagagacggggucuugcuguguugccuaggcuugucucaaacuccuggccucaagugaucuuucugccucagccucccaaaguguuggaauuacaugugugagccacugugcccagccucuaauuggugacuucucaauuaacuuugacauaaguguguguuuuauaagaucauuaucaccgauaauaaaugcagcuuaauuucuaaucaauuggccaaacagggaaauuugaguugagugagaucauuaacaacuuucuuuagcgcuuuaagagcuaagugauagcuuuuccaguucuuuaaacauuacaaacugccguuccuggugaaugucauuuucucaaauucauuuucagagacuggaaugggucugugcuacucuauauaauuuugugcugagcggaugguauauugaugggaggaaguaggagaguagugauggaagggcacaggcauuggagucugucucccaggugacucuguaaguuuuucaacuuuccuaugccuugauuuccucaucuguaaagugaggauaaugaguuaaugaauguaaagcacuuagaagggugccuguaguaaggacuuacaacuguuuuauuuauuguuuuuggaguuugguuggaggauucaaagcaacauucauuaaacuaaacacucacuaaauucacuaaaaugguuuccaagugaaauaauaaauauagcaaaggagucucuccucugcuauggaguagcugaguugagugcaucuggguguccauucugcugcaaauccaggccaagcaaauacaguuucugugcaauuaaaugguuguugacuggcaaagaaaaaaaauguaaaccauaguuuuuccuucuacccuguaaucuguggugucuuuaugcauuaccuuaagagcaacuucagugacuugauuagagggagguuuauaaacugcuuggaggcaaagcaccgaacucuugacuggcacacagcagguccacaaggaaagccacuucccaggguaagaaagcacacacaaauuauucagggacaaauguaaugguuacaagggugucauagaaacagaucagaauacuuuuauacuacugccuggcuucuuguucccccauuccccauuauaauucuggauucuuaaguuuauuuuaaugacaaacauuuuugccugucuuuaaguaaaagaacagaaaagaaguuacuuaaaaugcaguccuaauuauguccuaaugcaauuuugaugcagcaauaugcuuucaaacaagcagguacuggguggcagauugacacaaguauuuagugaauugagaacaacauguguuacaugaaauuauaaucaaauuacaaacaauggaauggauuguugcuuuuaaaauccucugaauguugguuaacuucauagggcagugcugugacuauuuccauuaauuacggaguaguuauacugggacuugaccaagcucuuuuaauaguuccaucugauuuauguuuuucucuucucuauuuuucuuuucugucucuuuauuucuuuuugucacuauuuuuguugaccuguauguguguuuuuuucucuuucuguaucaguucaaguucuccagagaaauaaaaccaauaggaggaguguguguguauaaaucuaaagagauuuauuuuaaggaauuggcuuacuugauuguggggggcuggcgagucugaaaucuguagggcaagcaguagguuggaaauuuggcaagaguuauugcagucuugaggcaaaaucucuucuuugugauaccuuauuuuugcucugaaggccuucaguugaauggauaagacccacccacauuauagaggauaaccuccuuuacuugaaguuaacugauuguagaaguuaaccacaucuagaaaauaccuuuauggaaacaucuaaauucauguuugauuaauuaacuggcugccugcuauugccuugccaaguugaugcauaaaauuaaucauaacauugucucauuccuuuuucccucacuguguguuucugucucucaucucacaugcacacaaaugagguuaugggacagcauuaguguuaaugaauuucagguaacaggauaaugaucauuauagcaucuaccaguaauuggauaccuauuaugugcugagucuuguauuugaugcuuuguauuucugaucucauguaauccucuugacaauuccauggauuggacagaauuaauuuuauuuuaugggugaggaaacugaggcuuaaagagcugcuagcuuuuauuuagccauguagagcucaagguucaaacucuaaucugccuuuccugcagauauacucucuucuguaucugcuuguuucucuaauauucccccaucacugucaucacuggcuauuuuucaguguuucacuuggaugaaaaacauaucuacauacuuuuuuuguuuccuuuuuuuuuuuuuuuuuuaaagacaaggucucgcucugucaccaaggcuggaacgcaguggcuggaucuuggcucacugcaaccucugccucccagguucaagugauucuccugccucagccucucaaguagcugggauuacaggcaugcacuaccaugccuggcuaaguuuguuuuguauuuuuaguagggacagaguuucacuuuguuggacaggcuggucuugaacuccugaucucuggugaucagcccgccuuggccucccaaagugcugggauuacaggcgugagcugccaugccuggccugcauacuuuuuuuuacuaagcuuuuuuuuuuuuuuuuuuaauaggaugcugaaggagcugaggcagugcugaaggauguuaaaagcacacacaguggagagcuuauuguuguuccaaggccuaauuggagaucuagguuggcauuuccuacagcuuucaaaguguacaacuaaaagacuauccuaagaagaugagauaguuucugaacuaggcacgaaaagcuguaaggagugucaccucccagugcccucuggccuauuuuucucacugauggauugcuuuguuaucugcugccagaccccuuaaugugcuggcucagccuucacagggauuagucacagaagaugggcgcugcagcugcaggucuggcuccagaggcuuugggugguaccuacuacuacuuacuuagcccuuagccagauauucccuagaagggaaaacgcuccuuaguuucacugaggaucuggccucaugagcagacacuaguucuaauaauacucuuuaccuucuuuguagcucccagccauugucuucuaccuucccuugccuagcuuuagucacugccagcagcuauuucuaggcuguuggcacuuugaaguggaauugggcagacagaggugagagcaggcugugaguucccucucuggagguuggcuccuuacagcacacaugggaggcagugcugaaggauguuaaaaagcacacacagaggaagagcuuacuuguuguuccaaggccuaauuggagaucuagguuggcauuuccuauagcuuggcauggaacgauuugaauguuuguggauggugcuugccucauaccuugccaacucaaauuuugggcagaucagcuucugugaguuuugucucgacaaguugggaaaguuuccuaacuuuagaugacugugugaaucuuugaggagcuugauaguuagcaggugagggcugcuauuuugaaggaaauagacauuaauauauucuucuuuaauauaucugaauggguauacauaugugcuccuuuguuucuuguaaaugggcaguacaggagggagaaacugaaggagaggacuuggucaggagauaaacccccacagaugccaagauguuggcuuguugaagcuuauucgugguuaguuuuacugugauacuaugugcagaugguuccuaaguuauaaugguuugacuuaugauuuuuuaguuuuaugauaguuuuggugcaaaaucauuuuuuuuuuuacguuuaguacaguauccaauaaagugugacauauucaguacuuuauuauaaaauaggcuuuauguuagauuauuuugcccaucuguaggcuaauguaaguguucugagcccauuuaagguaugcucggcuaaggucagguguaucagaugcuuuuuugacuuuugauauuuucaacuaacaaugggcuuauugggauauaaccccaugauaagucuaggagcaucuguauuugucugugaauuacuuagggacucuuuugaugucuucguuuuggaaacucucuguuguugguuuuuguuauuuuagccuugucggguuuuccucauacuggucuaacugcuaguaucuuuuauuggccccucuuucuuggauauccuuuacauguuuauauuuguuaguguuucuuccuugacuugucucacuucucguguuuccuuggguuugccuccauuacuaagucuucauccagccccuaugucauugguucucaaagugugguccccagaccagcagcagcagcaucaccugggaacuugcuggaaaugccugaacuaaacuuaagacacuauauaaaacaggaaaaggcauuuuacauuuugauacacauugucaaaaacauuguacugguuucaugguaugcauuauaaggcauaaaguagaucaagccuauguuccuaaugcauacauuucuauugaccucagagagugaacuaucauauaauagaaauaggauuaucauuaguuuaaugaaugagaaagacucuucauguuuguucuuuaccuaaucuaugcaguuuaaaccuagaucgaccucagggaaauaugggaaauuguguucucuucuggcuuguuuaaguacaaggaacucagacccacucuaauuugcuuuaaguguuuuuuuuuguuuguuuugaacaguaagaaacuauuuaggguggagaacuuuauuucaguaaggccucaugugaaguggaauuaagacagucauaauguccuuuuguggcuugaucuugaugaggugauaggcuucugcacacauucaucaacuguucauauucuuucccgcucuguccgccccccccacccucaucuugcuugcacacacgugcauacuuuugcaugcucucugacucucucucuucuucccucuccuuccugccaacacagcuguauucaucuucauuucuuuuucaccuggcuuccucccucucugcucugugucuuuucaggucccucccaaguuuaguucacgcauuacucauucuaugaaccucuuaaacuucgugcauucuaucuuuuaucccuauuacuaugucacccuggcaguuucauaaugcagauuucugaguaggagucccagugggacagaaccuggccacuugauggcagguccaguguccuggucgauucccuuagaaagugcugugcagaggacuguuacuuuuucuuauagaucauucuauguuuuaaguauuaaaugaagccucagcuccagcauagcguuucugacaggcugacucacuucacauuuaaugauuguauccagcaucuugucucuacucuccagcaaugcagcuccuucuucuggugucgucacuucuauggacauauccuguggauguucccauccaccugagcccaaaaccucugugcuuguuuguuccuccuccuccuuagcccucacaucucuucaauauuuuucucucucuuuacuauuacuuaaugcuacugccauauugcuucuugacuagauuuuaauaaucuucugauuucaaucuguuacuuugucucagucagaauaaccuacuuccccuuucacaugaaauacuuaucuacccugaggaauaucccucaaggcucucuauugccugcgaauugagaauagacuccucugcugaagauucacggucuucagcaguaugcccccuacuugguucuuuuacuccaaacacuguacucuagcuacauaggacuacugaguaauacuccucaaaggcucccucucuuggguacuuguaaagugcccuuuagcuguguagcagagaauaggacaggagugcacacucuggggcuagacugacgggcuggaaucucagcccagcuugaaaacuuugagcauuuguuauuuuaucuuucugugccucauuuuucucaacuguaaaauggaaacagugauaguaucugccuuguggguuguuuuaagaguuaaauauggagcacucagagcagugccagacacacagcaaauccucaggucuuuccagggauacuuuuuuuuuuuuuuuuuuuuaauauucuccauuagacgugauguuucugucucugcgaugugguaauuuuuucuguuuuuuauuuuuaaggguaccuaucacagucugcuucccccuuuucagauuauuuguggauuucagauguucaccuguuuuucuuugagcuccuugaguauggagaugguauuuuauugaaacuuauauuaugacauacggagcucaauaaacauuuguugaauuggauuauauccaaaagaugcuucugcuaaaauacuguaguaacuuccaucugucccaugaauguucguguucugagacaauaauguaauucuuaaaacuagguuuuaaaccuuaaaagugaaagaaagugaauacuuugcgguugucauauagauguacugcuacucaaguauaguaaguauauuggugaaauauuuagaaaaaaacaacuaguugugaaucugaaucagagaucagcaaacuuuuugcuacagagggaaaaauauuaaauauguucaacuuugcuggucauauuaucuguguuggaucuguuuaccacagcaaucguaauaugaaaaauauguaaaugguugaguuccaguaaaacuuuauuuacaaaaacagguggacuauaauuuaccaaccucuggccugugucauuacugugcaaaccacacaucauuuuagaagcuguuuguugcaaaagcuccaggugcugccacauccaaagauacacaccugcaugucuucucauuagguauaaggaaaccuuuccagaaaaucucagcagauuacucacaaguucaguggcccaaaguuguaucacauucucacacuucaaaccaguuacugaugauggaaugagacuaccaugauuggcccaaauacaccaggaaucacagguguuguuguggauaaggccucccuaucugcaucacgugaccauguugaugagggcauuuccuugugaagugaaaaccauugaauuguacaaugaaugugauacagcaugggcugccacaguccaguugucaccuacucuucuguuguucuucugaacaucaucauaaugucacauuugacaggugugagguuucuuuguuaaagcucagacuuauuuuaaauuaauauucuuaucacaugaauagacccgugguaaugauguaaugaccuuggaggggcaggccaguuuuccgcugugaagcauaaaguuucccauaugacauccuugggcuacucauuuugguauucucagauaugcaaaacagagaaaacaacaggcuucccacuucagaauucaccauauacccuucuccuucuugaaagggagaaaccaauuagacaaggacuagccuucucuuauacuuaauaaaggcaggugaguugagccucuuaguauuugucauacacuauggauuaaaccaguuuauggcccaugucauuguacccaaaacucugguguauaauaguaaaacguucauaguuuucaaauuagacuuagagcuucuuggucucacuuuagaauauuuugacagcccuuuggcuuucacagaaagaccuagucccucaggggucuugaacugagcuaauuauccuagucauauccuguagaacgggaucccacuauggcuugucugagacugcauuguugucuuggguuguaugggaccaugagacaaacggcuguacuguuuuuccacuuggcuuuucugugguguaaaacuaucuuuuaggagccacaaaaugcuauucuuuuacuuguugaaagauuuuaagaaagaaagaaagggagggagggaggacuguaagggaaaagagaccauuaacaugacauguuuccugucgcucuccaaucugagucuaaccccagaugacuguauucccauuguuuuauugugagggcauuugugagggccuuccccuugguugugucuugguuuacagucuauagaauuggauuagacaauguuaauucaauuaaugacuguacugaaaguuugucuuagugugcagugaaaacaggagagcagccucuaauaaucuauggauuuaaugacugcaacuuugaagaguguuaagcuaaagugaaguucagaauggcuuguuaacuggguuuauuagcuguugaccuucccuuucagcauaauaguggcagucagaccgaagagagcacuaacguccugauuagcauuuaucuaaagauaggcugcugccuguuacacaguaaauuaguucaaucagccauaaagagcuugagaaacauuuucugcuuuauaaaaagaauuagauguuagaacaguucaucuggcauagcucagugaagauggauugagccccugaacgugcucauuugaggaaggcgcuuugaggauauugaguaauugaacagauuuuccuacaagauugaucaggggcccuagauuuccugcacaauugagugaugcucuaauuuuugccuucuaauaagagcaguacaucugcuccuguuucuguguauucaucgagugaaacugaaaaucaauuuauuuagcaccuacuaugcacucuaugucccuuacgaaauaaaagcaauaggaucuacugaucacagucuauuugauugaagagaugaaaacuacacuaaaacuugaaauucaccacuuccacuaccacugcuucuuuucuucugaaaagaagaaacuguagaaugaaagcugcuacuuuugguauauuucuugagaucaucuuaugaagugaagcacauuuucccacagaaacaguauaguagucgggguuaacguuucugacuaaagucuuggcaccaacuaaguucuucucauagugggucauaaaagcaaaaaggcaaaaauuauaaaccuuucuaaaucauuuaaaaacuuaaauuaugauccagguccuuaaaaaaaggacauaaauguacuguacaauugaauuuuaugaggugccccaauguacuauaaaguauacauagagcauauaaaauucuaacuccgcuguaucauaaauuugaccucacugaaaugaauaggcucacuguauggcaagcauuaaugaaacguuuaauuaacauucccuucacuugcauuuuuagaauuuuaaagggcuuccuggggacuauuucaauggcugagguuuuugcaaaacaaaagaacaaaaccuucucauaaaaacugaucucuuuugcucaauaacuccuccaauagagacauuuaauuuaauuagacugaugaaccugaauuugaauuuuauacccaaaccuaugaucauccuuaaaaaaaauaaaacaaaaaauaugguauugagacaguuaagcacuugaugacuucaugaaggcuuccuguggacccuuuaagccacuguguauacacauaucauuuauguccuugcaguuuucccaagcuaaaagccacagggauaugaguacuuugugagggacaguggugcaguguuagaauggaugagcuguagggcugugggcuucagacccuuucauagcucccuguaagguauccuccuccucuaaccuucccuguaauuaugcuauguugguuuacuuuauugccuggucacuccaggagaaguccccagggagucauacuugaaugaacagauagaggcagaguaaaaaaaaaaaaagacauuaugcuaagugaaagaaaagucauucacaaaugacugcauauggugugacuauauuuguauuaaauauccagaauaggcaaaucuguagagauggaaaguuggaaaguagauuaguaguugucuaggggugaaacaugagagggauagggaguaacugcugauagguacagaguuucuuucuggggugguaaaaauauaaaauuagauugugguaauaguugcacaacuaucugaauauaauaaaaaccauugaguuguguauuuuaaaugguugaguuguauguaugcaaauuacaucuuaauaaagcuauuauuuuuuuaaaaagguauuaaguuuccucaaguuaaaugaaaugaccaaaaggggaaagguuuuaagcagugagcacuccuuguaauguauguguauagugaguaugcauauguuuguaaaaguauaaugugugugauccaacuaugagccauauggugcuagucaugauguguauacaugaauucuagaaaaagaggaagaaccuuuaagugagagaaugccaugcauugggaagcaguguggggcaagaucuguguggcucuaggguggcaaauuuaguuugagcuugugaauccuugcagagauuggcaaauaucagauacuccuuggcagagaaagcaguagagucaaaauugagaagauuuaaggaagcagagacuaauaaggagagaauguugaaaccuguuauuuguaguuagaaguguagauguauacaaaauagaaaaaaacaaaaagaaucuucugcauuauaucaggaggaacuuauugguguuuuaggaccauuaagauggagaacacagcucacucauaugugggagcuacaaaguugagcucauagaaguagaauauaacugugguuauucaaaguugggagacguggaggggcggggaggauagggagaauugguaagggauacaaaauugcagcuagauaggaggaauaaguucuguuggucuguagcauauuagggugaacaccguuaaucuuuuauuguauauuuuuuaaaagcuagaagagaggauuuugaauauucccagcauaaggaaaugauaaauguuagaggugauggguaugcuaauuauccugauuugaucauuauacauuauguacauguaucagaauaucaugccauagcccauaaauaugguugcuacaugucaacuaaaaagaaaauuuuuaaaagauggaagacaaaaguaaaagauaaauguagauauucuuuuaacuguuuggugcuuaccugguguccucugaaaaaucagagucgugggagaugaauaacauuuccagagagcacuagaugaggaguuagaaaagcugguuuaucauuccuacucugucucuucccauguuacauuaaauaaguaacucugugaugcuuucuuccucccuugaguuguccuucuuacccugagaggauggcacaaggaucaaaugagcugacauauaccuauugcauugcaccuacuagaauguaacaaauguuugucagacugagggaggaaggaaggaaggaaggaaggaguagagugauaucacaugcaaggaauuggauuuacugacuuauuccucuggccaagugugucaacauuaugauugcaauaagaacuuuugcauuaauacuauuuauacuuauggguauuauugcugcauuugguaauucuacgguaaauuuggaggugcuucuaguaucacugucuuguucuaccaauagucuuguauuuauugacaguuuggugguuguuacaaaugacaggauugcaaauagaaaucaagcuccaaagauggauggauuagcuuccuuguuaugaccguguuaagguuaccacucagaacaaacauugguaguugagcacgucuugagugugagugucauacucagaacaauucuaauuuuuuaaaaauuacuuuuuuagaggcugucucacucuaucaucaggcuggagugcaguggcauaauuacagcucaguacagccuggaauuuuugggcccaagcgauccucucaccuuagcuuuccauguagcugggacuauagucacgugccauuacgccuggcucaauucuacuuuugaugaaguuuuugacauauugacauuggguuugacaugucauuccaauauaauaugauacuguagcauucaacaauucucuucccagaggagacuauagaaaacagaacauuugcauuucccauuuuguacuuuaugccacccacuaaagaauuccaaagucaugcagaaugccuuugaugaugugagcugcaugugaauuucuuauugcuugacuuuuaaauccccuuuguuaucuagguccauuacuuauaagcugugucacauuaggcaagugacaugccucucuaaguuuccacuuccuaaucuggaaaggggggaaauaaugagauuggcccuguggcaucaggauuaggcaaaguacuuggcauaacaccagucucacagaaugcaguuuuucuugagcuguugggucagugaugccugaaagaggaggaguggagguucugaggcauugcuguuuuuaucacguuugauuuguuuucuuuuugucuagacuugccauauuauagcuucaucaggauuuuaaagacgauugugaauuauauuuucaaaaguuguauggacucuuguacuuuaguauaagcagcacaaaauuaggcuuaagaaacuuagauuuuaauguuagcuaugagaccuuaggucacuggugcguguuccucucaugaaauaagagaauggaaccagcugguucuuuauucuucccgguuccaagaugauguggucauagagucuucauugcauaauuucuuguuccuccucauuucuucuuaccacacucuugucuuuaaucucugacaccuuucuacccaucuccuucaaugcuccuucuauucauccuuucauacguccuaaaaauuguuaugucaacuaugaggcaagcaguauauuaggagcuagauauguaauguugaaaaauauagacaugguuccugcaguaacagaauuuacaguuuaauggaagaaguacagauaacacaaguaauacuuacaaaaugugguaagugcuaugaaagagcaggacagacugcuuugaaugggggaaggggggaucccuggcaguuuaaaugacuuuucucaaagcaggcugccaaaagguagcggcgccggccagaggugguuugagaggcaaagcagcaccacagacagggguccaaggcaagaaaacgcugagcugcucucaggugcuggaaagccaguguggcuugaagcgugcuaagagugagacuggaaaugcaugccaaguuugaggccgaguucaggauuuuguauuccaugauaaguguaaugggaaaucuaugagaacuuuuaaguaacaacaauaugggaaucauacuugacuuggcuagaacaauuaaaagcugaucucuuuuagaaaguacaguuuuguuuuacauuaaucuuaacacagaauaguguauuacaccuaaagugaauacucuuuuaggcuggguaggggcugucccgugguuuaauauuguuucuaucauaggagaagccuugguuuccuaguuucccaccuuguuucuccucucucugccccacugggauucuagcugcuucuucacugcauuugcucaccucuucuucuccacaguccuuugguccuugaaaugcuguaagagcagaaauaacagcuauccagagaccuucagauagcagaugugccuugggccugugggucuguggcucuggagggcuaggaauuacagaagaguuaaaagagaaggccucugccagcaggaauuccgaagacaccaaaacugaugucacuggcugugcaggcacugagcuaauucuuuugccaaucaguuaaaucaccuaccaagaguguucauuguaaguaacacuuucuugccauuugguggggauguagagggacaaaggaugcaaaaggcaacagguucuuuccuuguaaaacuguaaucuaauucuguaaacaagccauguaccuuuggaaggucauuuugaacucaguccugguaaauauuugacagguguuuuaaaaaaauaauuauauuuauacaaucuauaauggaauauuaugcagcuuuucacaaggaggaacuccugccaucugccacaacgugggugagccuggaggacauuaugcuaaguaaaauaagucagacaugaaaaaaaaauugcaugauuucacauauguagaaucuaaaaaauaggauaaaaauacagagagagaauaaaacagugguuacuaggauuggguuuggaggaaggaaauguggagauuugagucaauggauacaaaguagcagauauauaggaugaagaagucugaauaucuguacaacaugaggacuauagugaaucacaauguacuguauucaggauuuuugcugagugaguagguuauagcugcucuugccacaggcaggaaaaguaaguaacugugagaucauggauauguucacuuguuuuccuauaguaaccuuuuacuauauauauguaccugauaacaacaucauguuguacaccuuaaauauccacaauaaaauguauuaauaauuuuauuuaaaaauauuuuaaaauguggacaauuaaaaauuuuuuauauaauuuuuugguaguuauaaugcucuguucuuuuacaaauugugagcuggauacucacuacucuucuuuuagcccaaauugagaacaucuggaggcauuuuuaugugaugacuaaaaauacgguaauugaguuagacuguaugggucuguacccugcucugccacuuccuggacaugucucaguuuucucaucuguguaaugaugauaguagcguccacuucuuguuguuauuauaggauuaaauaauauauuacauguaaaauguugaguauaaaaccuggcagauauuaagcaccuaauaaauguuagguauuaaaaauauauaaaguaugacuucugcuuucgagaacuuaaccuauaaauauccuuugauaccccgccccccgcccuuuccaccuugauuucauuuacacaagagccaagugaaagaguagugagagaugaaacuaggaaagcaggaaugaggcaguggguagagaaggauauguccugaccaauggcauugacagagugguuuugacaggugaguguggaaauggacugcggugagggagaguggagguaguguugagaacccguaggcucuggcagcaauguggagcuuacuugcagcauagccucccuucaacuuggaaaccaagcauuucaaaguaccugggaacuuucuucaucacauccuuccagcauuuacauuguuuacaaaugaaggagggaauagaguauauuuuauuuucugauaacuuucuggguuuccaaagagagaacuguaaaacuuugauaaacacauccauaagaguugcugcccacacgguuucaaaacuggaucucuugagcugggcauaacuggucauaggcagagaaacguugacuggugauuuauaccuuauacccucucauuaaacacucuuaccuaacuacgcaaauuaggcuuuuaaaaauagauuauuuuuauuguuuaaauguagaagaauauaucucagaguuauaggaaauuugcauggguacauguuuauaauaaaaauccugccaccauuuaucauaaauggccuugguuuaggaguuuacacaguagagagcucaaaccacuggcuuugcuaugaaauagacccaauucaagcuccaucucuuaaaaagccaugugaguuugggaaaguggcaucacuuuccugagcccuggguuucuaauuauuauuauuauuauuuuugaaacggagucucacccugucgcgcuggagugcgaucucagcucacgguaaccucugccucccggguucaaacaauucuccugucucagccucccagguaacugggacuacaggugcccaccaucaugcccggcuaguuuuuguauuuuuaguagagacggaguuucacuguguuggucaggcuggucucgagcuuguggccucaggugauccaccugccuuggccucccaaaaugcugggauuacaggugugagucaccacaccuggccagguuucuuauuuuucaagaggaguuauaagacccacaaaccuuacaauuauuguaaaaauugguaauaauauauaugaaaaguccccagcacagugacuccugccugguaagcaacccacgaauuuuaccuauugucagcauuguuuagaucaccuuuauuuaacuuaguuauaauggggcuuaauuacaaaggggauccauauucuaaaagcaaauacugaaacaaauuuuuacaauucacuaccgguucuucagauuaaggucuucugaucaugguucaguuuggguuuuuguuguuguuguuguuguuuuuucuccccaagaugcagucuugcucuguugcccaggcucaagugcaguggcgcgaucuuggcucacugcaaccucugcccccuggguuccagcaguucuccugccucagccucccuaguagcugggauuacaggcgccugacuaauuuuuguauuuuuaguagagaugggguuuugccauguuggccaggcuggucuccaacuccugaccucaggugaucccugccuuggccuuccaaauugcugggauuacaggugugaaucauugcacccggccugagcuacugcgcuugggccaugguucuuaauaguaaaauuauuuaacgagauuuuucccaguucuuacugguaaaaauguccugugguuuaaaaacguucaaauuaauuuguuguauauuucacaugacagugauacgagggauaauugauuauuugagguauugauuugaccuaauucagcauaauaauuuacugauuuucauucagugcaugcuaaguacuaaauccagucuugcuggguacagagaaacauacauucauucaaacaucaucucuucucucaaggagcucacaguagaaccuauuuaaauuuaggcaguggggagcaugaggcugcagagaaacaaacauccaacuuuaugaaaagacaaaauuauggagacagaaaaaaugaucagugguugcuaggaguuggggagagggaggaauggauaggcagaguggagaggauuuuuagggcagugacucuguauuacaguggguacauauaauuuuacguacgaccaaacccauagaauguacagcaccaagaguaaacccuaauguaaacuaugaaaguugugauaaugaugugucagucuagacucauccauuguaacuauguaccaguccuguggggaaugcugauagggagauuguccauguguagggacaggaaguacaugggaacucuguacuuucugcccaguuuuucuaugaaccuaaaacugcucugaaaaaaguauuaauuuuaaaaaguggucuuacugcuuuggagcacaaguaaaucauacuaagaagacgauguuuaaauuaauauacuacagauacaguuugcuuuacugaaaugcaguauaugauguucaaaacauauaucuuuaaguaauagccauuuuacaaaggaauugcauguuuuuacagggagguuucacuggccuauuagggcauguuggcuuggugguacagcuaagaucuaauuccuucugccaccaaggagcuuugugaccgugggaccacccaggaaccucucuggcuguauucucugcagaaagacuuaggacaacaacauggcaugcuguguggacaugauuugcuuuguugggcaaacuggugggauuggugggguggauacucucuaauggagguuaaagguccugaagccacugcagguuacccuggggcgccauuucugugcucuggauuaauucuuugcucagcuguuaaaugucugugucuggaaguggagauacacaagauggguugguccccauggcuuuuuauaccucaacaauuauuucauccaguagauaucuauacuaacuugauuguaaacauuaaguuuacaugggauuucuuuaacacauccauuuucuaagaaagugauccauguguaaguauagagugaccaaugagaaaauaggguaauucccacacacccuuccaaacuuuacaaggagugaaauaauauaaauuagcuuccucuagugauaaaacugcaagaauuuucaggcaaaagaaaaacaguuuaguagcaccaucuacaggcuacugaagaggaaaacuuccuauguggcuuuuaaaugcaaggaguuuguggaaaagggaauacaaaaacuucauacucucuuaaaaaaauauuauccauaaaauauacuaauuuuaguauuuuuguucuucuuuaccaugcauucaauucauuuuacaauaugucucuaguuauccugaacuaguggaauauagacuugauuauguguuuucauuaggaucccuguuucauccccaugcuuacaaauuucucucccucucuguacuaaugauaagaaugaacugugaaauucacaugaauuccaguaguuucauugauaguaauucacaguauaagacuugaagcacaaagccugccagcaagggauguuucaucuuagcuuaucuguauacucaaaggauuuauugcaucauuuacuuccauuaugggaggaaaaauaaaagcagacacucuuggguauguauguauauguguuugccuuuuuuaaaacaaugaaguugauuuauuaccuucuggguuuaaaaucuuaucugagccuuuucugccccuaagauucugugauucuauaaucagaaauagcuuggggaauggauaauuauuuuguaaaggaaucuagaaaacuugucuuugaauaugauaacagugaagguaauauuuucauucccagauaccccaguuuuauuaucuuuuuuugcuaguuuuauuuuguuuucuuauaaacuauuaucaauuuugguaaccuggaaaauuuuauuggauucuccaaauaacuggauuauaaaguauuuauggaauuaucagaguuguaauuuucuguuagaaauggcuuauuaaaauuaacuuaauggccuccuuguaaguuguugguggaguugcuguuucauucauucauucauuucauuguguguguuauuggaaaguggguaagaguuacuggaaugccuagauaauaaguuuucaguaaagcauuacacauugcaagaagccaaucugcacccccacccaccccccaaaaaaaaauugagcauaaauuauaauuauuagaacaaucuuacuugaacagcauuauuucuuggaggaaaagaggaauagaggagauacauauugaaauaguuugcuaaacuaaagaggaauucaaaggauaaaaaaauugauaaugagauuuucaagguuccuguugaaacagaugaggcagagccuaucaaaacuggagccaggagugauaaugguuuuuaaguuuguguagcuuaauugcugaugguuuagguugauggaaaacuuaguaauacuguuuccaauuuuuuccucauuauuuuaaauguguaaaaaaauugugcauuaaauacuggaaccuuucucugaaaaaaaguaaagcaaguucuaguaugaauagagguuuaaaguaaggcacugccucgucguccuauagcuaauauuuuucccuguuuuucuugcaccagauggcacuguuuaguucuauuucacaaucuuauucuggaacuuucuucgggagaaucuguuuuagcccagggucaccagugacaccucucuauucugcaugaagucuuuaugaaugcuuguaaaaggucacugacucagacaugaagcuguuuauuugaggucuugugguucuuuccaguugcacauuugcugugaggugagccuaauaaaccagcugauagaaaccuacaugcuucuuauagaguucagccaguauuuugcuuggagacauauugcaacaauaugauuucagcauucucacggcccagucuaauuaucugacacauuuuggaauuauuuuauauguaaaaguagagcuauaagcagaagggcacacucacuaaaaaaaaaaaaaaaaccuugcagagcuuaaaauguuucaugacagucuguugaacuauagauuuaucaaauuaacuugcaaaaauaaaauuuaaagaaccuuuccugacuauucccaaggcugacuuggaaggaaauuaucaaugaccucugaugucauuaugcauaaauggggcagguccauagccaagcucgccucuuugcugcacauaacaauaaaacauccuuuuggaagauagaauuagcuuuauuuaauaaaaaugccagggucauauuguaagacuuaucucugugagcuuugcccuccccuccccuccucucccuugaauaauacagaaacguuggacauaauuaugacacagauuucauaaggcugcuucuccuuuuacaauuauauuuuaugaagaacagacaauguuuucuuugcaaauuuugaagcuccuucauuuucugaaugcauuggauuugguacuaaaugcucucucccguuugcauuuccuucucucccucccuccuugccuccuucccucccuuccuuccuuccuuccuuccuuccuuccuuccuuccuuccuuccuuccuuccuuccuuuuuuuuuuuuuuuuauuuuuggucaguguuucacucuuguugcccaggcuggagugcaauggcgcaaucuuggcuuaccacaaccuccaccuccugaguucaagcaauucuccugccucagccucccgaguagcugggauuacagacaugcgccaccacgugcgucuaauuuuguauuuucaguagagacaggguuucucuauguuggucaggcugcucucggacucccgaucucaggugauccgcccaucucagccucccaaagugcugggauuacaggcgugagccacugggcccggccuccccuuugcauuucacugcucuauguauucucuugguggugauaugaguugaagggugggaguagggguggagagcccucucuagacuggagcuaugagugcauaagugaaaucucauuauuuccaucuuuaaaagaaggaguauuggcgugugguguuuuuagccagcccucccuccuuuccucucaugcccauccacaggccauugacuggaaggcacaacagcucccagcacagccccuccuccugccgcuggagagguguugggacuggugugcugguuuccaggugcagguccuccaggcugagccacagcucucuguagaaguaagcaugagacaggcugcuuccauaaaucaagcccugaauuuuauuacaguguuuauguaaccucaguuuaugugcuauaauucuuugcuguguugccuagaguaauucccaaagaggauguuuguucuuuuucccuggaaauuuucuagcauaggccuuuuguuuugacauucuccuuccccccacccucugccuuuuuugggauggccuggggauggguaucacuaacagucaauugcuuuuuacugaguaaauaauauaauccagcguguguuagauucuguuuguacuagauguuauuccuacucuuaagugggagaaaaaaucucaaauuaauuuuuacauuuucaagauuauagggugguaggguuaauguguacuuaauugaugaguaaaugaaauauaagugaaaacaaaugccuuugcuauccaugggagacccguuccuuuucauagccuccgccaccaucacagaucucauguugauagagucagauugaccgcugagagagaaaauacagacuggaaauuuugggugauuuagacuuuuaacugaagaaaaugucaggguaagaugaccagauucaacuguauuccauguagacaacuaugucaagagagaaauguuuucugguuggaaaugaagacaauuugacuuaaccggagcauguuuuuaaagaaacccauagcauguuuuuuuuuuuuuuaacuuagcucuuuuuuucgaaccuuauguuuggcccuacagagaaauuaggugaugagacuggaccuacugaaaguguuaccggaccuauucugcuuggacacgcuagacuugugaacugcugacugguauauuucaguuaguacaguuaauguuuuaucaucacugccauuagaagguauuacauagaugugaucuuuuucauuguaguuuaaagaagauaguuaauccuggggcaaaguuuaugaaggaagugugugaacagagcaaucuuuuuagauuuacuuuaacuacaaaacuggauauuuguuuuaaagcugugcuguuuaggauuguagacacuagccacaugcaacuguugcgcauuugaaauaugaccaguucuaauugaggugugcuguaagucuagaauacacacuugauuuuggagcuugaguaugaaagcaagaauuuauagguccucuuuaaucauuuaaauuaauuacacauuguaauaauuauauuuuagauacauuggguuacauaaacuguaucaucaaaauuaauuuuauaccuauuuuuaccuugcuuuuacuuuuuaaaaugugacuccuagaaaaaccuuaaaauugcaaaugugacucacauuugcaacucacauuauuuuauuauauuauauuuuauuuuauuuuauuuauuuucaagauggagucuugcucugucacccaggcuagagugcaguggugcaaucucggcucacugcaaccucugccucccagguucaaacaguucuccugccccagccucccgaguagcugggauuacaggcgcaugccaccaugcucagcuaauuuucuaccuuuuuuuuuuuuuuuuuuuuuuaaguagagauaggguuucaccauguuugccaggcugguaucaaacuccugaccucaugauccgccugccucggccucccaaagagcuggauuacaggcaugagccacugcgccuggccuugcaacucacauuauuauuggccagugcuguuuuaaaguucuguuguccaaugaagggaauaacagaugaguacacucaguaaaaccuucaaaguuauacguuuaaaggaauauucuaugcuuccugauaaaauauuaauaaccaaaauuagcaacaauauauagaugaaauuauugccucaagauuuaugaggaaauauugacuggaauacugucuauuaaaauauuccucuuuacuugucaagucuaccucucaguaucuuaaaggaaaguucucaucuaauaggguguagagguuaagagcaugaacucuagguuggaaucccagcuugguuguuuacugucuguauaauaggaaguaaguuauuuagcuucccugugcaucagcuucccuacauguaaaauggauacaccuuaauaucuucuucauauuaaauaaaacaaaguguauaaagcacaugcuaggauucgcacauacuacauaaguacuauguaagugcuagcuauuauagugauagauguuauuguucuuaucuuguuaaaauacguacaacuuuuugauagauuauucgaaccuggacucuauucucaagcaaauggaagcuguuggcuuucaguaauuagucugaauuuuguugaaacucagaaacaacuggcaguaauuaaaaaugggaaaguaaaugagcaaagaagggagcucauuuauuggaacauaugaugagaacauuccauaaaguaaaacuuguaguaauugucgauuaaaccaauuuucuaccugauauaaauucaguaguacuauauuucuuuuuaucauguuucuuugucaccagguauauuggucugcaauuuugagucuuuggaaguuauuuuuguguuuauuaugcucugauaaagagaugaugaccucuuaaucuuguguccaagagugguggugcuauauuguccuagaauuguuugaauuuuagagcaauguguaugugugcauuuaaacccaaguuuaauaagucauuccauuguguucuuaauagggcuagauaaccugagaaccaguugguuuuuuauugugccgaauaaaauuuguaaucugguuuagacucuguacagcacuguagguauaacaagucuuuuaugcaguucgggggugaucugugauauaaguuuguuaugguggaauugauguuugugaugggaugucuagaugaaauuaccccauggaauauaaucuuuuuugaguagaggaugguauuuaagaaauaugucuucaaaacucuuauacaggccaguacugccucuuuagauguaaaaguuuauaauuuuaauugcaggaccuucuuuuacuuggcuuuuaaaaguuauucacuuagucaaaauuuauugaacaccuauaguauuccaggcagaaugcuaacccucacggagcucacaggggauacacacuaagggauauauauuguaguacagcacagugcuguauuaaauagcaauugcagagacacuuucccuauuuuuuauguuuuuacugccacuuugccuuuauaacaugaggugauuuuagcauagagcugaaccaaauguugggauauuaaaaagcugaagcaaaguucauaaagagcaugacuugggcuuggacuuugcauuuuacaaggugugcagugugagcuuacagaggcuuugacagcagggagugaguggagcguugggcuuuguuauuuggagagaucacucuuaguauugguauugggacauagaugguauaauaacaaggagagacuguaagaaacuuugcaguaucuaaucaagauauggggagaaacuuacacuaaagagugugugcuaggugaagaagagguaggauuuuaaggaaauucuccaaguuuuaagugcagaagugugggaggaaaaaauguaagaugaugaugguucuggcuugauuuuccagaguagaguagaguagccuucaagauuugauacaacgcuugacauaggacaucuuaaaggggagcucuuagacuucaaggagaauaugguaaauauuaaguacacuauugggagcaugggucugcuguaugggagagugucuuggcuagaggcuuacuugagguagucaugaucuaaaggugauagcugaaggcaugggagguagaugguauaaaauaauaagccucuccacugugcuucugggggauuuccaaacaccuuagcaugccuuacaaggcccuuuaggguuuuuuucuguacuuuguuagucuccuuuacaaaaguuaaugcuguucucucucaugcaacaugcauuccucgugucuccagcuguuugcuguucuccucacuucccgggcucuucuguaucuccauuacaucacacaugcuguuuccuguguuugcaaggcauggcuccucuuuguccccuuaacaagcucuggauuuuucuuuaacacccaguuccugaaccuccauggcccagcuaauagcuccauccuugaacccauaagauuuuguacauauuucuauuaguacuuauaucucacuuagaguaauuaucacuugccuuucacucauucuguauagacugugaacuccuaaaggaaagagaaguaacuuuagucauuuuuacauccccaaccucaaaauggcacuuggcaaauagaugcucagagaauguguuuugauugaauuaauucauuugugugugagcugcaggugucacauuaguggcuuuuggauguguccagaaguauaccuauuauacguugaaauuuugcaaaucaucauauuugcaaagguuaaauguaaacaggagaaaggugagaccugagguccuugucaaaacuguuuuucuuacuguaauaucaauguguauuguuuguggaaaaguugauugauaaauaaaagaagaaaauuuaaaauauccauagucugaccacccagugauaucuuggcuuaaauuguacguacccaaaauagcaaaaauaggaucuaucuguguauauuguccuugacuuuuuuaaaaaacuuacuaucugugcaucauuaaauauuaguaaguagucauguuuugugggguuuucuuuuaguuugagaugaggcuggucuugaacuccuggguucaagcaguguuccugucucagccuccagguagcugggacuauagguacacaccaccaccauccucaguagucauuuuugagugggcuaguuaaauagacgacacucccaucaugcauuauuuaaccaguuccuugcuguuggacuuauaggcugacuuauaggcuguuucaaauuuuuaauuuauauagucacauuucaaugaacaauccaguaguguugucauauucauuuuuauuuagaauacuucggugaaaggaaguauauaucuuacuuuuuccaacucuauuagcaaaucaucucuuggacauuuuuuuuuuuggagacagaaucucacucuugcccaggcuggagugcaguggcaugaucucggcucacugcaaccuccacuucccagguucaagugauucuccugccucagcuuccuaaguagcugagauuacagguaccugccaccacgccuggcuaauuuuuguguuuuuaguagggacagaguuucacuauguuggucaggcuggucucaaacuccugaccugaagugauccucuugccuuggccucccaaagugcugggauuacaggcgcccagccagucucuuggaaaagucuuaacaauuuuuauuaucaccaacugaauucuucucaucauauuuuuagguuuuaaauugucuggaacuuaaaaauauaugaagauaggccagccacagugguucauaucuguaaucccagcacuuugagaggcugaggcaggaggaucacuugaagccaggagguugagacuagccugggcagcauagcaagacccugugucuacaaaacccaacaaacguguguguuuguguguguguauguguguaaaacauauauaugaagauaugauauaugaagauacauuacgaagauaauucaaauauauauaugaagauacauaggaagauaauuuagcuugcugcaacagaaauuccaaauuuagggcuaaagaaauuaucaaacugaagccuuuuuguaaauuuaaguaguuuuguugauuuuagaaguagacuuuucuggccaggcgcgguggcucaugccucuaaucucagcacuuuggaaggcugaggcaggcagaucaccuaaggucaggaguucaagaccauccuggccaacauggugaaaccaugucucuacuaaaaauacaaaaauuagccaggagugguggugcgcaccuguagucccagcuacucaggaggcugaggcaggagaaucgcuugaauccaugagguggagguugcagugagccgagaucgagccacugcaauccagccuggcgacagagcaagacucugucucaaaaaaaaaaaaaaaaaaaaaaaauuagacuuuuccaaauaauggucaagguuuuuaaguaugagaaaggaguuucauggucuuggggaucaggguccucuuggcauggaguggguggugacgugaaggugagcccuccaguuccagcucuguuauuagccuucuugugccucuuguguggcuguuucccagcuccaacccaaaguuuuauuaggauaaagucuuggauuuaggcauauggauauuaaauaucaguagcugaauuugggguuugaaauaauugcugcuuacuucuaacuuccccaucccacuccagauucuuuuugccaucccuaucuacauuaaauagcuaauugaagccaggcgcgguggcucaugccuguaauuccagcacuuuaggaggccaagacgaauggaucaccugaggccaggaguuugagaccagccuggccaauauggcgaaaccccaccucuacuaaaaauacaaaaauuggcugggugugguggugugcuccuguagucccagcuacuugggaggcugagacaggagaaucacuugaaccugggaggcagaggucgcagugagcugagaucaugcuacugcacuccagccugggcgacagagcgagacucugucuccaucaaucaaucaaucaauuauuauucauaaaaugagaagaagcuccuccgccuuccccugccaaggggaugagcaaauguguguuacagcucacuuugaagagcuguccaggcuuuugagugaaaugcagaauuuuuaccucuugcuuaguaauuugcucauuuuucagacuacuuugcacagauuuaaugauuaaggaaacaggauaggcaaaggugccagcguuugauauuaucuuaaggccuaaacugaccuuacggugaugaaaugaacuuuuugagugcguuugucuccugaauaaaucuguaacaguuuucuuaacugacucccucugucucucagcaucagaaagaaaugagagaacauuaagccacagaaagcaaauaauggucaaaauaaagauacucuuuugcuggcaaacuuaaaaauucacuuguggggcugagcguguuggcucacaccuguaaucccugcaguuugggaggccgaggcagguggaucaccugaguucaggaguuccagaccaaccuggccaacaugaugaaaccccuucucuacuaaaaauaccaaaaaauuacccaggcgugguggugggcaccuguaaucccagcuacucaggaggcugaggcaggagaaucacuugaacccggaaggugaagguugcagugagcugagaucacaccacugcacuucauccugggcaacaagaacaaaacuccaucuaaaaaaaacagauucacuuguggaaucuaauagcuguaggcaagggauauuuauugaaaccaagauuuaagugugguuuaugauguuuauggaguaguuuaauacuacuuuucuucaaaaugaguuuuuaauuuaggaaaaagaauucagauauguucccagaguagagaugacugaccaucaugggagugguuaggguuugggguuuguguggguaagauucuguuuacccacuacagccauuguguggauuuaaaagcuuuccuggauggaauuuauggagugaaauuugaaacuaguguccuguguacuacaauauauggucacaacaagcaaucaauuuagaaagaaauggaacggagaagauacagguuaaaugaugaguauugugcagugcagcaagacauagagugaucuuaacaguaaugugguaugucaccaucugaguucuguuauaaagcuccuaggcaaugacuaaauccuagaaaucauugccuacuuucaguggcagacagaguauaauccauucaugauaggggguuccagguacauugauauagaagacuggccaagggggaaugacagggguuacagcuaacauuuccuagguaauugguucuaauuuccaggcuccaagcaagauacuguaucucuuuuacccuguuuaauccuccccagcacccagugagguacagaugguauuguauccauuuuagaauugagaugacugaagcuuagagagauuuucccagucauauauauucacgguuccuggauacagcuguacagguuguucacugcaugaagguggcuggcugagguagcaggcaaaggauuuguuugcucagcagaggcagcauuuucuaauuugcacuaaaaccuguguaggccaacuguagcccuacucauaaaguugguuaaugccugaacugggaguagaggugaggcaguguugaaguggauagguagauucugagaagcuuauacuauaccuacugaaguccuaaucuguaggcugucugcaaacugguuuguuuugcuaccauccuaucccagcauuuccucaaagaucccacagugacuucuuuauuguggaucugauggucuuuggcagcuauacagacauucuuagagucacagccaggauuaaagucuaggaugcuugucuucaagucaugcaugcuuucuguaugagauaauauacaaaaagauggucaagaaaagugauuuugagauaaauaguggccuagaauagcuagacugagauuguucaagcacagcuauuaauuugcuuacuugcucagcacucaggcugugcuauuugcuucaagggauauaaagauugcugcuuucuagaaaauuauaacucaauuagggaaaccaaaucaauauauauuucauaauauaaaauaagagaaauuacagauaacaauaaauaauagccaaaauaccuuucuuaacuaggcaugucuauguuucuuuaccuugcuuuagugcucuuagaugucccauuccagccuuugaguuggaguggggaagguguuccuuauuaaagaagcaucuacuacaaaaaaucuaaaaccagaucugaggcccauacuagacccuucuauuagugguaauuuuaaaaaagaauuuuccaucuaaauuuaauagcuuucuucuguagcuacccuacccuaucccugggccaggcaccaaagugaauaauaaugugcuauaaaauccaaaccaaaauaguacaucuucuuuggcauuugaaauuucaguguuuuuugcguguagcuacaaaugucuuccauuguggcaaccacuguuuugggugguuuuuuuuuuuuggagacaggaucucacucuguuucccaggcuggagugaagugaugagaucauggcucacugaagccuugcccuccagggcuaaaguaauccuuccaccucauccucuugaacaacuuggacuacaggcaugcaccaccacagucagcuaguuuauuauuuuuauuuuuguaaagacagggucucuacuauguugcccaggcuggucucgaacugggcucaagagguccuccugucuuggccucccaaagugcugugggauuacuggugugagugaaccaccacagucaguuuugggguucuuuugaauaaucagaagcugaaaucagaagccaaaaauagcaaaaugggaauucugugugcuuuugugauaugauuauauuuguguucccagccuccaaagaaagcaaauguaauuuauaugguacucaauaaacuauggcagucaagaaaaccaaaagaaaaaccuuuuuccacuuggcacuguccaauagagcuuucugugcugaugaaaaugucuucuaugugcacuauucaauucgguagcuacuagccacauaugcauuugauauguggcuagugugauccuaaggaacugaauuuugaguuuuacuuucauaaauuuaaauuugcauagccauguguagccaguggcuaccauacuggguagcacaggcaugccacaugcuguuucucucuuaaguuggcaccuuuaauuucuguuuuaaaauucaugucuccuuuacuuguccccuucuaucuucucuuucucacucacucccuuccuuuuucucuuugcuuuuuauuucuccuugcuucuuugcuuuccuguuuuuucucaaccuucugugauacuacuaggcugaccguaaccccauuaauuauaauuauuuauuauggucuuucaccuaguuagacuugccugccuguguucuccuucuguccccaaagaugggggcauucgcggauaugcaguguuuaccaaaagcuccugauauacugguuacuuaauaaaaacaaacaaaaaaauaaaugggauuuuucugacaagaugguuuuggugaaccuaugcugauuccugagaucacggcuucuuuuucuaaauacacaaaaaaacugcuuugguaaaucauucuagaauuuugcacagaaugaaucaaaaucagugguauuacauaauccuaggcuccauaguucugauuuccagaacuauugacuaauaguaaucaaaacacuggaauacuucacuggaagacuucucuguccuuacuuuucaguaggggguuuaaucuaacuccucuccagucuuucuucuagaggaacucuguaauuccaaucucacuauuuuggucuucccuucuccuccuccuuaucucuucccccuuucugcuuuuccuucuccuccuucuccugauauaacuuacuuccuuucugagaaugccacuugucucuuucuaacuuuagguacuuuugccuacuucuuuccuucuacuuuaauucacauagaaguaccgugagacuauguaaacacaucuacuuuaaguuaaacauuuccucuauucagagucaugccuuuuuauauuuaaaaaaaaauucuaggcugggcacgguggcucacuucuguaaugccagcacuuugggaggccgaggcggguggaucaccugagguugggagugcaacaccagccugacaaacauggagaaaccucaucucuacuaaaaauacaaaauuagcuggacgugguggcacaugccuguaaucccagcuacgugggaggcugaggcaggagaagcgcuugaacccaggaggcggagguuguggugagccaagauugugucauugcauuccagccuggacaacaagagcaaaacuccaucucaaaaaaaaaaauucuauauuugauuucaagccucaaauaacuuaaguaauaaugacuacccaucuguaagaguccuugcuuugugauacuguuacacucuguuguauugagaaugcucuaagucauauguuaccaacaugcuguggaccuuuagcuuuucccaguuuccagacagaagcaguggucagucacuuaacugcacuagacagaaaagcaguuuuucccuucugaagguuaaacagguuuuuacaccacuggagauuuuuaagguggguauggguauuaagguggguauuguuagucuuuucccucuaaguuuccccaauguccaaagaauuaacaaaauuuuaaggguucugauuuauaugguaacacagucuguuagucagauguaccaaguuucuuccuaucuaauuuuuuuuauuuuuauuuuuuuugaaauggagucuugcucuuggucaggcaggucucgaacuccugaccucgugauccacccaccucagccugccaaacugcugagauuauaggcgugagccaccaugcccggccuuuuuuauuguuauuuuuuucagagacagugucuugcucugucgcccaggcuggagugcaguggcgucaucuuggcucacugcaaccuccaccucccggguucuagcgauucuccugccucagccucccgaguagcugggauuacaggcgugcaccaccgugcccggcuaauuuuuguauuuuuaguagagacgggguuucauguuagccaggcuggucucgaacuccggaccucaggcaauccauccuccucaucuucccaaagugcucaggauacaggcgcccagcucuugccaucuuagagucuuugcaauuuuuacuuuuauagccuaaaguggcgcuuugcaugccuagauguaucuucagccuuuauacuuuaaucauucugagggggguuuucugugucccuccuucaucaccuucacccuguuuacucccuccauaucauucauuccucaauacuuauuuccauguuucccugucuccaccacugggauguaaggauuucuuaucacuuguucugugcaguuaaucucagugcucgggcucacagcugggagcugauaagugcucaaugaauucaaguguuuagaagaauguuagugcagaguagagauugggcaggcaguguuaguagguuaguaauuauuacuagaaccagguagaguuucuacaaccugcauugaggcccugagcaugaagaauggaguguuaaaaugagccuuucaaaggcaggauuggcaacugugugaggugacaccacuagagacaugguuuggacagcgcuuccgaagauggaauaccagauaaagaucaguguggaugguggaguccuuaacugauucaguuuaagauauuugauuuugaugcauuugggaauagggugcucuugcugagaauagggguuagggcucaauuuacaaaccuuucuguuccuacauucuagguuccuaugauuauaaugauucuugcugauaauauuuucucccagcauuauuucuuauauauaauacgugacuauaaaggcucguuccuguuucaaaugccuuugcacaugcaugauuuggauuuuuuuccagccaggucucaggggccauguuuuuaaagucugcugcucuuugggcugauauuguggcuucuugaaucgcauacaaagcagguuucuugaaaucugcucaucuaccauaguuuaccaguuaucuguauccuugcggcucugcuugaacugaagcuuaaucuuguucuuuguagggcccagcuauuuuugcuugucauucuaucacaugccguuuaccaggaaacauucaaauaaugauuaaugaugccaaaacuuuaaacauggaggaagcugguaauaccagcuccgcuguggagauuuucaggagcaucaaugccggcugaccggacugguauuugagucucggauaauggaguaguaggucucaaaaaguuacacuuuucuggguaauugucagcuucccagaguacuguuaaauucugucccucaaaaaugaugaaauugcaaaggaauggucacuguuacagguauucuaucuucauuaucugauuuaauccucaaaaaaauaauugauguggaauaaguuuuuucauucccauuuuaaugcuagaaaauugaagcacaaaaucuacccaccaaauuguggacuguguuuucuguaucucuuaucaaagcucuccagggucccuagacccucuguugucccucuguucuagccuuucagauuggcuucuuucacuuaguuauuauacauaaaaugccauguuauaaaaugccucagucaggauaauggggaaaguguucuugggagacagugcacauaaagaccuuacagugcugggugcucaaaauguuaccaucacuuuuauuguuagccucuucccucuuaaguuuccccaguguuuaggaaauuagcaaaacuuuaaggguucucaugguaagacagugauacgacuauuauguauaugguaagggggugauauaucuaucaugguaaguaacaggacauugaaaagacagucaugggaauaaagcuaaguaaacacauguuucauuggaauagcuucuauuagugacaauaccuccuauauuuuggacuaauucccagaugaaagauuuugcugaaacuaggcauuaaugaaacuaagccauucaguacagugugauuuucuuuuuuuaucuugugauuugagaaguauauucuaaaaacccaguaauucagccaggcuggacauucaguuaaauaucaguggagccagcuguguaaggacuuauuggcuuuguccuauacaugugguaugucuggaguuuuggaaacaauucauggccuccuuuuaucgguugaguagcauugaggccucauaaaaaauaguaacuugauucuaagguaaauuucccuggaaaguaugaaaugggaaaguuagguuuccauguacccccccgcuacgcauagcauuauuucaauuccaagaggcauuuguagucaauuucuaugaugauuggaaaggagcuuaaaaaauucuuacaaucucuuuaaaaacuuuugaagcagaggagaaaaaauugguaauuuguuuuucaggaagaaacauaccuggauuuaucuauugcuacauguagguuuuuuuuuuuuuuaacuaacuagaaucacagcaucuuuuucuuuuuaaacuaacuugaaucacaaaaucuuaugucauacuucaugucuuuccuuauuaaggauaauuaguuuauggaggauucaguuaugauggugauauuauuagagacuuaucugaaugaaaucagaaaaguguaucccguuuuauguagaagauuuuuacauaaaauauuuacacacacacauacacuucauuuuuuagagcaguuuuagguuuaacagcaaaacugagcaaaaagugcagaauccucccuacccccaccauaccccucacccuagcaucccugacuauaagcuucaagacugcaccaguaugguacaguugcuacaguugauuaacugguauuggcaaaacauaaucacccaucuuacauaguuuacauuagaguuaacuuuuggauuuguacauucugugagcuuucacaaauauaaaacggcauguacucaccauuaugguaucacacaaaauaguuucauugcccuaaaaauccuuugugcucuaccuauucaucccccuaccaaaacccugaucuuuuuacuuuuuccauaguuucgccuucgcaagaaugucauacaguuggaaucauacuauauauauguagccuuucagauuggcuucuuucacuuaguuauuauacauuuaagguccuccgugucuuuuaauggcuuaauagcucauuucuucuuagcacugaguaguacauugccuggauguuccacaguuuauuuuuccauucaccuaaucuugguugcuuccaaguuuugucaauuaugggaaaaagcuacuguaaacauuuaugcgcagauuucuguguggagaucuuaacauucacauugguuacuuuuuuuaaauuucagauuuaucaauauuacagagcuauugcaagagucauaugagaaucgaggaucuggaaauucuguaugaaagaggugccaucugaguagggccuuaaaggaugcgcugauuuggacacauagauuggaggagguacaucguacuguggcuggcacaguaugugauuuucuguuugauuggaguucaugguaaauguaggaacacgguguuauguuuucgaugccuucgaugcuaggcuaaagaagauaggcuuccuuagugaggccauaggaacccauggcagauuuuugagguaggaagugauaaguaaugucacucauuuauuuaagcagcuagucaagcucgcuuaguuccaaauagcugcuugaccuugccuaguuccaaauaauugacuuaaaauuaacaaguugacauuuauuaaacaguacuuuuuacaguuuaauuguucaccacuuuagacuaaauuuuuucuacagguggugcaaguuaauuagauuuucuuauaaugagaaagaaaagcauuucaguacagugucuucuguucugauauucaaggucauuuccuauauaaaaguaaaauucuacacagcauaaaaccauccuuuuugacauuuagggaccauagguuuuaauaacauugaacaaaggguuaaauuuuuuaaaaaguuuuuguacacucuuucuuugguaugcuucaucucuuucauuugagcugaacagcuuuaaauuucacuuaaagaaaugcuagauaaagagaagaacauuguauaagggcaacuaagugaacaggaagcugugcuucucagaauggggagauuuuaaaauagaggagaaagcugucaaagcaaaaguauagcagccucagcuuuacuugggaauuuauuagaaaugcagauuguuagacucuaccccagaaguccugugggcggggcuggcaaucuguguuguaagcgagaaagacuaaucuaaaccacugaucaagggagggggauguuaagacuuacugcagaaaagaggugagaaauuguacuaacaguuacuguuaauucaacacuuacuuuguaaugcacauuuuacagauacagcuuauguaaucuuuuaugucaacccuaggaaguauaauauuacaauaucuuacuauauagaugagcagaaaagaaugguuuaagaaguagcauugcaaaacuuccggcauggaaggugucuuugacucuauacucugaccucuuuaaaucgugcuaggccaugcagguauguuguuugucucccagaaggcagcgguggggcuaaggcagcacccaccucucugcucccucugcugcauuccccagccucccugacugagguagguauuucuuccuuccugcauccagguggagccugccugguccagugaaggaagcagaacaggaauggcaggaaaccagcuuuuucuguuucucuggaguucucuuaacaaacccugugacccuaggccugucucuugguaucucuaugccuuauuuauuuucagcgguaaaaugaggacugggauaaaucuguagguucuuucugaauuuuaucuggcucuagcacuuaauuagagacagauggucaaacuaggugaccucucaaggguucauucugguucguguugagaggaguuugauauuggaaauaauagauucuuguuuaugugcgaaauggagacaguacuuucuggaaauggugugaugcaaagugaaaucaugucugugaagucccuaguagccugccuggcauacauggaaggugcucaguaaaugguaguuccucaguccccaagaggaaaacagccgcauuccugauucugguguuuucuuuccuuaaguuuuaacagguuaguauuuuaauuuuccucucaaggagggaauaagaggugcuagguuuguauuaaaauauuaaguuaauuaaagcuuccuauuaaaauuuuaagagagaggaagagaauggggcaacaugaccacaauaaauaaagcaaauaggucauuauguuuccaaauggcauuaucccuugacuguugguagcuuuccuaauaauaauagguugaaaaaauguuacuguaacauaaauaauaaaagauacuuaugguaguacucugcuaaguacuauauagacaugagauacuuaauaacuuuuaauaucaugguuuggcaaaagaaacuucacaauggauuaacuauuuauuuggugaacuuaacuuggggcaggcuuguggguggaauuuaaggguuauuucuucuuuuuuuuuuuuuugcucccccggagacggaguuucacucuuguugcccaggcuggacugcaauggcgugaucucaggucacuggaaccucugccucccggguucaagcaauucucccaccucagccucccgaguagcugagauuacaggcucccgccaccaugcccagcuaauuuuucuuauuuuaguagagaugggauuuugccauguuagccaggcuggucucaaacuccugaccucaggugauccacccaccucggccucccaaagcgcugggauuacaggcgugagccacugugcccagccgaguuguuucuucccuaauuucucucacaaaccuuccuuuuauauagagaaaacauuuuuacuuuucauuugaaauauucuuauuguuguuuuuuucugaucauuacugauguaccuucuauagaaauaagacacauauuuggcagggcacaguggcucaugccuguaaucccagcacuuugggaggccaaggagggcggaucacgaggucaagagaucaagaacauccuggccaaccaacgugaugaaacccugucucuacuaaaaauacaaaaauuaucuggacaucguggcacacgccuguagucccagcuacucaggaggcugaggcaggagaaucgcuugaacccaggaggcagagguugcagugagccaagaucacgccacugcacuccagcccaggugacagagcgagacuccgucucaaaaaaaaaaaaaaaggaagaaauaagacacauauuuaucccaacguacauuguuuuucacaaguugcaauuugauauccuuagcuaguuucaucauucuaccgugacauuuauccccauuaugacauuucuaaauuauagugcuucucucucauguuacgcauguuucuaagcucuugguuggaaucuguaaaauagcuaguuguuaacauuuaauaaaauuuagacuuaccucaccuuacucuguuagcaaagaguuacaugaacucuguuguuuugaauuaagaggucaguuguggcaguaaaccuggguagaauuuggaaaggaacuaggcuacuuccuuuuugauucuuccuuauuaggucauuugucaaguggauacauuaucuucuuucccugagggcaggagaccaucuuaguucccuucuguuaaagagaucuaugauucauuacuuccagugugaaggccaggugcuuuugcaugaguuguaaacugcuaagcgagcccuuuugugccuuguuuguguaugagagucuuucucuucagaguguagggcaaccuguccccaaccaguccccuuucccaacauccccacccacagugugauggaugcuggcagucauaccacauucaacauuuccaagugggacuuguuuuuauuggauaugaucaccaaaaaaauuugaauuuagaugagaaacaaaucaaggggugguuauucacauugccgauggguuuuggguuuuguuuuuuuuuuuuuccuucaaaaugguucagccuagggguucuuuaaauagcaaguugcucugcuagauuuaaaugggauuugauauauaaaaauccauuuacacauuuaacaggauguuauguugguauaccagaaugaugaagagcaaaauucuggagucuuaaacccaagcaaguuuagaaucccagcuuucucguauccuggcuugugugaucaugggcgaguuauuuaacuucucucagccucgguuuucucacugguaaaccagagaucauagcaccucauagauagcacuucuggaguguuuugaauggcagaaacagaaagugucguguaagacaacacaugcauuguguaaggaaagucuuagaugucuaacacagcaguggcaguguucauuuucagggccauuuugccugaguuuuuguuaggcccuucucucuuuucuucuuugaauguauuuguaaacuugaaaagaacaccgcgaaaagagcucaggauccugcucagccacacuucaccugcucuccagcuuggcaugauugauugucaggaaggcauaaagaacucaaaccaugaauuacccuacucgggguaaucacaaugguuuggauggcaucuccuuaauuuuugcuuugacuuuucuuuccuccgggcaagagagaguagaaggaguggcaagaguaugccuuuuaguuacugaguucuaaauucuuggaaugagcauagucuguuuucucaggaucagacuagaaggcgucauucuauuacagaagagccaagacuugucccaaauggauguggguuucagcaaagcaucuuuagcuuaaggagcgaaggauuuggacuguguucagcaucugugcuucgcaggccacucuuuauccuuuuagugagucccgcuugucuguccucugucaagggcucguguacaccaugcugauuuagugcuaacuggggagauuacaaaugccuugccuggcacugucagcuaaaccugaaucauugucuguguacugugacccgacuagucagagguuuacccuuugcuuugcugcucacucuuauaggcagaaaagcccagcucaccccagcuuuuauaacggggucagcuccagaaauagcaccuuuaacugggaauagaagcaacacaaauccagcaaguagauaguauacaauggcugcuuuuuggccuuggaacaaacaaaagugguuuauguuuacuacauaccacuuccaaaacugcugucugucauuuacuagagaguuuaucauuccugagggccaaggucuagguuuucuucacacaaaugcccuccaagugggagcugcuugguguuggucauuguuugcacccagauuuauaauuugggguuaauuagacauaaagacuuaaaggcaaaugugguaccugauggaccauggguagauaagacaccucccaaaauggauggugaaauucuuuuuaagagucauaguauggagaaaguccccuugugaagcuuuguguuggagccuagaauuguaauguauggcacuauuagacuuccaaaaccaaugugaacuucagucguuuguaucaugauuugcuuuauccuauguuccuaucuuucccgguaguagguauuacuuugucuguggguuacaugucuuucuccucuaagauuuaaccuggggauuauuacaugcauauuuauaugcccagagacaauaguaggcgcucaucaauuguugaauaaaugaaugaaugaaugaccaaaugauugaacaaacaaaggagcaagugaacaaacagagaugugaagugguggggggcauuucuauaugauuguguguaaagagcacccuaacacagcaucugaacaaaucacucuuggaaaucuguucaaucccaccaccuucacuagcuauuccugugaaccccaacccuccccuagauacauuuuggugauauauuagauuauuuuuucuuugccucccuccuaccaugauaaaaaggauauugaauggccaaaccagugcauuacaguaacaugaaagaaauguuuaucuuucaucuaccagaauucaaggaaaaaaaccacaaaacuuugucagcuagauacuuuccugaauuguuuuuuaaaauuguuuaaaaaauuauuauuauugccaggcacgguggcuaacaccuguaaucccagcacuuugggaggcugaggcagguggaucaccugaggucaggaguucaagaccagcccgaguaacauggugaaaccccaucccuacugaaaauacaaaaaauuuagcugggugugguggcaccaugccuguaauaccagcuacucaggaggcugaggcaggagaauugcuugaacccgagaggcggagguuauggugagccgagauggugccacugcacuccagucugagcaaccagagugaaacuccaucucaaaaaaauauauauauauuauuauuuuuaauagggucccacccugucacccagucuagaaugcaguggcacaauuauagccuacagcagccugaaauucuuggucucagggaauccucccaccucagccucuuggguagcuaggacugcagguguaugcuaccaugcacagcuauuuaauaacaguuuuuuuuagagagggagcguugcuuuguuguucagacuggucucaaauucccggcuucaugcgauuccccugccucagccuccuucucagguagcugguauuguaugaauuguguuuugaauaagaagaaauuaaggcuuauaagaucaguuguguguuagcagcgauguugcugacugaucuuugcaaucuguaggacuauuuggugcuacaauaauaagaaauuaaucaguuugauaauuuugccaucauuuuuaaaaaauuuuguaaaauaauugaaaaucauaugugcaauaucuuauaaauuuuuauuuucaaagcacauuccuauauggcaauugaaguacaguuugaacuuacuuuugacuaccuucuuaauagugauugaucauaaauuauaaaauuuucacuuaccaaauuauguuuaaaaagcuaaauuuaacauuuucuuuuuaauuuuggaguugaaugguccuuuauuccagucuuuguuuuuguuuuuuuccaagggaagacaaauauuuaaguucaaagucauguuuaauagaggaaaugaaugaaaaguggaugucuguuaucuguuugcaacaaucaucuuuauguccuaguaaaaguuuaauuuuaaaaucuaacuuuacagaucuauacccaguaaauuuuuuuuuuuuuuuuuuucaaacagagucuugcucugucacccaggcuggagugcaauggcgcugugucggcucacugcacuccgucucccggguucaagcgauucuucugcuucagcccuccugaauagcugguacuacaggugcaugccaccacacccagcuaauuuuuguauuuuuaguagagacaggguuucacuauguuggccaggcuggucuugaacuccugaccucaggugaucugccuaccucagccucccaaagugcugggguuacaggcaugagccgccacuccuggcccccaguaaauaauuuuaagaaucuuaaaguuacucauuuuuacuuagacuuuaugagauuaagcuauuuucaaacucacuucuauuuguccuccccugagagcuauuuacaaauuuguauagcacucuggagugugauaauaucgaagucaaugcacagucaggaggcuuguuaacuuaugugaugaugucaguuuugauaaacaucuuucucauuuaggcauuuaaugauaaucauuucuucaagaaaaaguucuuaguggggaaaaagaggcgaaaaguacagugugauuaacuuaugaugcauuuuggauuacagccuuuuaaccaaaagagaaucaucauuaaaacaauaauuccucagaaggcuugaggcauuuaacuucucuuaauuaaauuagcucaguuuacugccagucaauaaagucugguuuggaaugaugauagaaauuaaauaucuaagaaugcaguauacauaauaguuaaagaaaugcaauuaaaaguaauaaggagguacuacuuuucacuuaggaaauuaauaaugauuuauagaagugagacuacuaacuucugggaaaaauauagugagacugucacuuuuauacaccacuagaaagcccuuuuauaauguuugucaagauucuucaaaauacuaauagcuuuugauccauuaauucuuugucuaggacaugcugaguuggugaucagaugugaagaaaacuucaggccaggcuugguggcucacgccuguaaucccagcacuuugguaguucaaggugggagcaucgcuugagcaaaggaguucaagaccagucugggcaacauagagagaucccaucucuacaaauaauuuaagaaaugaaauuagcugggagugguggcacaugccuguggucccagcuuacuugcaggacuaaggcaggaggaucaccugagccugggagauugaggcuaaagugagcccgugaucacaccacugcuccccagcccaggugacagagugagcaccugucuaaaaaaaaaaaaaaccuggaaaaagaaaaacuucauacagccaaaauacccaacaucaugcaaaugcaugguugauuuauguuauuuucuauuuuggaauauuaugcagagguuaaauaauaagugcacauaauauuuacuacaaggcagaauauuugcuauaucuuaauuuuacuaaaaaguguaacauauaauaauauuugaauuauguauggaaaaagagagugagaacaagaaugaauugaaaacagaaagaaaaugcacccagauguuuacagucagugauuauguucugacuggcaaaacauaaguagauuuuuuuuuucuuuuuuuuuuuuuugagagagauggagucuugcuuguggcccaggcuggagugcaguggcgccaucucagcugacugcaagcuccccaucccagguucacaccauucuccugccucagccuccugaguagcugagacuacaggcaccugccaccccacccggcuaauuuuuuuuuuuuuguauuuuuaguggaaacggaguuuaaccguguuagccaggauggucuugaucuccugacuucgugaucugcccgccuuggccucccaaagugcugagauuacaggcgugagccacugugcccggccauaaguagauuuauuuucuaaaauaagugcauauuacacuuaugauaaaaauuaucaucaugaaagauuuuauguucaaggauuucauauagcugcuuuguauuucuucuggcacauuacagucauaguggcagugacuuguagggacauuguccugauacuucgagugcaauugaugauauuuguuuaauagugaauguagcuuaagaaaagaaaagcaaucaaacaacaaggugauuaauguagccacuucaacuccucagaucuuuggcugacauguuuuccuagcaaagcagagguacuuaacuaaccacagagaaaugcucacacaugucagaaggaaauccaagugaucacuuguuuugccuugggcaucugcacuuuuuauauaaguaugacuuucagucugugagaccuuucgauaaguagugauaauccagaaggauugauguagugauucuggacuugagauuucuuuucaccacuaagacauuugacugucacuugcaucuuaaugcguccauauaauuuucuaaagcauugggggacugacuagguaaagucacuguggccuuuuaaguauguggccagcugaucucauggccuaccagggcuuccaagugauuaguggggauuggcaagaauugaccucuuuggagccuggggaggcagaaguaccucaguaauaggguucagggagaccauacauggagcauagcucucucugacuuucaaguggauagagcuaguaggccucuacucauugugguguuugugaucagacaacccuugcuuuggaaucacucuucguugagagauacugaguccaggaugugccaagcaagauuguagauacucucacagaugaauucacccauucauuuauugagcacuugauuuuuuaggaguacaacuucaucauuaauuuccuagcugugucauacaggaucaguuagguuagauucucccuuuguaauuaauccuaauugcugggacuuucauguuucuaauaaaugucuauucccauaauccuguccuacauuagcuuucuucauguuguucugugagaucuauaguaagcagaugacacugcuuauuauagauuagcuacuuccuguguaauaaaucaauuauuccucucaauagggacaaucuugaauuaaaaucacauuuuuuucuuagagaauucucugucaaauucuaucaaaggccaugguuuuuuuuguuuuuuuuuuuuuccuguccagagacaccuuauuaaugacuugauuuuauccuuauuucaaauucuaauucaugaauaucaggguauaaaauauuaaauaugcugguucagcuaccagcuuuucaagcaucauuggggaacauccuguuauauaauaggaaaacauuugguauggcuuuugggauguagaucauuuuuauaauuauuauagggaguaaaaaaugcagaauaaaaaauaauuuaaauauaauuagaagugagagcaggucaguaugaccaagaauauaaaucauaaaucucucuauuuuuguguuccuuuauuucaugcagagaaauaccaaaccuuuguuucuaaaagggcaccaggucuuucagaaagcugugguucucagcagcaauuuuaguuagguuucguuucauguuuucugguauucugggccucccaauagccauuugugccuaaaagagagagaggaugaggagauuuggguugcuuguacugccagccugguggcacucuggggauauuagauguguucugaggauauauguguuuauuuaaauuuaaacagaaaguauuucaauggaugcugggcgcaguggccuguagucccagcacuuugggaggcugaguuggguagaugaccugaggucaagaguuugagaccaaccuggccaacauggcaaaaccccgucucuuaaaaaaaaaaaaaaaaaaaaauuagccaggugugguggugcaugccuguaauuccagcugcucuggaggcugaggcaggagaaucgcuugaacccgggaggcggaguuugcagugagcagagauugcgccacugcacuucagccugggcgauaagcaagacugugucucaaaagaggcuaggcgcaguggcuuacgccuauaaucccagcacuuugggaggcugaggaggguggaucaugaggucaagagaucgagaccauccauggcuaacacggugaaaccccgucucuacuaaaaauacaaaaaauuagccgagcaugguugugguggcacacaccuguagucccagcuacucgggaggcugaggcaggagaaucgcuugaaccugggagguggagguugcggugagccgcgaucaagaucaugccacugcgcucuagcccgggcgacacagggagacuccaucugaaaaaaaaaaaaaaaagaaagggagagagggagggagggaggauuucaaugggacagaaauucaccagguacauuagaaagccuuaacacuugagaaugugaagucuuaaaaaaaauuuuuuuaauaguuuggguuacuuaaaaugaaauacuguacugaagcagauagaaggacucuuaggaccuuucuguguuucuucuguaccuaauggcauauaauaaauucacuguuuuguuuaaaugaucaguugacuugagcuuucugucaucugcucagaaacacuacuuuaggaaucuuauuccauuugggaauucugacuagaagcucucccagggucaucauaugaaugaguaacuuacuucgcagcucuccucuuccucaguagcugcuucucuguagggcuggagggaaagagagucuuccaugcagucucaucagccaagaggaaggagaugcugguaccuggucugcaucccaacagacagcacacccucaugccuuccccuugaauguaccuuuuuggcucuuccucauuccuggggaaauguaauaguucuugauuguucacaguguugacugcucccuacaaugugagguucccccucuccucucccacagauggcacagagaaagugcuuaucaucgacacaguaguggggaaaaaaauggauucucauuuuagcaggugacuugagggugguugguugucagugugcuuuuuuucauauuggcuuguugcuacagggucugaugcuggcagauuacaacuuuguagcuagucauuuucgauuuauuugaaccuauuucuccagucuacugagcuuucacuggcuagcaucaauucagacacauugcaauucuucagaaucucuauccccaucagaugguucgaucuaugagaaauuuagcuagaggcguuuagacaaaaaagaaauauuguggcuggggaagcauuuaaguuagaggaggcagccagggcuguuuuauuacuuaguccugugucaccugugaugacccaugagaguggagaauauugaucgcuugucacucaaggcauucagcagauugcauugacaaagcuuggcaggucucuaauagcaggguuacuggccuugcugcggcccaagggaaaacucugcaggcccuauuacuuggcggccuuuaacucuuauagaauugggagagaacacugacaaaagcgaggacaugauuuuacgguuacaaaugauuuuucuugcuugcuuucuucucacccuuuuuaauuuuucuuuucuucuuuuccugucuaucuuaccuucccuccgugaucccugccagccccuccuuucuuauuauagcugaucauggcaguauuguuuuuuucuggguaaaaaucagaguggauuagagaaagcuuagcaggccuagcaugaggccugaguuauucucuccuuuuaggacagcuugugccugaccacauuguuuggaaugugccuguggauauauauacaguacuugaacuugauguguaggccauucacagcuguuguccucuaguagaauaagaacugccacuucaugacagauggguuucucucguuuuccauuuccugguagccaggcuugguucaagccuuugaccuuacauagucccgagguucagcugaaaguaaugugcugacaucagagagauaauggcacuagugcaaaacaggaaugauucuaaaaaaacaguagagaggauucuaucuuuccuagacacugccugauuuaugcacagguucgaaucaccaccauuaaugacauuuucauuccuaacauagguuggccuccuguuggacacuguuguguaaugagcguuucugcauggcugucauuugcuuuaugaagcauucuuuuuauuucuauuuucuguguaccuuucauuuaaaaaaauaucguguuuguuaucuccauugucucuuugaggaugagaaagacaaauaucauuacccccauuucaaagaagaguaaguucuaaucacaagugauuuaaauguuagaguuucauucaauauuuucacuaaaauuucuaguccucuaguaaaucagauauaagcaaagaucauaugucuauuucagccucuagguaggcuggccagcuuucuugcuuucucccucuccccuccccuccccucccuuccccuccccucuccuccccucccuuccccuccccucuccuccccuccuuucuccucuccuuuuuuuuuucuguagucuuguacuggucaccccuucacuuccucuuccuuugcaaugcuuuaggcugcccaaaagguucuagccagaugaacagaaacagaggagaggagagcuucuuaagaggcugguaggccaggugcaauggcucaugccuguaaucccagcacuuugggaagccgaggugggcagaucaccugaggucaggaguucgagaccagccugaccaacauggugaaaccccgucucuacuaaaaauacaggaauuagcugggcaugauggcgcacaccuguaaucccagcuacucggggggcuguggcaggagaauuacuugaacccaggagguggaggcugcagugagcugagaucacaccacugcacuccagccugggugacaaagugagaccucaucucaaaaaaaaaaaaaaaaaaaugggaugggucagccuugaguaguggacauggccuuugcauuuauauuccaacauuuugccacagaugaguuauguauuauuggcagauuacuuaaucucucugagccuuuguuucuccauuuaucgaauggaagguaauauuguuuaccaaaaaaagugaauuaugugguauauggauuauuucucaauaaaaaauaugaguuguguaaaguuucuaacauagaaaugcccuccuuugcuuccuuccuccuuauacaacuaagggcccacaaaggcagaaugagaauuaccaucuaggccaauacuggggaaauaugugcuacuacuggagacagaaauguggaaguauugcaaacgaauguggaccuauuaauauucuauagcacuuugagccacuuugaauuaaaauacuuaucugugaaagguuuuauaauuuauaugaccugaaauaauuuacaccuaauuagauuuugucaacugaauaauucugucucauguugcuuccacagaauaauuuaagcaacugcauuuuauucucaaaauagcuguaaaugucaaauuaauuuuguugacaugaucaacauguagaagagcuacuuggcagaauuguuugucaacugaauguauuaugcaucuuuacaaaauauguagauugauuaugguuuagcugacuuuugcaguuuguuggucuccuggaaagaaguaacggguggugguuacaaaaaccguuauggcauuucuguucaucuggcuagaaacuuuucgauaucuguaaguuuuccuucacuuuucauuauauagaccaugucuuucccuuggguguuaucuuuuuugucugggugagacuggaucccacguaacugcuuugguguuuguuauacuccucauuaauuuuauggggcucuuaguugacacuggccacauaaaaaugauuguugagucucacucuuuuuauuuuggaccauuucuuucaugugggagccucuuuaucccucuccuuaaaaacccuguuuaaggauuaguguccuugcaguuuaguuguagcuuacucaaguuaucccauuuauuccaaaaucccuuuuccacuccauuauacccugucuaguccggucuucuagcuacuaagauugaaguccugucaucuucagguuugguugaauccagugcuucccaacccugucucaucauggcacauguagaaaaugauauuauuguacagcacacggaaguaaaucaagaccuuuugcuguggagguaccuggcucagaggccaugaccugccuuaaguaggagggaauacaugcauacuauccuguauguuuugguguaaccaauccccaaauuugaaccaaucuuggcagguauuagaaauuugcuuauuuggugacaucuggaauuuaccuccucuuuugagcucaguauuucauguacuuuaaggucauuacugagcuuucuaccaaaucauucccauuugugucuagucauuagauaauucagauuucuaccuuggaugccuugaagugaugacaccuuacccuugcucaucucucucccaagggaauaaaccuguauuuugcuuucagcuucugcuuagaggagcuggcuccauccagaacaauuccccucccacuggacaucaaaagauugcauuuccauuggcaacaagucucaacauagcucagaaacuacuguugacuacuugucuccccuauaacaauauuggauccauuggagagugaaucagugucucccucaaguucagcccacucauuuagauuuuucauuuuagacuccgugggaaggaugucccagugcagaguuggccucuguaccccugauuauguuucagcuuucucuaauuucucugcuaaccugcuguugaugccccuaaaggcacucaauauugagugugcuuuauaaauacaugaacuacauguauuuuaugaaaacauaaacuacaaauacguuaaaauauacuguagauucauuacuaaaaggcauuaucuauucaguauccuuaauguacaaauaauaaaagagauaugaaacccugugucuagagcuaaaaauauaccuugacaguacaaauacacauggcuaaaaggcauuaucuuuuuaguaucuucaauguacaaauaaucaaaaggucugaauacuucugauuuucauaauggagaaggggaauuguagaaacuguagaccaauuagcuugaugucagcucagaaaagauucuagaaaauauuauuaaugaaugcuuucugagaguuuaauaaaagaaguagucaucacugggaaccuguggagguucacuuaaaauguuaugccaucuauauuccuucuucugcagcagagauugccaaacuuuuucuauacauagccagauaguaaauauuuuagguuuuuugggccauacagucucugguacagcuacucaacucugccacuguagcaggaaagcagccacauaggcaguauguaaacagauggauguggauguguucuaauaaaauaacuuaauuuauaaaaacaggcagcaggcugauuuggccaauuggccaucguuuaccaaccccugcuuuagaagaauaucuuagauaauguguaccugauauauucuauucuucuuucugaugggaaauacuuucucuuuuuuuggcguaaagacguuuuauuuucuuugcuaauaaagaguuggcauaaaaaaaagcaucgcauuaaaaucuucauaaaggacauggaaaaggcucaaguuaauaauaguuuacaguaaguucucacuuaauguugucagucauuucuuggacacugcuaccuuaagcaaaaugauauauaaugaaacuaaucuuuuuuucucaccaacauuguagugaaaagauguugaacaaaaagacguuauccaaggauguaaaucauuuaauuuaaaguugcaguuuccaagaaccuauugacugugcuaagugaggacuuacuguaguuagguagaauuauaacagguuuaauaauuaugaaacaugaagaguggucugugguugcaggccacaggcugugugcucuugauucaauuaugucaauauuuuuauuagugacuugacugagguuggaauugacuuguggaucaaauguguggauagccugaugaagagagagaucacuuacacuuugggugauaggaguaagaucccaaaaggccuuaggauagcagcugaaaucuuucaggcuuaaauguugaaaacagauaaaugggaaacccugugucuggagcuaagaauguaucuugacaguacaaauacaaauugugaaaacauaguugaauagcagccuguuugaacaaagcuaagagaguauuucaauuagagugcuugcagagaaaguuauccaggugguugaagggacucagaaucauguccuauuagaaaugguugaaagaaguguagauauauagccuagggggauauaugauaacugucuucaauuauuuaaagggcugucauguagaagaggaauuagacuuauucugggggguccuggaggacacaggggagagcaguggguagaagauacagguagauucaauauguaaauaggaacuuucuaacaauuugagcuguccauuagagggaugggcauuauuuagaggguuuaagucacuggcaauauuguagacaucuguugcugaccuuguggggauguugugagagaauauuagcuuugacucauuauuggaugggaugguucuuauggucacuaacaauucugagagugcguaaaagguaggccgagggauaaugugcugcgcccuacgucccaguaguuggcaaaguccaaacccagauguuuugagucuccugccuuguuuauaugguugaaaugcugacuuuacacaguguuccauauauguaucuguaccugucaucuuuaugugauuggcuagagacccugucacguucacuuuuguaaucucacaaagcuugacaaaugcccuguacauaggaggagcaaaguguuuguugaccuaaagugaauuacagaacagcugagacacaucuaaauauuguucuuuuacugauccugguuccauaaugaaaacauuuggaaguugaccagaaauuauaccuggggauuccuaguagaauggugauguagauggaacggcucucugccuuuguuucugucugugguacaccacacacaaaugccaacacuucaccaagaguggaagccaucaggcugcacucucugaccaggauuguuuuaccccuucuggauggcaauacaucgcucccuuucuuuuucacugccuccugugcauaccuccgugcuaaauuaaacuccagacccugggaugucuggaauauauuuuccagucuucugaauucuaccacccugaaguagucauuugcugucaucauaauucuggaagauuuaauauucagauugacaguggauaugccggucucauucuuugauguuugguacaugggcaaguggucagguauccuggccuauuuaucaccauauucuccauggccuguacucagggucaggcauaugguagguagucagugaauguuuguuuuuguuaguaggacucugguuuaguccuuacaguagucccuuuuauccauguugguauguuccaagacacccaguggauaccugaaacuguggacaguaccaaacccuuuccauacuguuuuuuuuuaauaugauaaccaagacagcuacuaagugacuaacaggcagguagcauauacaccaugcuggacaaagagaugauucucauccuggguggacagaucaggacaacgugagaauuucaucuugcaacucaaaauacugccuaauuuaaaauguauugacgaauuguuuauuucuggaguuuuccauguaauauuuuuggacugugguugcucaugggugacugaaaccacagauaagggguacuacuguacuucuguuucauccuaaugaaguaaaguuucuuuguucaucaaggcaguauuuucuuucucuuuuguaccuaccaugcucuaccuaccucaugucuucauuuucugugccacuuucuugcuguguuuuauuaggauaauguuuuaauagaauaaaagaagggcaaagguauaguaauugaauguccuucacuaucaauccccccaaccccugaagggagaaaggaaggagaaugugggggagaggggaaggaagaaaggaaaugguggagaaaguagagaaugagagaagcauccuguuucauacugagaagacuuugguauugaagaauuuugacuuuguuagugccauauaacuuguguguugcuuuguuuaaauucucgucugcucucauguuuucauugcauucuguggauagcagcuaagagagcuuucagacacaucuguauuagaaguaaaauaacuguuaaugucaagacuauaucuuugcuuuuuucucccucagcuucuuuucucgauugguagaaaacauggaauaauggugccaggguuagcuuugccuggagaagaguucuguuugccagcccugcugcagauugauaaccaucaagggaaggauagcccagucauaagugaccuuguggacugcguaucuuuauguaccccuuacacacuaguaggaagaacccaaauaccaucugccaaugacagugaggcaggaaccucacuuuugugacaaaaggauuguacuuugcucugcuggaacuggcucguuaacaauucauaagaaccaauuaaguuuucaagaauuuugugagcugguuuuuuaguaaaaccuuuauuagaaguuaaguuauauuaaaaaaaauaauuagauggguaugguggcaggcuccuguaaucccaacugcuugggaggcugagacaggagaauuacuuaaacccaggagauggagguuacagugagcugagauggcaccacugcacuccagucugggcaacagacagaaacuccaucucaaaaaauaaaaaaaaguuauguaaacuuaccugugcuuuuaauauaauuuacuuaauuguaaucaguauucaaaauucaucacuuccuuauuagcugcuacauuuuacuaauauccaugaccuugagguuauuuacaucuaguauaugguagaaauacuacaaaaugauguguuauugagccucuuuuccuaacucuguauucaaugacaucacuuuaguagccaugguggaaguauuuacaccacagaaauugguaaacaggaugucuuauucuguuuuguucugcuguaacagaacaccgcaaacugaguaauuuauaagcaauagaaguuuauuuggcagaugguucuggagacugggaaguucaagaucaaggggccauaucuggugaggaccuucuugcuguaucacaguguggcagaagacaucacauggugagagaacaugcucaagagaguuugaagcucuuuuauaaucagcauuaauccauucaugaggguagagcccucaugaccuaaacauuucccauuauguuccaucucccaacacuguugcacuugggguuaaguuugcaacacaugcuuuuggggggacacauucaaaccauagcacuguacaaauccaaauuuggucauuuguuuuguugauugucuacacuuaaaagaaugauggaggaaauguuauuaauacagauuaaauuuaaaaguauguuguauuugcauccauuacauuguggauagcaaaacaauuaagagaauaucuucuuguauuuugaaacuguuuccaacucaacaaagaaguuauucauguccucgaggaaggaaacuguuuauaucauucaugucuuagguguuccacuuuaauuuuacugguucaaaaacaucaaccagguuuuacaaaacuacacucauucuucagguacaaccauagguuggcuguagauauaagaauugcacauauuuuaacagaagcauucugugaauguuaauuuucccauuugguuggaauucacaguaaaguuuagcauguacuuuguuauuauuuguaaauugcuugcuauacaugauuuauaucaguaaauuuuauaauaaauagguguacaucuauacauacauacuucuuuucccaaggagcugguuguuaaguauuaccaacacacuacuguuuacaauccaaaugagaauguagcucugugucuuaagguagugaugaucuuguguaaauggugagauuuuugccuucaucauagcaaaaggcucaaaugcacuauaggaaggaaaccuuucugauuauggaauaugaagucaggauuuuaaaugccaccaacugucgaacacuuaaaggacaaaguguuugaaaucuuaaagccugccuacucuauuuaaaagaacauuagagggcguuggaaagaggugauaaauaucauuaggaccucagcaaggcuuuggaacccaacacauugaaagauaauugagugaagaggaucucuggacacaaagcaggcaauuuaguuauccaaagcauuuaugucaagcagcuaaugcgugaggauuuauuuauuuguguuuuucucucagagcuuaauccaugaggaguacagaguggugguaggguggaggcuagccuuuauuuugcauugcucugagaaguguugcgauaaugggagaaauuugguguccuagaaacguuauuauuauaaaugaaaaaucuugaaauacgaggaaagugaauuuuuuaaaacugggauuagaaacucagaacaaaaugagcuggacgcgcuggucaugccuguaaucccagcacuuugggaguccaggaagggcggauuacuugaggucaggaguuugagaccagccuagccaacauggcgaaaccccgucucuauaaaaaaaaaaaaaaaaaaaaaaaaucagcuggauaugguggugggugccuguaaucccagcugcucaggaggcugagucaggagaaucgcuugaacccgggagauggagguuguagugagccaagaucaugccaguauacuccagucugggcaacagagcaagacuccaucucaaaaaagaaagaaggaaaaaaaagaaacugagaacaaaauggucuuuugccucuuucuacuuaaauaagauggcucaugcaaaacuauauuuuugugugagauuuuugguuaacaagaaguuguauuuccguucaucaguuagacucaguguggaggaauguuuuguuuaaccuacuuuaacuagaaacaaaauguauuugcagaaguuuauagguagaauuauaaggugaucuaauaaacuugaagguuacuuucagcauauggaaaucagaauuuuguuaguggaauggcaaaugugaagaaugaaaaauccaguugaugccaguuaacauuaacuuuuaggaaagaaaaaacgguagauuuuucugugaagagugugugugugugugugugugugugugugugcgcgcgccuguguguguguuuaaauuagauuuuucugugaagagugugugugccuguguguguguuuaaaauuuagcucaucugguucuguguuguguguuuucucuguguguguuugaaaggggacauauuaugaacguuaugguucccuaccucuaagauccauuccuaaaauaguuuuacuaauccgaagaaugacuaagaauguaacuauggaaauaaaaugacuuuucaauccuguguugacuacgugccuaaaauguugauuugcuaaaaccugguacuuccaaauuaaauuucaugguauauggaugauuuauuguaaucucuugugaggaaauucaucuuaaaaacuuuuucgaaaucauccuaaguuugggagaggagagcauuucuaauucaaagcaggagucaggcuaagaucacaugucucccuagaggaaagaggggagguuuuacuugugcauauguuuuuuaaauauuuauagauacagcuggacuuuuaguacuuuaguucugguuuuaaugauggaauucccaaaggacuaaaauuguuccaaaugucugaaccgugucugaaguucaagaacaguauaugguuggucugaagacuuuaauccuaguuggaaacuuugaaugagaaaccuggccuuuuagucuuguauuucuugaacuuucuguuaacagaauaucuccucgccuuuuauguagcccuuaacuagcugcagacugacuuggucuucucuaguaaagcauuuucuauguaaggucaccaguaaauuucuuuuugucaacagaguaccuucuugccuccuauucagccguuaacuguuuuguacugacuuggucuucucuacuaaagcauuuuguauauaaggucaccaguaaauuucuaagucauaaaauuaagugauuuuucuuauuucccaucuauccagucaacagucauuuuauucaguaccuacugugugacuuggugcuagggauucauuaguaaacaaagcaggaauauucuuuuacaauguggagcuuucaauuuucugacccuguugaccuuccuucuucaaauuucauaaacucgcuuacuucugguuagugaaaucaaugaugauuauuuuaauaaugauuccuccccucaugauugugcucagggcccucucuuucccugaugauuguuuuucuugauacuuuguggaugauuuuauauggcuaagacuuccagguugucaucugcccauacacagaggaaguccugagggaacccacgaguuuccucucacugcuuccgugcuguguaggcaccuucuccuguuagaaaaccaucaauaggagcuuccaugaucaugguggaggcggcaaauaguguguauuuugcagggauaaggcagcgaggacaaguugccucuaucuacuuuagccagaagauuaguacuaauuucuaaaacuuucaaauuugucuuuaaaaaauugcacccauauagcauauacauuuaguuguaugcacacacacacuaaaauaaacuucuuuguauacagugauuugguauaaucuuaggacgauuguauuuuccuuuuguuuguaacaacuuuauugagauauaauuggcauauaaugaacugaucauauuuaaacuauacaacuugauaaguuuugacaugcauacaccuauagaaccaacacaaucaagguaaugaacaggcuaggugugauggcuuacaccuguaaucccagcauuuuggaaggcugaggaagcagaaucacuugagcccagaaguucaagaugagccugggcaacacuggaaaacucucucacuacaaaaaaauuaaaaauuagcuggguauguugguucguaucuguagucccagcuacucaggaggcugaggugggaggauugcuugagcccaagaggucaagacugcaguaagccuugaucaugacacuguauuuuagcuugggugauagagcgagauuccaucucaaagaaaaaaaaaugaauauauccaucacccccaaaaguuuccuccuuucucuuuguaauuccuuucucccccaccucccuuccaucuccaccccagcuuauucccuggcaaaaaaacaaaacaaacaaacaaaaaaaacaaaaaacaaaaacaaauuaacuguuuuuugucacuauaaaguuguauacauuuuucuagaauugcauauaaauggcauuacauagcacauacuguuuguccuuuuuuuuggaggaggggggguucuggcuucuuucacucauauuaugcuuauccacauugugcuguauauaauguuucacaauauuacucaauuuauggauauaccauaguguguguuuauacauuggacuguuuucaguuuuuguuauuauguauaaugcagcuaugaacauuuauguaagaguacaauguacauucucuuggacaaauaagaguggaauggcuggauaauguacuagguauaugcuaaauguucuaagaaacugccaaacaauaaucaaagugguuguaccauuuuauaugcucaccagcaguguguaagagucccauuguuuccauauccuugccaauacuuguuaugggcagucuuuuccauuuugccauccuaauagguauauagugcuaucucauuguggucuugaauugcauuucccuaaugaauaaucauguugagcaccuuuucaugugugauuuuucaucuguauaucuuuuuuggugaauucuguuuauaucuuuugccaauuuuuaaaaauuacauuuuuuucuugagugucgaguucuuuauucuguauacaagaccuuuaucggauauaugguauacaaauauuugcuuccaguguguuguuugucuuuuuauucucuuaacagcgucuuacaagauaagagguuucaagguuguuuuuuaauuuuuauuuaauuuuuagagauaggaucuugcucugucacccaggcuggagugcaguggcaugguuauagcucaccguaaccuugaacuccugggcuucagccaucaucccaccuuggccuccugacuaccuaggauuacaggcacgaacuacccuacccagcuaauuuuuuaaaaacuuuuuuguagagauaggguuucaccguguugccguggcuguucucgaacuucugagcucaaucaauccuccugccucagucucccaaagcaaagguuucaaauuguggugaauauaaucuaucaacuucuuuuuaugggucauccuuuuggugucauaucuaagaaauuauuuacauaccaaggauacaggguuuucccuuaugccuugcucuggaaggguuacaguuuuaacuuuuacauuuaugucugugauccauuuugaguuaauuuuuguauaugaaaugagacauauagugaauucauuuauuuuugcauacuuuuuuuuuuuuuugagauggagucucgcucuguugcgcaggcuggagugcaguggcacgaucuuggcucacugcaaccuccgccucuguguucaagcaauuaucccugccucagccuccugaguagcuggaauuacaggugcccgccaccacacccagcuaauuuuuguauuuuuuaguagagacaggguuucaccauguuggccaggcugaucuugaacuccugaccucaggugauccaccugccucgcccucccaaagagcugggauuacaggcaugagccaacaugccuagccuauuuuuacauacuucuauacaguuguuccagcaucauuucuuaaaaugacuguccuuucuucagugaauuaccuuugcauccuugucaaaaaucaguuguuuauuuacauguaggccuaauuuucuuccuuuuuacuaaucaauuugucugucuugagguugccaacccaaggcccaugggccaagaaaagcucacagccugucuuuguaucaucuguuagauaagaaugcuuuuuucuauuucuuaaggguuguauaaaaaaaaaaauuaaaggaaaugugacagaaaacauguguacugcaaagccuaaaauauuuacugucugaaucuucucagaaaaagaaaauuucuaaacuugaccuaucuugacaccaauaccacgucuugauuauuguaguuuuauaaucuauuaaaaucagguaauguuagucuuccaacuuacuuuuuccuuuucaaaguuguuuuggcuauucuuggcccuuugcauuuguguaugaauuuuagaaucacuuuguaaauguaaauuucuucaaaaagaccugcugggauuuuuauucauauuguauugaaucuauagaccaauuucaaaaaauugauaucuuagcaguauugagucuuuuaacucauaaacaagguguguuucuuuauuucuuuagauuuucuuuaacuucucucagaaaaguucugcaguggccgggcacaauggcucacgccuguaauccuagcacuuugggaggcugaggcagguggaucaccugaggucaggaguucaagaccagccuggccaacaugcugaaacccagccucuacuaaaauacaaaaauuagcuggcuauaauggcgggugccuguaaucccagcuacuugggaggcugagacgggagaauugcuugaaccugggaaacgaugguugcagugagcugagaucgcgccacuggacuccagccugggcagcugagugagacuccaucucaaaaaaaaaaaaaaaaaaaaguuuuguaguuuucagguuacaaauauuucacaaccuuugucagauuuaucauuauguauuuuugaagcuguuguaaauggcauuguuuuauaaauuuuaauuucuaauuauuccuugcugcaauguaaauguacaguuaacuuuuguauauuuaucauauauucuguaauauugguaaacucacuuauuaguguuaauggcucuuuuuaaaauuuauuuguauuguauauauaguugauaaugucaaagaagaguaaauauaauuuuccuuuuuuuuuuuuaaucuggaugcuuucauuucuuuucuuauauuauugcacuggcugcaaucucuaguauaauguugaauggaaguggugagaguguacaugcguuuucauuuuaacucauauuauggggaagcauuuggugaucuuccauuauuuaugauguuagcuguagguuuucugcacauaccuuuaucaguuuaaagaagucccuuucuauuucacauuugcugaaaguuuuaaucaggaauggauguugguuuuguaucaaaugcuauuuauuaauccauugaaauacucauuuuuuuauuuuuuaguuuaauauggcaaauuuaacugauuuucaaauuuuuuuuauaaaaacaugauauauuuuuauaaaaguauauuaaaaauuauucguauauauauaguugaacuuaauuagccugucauuuucuuuuucuuuuuuuuuuuuuugagacagagucucacucuuguagcccagucuggagugcaauggcgugaucucggcucacugcaaccuccaccucccagguucaaacaauucuccugccuuagccuccugaguagcugggauuacaggugcccaccaccacgccuggcuaauuuuuuguguuuuuaguagagaugggguuuuaccauguuagccaggaugcucucgaucuccugaucuugugaucuacccaccucggccucccaaagugcugggcuuacaggugugagucccugcgcacagccuauucugucauuuucuuucauugucuuugguuucuauaucaggauaauucugacauuauagaauauauugggaaguauucccuucucuccaauuuucugaagcaguuuguauagaauuuauauuauuguuuccuuaaauguuugguaggauuuaucagcgaagcccuugggccuggaguuuucuuuauaggaaauuuuaaacuccaaauucaauuuguuuaauugacaaagggcuuuucagguuuucuauuuuuucuuaaguaacauuugguaguuuguaucuuuucugagauuuauuauuucuuuaauauuuugaaaaucugugcuguuguaaccuuucuuauucuugauagugacaauucaugucuuuuuuuuuuuuuuccaggucaguguggcuagaggucuguaaguuuuaucggucuucucaaagaacuaacuuuugguuucauucauauuuuuguuuguuuguuuuugagauggagucuugcucugucgcccaggcuggagugcaguggcgugaucucagaucacugcaaguuccaccuccuggguucacaccauucuccugccucagccucccaaguagcugggacuccaggcacccaccaccacgccuggcuaaauuuguuuuuguauuuuuaguagagaugggguuucaccauguuagccaggaucgucucgauuuccugaccucgugaucuucccgccucagccucccaaagugcugggauuacaggcaugagccaccgugccuggccacagguuucauucauauucuuuauugccuuucaguuuucuauuuuauuugguuucuacucuuaucguuguuauuuccuguauucuacuuacuuuugcucucuuuuuuuuuuuuuuuaguuucuuaugauggaagcugaaggcauugaucugagacccaccuuguuuguuuguuuguuuguuuguuuuguuuuguuuuguuuuaaagacaaagucuugcucuugucccccaggcuggcgugcaauggcgcgaucucggcugacugcaaccuccgccucccagguucaagcgauucuccugccucagccucccaaguagcugagauuacaggcgcuuaccaccaugcccagcuaauuuuuuguauuuuuaguagagacgggguuucacaauguuggccaggugugagccaccgcgccuguccgagacccaucuugcuuucuaauacaguuuaaugcuauuucuccuucaaguauuauacuauuuuagguucaucccacacauuuugauaugcuguguucucauuuuuauccauaucaaaauacuuucuaauuuuucuuuaaguuuacugagacuugcuuugugacucagacuauggucugucuuuguaaauauuccaugugugcuugaaaacaauguauauucugcugucguugggcugaauguucuauaaaugucaauuaugcauaauaguauuuuuuaagucuuauauccuucucgauugucuauuuauuuguucuuucaauuauuaagaaaggggcauugaagucuccagcuaauauuuguucuaucaauuauuaacaauggagcauugaaaucuccaacuauaguuauagauuuuuuuuauuucuccuuugaguucuaucaguuuuugcuucacuuauuuugaagcuuuuuuauuaggacauuuaagauuguuguauucuuuucaugaauugacuacuuuauuauuauaaaauauucuuuguucugaaauauauuuugucugcuauugauauagcuauugcagcucacuuuugauagugucuuuuuucauuccuuugcauuuaaccuauuuguguccuuauauuuagaguccauuuuuuuuaagagaacuuguuuugggguauuuaggucuuuauaauucuuuuuauugugucugacaaucuuuugccuuuuuaauuguggauauuuagacuguuuauauacuuucuugauaugguuauguuuauauauuuuaucuuauuuuuuccuauguuccucuguauucuuuacuuacuuuuccacauuuugugccuuuuaaaaaucaguugaguauuuuuaaaggccgggagcagugucucacgccuguaaucccagcacuuugggaggccgaggcagguggaucacuugaggucaggaguucaaggccacccuguccaacauggcgaaaccccgucuacuaaaaauacaaaaauuagcuggauguggugguaggcgccuguagucccagcugcuugggaggcugaggcaggugaauugcuugagcccaggagguggagguugcagugagccaggaucgugccauugcacuccaagcugggaaagacagagagacuguuucaaaacaaauaaauaaauaaauaaauaaauaaauaaauaaauuuaaaaauaauaauaaaauaaaauagaaaucaauuauuuuuaaugauuccauuuuaucuccuuucuuggcuuauuagcuguaggucuuuguuuuuugguuuuaauuguugguuuugggguuauaccauaucuucaacuuauaccuucaagugauauacuacccauucauguauaccauaagaaucuuacaaguguauacuuuuguuucaacucucuuguugucacacaauucuacuuuuauauauguucuaaagucuauacuauauuguuauugauauuuaauuaguuaauuguucuuugaagaaacuuacauaauauaaauuuuuuuuuuuucuugagacgaagucuugcucugucacccaggcuggagugcaguggcacaaucucagcucacugcaaucuucaccuccuggguucaagcgauacuucugcuucagccucccgacuggcugggacuacaggugcgcaccaccaugcccagcuaaauuuuguauuuuuaguagagaugggauuucaccauauuggccaggcugcuagcugugcuacaauuucuggugcucuucauucuucuuuacauagaugcauuucuauguaauaccauuugcccucuuccuaaagguuauccuuuaagauuucugucuuuuuuuuuuuuuuugaggcggagucucggucacccagacuggaguguaguggcaugaucucagcucacugccgccuucgccucuuggguucaagcaauucuucugccucagccuccugagcagcugggacuacagaugugcaccaccaugcccggcuaauuuuuguauuuuuaguagagaugggguuucaccauguuggccaggcuggucuggaacuccugaccucaaguaaucugcccaccucugccucccaaagugcuggggauuacaggcaugaacugccacaccuggccuaacguuucuugaaguacaggccuacuggugauuaauucuuucagcuuuuguauaucugaaaacaucuucauuuuacuuuaauuuuuaaaagacauguuaguugugcauagaacuagcgguugauacuuucuuuucccuucucccaguacuguaaaaauguuucacagucuuugcaauugcauuuuuuaaguaagaaaauuagguaucauucuaaucuuuaaccucuguauauaaccugucauuuuuccccuggaugcucuuaagaauuucuuuuaucacuaguauugagcaauuuuuuuaugaucugcauugguguacuuuucuuuauguuucuugugcuuaggguucuuugagccuuuagauuugugguuuuauagcuuucaucaaauuuagaaaauguuuuauccucauaggacuauucugauucuccucagcuaguaauuucuuuaccuaauggacccauuuacaaaauacacuccagguccuauaaauuuuuuuuaauaggucauauaaaaguuacuaccaggaaucugauguuuauagugacagaaucaagucucgacacuuggaaaagaacauugucuguuuucucuuguaaacucugggauugcugagguuuucaaggaagccagguacuaaaccacucugcuguuacagucacuguucuucuuuuuggcuuuccuaccuccugagauucuuggcagaugaaggauaagugcuucauaagccugaaaugguggcccuucuggguccugugguaaucaucugagcacguacuuuucauuucugaguuaguacggagauuccugaaguucugucuacaucuuuccaauguuggauuuauacccaacauguaggaauauaaaauuuagugcuaagaugauagguguucacuuuguuccaauccuguaauuugcuguggugacauacaagggaaagagaagagccuuaaauauuugccugcuagcuaucaaguaggggggauuauacucuuaaucucauuuacauuuucuuguagcuauagcaaaguuugacaggcaaucgucauaucccccaaauuauauuagugugccaguuacaggucugugacuccuaaguauuauuuuuaauacuuaggaguauuuuaauacuccuaagauuauauuuaaaaaacauaaucucaccaguacauuuuuauuccuuccuuuuuaauaaaccagcuuugacagaugaaaaggaaucugugcuguagcucagauuucucauguuaggcauauuuuagccguaaacuuaauuaucgcaggaauuuucaaaugacuccaacuuuuucugcacuugguaucagaggauaccaaguccuguuuuugagcugauaaaauccuccuucugaaagcauuuguuuauuauauuacugcuucacaugagcugagcucuauccugaccccguguuaagugucugugguagauuucauuacauccauauacuggaaguccugccaauacacuggcagcaaaauccuaguggaaaauaaauggcaauaaaaaagagaaaugauagccugugugaguggugaggagcacagcuuuauugagacuggacaaccccagaguagugacuuggcaugcagacaugagcuuaagagagugugagugaaagcugauauuggaauaacgacucuguggcacagacaugggaauaauuuaauuaauugcacugaaauuucuuugaugaauaguuauguggugauaagcaugaggucgaacagcagaaugagucucagcuuuuuaaugggccagcacagcugcgguuuuggaugccuucccacuuuauuucugccugcagcucuccaccgcuuuauucauccacaucucagcuaggagcaccacucgcggggcccccucuccaugucggcagagcugaggggcaaguacauuuggccaugggaagcaggcuggugacugcuuugaaaugaaaaccagaucaaacgaaaauuguaggaugguguccuuaugaugccugcaccuccccuccuccccaaaucucuaggaugcuuuuacagagucuuugcugcuacguuguauaaagauuuuaauaaaaauuucuugucccuggagaaacaggcaugucuuuguugucagagagcuagagggaaaugagcaaugcagcccagcuggaguaccagcauuaaucccaugauucguagcccguauuuucagacagaucaauuacuuauggcuguaaccaaucucucaucguuuucuugcugugcagggcuccauuuccagacucggcagcugacauaaccuuccaacuugauaggacuucagcugcaaaucucuucaggucugcugccuccauucaucgugguuauacaaaugaguuguuaaauaaaaaucaaaaguaaaaaauuaugggugguaaucucugccuggcucaguaauacccaugggccuaggcaacauuuucaguuggauuuuuaaaaaacaagauggaugauucacuugucugacuuccuucacuuuuauggacaggcuuugcaugagagaaaagccaucucuagagggaagaaauuauccacaguggauacauuucuuaucaauuuauaaguugaaagauuaacuuagaaguggagagaaaggagauuaugaggagacacgaaggacauguacaggugagcugugucuaaugcauuucacacugagugagucaccccuuuucagcugcuaggcugccugggcuuaaggccaggagauucuguaucaaaaagaaaugacccuugcuaacacagaggugucauggaacauguaagcuguuuauagaguaugucacugugugaauguagaacuugugugaaggaucuaaacccaauaaccuuugaagaauuuacccagaauuuauuuaguguuuucaaguuauaacuacuccuuguguguauugaacccuucacagcuaugucaggccagcuaagccuuccuggaagagguacuuaggggccagauaaagcaaauuggagaaucucuuugugauuugacucacuuuagaugcacagaugcucaucuguuaggaaagcauguauugacucucuuugugcccuuuucuuucauugucacuccaucauuuccaucucuucaaugaauaguccuuugaggacuuucccauuuucccuauaauaaccaacuacgaaaauuugcaggaagcaaaaaggaaaauguggacaucuagagaauauaaaugguuuuauguuuaaucuagggggaauuauguauguauuuauauauauuuguguaugcgcccugcaugcuuguugcauuuugcuguaugcuuuagaaaccuuugccuacauggaacccauuaguaguguccugggacagguauucaugaacucuguuaacaauuaaggaaguaaguuccugcugcuacaggcugacagccacaguuuccccuugggcuuguauggcuuuggauugauucuaaagaagcaaaggaaacauacagaacauacuuguuugauuugaaaguuaaaaaccggucugugucuguuuucuucucccuuuucacucuagcccuucuuaggcaucccaaugcgaguaguaaaacauaaaucaugcaauaucauaagauacugcuacagcucuugcccugcccuggauuuguuuuuuugugcaucugaauuuuauuaugauccauaaagcaguauggaaauggcucauugguaggguugcauggcaguaccccauccucagacccugccaacaauugaaagucugagagguaauaagaaauaaaagggagaugagauuuauaguucgugaguucaaguugcuuuuuuuucuccguggaauguugccugucuuauuaggaguucuuuagugaaacaaaaugcagugguagcuuagagaaauuauggauacuuuccaggggugugggagaagcuuaggagucuguaagccuucuccccugguugcaguuaggaagccaguugacaguauaauaggcuuuuggaagugggugcaaugguuuguguguucuguuugauguugcaaauaccaagcccgcagggagaucugcaaagaggauauucuguucuuaaagaaaggaaaagauuaaccugaaacgugaacugaaaaacuccugaauucuagaggacuuaggugcagccaaggaaggaucucauuuacuuacguggaaacaucauuuggcaagcugccugcuccagacaagcagauauuuuuuaaugauuucaauuaaugaaaagcaaucacuaauaaacuugagaggauuggaucacauauuaagagugugugugugugugugcgugcgugcgcucacgugugcgugugcaguauuugcaugguuaagguuuggaaauacgugcauucucauacacgcauagaagucuuacaacuacguguacuacuuggagccugccugaugguccuuuucuucacauucagaaucaugcuucugacccauuaggagaggcuaacucuuguuauuuuggagacauuuucaggagugguaaugaaugggcauuaaggcacuucuguuauucaugaauauguacauucacuuaacauauuuauugaguaccuacuguaugccagguauuaugcuaggugcugagguuauagcaguaaaaaaauaaaaagauacauagucucugcucuacuuuaguuuauagguuauuggagagacagacaagaacaaauaauaauacaguuauacacuuaaaauuuuuauauugccuuuguauucaauaaaaauuuguugagggcuucuagaugcuguagacucugugauagagucuaaagaaaagcgucuugccuaauuucuguuaaaaucagugguuugccauuuacgaggaauaaacuggccauguuuaguuaugguauugaagaaaggguuugauccauacaggaacuauacuucaccucuauguauuaauuuaguacacaguuuuaagaacagcaagguagcauucaagaagagcauucuguuauauacuuguauauaaacccuauuguaucuacuaaggauauuguuauaacuuccucuucacugguaucuccucaacucugaguucaagaccuacccuucucuccagcugugggaaaugggauuugucaaccucucugagacaaaguuucacaucagcaaaaugggaauaguuguacuaguucacacgggguuguaaagagugaauggaauuguguauuugaaaacacuucauuaaagggauggauauuucaaguacacugauuuaauuuuuacaaauaauaugaauguauuagaucaucacauguacccugaaacuaugcauaucaauuaugcaugaauaaaaaaauuguugaaaaagccggucgcaguggcucacgucuguaaucccagcacuuugggaggcugagguggguggagcgccuaaggucaggaguuggagaccagccucgccaacauagugaaaccccaucucuacuaaaaauacaaaaaauuagcugggcaugguggcgggcgccuguaaucccagcuaacuagggaggcugagguaggagaaucgcuugaaccugggaaguggaguuuguggugagccgagaucgcgccauugcacuccagccugggcaacaagagugaaacuccaucuuaaaaaaaaaaaaaaaaagaaaaaaaaagaaaaagaaaauacuguguaaaggacuauacucauuugaguuuguauaauuuucauuauuauuacaucagauuuacagagagaauaaaauuuauugaagccaacuguguugucuuaaaccuccgaaaauucagaaggaggauaaugcugaguucaaguacgauauagaaaucaucauaucuuuucucuagcaaguguuccaagagaauuagaauauaaugccaaaauuaagguagaaauuaaguuauucuagaagugggauagccagugucagcaugcaugcaugauccuugaaaagugauauugggcagcauuuacaccaagcuuugcuaucuuacguucucuuuuugcuucuucuaccugguguuauuugugccuucccuaaagggcugaaauugaaaagaauuaguacgaaugcauuuucaaugacaccuuggccaagagguucaugcauuucagcuuuggacaaggugcuaugguucaaauacucaugaauaugauauaagaacagucauuauuuaaaugaugaaccuuuauaugagauuacacuggguguuacuaaucugcaaguuguauuuucuguggggaaaaaucaguaugaaugaaucaagaacucagugugcauccugcagugcauguuguauuugcaugaacggagauguaaucucuucaccuuuugaaucauuuuguuuaaaggcccuauauagaucauucugcucuuacuggugggugacauuuucuuaagguucucucccuagauagacuaauuugaaaaaaaugcaucccucuugaugucugcaugugcauguguguaugcauauguauaaaauauagaggugaucacaaagcauacugggccacuuagcacuuccacuaauuccacauuaucagagauuguuuggagagcauauuucauucucccuacuuugucacuuauuucuaacacugaguauaucuguacaguucuuaauaguaaauggcauaauaucuuauucucuguauucuauacauugucaaccccauuccuagcugauaaucaguagucaaaaaugggugaauaauuugaaugguacuugucuuuaauugugauucaugucugaauggcuugcugguaacuaggagcuaaauuuaauguuaauccaaggucacacucuaguccacauacuggaagcucagccucuugacaugcaugcuucaugcaauuaucaggcugcucccuuguaggauaaagugcggcagucuagaaagcauggcacucaaaugggaagaacuguuggugagucuguacagaacagaugagguugcagauauuugaaagcauuugcuaauggaaacucuggguaaggcagcaucuuaaauaauacguagaaucagcaugcugucuccaaaacacauuugcagcauuuauuagcugggugugagcuaaagguaagcucccauuaaaagaaaaaaaaaucuucguaaugauuagcaggggcccaguauaauuuaagguauucuuuggaguuuauaaauauggccucauaaaaagccugaauauaagagaacugugacuuuaagucauuagaagcccagugguuugauaaaauaacaggaaacagacaauuuauuaugagcagucucaguagcucuggauuaucuauaaaacuuuuacggccuuccccaaguggcaagaagccauaaaacuugccugaaugagggacuuguuaauuuacuuguuaaagcaaauuaaaaauuuauaagugcuuuuagguaaaugagaucuucucucauugcugcccuugcggggcugggaguccuaggaggggagaguggauaugcuuagacaccacugcagaacaauaaaagcuauuaaauuuuuccaguuuauuacagcagagccaugcagcuguugccauggcuagcugugggguaccggugguugacagccuggagucucacucaaagggggaaaaaauaaaaagccaaggaaagggaugauuuuuuacuuuuauaauucuccaauuguugauguuguagaccaugucuuuuuauuuuuccuugaccuuguaaauccagaaguuuuaaacuuuuuucuuuucuuuuuuuuuuuuugagacagaguuuugcucuuguugcccaggcuggagugcaaugucacaaucucggcucacugcaaccuccgccucuuggguucaagcaauucuccugccucagccucccgaguagcugggauuacaagcgugcgccaucacgcccagcuaauuuuuuauuuuuaguagagaugggguuucuccauguuggucaggcuggucucaaacucccaaccucaggugauccgcccaccucgaccucccaaagugcugggauuauaggcgugagccacugugccuggccuuauacuguuuuuucuuauccccagaaguguuucuguuuauuuugucauacauuguugguccuugaaaauuccugcccgucaugauuccuuuuagucauuuaguccauggacaaaggccaggucuuaggcuguuuuuguuaaccucaacauuucuugaaaaaaaccucuuucucucucuuuuccuuucccauaucuagccacaaaacuaggagaaggaagaaagggaaucugguacauguucuuguguauuuaacuccaaaaacuguuagaaucaauauuuuuuguggaagccaaaguuuauagguaaaggcagauuuucuugcacucucccuuggaugaaaugucagcguagguuaaaauucuuggaucuuagcaucuuccuuaacuuagggcuguucucuacguguugaauuucuucuguaauaauagguuucugaauggugacuuuggcuggugggggucauuuuuuuggcuuuaagcccugugacucaggggauuuuuuuuuuuuuuggcucccuuaaauacaauucacaaugagcaguuuucucccugcccuagugacaguaagguuucugggacauaggaaauagcuuauucuuccacucagaucagaaguuuugauugagcucuguggcauuuuuaaggcagaaaaagacacguuaugccucaacuaccuacccuauuuaauguuaaauuaaaaugaugguuauuuuuaaaguguguuuacauuuaaaaauuccuccagaaaagucaaguucugcaaacauuuucuuguaguauuuccagucacugcacaagaaagguacauuuuauuaguuuuaagaacagaaauaguagaaagacauaauugguacaaguguuuguucuucuacaguauuuacucuucaguuuuuacauauauauccauaccucugauuuguaguuuguuuggaauuauguuuagaaaagcauauuguuggcaaguaaagcaucacaaaauuaaggguagagaacagcaguaaaaaaaaaaugacaaauauguauuuuuagacuguauuccaguuuuaggagguaucagcuuuuagagauuccuuaacguuaaaauuuguuucaguaaguaacucuuguuguggucgcugucuucaguauuccagaaauaaugcuguaucucuuauucaacuucaugaaccucuuuacuggcuuccauauuaaugucauuugcauuuagagugugucaucuucauuuagaaucucagcaaaaauucugguuuauaaccaucuuugcacaaauuaucucugugcuuuaggacacuuuucugggccuggucuugcauuuuuuaugaauacaacuuuaagaguggaacuuaaauauguccccuuuuauuggauuauccccauagaccugaccacaaagucuguggaaguagaaagcuauaacgguuguaccauuuuuuuuuuuuuaaauacuuuaaguucuagaguacaugugcacaacaugcaaguuuguuacauagguauaccugugucauguugguuuguugcacccaucaccucaucauuuacauuagguauuucuccuaacgcuaucccucccccagccccccaccccacaauaggcccuggugugugauguuccccucccuguguccaugcguucucauugguuguaccauucuuuuguucaagaguaucaaguugaauuucauguacugaaaaaguagauagauuuaaaaacauuuaaauuuagguagcaaaugacauugggccaaagguccauugcuaaggagacccaggaaagaauuuauuacaauaggaauaugagguguggaacccaaggacagcugucaugaaggauagguaaucacaguaaaguagugaugcuucauauacauuuguuuuuguuuuuguuuuuuugagacagagucuccuucuaucccccaggcuggagugcaguggcaugaucucggcucacugcaaccuccgccuccuggguucaagcgauucuccugccucugccucccgaguagcugggacuauaggcgcacaccaccacaccuggcuaauuuuuguauuuuuaguagagacgggguuucaccauguuggccaggcuggucucgaacuccugacgccaggugaucugccagccucggccucccaaagugcugggauuacaggcgugagccacuucgccuggcauauauuugguuuuaagaguucaagcuagaauuuuagaguagauguucacucauuaguaauauugauauauguuguauaaugauugcuuaauugcuaauuuucuuaugcuaauugauguuuuucuauaaaaccaaauucuucagcucuuuacauuuauugaaugcuaucuggcuuaugaauuuucauaagaacugccaaaaaaaaaaagaaaaaaaggggcagguccccuccuuccuucuaaaaagagugguucaugccuguaaucccagcauuuugggaggcugaggugggcagaucacuugagaucaggaguuaaagaccagccugaacaaaacagugaaacaccgucuuuacuaaaaauacaaaaauuagccgggcaugguggugcaugcuuguaaucccagcuacuugggaggcugaggcacaagaauugcuugaaccugggaggcagagguugcagugagcugagguugugcuacugcacuccagccugggugacagagugagaccuaucucaaaaaacaaaaaacaaaaauuaaagaaauaaaaauaaaaagguagagaguaugucuauaaugacuuuuuaaugugucagggaguuuuuaauaggaaaaaaaaaucauuccacuaaaaauauguccucugucucccaacuagaauuucuuccccaugucacugccagccauugcugugacaauauagucucuuacucuuuuaucaaauauucuccauauuauugcuguaaguacuggacagauaucauaaguaaaauauguccaccugguugcuaagaaaaaucccacauuuauuuuauauauuuuguaauagcuuuacguauucguucaaccguaacauuuugguuuaaagacuucauuaagcuuucauuguccaauagcaaagaaguaugaaguagauaccccuuacuuugcaguguuuacuuuuuuuuuuuuuuuuuuuuugagacagagucucgcacuuucgcccaggcuggagugcaguggcgugaucucggcucaccgcaagcucuggcucccggguucacaccauucuccugccucagccucccgaguagcugggacuacaggcgccugccaccacgcccagcuaauuuuuuguauuuuuaguagagacgggguuucaccguguuagccaggauauucuugaucuccugaccucgugaucugcuugccucagccucccaaagagcugggauuacaggugugagccaccacacccagccugcaguguuuacuuuuuauuuauuuuuuauuuuuuggugauuuccuuuuaccauuagcuaccagcugucagguauuuucauauaguuuuggcauuauaguuucuuugguuagaucacacacacacacacacacguacguauauguauuguagguauaagcacuggaauuuagcagagcuuuuuaaauaaaugggcuagucuacaugccuuucuauucuuuuccuucuaauaaucuuauacuaauaagauuauaguuacaagucagacagcaauuucauggcaccuguagauuuugaguaagaaauaaaacuaacuucaguugauuauaguuuuuuuuccaucauuaauuuaauccaaauuucuuuaagauggcuaagguaaaugaaauuauauucucaauugcuugucuggucuaauaugaccaaaaaaaacuguuagagacugcuuuaauuauuugaaguguuugaagaaauuugagagaguauuguagaauuuauucuuauauuaaugcaauuaauauauuaagauucaaccacaucaaauuauguauuagucauccagaauugagagacaugguuguaaaaauaucauuaaggugugugguauuuacuuaaaauuuauuccuuuagagauaccagaauaauuauuuauaucuguuugcuaauugcuuacucuaaauguuuggucaguaaaucagaaaaauauuagagcuauccaaaggaacaaacacacugcaauguguuauaacaugccuccauugcccauaaauuauuaauacaauguuacucuggagggguagcauaauguuuuggaaauaaugcacacuccagaauaaaaaggccugaaugugaauucuaggcccaucucuuccuuucuguuuaaucccagguuaaccugagccuccacuuacuuaacucuaaauuaguaauaauuauaucugccucacagguucugagaggaaccuguagcucaguacagcaaauaguaggcacuaccucaagggcaguaaauagaauauucagucagggauccacguucuaggcucagcuuaccacccaaucccugggugucuugguggaguuguucaucucucuauauuuuaguuucuuuguaaaggggauacauuaaaauuuacuuuucucacuuuaaauauuuacgugaggauuaaaucauuuauguacaauuauuagaaaauuguauaacaguaggcugggugcaguggcucacgccuguaaucccagaacuuugggaggcugagguggguagaucacgaggucaggaguucuagaccagccuggccaacauggugaaaccccuaucucuacuaaagauacaaaaaaaaauuagccgggcaugguggcgugcaccuguaagccaagcuaguugggaggcugaggcaggagaaucgcuugaaccugggagguggagguugcagugagccaagaucaugccauugcacuccagccugggcaacagagugagacuccaucucaaaaaaaaaaaauaaaugaaaauaaaaauaaaauaguguaagaguagacaaauguguacaacauuauuaucacaaaaaugaaagcagcuuaaugguaauugaucauccuguuuuuaagcuacuagaucagagaaugugaugugcccacuuguccuuuacuguccuuaugauaguugucuuuccauguuggcacaaugguagaagcugcuguccaggcuauuuugggcaauuugagucaaaaauuagcaguuauucaauauauacaccuuuuuuuuuuuuuuaccagcagcucaaugaggguuucuauuauauaucaaggggcuaauguggcauaaguuguuuuuucuuuuuuuuuugggaaaaauccuaacuagaaaauugggucuguucuuaaauuguaaauguguguacaucaaagccauuguaaggauaaauuuaagucugauaguguacauguguacauaguuucaguacacauuggcgaaauauccugcugauugcugauugaaaacaguuguuaauucucuacuucacuaaauucagaguggaaaacuuuccuuaaugaagaacagauugaggagauccaagaccuuacugugugggaauuaauggcagaugcauauacugguaguuaaaauguuucauuagauguuaaugucuugcuguguuuuuaauuguucaggaauuagccucuagaauauuaaaaccaucuguuuguuaugaugaaacagaaugcuuaaauaguuauuaauuuguguuucuugucuuuuuuugagggauaaucuguaaaacuuugaucuguuuggaguuuagggaauuuggaauguggaagugaaaaauaauuuuaaagcacaccaguguccugaauagcugaaguaugucuuuuuuuuucuccuuacccacugcauauauuuuguguucuuucucucuuuuuucuuaaaggagggugaguugacuuuuuuuauuccauggugugaugagaaucuauuaaacagagcugguuuaauaguugauuuaaacuuuaagauuaucuucgugcauguggauuauuuuacauucaacaucaaaacagaauuuagacauuuagaggaaugaaggacagcuuacguuuuuaacucuaaggauguacuuuuacuacuauauuccacuagcucugcauaacuguugauggcuauacagacuacugcuggcauggguucuagucuugacucugcuguuucaugccuugugaucuggcacagauuagucuuucucagcuuuaguuuauuugucuguaaauugggaaguacaauuuaauuuauagcauuuuuuuuaaugcuuagaaguaauacaugaagacugcauauuugucuuuuguuuuguuuuuauagagauggggucuuacucugucacccaggcuggagugcaguggccaaucauagcucacugcagccucgaacuccugggcucgggcaauccucgugccucagucuccugaguaacugggacuacaggcauaugccacaaugccuggcaguauuuaaauuuuuuuuagugauugagucuugcuauguuucccacgcugaucuugaacuugucccucaagugaucuuccagcuucagcgucccaaagugcugagauuacaggcauaagcacauacccggacccacauuuguuuuauguagugggcauauuaauugcugucuuucuugauuacauggagccagugagauacuuuggaugccacugagaauauacauuagcacuguagcugcaagagccagaaauaaacucuucauuuacuggccucuccccuguguugauagccaaacaguggugcauuuaaguucuuacccccaaaaugaaaaucucagcuaaugucaucuuggcucuaguuaauugccagguguguagagcuacaguggagagaacaaaucuaccugugcaugagaucccaauuuaugucucugggggcccuaguauuugucuuuuugucugugaguuuggcuaagaaaaauuuucagcuucucauaaauuuauauuaaucaguaaaaucaugccaagaauuagaaguuuuauauaguugaaucuuucugcaucuuggagaaauuccauguguuuagaccaaaaaugaaugauaguugggaaauucaugguucucuuuacguuuccuuuaccucacuugccccucaaucaaaacugaauuaucucauuuccuaagucuguuuugcgcagguuaaaaaugggagggucuuuauacaucuucuggagcugagugaaagucacuugcuacaugaaagugaaguuuguuguaaaccuugagucucuaauucagguuccucagaggccaggcucauaaugugaauaagugacacaggacaauguaggguguggggucguccuugucauggugcuccauugacccuuuauaacuauagcauuagugcaguuagugcucuuguuuccaggggcacacccccuugcuaacuggacuaugcuggcacuggacgucauaugaaugauucauucaguauuaaaagaagaaucaggccaggugugguggugcaagccuguaaucccagcauuuugggaggcccagguggaaggaucauuugagcccaggaauucgagaccagccuugguaacguggcaaaaucuugucucucaaaaaaauguagaaauuagccgggcaugguaguauacacuuguagucccagcuacuggggagacugaggugggaggaucacuuuagcccaggaguucaaggcugcaguggggugugaucguaccacugcacuccaggcugagcaauaaaguaagacccugucuuauaccaucuccauagaaagcaccaucuuaaaaauuuacccaggauuucuuuuauaaagguuguuguuguuauuuuuauuauuaagaaaucagugauuguuaguacacauuuuaaaagcuuucugucauugcaggauaugucagaaaaaaguuuuugcuguagugaucuuuaacaacauaagaaaaggagugguuuuuuuuuuauacuuguuagguaaaauaaauaggauuuuuaaaugcuucauauuauccaaauuacauaaaaguggcaaucucgucaguaaguauguauaauacuaagagagcuauuaacuuuucuugguagugguuuuugaccuuuugcugaacaaguacuuuaaaaauuuucaaaugccaggaugaagacuucuuaaacuaacuguaauuaugcaacuuuuucuuuauaauccgauaccucacuaucuaaaauaucugaaauuacauaugaucacuguuucaagaacaaaaucagugauagcacauuuugaagacuauggaaucuaaaggcugauuuuguaugcucacuagcacacaugauacuuuucauguuaccauucagcuuuugagcucuccuuacuggccaaucccagaugagaagcuuuuuuuuuuuuuuuuuuuuuuucuuugagacugagucuagcucuuucgccaggcuggaguucaguagcgugaucucgguucacugcaaccuccgucucccagguucaggcaauucuccugccucagccucccgaguagcugggauuacaggcacgccccaccaugcccagcuaauuuuuguauuuuuaguagagaugggguuucaccuuauuggccaggauggucucaaucuccugaccucgugauccgcccaucucggccucccaaagugcugggauuacaggcgugagccaccaugccuggccucacaauuaaguuuauaacagggauauguuaugaacuuaauaugcuuggcuauuaauauuuggauauguucucaaauauucuagaacauaggccagaugugguggcucaugccuguaaucccagcacuuugggaggccgaggcaggcagaucacgaggucaggagauagagaccauccuggccaacaaggugaaaccccgucucuacuaaaaauacaaaaauucgcugggcauggugggcgugccuguaaucccagcuaccccggaggcugaggcaggagaauggcgugaacccaguaggcggagcuugcagugagcugagauuaugccacugcacuccagccugggcgacagagcgagacucugucucaaaaaaaaaaaaaaaguuuaacucuagugugugguauaccaguucaguucuguccucauggaaguaauauggccuuucaugggauagucacuaaugauaaguuuagugacauauaguuuauuaagauagcuauggacaguguaggggcuuagucuugaugagauuuuaauuuuuggcugcacuugaaaugaacugggaucaaaauaguggcaaguuggauagagauuugcugucagaauuaauauucaagaaguucugauagcuugcaaccaaaguauuuuauauuauaacaaauucuagaugcucauaauuauucaauuaaaauggauaaacaguaaauauauggguuagagaagaacaaugcuuuuuccagaaacaaaguuuuaaaaacuuguuaauauggcaauuuuaaaacauacaugaaaguaaagauaacgguauaaugaacccaacaucaucuaacuucaacaauuaagacauggcuaaucuuacuuccucuauaucccuacacuucccccuucccaauagguauugcucccccuauccccuggauuauuuuauaaaauaaaacucagacucaaguuaucucacccauuaauguuuuacuguguaucuguaaaggacucugcuuuuuuacuguaacuacaacaaaauguaaauaauaauuccaggccgggagcuguggcucaugccuguaaucacagcacuuugggaggcugagguggguggaucacuugaggucaggaguuccagaccagccuggccaacauggcaaaaaaaaaaaaaaaaaaaaaaaaaaaaaaauagccgaggaugguacucaggaggcugaggcaugaaaaucacuugaaccugccucggcuuccgaaagugcugggauugugagccaccaugcccggcccaaauuguuccauuuuuggucagugggaaccccuucaguuuggcucccaagccccuuugucagggucuugcuaggaugacaagguguuccagacucaucuuacauauuuccuuucucagaccuucaguuggacacuuuuaguuuuuucguguuagaaugggaaaaacaaaagauagaagacauuuucuauuugagagugguggcuauuuuaaugaaugacaggccauuuaaaaaguuauugaaacauguuuuuuaaaaacagaaaaucauaaaaaguaaguuuuguguguuuauuuuuuauauucauccuugaaaaccaaauaauauugucucuaaauuacuuuuuaauaaucaaaaucuuauuuuaagaaagcugaaaacuguacuaaagcaaucaaauauuccuucaacacauuauuuuuuacauuguguauguguauugugugugaauuucugagccuauuugaaaacagauuuaucauuuaguccaugguuauacucaaggaaugccaaaugcaaucuguucauucuggccuuucucuuuaauucuuguacaucuuuuguacauuucuauucuuguacaucuuuuuuucucuauuguuuagacuuuuuggucaaaaauuuaaaaauuuucugauuggcaguugguugaaagagauaauuuauuaucuaaagaucuggaaucaauagacaggaaugucuggcuuacuacgauaaaggguuauggagaccaacguuuuaucaugcagauaaagccuccagguaucaggcuucagagagaauaaauuguaaauguuucucaucagacuuagagagucugcucuauuaguaauucugaaagggaggagguuauuauggggcauguccggucccugucccccaucauggcuugaauccgucccucagguuagccuuagaaugcccuugcugagaggaagaguccauucagauggugagggggccuuagaauuacauuuuacagcauaauuaaaccuaggaauaguauccaaguuguagauagauaugugaguuauacaucaaacacugccuuuuacacuuccauuuucuugccuucacauuauuaaauuaugaagaaauaguaucguaauauccucuuggccuaaucauagagaguagaguuaacaauucucuugauaagcaguagaacauuguuaaguucugcugucuggauugagcgugucuauaguaaugaugucaaagucggucaguucgcucuugauuuucuuaacugcuucuuauuuauguuugagacuauauaguuagauugaucuuggcuuauuuuccuuuuuaaauuuuauuagggcugggcgcaguggcucacgccaguaaucccaacacuuugggaggccgauguggcuggauaaucugagaucaggaguuugagaccagccuggccaacauggugaaacccugucuuuacuaaaaauacagaaaucagccaggcgugguggugggcaccuguaaucucagcuacucgggaggccaaggcaggagaaucgcuugaacccgggaggcagagguugcagugagccgagaucgcgccauuggacuccagcuugggcaccaagagugaaacuccaucucaaaaaauaaauaaauaaacaaauaaauaaauaaauuauuaacuuaguuuuucuacugcuaugaaguccacugaaccccuuuaaauaaugugcauguuuggcagcuggaagcacuucagucguuuuuauuuucuaagcuaauagcacaauuuuaagucauuuccugucuaauaaugccuaaaguguuuauugggaucaucauuaacacagguaaauaacuuuccaaaguccaaacauauccaaaaauccuguuucuuacuuugcauuaaugaaacuugucuaauugcauuagagugacuuuacgauacaugaauuucaagggaauaccuaacuuucuuucuuucuuuuuuuuuuuuuuuuuuuuuuuuugagagucucgcucugucgccccagucgcccaggcuggagcgcaguggcgcgaucucagcucacugcaagcuccgccucccggguucaggccauucuccugccucagccccaccucgaguagcugggacuacaggugcccaccaccaugcccagcaauuuuuuuuuuuuguauuuuuaguagagacgggguuucaccguguuagccaggauggucuugaucuccugaccucaugauccgcccgccucggccucccaaaguacugggauuauaggcaugagccaccgcgcccagcccuaacuuucuuauuuaaaauccaccaugguaagcagaguuccaagaugacccuaaaaguacuugucccuuauuuacucccauguuuucuuauauagcacaguugacuuuaugaaaggaaguucuucuguaagccugaccuaaucaagugaacuauuaacaggaugcugacuuucuggaguaagaaauuaaacugaugggaucuuuccuuucuauaauaaacugcuuuuuuagaauauaaguuagauaccauaaaauucacucauuguaaggguacaagcuaauuaauuuuaguaaacuuaaagaguuaugcaaucaucaccauacaacauugccaucaccucagaaauuucccuugugaccauuugcaaauugguagaaucuuaaauucuugugaaaaauccuguuagaacuuggugggcuauacuuuaauauauuauuaaauuuaauuugcuguguuucuucagauuuuugcagcuuuuuaaauuaggaaggucauccuguaguuucauuuuuuguuuugucaccagauuuuggcacaaguuagcuuuccauauuuuuucauguucuggaacaaauguuguuaaaucuucuuaaaaacuuuagacugcuuaauuaugguuuugaaaguaucacuguagaauguuuacuucuguauuuagaaauuuaucuguuuuuuauuuugcuugccaucucuuuuauacuuaaauguguuagagguguaucucauaucuuuauggguuccccccagauuauacuauaguuuacuaacuguacaauauuuuaauuucuaaugauguucuucucauuuuuagaauucucuuccucugauuuuaccuauacuugccuuuuugucuuauuucuuuuuuguucauuucaaucuuuauaauuaggccauuuauuucuauucuuucacauuuaauagaaaauacauuaaguccaugaguuaacuucuagcaaagauuuuacaacauaaguuuuaaaauuuauauauuuauaauuuucauuuucuuaauuuuuaaauguuguaugugugauuuugucuuuuacccaguuguuaauuguagacagacuuuaaaaaaauucuuuaggugauauggauauucaacauaaaauacuguuauuacuuuuuaucauagagaagucuguucauauaauuuuuacauuuugaaauuuauucuuauauucuuuguuacccugguacauuuucaguuggugguaaugucccauagauccucuaggugugucucuuuaaguuacccaauuuacuguauauuaacuaagucaaacuucauuuuuuaaccucugcguccuuuuucauuguuuuguuuucuuguuccuugauuaguagaaugcuaaaggcucccaccuucuuuugcuuucuuuuauuauuuagaauauuuuuuacuuuguauaguuuuguauaaugguuuauaacuuagaaggguauaaaagguaaagacuguaccuuucaucacuauaaaaugacuuugacaggugauuuuuuuaccuauuuauuucuaaccuuuugucuuuuucccucucucuuuuuuuaaauuuaggaguucuuuguaacuaauaaauaaugggacaucaaucuguugauugaucuguauaucuauccaucucucugucuuacccaacacaaaccagauuuuuauuuuuaaaugggagcuuaauguauuuauauuauuaucagaacacuuuguuuuacacuuugcuuucuugccacuuuucuuauuuucuuucccuuucucuauuaugauuugagucauuuuauauuugguaauuauuuggaaggcaaauauuuuuaacguuuaaauuuuacuaaugguuagcuucaagauuaucaaauuguuauuuaaaacacuuucucuagcuguuguagaugauaacaaaagaaccuuugauucugugaucccagaaaaauuccuugcccugcccuuguguccaaaauuuguuaaaauaauuuuagcuuuuauucacaacuuggcacuguacacuuaaagauacaauauaguuuucuuuuuuaaaaaauaguuuuucuauccaacuuuauaauuuuacuuauuguaguuauuuuguguuugcuuauuucgauucaucagcauuuuucauuaaguuuuuuaguuugguucauguaccugucaucugaaauacgcuuuaaaacuuaaagaauaaaauaguacaaauucuauccaauccaugauacuuucccaauuuggggacaauuuuaucuugaaaaauaaaaauaguauuuuucaagauuaaauacuuggcugcuuugaugguaguguagucuauggguauauuaaaauuuucuugaaaaaggagaaucuuuugagcuuacugaaacauuccccaaauuuugcauagaguucauuuacauuccuacagaaaaacucagcagucugaaaaaggauaugugcuacuuugaggaaucaaauuuguggaaggagauuccauuuggacagucuucuacauugccugcauaauucgcaucauuccucucaaauuccaggcauagauauauucuccacauaauuuauccuucuguaaauuuuguuugauggauuaaugacaccuacugggcaaguagcaucuuuuugaaacucuccauauccaagcugaaaagaaugggauagcccagcucacaaaugccaagcagaugugcacagaauugcuauaccuucaugcagucuagggugaugggacuucguuacauguucauuagcagugacauaacuguggaucguuauuuuccuaauuagccauuaauaacaguuaacacuguaaugggaucacaauuucagaauuuggagcauauauuguugacagugaaaucuaaugaaaaacaaacuagcuucuuauauuuuauaaaagauguuaaucucauugauagaauuacugccacucaugccagauaccagcuggcuuucauuuugcauauuuuguucucauucuggugcccaaacuauugaauauauaauacucuaaugggaagaagcuucucacaacagagaguggguuauaguaauuuuuaaauaaacaagguccugaaguauguaaaggcugaugguaagaaaucuuacuguaucaguuauaggaaaagcuuucuuguaauagcugccauggaugcucauacaaaucaaugcaagcagaucaauuuuucuuagcucuuuaaauguuuaagccagcaucuggccuuugugauguuucuugguuguagguaauagcugggaauuucaggugaaggauuacaacuucugaguuaguuaugcuaccccaaacgauccauuggauguggcuaaaaugcuaguuugaaacuauauucagcugggcguggugacucacaccuguaaucccagcacuuugggaggccgaggugggcagaucaccugagguuggggguuugaaaccaaccugaccaacauggagaaaccccaucuguacuaaaaauacaaaaucagcugggcgugguggcacaugccugucaugccuguaaucccagcuacucaggaggcugaggcaggagaaucgcuugaaccggggaggcggagguugcggugagcagagauggcaccauugcacuccagccugggcaacaagagcaaaacuccgucucagaaaaaaaaaaaagaaagaaaauauauucaugggauuggaaaugaauacuucuuugccugaaaucuugugguuuagcuuuaguacuuacuguagucaguucauuucuuugaaauauugagcugucugacagcuuaaaauccuaaguuuccuuuaaacuugagccuggcuuuggaggagaagggggugguguagggguggauuuuauguaaggcucucugaagagaauucacugaaguguuuuuugcuggcagggcacugggaaggcuagcaggcugcuuccucucaguccuucuuggguuuugcccuuagccuagaucaacauuuagucagauaauuuacgucagguccacugaagucuguuuuugugccuugguaaagucaucauuuuccuuccgugaagaagcauggaaaaggcccaggugcaauguccagguuuuguuaagccaguuggauauuaggaaaagccuugacacucuuuauagucuuaguucccagcuggauauguaucucucaucuaaguugggaacugaguuuuuauuauuaguuuuuuaaauagagacggggucuuguuauguuuucugggcuggucucgaacuccugggcucaggugauccccccgcuucagccucccacagugcugggauuauaggcaugagccacugugcucagccauaaagguguugaucaaauaucaccuaacaagauuauuuucuuugugaacguacuauagucagguaccacauacaaauuuagaacauauuauguggagaguacuaauaugcugcagaaucauuacuucaugucaaauguaaacaucuaacugugcacugagaauuaguuuuuucauccauaccuuggagguaguucuaccugcccuuacuuaacucagaaucagugggauaagaguuugauacugcuuaugaauuggagggcccaugccacaugcaaacuuuauuaucaguauaacuauguuauaacaauaggcuuuuugagcuugaaaaaugugucauaauuuaaaaaauaaauaauagaaagaaagagcucuucaaagaccauaacagaggagguaagaucugagcuuuaaaaaacaucuugacaucagaagcacagagaagguaagggugaacauuccagagggaauauggugugaaaaaaaugcagagcaggaauggacaagaaacguucagggaauggagacaaggcgauguucauuguagauuaaaucucuccuuuauuaucaauauaaaagugaaaaaucgaagagaaugacaauauucugagcuuuuauuccauaguaauaacaaaagccucauacaacuugcaucugaauuaacuuagaaugaggagcuuuagcguugacugaggagaaaacuaaguacuuaagagcucaggaaggauacaaaguaaaauuagcaucaauuuucugggcuccuuugcagaaggcuucccggagaaagggauuuuagaagaaagugauaaaggugaauuucuggaaaggaugauagcaaaaaagaaugccuuguuuuggagacuuggggaaagcugacucugugaaugguauaaccaaaagugaggucugaacuguagucuuuaaagacuacaaggaauguugauucagccucacucuauucaucuugguuucaucuuccccuaggcaccauagccacuugaaauccugcaggcaaaaauuuccuacuuauugccucuucuauucuuugaaguuuccuccugucuagaaaaauggagcuuauguuuaguuugagauuuuccacguuuucauucaugcacccagcucuaauguuucuuauugucuccccaaaggaacucuguuucaaaugaaacugcugaucauuucccagcauguugcuuuuucugucuuugcuuucugcuuuucuccucaauggaguaucuuucacuguccucucagccauaugaguuuaaucuacuuuuaaaauccaaggcuucagaaaucacuucucugaaccucccuggcuacuuuuugguuucauugaacauguauuuccuugugguguuguauuugcuuaucuuuuacugccuuuuucuuguuauauuggaaacauugucaaggggcugugacuuguaaccaguacuacauugcuugguguuucugaaaauguguuuggugaugauauuguagacuaguacuccauauauuuaugacuuagucuuauguagacugaugguuuucaauuuuauguauuuguucauuuuuaauggaaaaccagagcuuguuaaauguguggaaaccacuagaacguaaacuucaugagaugacuuuuguuuuuuuuuuuuguuuuuuuuuguuuuuuuuuguuuuuuuuuuugguguaguaccauaucuucagcacuuaguucuagcccauauguggcacuuaauacauuauuuguugaauaagugcugauuuaauuuacuuaaucuguaggucuucauugguucuuuuaaauauguaguaagaaaccuccaggauguuaucucaauuaacaagaucauuaggugccaucccaguguuugaaggauaacaucacagcaucucaucauuuuuuccuaggagaagaaaacuuuauuuuauuuugcucugauuuguuucuuuuuuugagacaagacagaagaaaaaagguaagaaaucauaguugguguaaucucacuuuaguuuauucaacauuuuuggucuuuucauuauugaaaaaaaauugcaguggaacagaagaaaaaauuugauggaaagacugcuuucuaauuuauggaccuugagguuuggcuuuuuagguguuuauuuaaggcuugcccacucuguucucuacauugacauuucauggugaauauuuugcuuauucuacccucuguauuuuuucuauggcagcuugccuggcaguauucagaaacugagaagaauauuaaagaucagaaccuuaaauuguucacucuuuuuuuuuuuuuugugagacggagucuuaacgcugucgcccagucuggagugcacuggugcaaucucagcucgcugcaaccuccgccucccagguucaagcgauucuccugccucagccuccugaguagcugggauuacaggcacaugccaccaugcccagcuaauuuuugcauuuuuaguagagacgggguuuccaccucguuggucaggcuggucucaaacuccuaaccucgugauccuccuaccucugccuccgaaagugcugggauuacaggcgugagccaccgugccuggcuguucacucuugacaaggaucaaaaacaggaacuaagaagcagaccacuaacuuuuuccuuuuuucucuuuucuuuugccuuuagcucaagccaggacagaacagcugcagggacagugacagugaaagugccaguggagaauccaagggcuuccaccggagcagcucucgggaaaggcucagugauguaaguuuaaguaaaaaaaaaaaaaaaaaaaaaauuaacgaaaaccacuaggccacacacacaccauugguucaagucugaauuacauaacuuucccucaucuuuagaacuuuuugucuacccaagcauugcgguucacauuaucuuuguauacuuauuugagcauuguaguuauggugucauucuaaaaugucguuugagcaaaaauguauuuugacaaaucauuagguaggaggaacuauuuguuaccuuagaaacaacaaggccgggcacgguggcucacgccuguaaucccagcacuuugggaggcuaaagcagguggaucaccugagguuggaaguuugagaccagccugaccagcauggagaaacccuaucucuacuaaaaauacaaaauuagcugggcguggcagugcaugccuguaaucccagcuacucgggaagcugagacagaagaaucucugaacccagaaggcagagguuguggugagccgauauugugccacuguacucagccugggugacagagcaagaccccaucucaaaauaaauaaauaaauucccguuggauuucuggaaggaaaaccuugugagaaugcgucauaccucuugagauaucuguuugcccucuagaugugauuuucauuguucucuagucugcccaccaacagggcagguucccccucuauuacuucugagaaccaccuaccccucuuuggacucucuuaccuucuuuacucauaugucauauaucagcauuuuuuuuuuuuuuuuuugagauggagucucacucugucgccaggcuggaaugcaguggcacgaucucggcucacugcaaccucugccucccagguucaagcuauucuccugccucauccuucugaguaggugggacuacgggugcacgccaccaugcccagcuaauuuuuguguuuuuaguagagacaggguuucaccguguuggccaggauugucuugaucucuuuaccucgugaucugccuucuucggccuuccaaagugcugggauuguaggugugagccaccacgcccagccauauaucagcauucuuaacucaucuguaccucaagagcaacacuuggaaauucuuuugugaaauggaucaaguaaagagauuuuuuuuuuuuuuuugagacugagucuugcucugucaccagacuggagugcaguggccugaucucagcucacugcaaccuucgccucccgaguucaagcgauucuccugccucagccuccugaguagccuggauuacaggcgcgugccaccccgcccagcuaauuuuuguauuuucaauagagaugggguuucaccauauuggccaggcuggucuugaacuccugacuucgugaucugccaccucaaccucccaaagugcugggauuagagcugugagccaccucgccuggcuuaauuuuuguauuuuuaguagagaugggguuucuccauguugaccaggauggucuagcauuaacagaauaagugagagaguagcaccaugaaaaaaaagagauagcacuucagagugucugaguauuaagaauaaauaaaggauauguaauaagaagcaaaaucuuuuauuuucuccauuuuauuuuuaaaaaacaccauacucuaaagcagugugcuguucauuauagagugcaagaugauucauugaguuccagaaagaaaauacuaguacuuuuuuucuuaaaaaaagaaauuaaacuuuacuaguauucaguuuaacgagcggggaauaauugaugucuauaauuuuuaaauacguggauuuaaggaguguauacucaaaacuuuuuuuuacugagagaugucuacuaacauaaacgguuggagaccacucuagcacacugagcaguucucuaugauaauaccacauccaucucuccaucagccaagguagacaauuccgagauacaaucacauuucugcaccucucaugaaaguuugugagguuuaugaugagauguuguaugagauacuguauucuuacaggaauuaaauggaauaaaguauaauuauuuuuauguuauuuuaauauauuaguuauagauaauaaccuccccuucuucugugauauaauaucaaaguuauauaaauaaagaguacuaacaguauuuuacuguguguguguuucuguguguaagaauauguuuuauuguguguccaugugucugauuaauuuugugauggagcuauacaaccauaaaaccaugacaacuuuucuuaucuaaguuguuagcaauaauaauuaauguuuaaauagcuguuuuucugagauuuuuguuauacuuuuaauguaagaucucauugacucuagaaauuauuccaggguuaguaggucauauuuuuuucauaguguagagaaaugaacgccauguuaguuuaggggacuagagcugccauuggaucuuuuggcuuguuuccucuaacucacuuucuguuagauaaaaagaaauugacaaaagacauuccauauucaugaauagaaagacaguauuauuaagaugucaguacuacccuaagcuauuuauagauucagugcaaugucuaucauaauuccaacaaucuuuuuuugcaaaaauggaaaagcagauucucaaauacauaugaaauggcauaaggccuuaauaaccaacacagucuggaaaaagagcaaaguuagaggacucacacuuaccaaccucaaaacucacugcaaagcuacaguuaaucaaaacaguauggugcuggccuaauauuagacauacagaccaauggaguagaauggagagcccagaagggagcccauacuuauaugccuaaaugaguuuuaacaagagugccaagacacuucaauggggaaagaauuuucucuuuaacagaugguguugagagaacuggauuucuaugugcaaaagaaugaaauuggacuccuacaucgcacuauguacaaaaauaaacucaaaaugaaucaaugaccaaaauauaaaugugaacaccauaaaacucuuagaagaaaauauacagguaaaucuucaugaccuucaauuuggcaguggcuuauuagauaugacaccaaaagcauguacaaugaaagagaaaauaaauuggacuucaucaaaauuaaaaacuucucacaccaaagagcauuaucaagaaaguaaaaagacagccuacaaaauggggaaaagauuugcaaaucauauaagugguguuuacucuacagaauguguaaagaacuacaacucaauaauaaaaagauaaccuaaagcaaaaaugggcaaagaauuugagaaauauuucuacaaagaaguacaaagaagagguacuugaaaaaugcugaaaaucauuagguauuagagaaaugcaaauuaaaacuguaacgagauuaucauuuuauaccuaguaggaugguuaugcuuuuaaaaagagaaugaaaaauaagaaguguuggcaaggauguggaaaaguuggaauauucauacauuacuggugggaauguaaaaugacgcagccacuguagaaaacagcuuggcaguccucaaaaagcugaaacauauaauuaccauaugacccagcaauuucacuuuuagguauauaccccaaagaauggaaaacaugaacuuaaacagagacuuguaagccaguguucacugcagcauuauuuaugguagucaaaaaguagaaacaacccauguguuucucaacaaaugaauugauaaacaaaaugugacagcuuggcugauaggcacacaauggaauauacucagccauaaaaaagauuggcauuguaauauauacuacaauauggaugaacuuuaaaaauaugcuaaauaaaagcaagacaaagaaggacaaauauuguaugauuccacuuauaagagguaucuagaauaggcaaauucauagagacauaaaguagaauagaacuuaccaggaauuugggggauggagagugggagggaggaaagcuauugcuuguugguuacagaguuucuuuuuggggaugauaacaauguuuuggaaauagauagucaugacaguugcucaauguuuugaauguaauuaaugccacugaauuacacaauuaaaaaaugaucuguuaaaaaauguaaaaauaauuagggcuguaauaaugcuuauucugcuuucacuucauugaaaauauggaaaauaguuauaacuuuuaccagccuugucuacuaauugugucaccugugccauuucugguccuguuucuauugguuguuuuuucucuucauuaugggucauauuuuccugcuucuuuguaugccuggcaguuuuucauuggaugccagacauuauaaaauccugucagucuuaugucaagccagucaaugaaacacuuccgauucauauuguuuauuauauuuuaaaauuaugaaaaaaauuugugggcauauaguaggcguauuguucauuaauuauuaaaauucacacuuuuugcaacauuacugaaaaggaaagaaagaaaaaugacccaaaacguggacauuuacugaaauguuuugagaucccuagucacauuucccucacucaugugcaggucugagguugcagaguccugugucaagcacuauggcaaucugaaaucugcugagaugaaagcuuuuuuuuuuuuuuuuuuuuuuuccgugacacggaguuucgcucuuguugcucagccuggagugcagcagcacaaucuuggcucacugcagccuccaccuccuggguucaagcgauucuccugccucagccuccugaguagcugggauuacaggcgcuugccaccacgcccagcuaauuuuucauauuuuuaguagagaugggcuucaccauguuggccaggcuggucucaaacuccugaccucaggugauccauccaccuuggccuuccaaagcgcugggauuacaggcgugagccaccauguucggccgagaugaaagcuuuuaacaaaccaacccacagaauggaucuuuuggauaccaaagcaacaccuaccugcacaauauuuuagagaauaaagaugccccauuuuuucuugaaagagaauuaacaauuaauuuauuuuuuuacuuuuauuuuaguuuuggggguacaugugaagguuuguaauauagguaaacucaugucacagagguuuguugugacaugaguuucaucacccaguaguacccaauaguuauuauuucaucacccagaauuauuucaucacccaguaguacccaauaguuaucuuuucuacuccucucccucuuaccaccuuucacccucaagcagacccuagugucuguuguuucccucucuguguucauaaguucuuauuauuuagcucccacuuauaaguaaaaacaugcaguauuugguuuucuguuccuacauuaguuugcugaagauaguagccuccagcacuaucuauguuccugcaaaagacaugaucuuguugauuuuuauggcaauguaguauuucgugguuuacauauaccaaauuuucuuuauccaaucugucauugaugggcauuuagguguagcccguguauuugcuauugugaguagugcugcagugaacauuugcaugcauguguuguuaugguagaaugauuuauauucuucuggguuuauauccaguaaugggauugcugggucaaaugguaguuaugcuuuuagcuuuugaggaaucaucauauugcuuuccagaauaguugaacuaauguacacucccaccgauaguuuauaauuguucccuuuucucugccaccuugccagcaucuguuguuuuuugacauuuuaauauuaauaauagccauuugacuggugagaugauaucucauugugguuuuugauuugcauuucucugaugaucagugauauugagcuuuuuuuguauaggcuuguuggcugcauauaugucuucuuuugaaaaguaucucuucauguucuuugcccacuuuuuaauggaguuguuugguuuugucuuguaaauuuguuuagcuccuuauagaugcucgauauuagaccuuugucagaugcauaguuugcaaauauuuuucucccauucuguagguugccuguuuacucuguugauaguuucuuuugcugugcagaagugcuuaaguuuaauuagaucccaguuguccauuguucccuuuguugugauugcuuuugaugacuuugucaugaaaucuuugcccuuuccuaugugcagcauaguacugccuagguugucuuccaggguuuuuauaguucuggguuuuacacuugucuuuaauccaucuugaguugguuuuuguauaugguguaaggaagggguccagcuucaaucuuuuuuuuuuuuucuuuucugagauggugucucgcuccgucaccagguuggaaugcaguggcaugaucuuggcucacugcaaccuccgacucccugguucaagugauucuucugccucagucccccgaguagcugggauuacaggcaugugccaccaugcccagcuaauuuucguauuuuuaguagagacgauguuuuaccauguuggccaggauggucucaaacuccugaccucgugauccgcccgccuuggccucccaaagugcuaggauugcaggcgugagccaccgcgcccagcccagcuucagucuucuuuaaugccuaucagagagugaaaagguagagucaaagaugacuacugguuuuuguuuuuguuuuuucuuuaaaaauuccauauuaguucuuauuaugcuuauucuucuuucacuucauugaacauauggaaaauaguuauuacagcuuuuacuguccuuguguacuaauuuugucaccugugccauuucuggaccuguuucuauugguuguuuuuucuccucacuaugggucauauuuuccugcuucuuuguaugccuggcaauuuuuuauugaaugccagacauuauaaaauuuuccuuguuggguacuggguauuucugguuucuauaaacauuacucauuuugggauacaauuuuguuauuuggagauguguguguguguguguguguguguguguguguguguguguuuuuaauguuugcuuuuguacuuucuuggacaagaccagaacaaccuuuagucuaaagauaauuuuucccccauucugacugaguacuuugccuaaugccuaacgucuuacaagguuuuuccacuguagauugugggaaaacaaacuauucccugccuugugugggcuuuguaaguucuuccuccuccuucccaguggugguuuuccucgccuuggguauuuucucucacagaugugcugacuagucaucagguagaaacuagaggggaaccuucugcagcuuucaugauucucgcuuucugugaugcugucuccuccuuauccucugccuuggaguuccagcugucuuugccuccccuuauucucaacugugucuucaagacucagggauuccaccugggucaccuccuacccggcaaucauguggcaugaaaacucuccaggcaguaaggugggaaaauuuuaagggucacccuacuuuuuucucuucucucaaauauuauuguccuuuacucugucuuacccaauuucuaaaaacuccuguuucauaccuuuuguccaguuuuuuaguugcuugaggugggagaauacauucagucccuauuaguccaucaugccccugacucguuuuucagcuaagaugaaaauuucugucagccuuucacccauuuuagugauauuuuuaggagcuuuggcaguugagacuuacucucaagugaggcuaaucaaaauaguauauuauucuagcuuuguuuuuuugaauugguuaggccaaaagaauaagaauaaagaauuccaguguagcuguauaauuugacucaugcguaaagcuuaaaaacaccaaauauguggccaggcaugguggcucacgccugcaaucccagcacuuuuggaggccgaggcaggcagaucacuugaggucaggaguuggagaucagccuggccaacauggugaaaccccgucucuacuaaaacuacaaauaaauuagcuggacgugguggagcacagguacucgggaggcugaggcaggagaauagcuugaacuugggaggcagagguugcagugagccgagauugugccacugcacuccagccugggugacagagugagacucugucuuaaaaaaaagaagaaaaacccaaauaugcuuugcuuuucuaaauuauauauucccagaccauguugccuggggggaauaauuggccacaaggacuuucagauuguccacaucaaggagacauaguaacuuguuuagauuagucacuagggaagaguuaaggggaauaauugaauauauaguuaauaaauguuuaugaugaguuauucacagggaaaauauugcuuccaacuuaaacagaauuuuguaacugaggaaauuugucaaaaguuaggagcaaaacuuacuuaaaaacuuuuaauaaacaagccucaaauuaugaaauguuaaugggcauuuauuauaaacaggccaagauuuaauagaaguucugcuauuuauugugugugaccuuaggcaaagaaugugaccuuucuuccccgccaagauggagucuugcugugucgcccaggcuggaguggaauggaguggagugcaauggugcgaucucggcucacugcaaccuccaccuccuggguucaagcaauucuccugccucagccucccaaguagcugagauuacaggcauacaccaccacgccuggcuaauuuuugaauuuuuaguagagaugggguuuuaccauguuggccaggcugcucucgaacuccugaccucaggcaauccacccuccucggacuuccaaagugcuggauuacaggcauaagacacugcgccuggccuuguucgcacuuucaaaucuuccuaccuuugcuuauucuuuuuauuuauuuaaaaugaauugcaguggcaugaucacagcucacugcaaccuugaccuccuggguucaaacuuuucuugugccccggccuccugaguagcugggauuauacacaagugcuaccaugcuuggcuaauuuuuguauuuuuaguagaaaugggguuucgccauguuggccaggcuggucucgagcuccuggccucagguaauccacccuccucagcccccucccaaagcccugggauuauacacaugagccuccacgcuuggccuauuuuauuucuguucuuuuuucuuucuuuguuuuucuuuuccuuaugucagcuucaaccucacuucuaccaaacacuucccaacacacuguggaaguaaacuucuuuaaugcuuuauuuaaugacuauaugaauaugacucuuuucaccuuucucucugaaagaauuuuggguuggguuguuaguuaugagaagacagaaaaauauuuaacaccuuucaaggguucagaucguucaaggaauugaaacaucucagaaaauaaugaaaauggaucaaagucuuaugagucuaaugcuacacaguugucuacucuuauuauucugguagcuauuuacaguugagacauuuuuucugcuuccuuuugagauaccccuucuccuacuucaaaucuucccuggucuuuggguuuuuauugauuugucuaucccacagugccacuguucauccacccaugccagcaucuguccuauucuuucuuucuuccucccuuccuucucucccucccucccucccucucuugaaaucuuuauugagguuuuauuccaugccagguuguuugaccagcuacuguuaaggaggaaacagacuugagccacuaccaugaaugagcuucccacauuguuauaauuagauuaggaaaucuaaucucgaccugacaaggauucuugguguuuuauuccucucuuuuuaaaaaaaucugugccacauuuuccuuuuccuuaacaguuugcuuaugccuuuuuccauuccugucccauacauuuaugaauucuccuggauaugucaguauuucaguugccaagaaaugucaaucaaauuucuuuuauucaucagguauagucugggcauuugagguugaguggagaacaagaugaaaccucugcccucaugaaguuuccauucuagugggagagacaaaucuauuaagaaauagcuacaauuuuuucuaauagaauguuuucugacauaaacaauaugaagggcgggaguuuguugcuacuuuaacuagugugauuagauaaggccuuucuguguaggugacauuaaaacugaggccuaaguaaagaaaagaagguagacaggugaaggucuaugggaagaacauucugggcaacaggaacaacaagcuuagaggcccuaucagaagcauguuguguucgagggaaagaaaaauggcuuguguggcuacaguagagugaaguagcacaguggcugaacacguaacuucuagcccaugcuaaggaggcuggguguuguauuaauuuccugggcugcuuuaaugaaugaccacaaacuguauggcuggaaacaacagaaaucuauuaucucacaguucuggaggcuagaaauuuaacaucagugugucuucagggcuauguacccucugcaggcucuagggaagaauccuuuuuuucuccuggccucuggugccucccagugauccuugguguuccuggcuuauagaugcaucauuccagucucuucuuuaguuuucacaugguuucuacagcagccauuggauuuacagcccauccuaaaucuguaugaccuuaauuagguacaucuaaaaagaccguauauccaaauuaugucauuguauuagacuucuccacagaaacagaaccacagcagaagauaacagaaccagcagaacaugauuuauuaugagaaauuggcucaguuuuggaggcugacaagucccaagaucuacaaucagcaagcuagagacccaagagaaccuauaguauaacucuagucucaaggcuggcagguuugaaacucuugaagagcugauguuuuuauugugucugaaagcacaauaaagaacugaugucccaggucaaagccaggcaaaaggaauucucucuucucugggagagagucagccuuuuguucuuuucagaccuucaacugauuggauaagucucacccauuuuagggaggacaauccaguuuacucagcauaucaauauaaauguucaacucaucuaaaaacaucaucacagaaacacccagaaucauguuugaccaaauaucugggcaccccguggcccagugaaguugcaacauaaaauugaccaccacaaucacacucugggguuccugguagacauaaacagggggacauugcucaauccaugacagguuauuaucuuaaaagccacuggacuauguuaaaaggauuggaguuguaguucuuacuuuaaaauguuuauuuugccuuugauaugaggaacuguccaugaagacaagagcaagaaugaaaucagagguagaagccagaaggcugagaugagaguuggugacaaccugacgugggcauaacagaagguugaauaauugguguuggaagugacguagcauuuuucccaccugaugcuuuuaucaaguuguugcuccauuuuuacuugauuucuuccaacaacuauaugcuuauuucucaaucaaauauauauauauauauuguguguguguguguguguguguguguguuuggucggcuauuaguaaucuuaucuccaagguacguuucuuuggauuaagauuucagguuuuuaaaacacuacuggaagaucugugaaugagcuuguuuugugaccuuugcaagaaauuuacuuguucaugugauuccuggcaugguccuucuccuuuuuacucccaagagagaaaagcauaacaugaagguggguagccaggaauguugaacacaauuagcgauuuggaagaauuuaaaaauauucaauuuaaauuagcccuagggucagaacacacauucucaccuagggguggaguacacauguguccugucuguacucagggagcuguaacaguagccauggccucucuguguggauuuauaaugaauggagcacaucuauuuuagauggauaaucaauuuugaaaucccuuauuguaaguaugcuguuaaaacagaaauguuaacuucaugaguuuaaugaguagcuucgaugauagcuuagugaagagauggaaggaaaggcaaguggggggaaaugagaaaaggagaacaaguguuuaaugaauaucuacuugcagacuugaaugucagcagcaacauucucccuccuggaaaaugucuuucaacugugcaucccauuauguuccugcagcccgugguagcaugaagauugagacaaagagaguguuucuaagaaagcucuccuuuacaauauaaugagauggagguggguaguuugcagagauugcuggagcaguggucaaauaugaaaaaaaaaaauccagcagaaugaaaagaccauguuaaccaggagauggcuuauaaugagcccagaaauugcauaucagauagccagcuggcuagcauuuccucauaucccuguguucucaugcaaacugcuaaaauguucuccuacucuauuuucucagccucuuaauaguucucauuucuaccuacugcauugaaaauaugaaugaaauggcaacucuaccacuugaagaaauaagaaugaagcccuuuucagcaaaaguauuugccuaaacauggauggauauuauuucaaaugcuuuugaaaccaaggaaacuucuguuucuuuccuuaaaaaaacaucuuaacuuucaagucucaguuugacucacagccuuuucaguauucuguggccucuuuugcuauauaguuuggacagacuuugcuugaagucuccaagcaaaaaaauggaaguccucccuucuuauuggaaauugauaggggaggcuuggcacggcgccucaugccuguaaucccaacacuugggaagccgacacaagaggaucacuugaagccaggaguuugagaccagccugggcaacauagugagaugcuaucucuaggaaaaaaaaaauagcugggcacaguaucgcaugccuguaguccagcuacucaggaggcugaggcaggaggaucacuugagcccaggagcuugagguugcagugagucaugaucuugaucauuaaggaagagucuugugaaauuguucaauaguuaggguauuaucaccugucuacuuucaugguucuuuaccuuuuggugacugucucuucuuuggugacugugucuucuaaaaugagaaagcaguaccaaucccuaaauauacaucugucaauaacuuacagcacauuugaaacaauauuacugcuguuucuaaacauuccuuuuuuuuguuuuuagcaugaucuguuguugccuguguucauauaauuucugucuuggaaaauuauugaagcuaccaaauauuugcagcuguauuuagauauagacuuuagauuauaaauauaugacagagacucuuuacugggccuuuuggaugcgagaccucagggauauaugauacguguugugagccucagcuaaagucugacuucccuguggcugguaacuucuguuaccaauacuuuaauggugggguccuguuggugaccaggcguaauaucucacugaauacaaggccguagucagaaucuugggguuguaggacuagacaagcagaagucucuuuauuuaauagaugucacuccuguuaaaauucuccagcuaugacugaagggaguuggcaaguagccaagaaaaauguggugaaaaggguuuaagaggggaggaaaugucaaugccauggacauuuggcaaagucgaucacaagaggguuuuucuacacauguguuuucugcugauccugaaaucaaaacugaauaccaugcaucuuuucccuuaaaaaaaaaaaaaaaaaaaaaaaagaguacaguagguuggcacaugugaauggcuccugauacgagacucuguaugcuuucuagcaaaugcugaaacaaauuccaguggaccuuuaauguauauggggaucuugugucuguguucccucgugugucuguguuugugugugcccgugucuaggggaggggaguuauaaggcagggugcuuaaaugcuuuguuacauuauguuaauuccucggcagugcaaucaaauucaugucguaauuaaagcugucaguuggaaggcaagccaaucgccaugaaaacacagcauaacaaaugaagugaaaugauucugcguguagcuauacaaugcuucgccaggcaugaaauuaaauaaguaauuugauguugacaucagaaauugaaaugauacccacuguucccucauucagucagaccugcauaaacaauagccagaacaaauaugcacaacaaagcccucuucuccacccagcucccugaguaauguacaauauauaugcaaaacgagcauaacagagcuuuccgagaccugaaggauguaauuuucuuugguauacgauaagaugauauguauguggggguagggaaguggguuuggugggaguacuucucuuucugggauaaaauacauuugcaggaagggaaagaaaugaaauaaacaaaucccauggucucucugaguaauucauccuaaaaugaguucacuucccaggggcaugacuccaagcugguggagaccuaacuuggcuuuugcuuucuucugcugcugcauggagggcugugggugcuggaaacaggugaugcugucauauggcuagucacugguaugagaaguugucuccaugacuacuguggaucucccuccauaccauuuaugggauuaagaaugcagcaggauuuuaaaaaacugagugcagugagcaggaucacacaucuauggugcuucauuccccugagcuugugugaaacgcugagaugaggaaaguuuugcuuugggagcugcauuuaggaaugccuugaagcauacuguucuuguuugauguagauauaguuacaguaccauguuuccuccucaaagagcuuagcaucaagaagagucaccaucugcuguauuuuuauagaugucaaauucuccugagccauuuuucuuacacauaauccauccauucauuuauuuauacauucauucaauaaguccuuauuaaaugcauccugugugcaagucauugugugaagcucuaagaagcaaugaugaaaaagccagcugguuacugcugucugaaguuuccagaguagggggcaggacauguaggcagaagagcuagcagugaacagaguaacuguugcaucagggcagaggucauuuugcuucugggaaaguauaauacccaacccaagcucaucagggaagaagccuggcuggugcagggaugcuuagcugagaccugcagaccuauucagcauuugcuucaccuucauuucaagcuuaaucacaaagaggaagaggaugcuaaaaauuaaauaauuuauaaagagagguuuuaggagaaaaaaagaaacaaaaaucagaaucucaggcaaguuuaaaauacauuuuuugggggggcuucuuuucccaaacaagugaugcccugcauuccuuucagaauuaacauuuuuaaauucccugugugucagaacuaugacagccuaaacugguaauucuugugacuuaaacccuucagaaaaauggugcuuuucacugcuccucuuggcccacacauucucugcauuuuagucuacuaauuacguuuacaaaaugucucauuuuugaaaagcccuguguguguacuaacugaugccuuuagggaauaaacuggcaaguaggucauacacuggaaaagucauccaaacccacugggcuuuuuauuuucaagucaaucugggcuuuuuccucuugccugccccuuugcggccacaaaacugaguagcuugagaccagggcauugaaugucagcaagucagggaggcaagcugaugcgugucuguuuagucucagugcagggcgaaaugccaucauuaauucauuacccagcugccugucaaauaaauuggcaauuacauccaccgcagaagcuuggaauucaguaaauagcacguuagcaucucugaguuguugagagauguaaaggggaaaauuaagcaacacgguguuuguaucaguagcagaugacaaggggcagcauacacuggugaugugauguggugaugaaaagccugcaaagggcugguaaugagcuguguggauuggaacguguuaaaaaccauugcugauuuuccacuuuugucuuuaugcuuuauugcagaguucagcuccuuccagcuugggaacaggcuacuucguaagucuaucucaacuuccacauaugugccuugcauuggcauugauuuccuucuauaaugaaugcucauugggauaugaaaaaaaaucugagaauuucucucucaguccuaaagagcagacugauuuccauucuuuauuaggaauuguuuuauuuuuagaagacauagccugcugggcccuagggaucuuaaguaaguccgagguauauaccugguuccuaacgcccaggacauuaagcuccuuaccuggccauguaaggagauacagggaacccugauuagcucaugccaccauuucuccacaauuacuuuuuuaguaagaagugucaugugggggauggaauucagauuaugcauugagauaacugauuucuugaauaacaucucuucauauacaaugaguugccuuuuuugguggggaggacggggaauggagaugguauuuuuuaaugaauguuuucccucacagucuggguaguuugccuuuagguuuuucuuucagcaauaauuaauauacuuauuuuugcuaaaaugcaaaguuuauuucugaaccuuauucucuguccuuugggaaagauggcagugaggugacccuucagggauuaucacaauauugugauaaucaugaauauaaaauucauucucaaacagcaguugucacuucauuauauuuauuuauagugaaauucuccuuucuggauuuagugacccuuuucaagauacaaaugaaaaagagugacaaauaagcauuauuuguacaauaggauaacaugucaauguaaaagucuguugugaugcuuaaaggaaucugauugguguucugagugaugaacacugauacagucaugccucaguauuuucugagaaaauagugaaaucaugaaaaucaaauaaaguggaaaauaauuacuaauucacuuuaguugcuuuuaacuuuucucuccaaugcuaauuacucugguuuucuucugcccacguauuucucucgauacauuuacauuaaauuuauggaaaccagcaucauuucauuaauaaaugaguauuuuccaagcuuagcaaaaguggcauuuucuagauguugacuuuuuuuuggucuuaaucuguaauaggagaaaaaguauaaggaugauuuggaccugcuuaauacaguuagcacacuuacccuugcuccuacuuauuguggcugaauauucaugcuaacagaaacaagcaggauacauucaguauccugcuucagcagucgaaauaacagacguagccccaucuggcaucucuucacaccaggcuggauguagguugagaugcuggaaguaaaaucuggagacugcgauaucuauucuccauccaaaagcuaaagccucccccuuugcuuucuucagcagaaagaaggccaaagccacuaccuuaguccuugaucacuucuguacugaacauucuaguauuuuuuuuuuauugucaguaggaucacccugaaagaagaaagucauuucuagaaacauugagauuuucauuaugcuuuuugcaguuauuuuucucucuaguuccaagaaugguuauuuuuauucucuaauaauauauucuuaugauuuaaagagucuuuaauuacaugucuauuaauaaaauggcuuuuacagaacauuggaugaguauaaaaguuuucucuuauuuugguaaaauugcugguagacuuacuuugcuuacauaaaagucugucguauuauuagcuuacauggagaagauacauaccagauguguauucagcuuucaacugugacaaaaaugcccugcuaggauguguuuccaauaaugugauuguuauguuaucagagugcaaaauccauugauauuguugcccaguccucaugaaaaguaucuucuauuucaacuuucuuuccaauaguaucacauguaauaauuucagauacuaacuuccacacuggugaguuucauacuucuaaguggaaaugauaugggcacaacuuacauuaguucuuugccaacauauuauuuacacugugcuuugugauuugugcugucauaauagcuuuuuacuuaagccuguaaagaaggcucagcuucagguaagugaaaugguaauuuuucaagucuauccuuacuccucuucagcaugucuuugaaauguggauggagggaaaucaccugcagaguccaugagcuauuagcgcaauugaaccauaacaugaauucugguguaagaaagcugaaggcacuuuuaacaaucuagaaccguuuucuugaacacugucccaagccccaacuucacagacuuccuuuguuucuauuuagagcuuuugucaacagagguaagaugcuguucauuguguuuguuaauaaaauagacaccugaguauauacaugugcaggugugugugcaugcacacacacgcauacacacccuuagccaaaaccaguauauuuuacuuucaguucuuuuaucuguagugauacauucaaggguuuaaaggagaagccuuuguuuuugaucugguuguauuuguuuauaucuccuugguuuuguguuccaaagaugucugcuuaggucugucacuuuuccaauccguuuagaagcagaagauuugagaaaugagaacagcagcucaaaucaguauuuacauaagcauauugcaaagaauucuuaaaguagacaaaauagagaaggauuggaacaaacuuucuacauuuuugggagcuuuugaauaauguggguguuauacacacagagagacacacauauauauucauuacauacucaugcccagcucauauucuaaauauaaaugaaaguauagacuaguuggaaucgauuugcuuuuuuuuuuucuuuuuuggcaagaggacuaaaacuuguuagaguguguguaggauuuucuuuuuuuuuuuuguuuugaacgucaaugcaaugaacacauuuucuuuucaauuuaaacguuuuaggcuguauuuucuccuuaaacauguauuugagguuucaauuugcauaguguauaauuaagaacuuagaggcagaaugaucuuuuaagacuaccuguaugaccuugguccgguuauuuuaugucucugagucuauuuccuuaucaauaccuaccuauuaguguugcaaauauuaaaugagauaagauauuuuaaugaacacagaauaucacucuauacuaccaaauaauaaguacugccuucuguuauucacacaaucgugugugauggagcaaaguuggucucaucagguggcugugcaauguugugcaaaguagguuuuauaauuuguaccuguaggauaguaguauuuuauucuuauuauauucuucuuguagcuuucucaggagcacagcuuuuguauuugaucaguuauuuacauuuuuucuguaugugaacauaaaacaggguauucauccucugugauucuauaugaacaugacgauguuggaaugaacuguucuauuagcuguccacauauuaugguuguucucuguaauuugucaguuaaaguuacuuguguauuuucuuccucagaagcauuugaaguacuuggagcuuuuaaagacugcuuagcagcuuuuaggauugggcugagagggaagguacaccuguucaauauauuccacuuuuaugaacuuguaucacauuugcuccuuucugacaagaaaaagaaaaauugaugcccuagcauauaugaacacaguaacugaaaucaguagaaugaaaagaccagugagaacauuucguguuggccaguggucugguaugucaucacaggaaagaucuggacucauucuuuauagcacuugacuccauguggaguugggagcuacuuuuggggcaacuaaccagccaggcagaacuugauuccugcuguaagggaaguacagccuuacuuuuuuccaagugacauguucugccuucucuggauaauuuucagcccucuuccagguuugaaucuaacugucuuagaaccacagccucaaauagcuuguauccugcuuuuguaaacuccauaauuucucuuaaggauucucaacuaauaauuuucaucuuccucaauugggucacaucuaguaauugacauacuuuaaaguuaucagggaaaacaacucacuucuacucagugauuaaaacugccgcauuauauaguaaaggggaauuguguagugguauacaucuucagacgggauuuguauaauuauuguuuuccugugcaguugaauuacuuaaguuguguagguagugcugguaacaggcaguaggugcaaaauauugaccuguagcuuuccauccaggguuauaaaggucauagugggaauauucuuugccccuuucuaaguuuuugacuauaaacccuugaaauaucuccuguuuuccuuugcuauaauuuuguauaacuucuucuuuuuucuuuuugacagggucucacugugucacccaggccauagugcagugguguagucacagcucacugcagccucagccuuucugggcucgggugauccucccaccucagccuucccaguaucugggaguaaaugugcaugccaccacaccugccuaauuuuuguauuuuuuguagagauggggcucuaccguguugccaaggcuggucuugaacuccugggcucaagcuaucuacccaccuuggccucccaaagugcuaagauuacaggcgugagccaccaugccuggcuguauaacuucuaaaacugauuugguauucugucuaaccauaguugcuuuuuaaccauuuucccauuuccccagauaauacucaccaguggugcuugcggcugcaacauuuaucuugauguaacugccagaaaauaucuugcuuuuauuauuuucccauugcucuaguauauugacuuuggaaacaaaagacgucauucuacucauagcauucuauuuucaguagugguauuuccauuuauaaaauauaguaauuuuuauaaaugccaccaugcccagccacuuuuaaauauuucugacacauuguauucauuuauuuucugggggugaauucuuuuauuagaacauucaaauuaauaauuuuguuugguuugcaagaaaacugaugccaucaaggaagaugaaaaguuacuacacaaauuucaacaaagauuucuauaauuuauaaaugagggcugggcacgguggcucaugccuauaauccagcauuuugggagacugaggcggguggaucacuugaggucaggaguucgagaccagccuggccaacauggugaaaccccgucucucuaccaaaaaugccaaaauuaacugggcgugguggcaugcaccuguaaucccagcugcucgggaggcugaggcaggagaaucacuugaaccugggaggcagagguugcagugagacaggauggcgccauugcacuccagccugggugacaagagcgagaucucaaaaaaaauuuauaaaugagguugaaaauucauuuuuuaauuuaauaaucccagucucagaugcccuuucauucuuugaauuugcauaucucuauaauauuucucuuucaaaauuuucugguugucuuauauauaauaccuuguauaagcugaucuagcaguggcuagauaggaucagauucagguuuggauuuuggcaaggaugccucauagaucauguugugugcuucaauuaggagccacauauuuaguucuuuauuuuuauuaauguuaacagccauugauuagacccaguguucguuaggagcugcaaaauggugauauugcaguuccaucauucuguaaagagaaacaucuacauuaacuacagguauuugguuauccugagguacaguuaacacacuguauuugaauaagaggguuugagcucuccagagaaccuaucacuauuuauaagauuucuuagggguuuuaguuucagaaguacagauacaucaacuuggugcugacggcagcuccauccaaagcagaagaaacugucuucuuccccacuuggcaguacuugcugugaugcuaggaaaggauuuuguaauucaaguguucauucaucaccuguuaaguacuuauauuuaagauaaauaacauuaaguauuuuaacacuuccccccaaauaaagacccuaaucuuuguauuuauuaguaauuaacacuagguaaauuaauuuuuggccauuauauauugacaaaaaucuauuauaauggaaauauuuuugaaaaucuaaauuuuaucuagaaauccaugaaggauauccaguuauuauuagggcauuuggacuaauugauaaggaguugaguuggaaaacuacucuccagauggagauuucaauucauuuuaacucacaaguaugacuuaaauaucuacucuuaguucuuaaguugcauaacguguaagcauggcucucaagucaaagauauguagcugaauuugaagcaaagcaaacugauuggucuaugagaaguguaaguagagcacuuggaaguauaaaggagggucaguuaaauguagcaggcuuaaauugugcagagcuugauggauguuuagauagucaacaggaaagaaaggguggaacaaguuugaggcagggggagcaacaaagacaagaauacagagaaauugcauaauaguguggauugaauugacuguaugaugucucuggagaaagacgggacuuagauugucagggaauguugguugauuacagggaaugugggauaaagccagggagguagucgggugaguggggaagagaugguuuguagagaaggacgucaaguaaaggaucaaugacuacaauacucuuacuuggaguuaguccccagaagaggagauuugaauguaggaaaauggugaguuuggaaguuagaauacguaguuagaaauuuaaguguguauuuaaguguaacuuaaaaucuaggacauuaccaaugccuuugaagcuaccuguguacugugcagaaacaucugggcaaacgaaaguuguugcucucccuuauggugaaacauugucacauuuuuuaaauguaaccuucaaaauacuacccuuaacuguguuuuuuccuccuaguaacaaaaccagaaucuaaggugcauucugacagacuccuccacguggcgcagauaaacucucuaauuucaagggccuuagacagaaaauauaauuguauuucccaugucuaauucuuacccuuuuuuggucauguuuuugaucuguuaacauuuuaauugagggaauaggaucagugagccaggagcagacacaccuugacuaaaugaacaguacaaguuaaacuguggugagagacauuuaaacauuuguagaaucucuacaacaggaugacuuuuccagcacacucuguagaaauuaucuucugccuacacacuauguuuaacuucagcuuccucauucaguacaagggaacugagaaauuugacaaaaaauaaucaggugagaaaagaucaauugguguuuccaguugcaaccaauaauuuuaacccuuucauuuucucaacauuuaaaugagggaauaggcuggguauuuuuaaacauuugcugucuacaggaaucuuugacauugcuguugcaaacucuuuaaggagauaagcggaaaacuuaggugcuacugauggauguggggaaauagcccucagccguuaucucucuguccuccuaacccccaucucuggccccucagauuuagagggaaaaaaugauuuuggagaacaaagauuuaaugagccacuaggcaagagaguggcuaaaggaccuuaauuucuaauauuucaaaauuuaugauuccagcugccuuacaacuagaugucugccaugugcaaccauugcuuguugcuggccucacugccuuucuuugcuguccuuugagccacaggaaugcaaggccauagugcugcuuagugaacacuguucuucacugucaacauugaaaggaguccugauuucaacggaguggccgagucugcuuuuguuugaaaguaauguauuuuaaaauucauuaugaacaauaaugcaauuauucauaaugaauaauguuuuauauuugcaucauucauuuagggcuaguacauagagauacugaagcuguuggcuuagccuguuccauagcuaguagauugaucauagagaugaagcgguaaaggcuuuagcacagugcauugacagucccagagggaauggacaggucauugccauggaauucugaaaauaauuuuaucuucauuuucaucuuuuuuucugacauuggcuuuaaggaagguugucuuauccuuguuggagauuuccacauuacagaaauuuguugcauuuguugauacaagcuauguaaaaugacccacaggcaaugucaauuccggagguuuacucugauuacccacacaacccuuauuuugauagauuuaacuagccuggaguuuuauugacuaucacucagaaucuuucagaucagagaacucacuccuuugcuuaacuacuuaaaaaauauuuuugcugaaauuguaaauuagaugccucccaauccauugcauaagaaacuuauagcuuggugaaacaccaagaguaucauuugaaaaagagguuaaaaaacacaacuggggcuuguuaaagaggaaaagugguauuuuaacuccaagugucacauuuuccuauagucagcucuagcaguaaacaagaguuauuggaggcuuagauaguuugagacacuucacuuaucucccaguacuugacuucagaagccaaacauuuaaaauguguuuugcucagguaaaaauguuuauccauuuaaaauacaaugucauuuuaacaaaagcacccuggugacaagcuguuuagauauagcacaguugauaaacugucagauccuguacacauacacuugaaaggaccagcgcaguaacacaaggauuggcauuauaaaucacuguuaacaaaccuuaauuugcuuaguaggcuaaugaaugaucuccaauuuuucuucaguaauuagcuucgcuaacagccaugucaaagggaccuuccuuauacuguauuuaaucucugcucugaaaucuuuggugucuaguuugcaggaugaauaaaaacaaacaaaaaacauuucggucuccauuggcgacucccugguaauaaauccagauguagggauuguggcuguuuucaaguagaaacauugccaaaggugaugacugucuauuagggcuuguaaacuguaauauaaucacagauuuggaauggaguggugaagccagauaauugcaguguuuccugucuaaaugugcugcugugcguaguggccucugauuuuaaggagcuguuaaaaaugcagcaaggcauaacagcugugguuccuagaauacuccuaauauuucauauguucaucacaucucauaaaaucuugcccagaccaacaaaugacuacuuaucuguacagcuggacugucuuagaaggaaauuagagaaagugugaaucauguagguuagcauuacagagacccaccaagagcucauccaagcccgugcugugccauauuucucuuacugcuccucagaguucucccuuuccauuuuuaguccccaaagagaacauuugccucuuaccauuugugagcagaucuuaucaauaacuuacuuuuuccuaccuuuguggaaaauagacucaacuuugccaagagaacuuaggguucuggggcagagaaauucaggcgaaguuaauaucucaacccaaaaucaaaaagagacaacaaauuuaguucucuuagaauuuuuuaaaauuaauuuuuaaaauaacuuugcaauagaacuagcucugugauaugaaaaccugguuuuucugggaggaacauuaguacuaggacauucugggaagcaaaggaagcuagugaacccaaaauguucuuuuaaucagauauuaaacagcuaagcaucaugaccaaauggaagccuuaaacugcauuuguacagaggcauaauagagucacaaguuguuuucgccuaauuguuucuaaauugcccacuuuacuaauuugauaauuacaguagaccuauuauuuugguuuuacauagguccagaguuacagaaccucuaggucagaagggacuucagaaaucaccuuacccaaucaccaaucugagacaugacucaaaaaguuauguauuauuagaguaggcugacaauuuggacugugaccuugcucauccuggauccuguccuucaguuguuauaguugaaagucacauuaauuuuucugccaugccacaguguuuucuugaugucagugacuguuuucauaugugauacuguuacaucuuuuuuaucaaaaagucuaauggauucugucuuaagaacgagccuuuauugaaaaaucucuguugaaguuugucaugguauacuuaguauacuuggcuuauuacuuuaacuuauguagauucugucaugucauauauuguuguugcuuuuaguuccacacuggugaagaucaucaagugcuacaacugucuuuguggcaguuaaauuucagugcuacuagauuuuacucauugcucuucuuguaaugccccacgauuugauuuacgcuggcugaguauuacaaguccuauguauuucuuuccauuggugauucuuaucuggagcuuuaacagaaaucagacauuguuccucuguuuugguuauuuauagauacaucuggaaagaguuuugagacaaccugugggcauacuuaacauacuguaccuuuuuucuuuguagccaucguguacaacugcuuuaaaaaaauuagcuggacauggagaaguguggaaaccauuguucuguuacacaauggcaaaauaauugaccauuaaaauauaccugugauagacuuaguugugauguggaugcauucaugguaagccucucugaguuauucuaauguaugugaacaagcaguauuauguaaaaauagaggaaaggauaugcuauaaaagaaauacaguuugauacaguauuuauguuuuaacagauaugcuugaguacuuuaaauagauaaaugaaaaaacuuucuauuauuuguaguaggucuauguuauacacaguaguguccugagaaauucuugaguugugacauacauauaaauuuugaauacagaagggauaaguucauuuuagaaauuacugcaaauuuugaauugguagagccaucaaauuuguaaagcuugggucacauuuacuucugugcauugagugucauuacauucuguuuucuuuaauuuucaaacaaaggguuguaccacgcuucucuuugaagaggccuuuugguuucagcacaucuauggguacguuguuaacacugucauaccuccaguuaaggaaugguacacguuuagagacugcuuuuucaagucaaggugccaauuauuuccugccuaagcacuauuuuagugaacucacuuuagucuaaaaucacuuguuauuuaucucagaauguuauuaaacaaggauaaaaucaaugcaaagccagcgauuuauguaaaucuuauaaaaguuugauuuucuuuagauuuuugugacuaacagccucucagucuuccuuggacaggggagugguuagaguuuggguucccuaauucucucaucuuacagccuaagcuaagccucaaugguugauacugaaguuuugugacccucguucaauguucagaaucuauuauuuuaguacuuuuaguggggaaaaaaaauucugcuuuacuucuuuuccugcugugauguguacauuguguuauuuuucuacugggugugauuuuuguuaucuuuuucagcuucauugaccauaauuuuacuuauuuuaauuaacauggaucuuauuaacaguuuucucuccuguacguuuguguuugugacauacucuucacuacauacuugaauuaaguaauuuuauuauuuuucaucuuucagcaguaugcuuauucuugguucauuuacuguuuugaagcaauggaauuacuuacauauuuuuauuuuuccuuuucucucaucuucuguuuuccaaccucuaccuccauuugguccuauaacaugauaaaagugcaaacaugagccugaauaauaaaggauugcuucacugauugcuaaacauauauuauagugcuuuaaaacucauuucaggucaucgugguggcaauuaguuugauuacaagcauuuaagcugucacauagaaagccuuccacuuccuagggcuuaguuucaaaucaugaaaacugaaugcucuauacuuaucuauguacacagcucaauuuuauuauuuuggaagaaagcuaugccuguuacaaagaucacucauaauuucagaaccugguuaaagccagugugcaauuuuggagcagagacacaauuuuauuaaaaaauuuaaaauaugcauguguacauauauguagguagggacuaucaaaagagaugucaaaaccaucuauuuauucucauuuuuggauacaguacacauuaccaaguuguuacaaugugguuauuuaaauaucauuugggccaggcacaguggugcaugcuuauagucccagcugcuugggaggcugaguugggaagaucauuugagcccaggagaucaguguuggagugugcuauaaucaugccuguaaacagccacuguacucccaucuaggcaauaucucuuaaaaaaaaaaaaaguaaaaucaugacucucauacauuauacaaucuacauguuuaaacauuuuauuuaauaaugacggaaguaggcagauguuauaacuuuuucaaagguaaaccaaaagaaaauccacaguuauagaugaggaauauugaaaugaguguguagauggaggcagaacuggcuucaaggaagucagcugagucucuaccucacaugacagaguuuacaugauguuagagaauguuuauuuugcauuguuaucacuuaccuacaacuuccagacuuguaaaauaguuuccauggaaucagaaauuaauuaugcuggagagugugcuauagacgaugccuaguguuuccuugaagcacauguuuuccuauuugaugaaaaauagucuuaaaggaagguuuguuuauuuaaauuuggccugaucauuuacacggguguaccaagaauguuaauuuagcauauaagccuuuuaaacuuugcuuucucugauguuuuuacaaaauaaaucuccuauugcacuuuuaaaaguauuauuugcuguccuaaggguggaaagccaaacccaagaaucacggaaaggaucacugaaaggagugaucaagcaugaucacugaauggcacucuagaagucuucacucagcccacuggucuuucugucaccggcaguaccuguaaauuugggugaauuucuuucuucuugauguucccaaaauaucccaaaguacccuaccaagaagugaucucucuuuccaucuauguggcuggauucuguaaaccagcuaccaggcuaguuuuucugggaggauugguacuuuauagagauaaagucaccuuuaauucccuguaaguguuuaaucauaucugauuaaaugagcauuacucacaaauaggacauuccagacaagaucuucaagauuuuucauacucaucuugguaaauaggaaggccaauuuuuacugaacccauguaaauaacuguguugcuaugaaaaguaagaagacuuagaguuuuuggauucuggggugucagaauaagauuccauuuuaaaacacuucauuucaguuuauaaaaucagaauuguuaugaguuauaaauagcuuaagaaaaaagagagcuuccuuauauucucagauaauagaacacugacauaagaccaacaauacucaaaacaaucauccuucaucauuucauugaguccuguuuaauuaauucuugcuguacugaaucuugacuuauuaaucucaucaacucaucucaugaauuucuugacugaaagaaguucuggaaaucuugacucagcccacuggucuggucaaaguuauuuaagcaaugacaucagaaaccuguacccaagagucuauucuuugaagucuuaauuauuuuaaguaccuggugcaguuuuuuuuuuuuauugugggugcucugagguugucuuucuuauuugaaaaccagaacucuguucuacuguguuacugaaugcauaacuuucaaggaaacauaaaaguaaaacaaaaaacgguguaagugacagacuuuacauggcugugguuaauuuucacuuacaacuuuuaaaagugaaaaauaugaugagaauuuauaacaaaaauaauguaacguauuugauuauuucuguggcauguaaaacaaagcuaguaaagaauguuuuacacaaaacuauuuaagcaaaugagcucauagaaacuaugaagauuuuaacauauuucauuacuuuucagacucagguauuacaaagcaagguaaauaaaauucacuuuccauguucuguucucauuauguucuuucauauuuuggaacaaaauaauacuuuacuucaagacuauucauaggguguuccaugaggucagaacuacuuccauaguauuucuaagauguuauuaccaugcaguaugcucauuauugcuaguuugaaaugaaucagcaagucagcauuuuaaauuuuuuuaaguuccaauuuuuaauguuguaaauaucaauaguuaaaacccacacacacucucauagacacaaaauaagcucauugagguccucaauaaguuuuaggagauaacuguaagcgguuuggagaccaaaaaucuucagaaacauugcauuaggacacagguguucuuuuccuugaaaaauggcagcauacacauaauuauauuucuuagaaacuguugcuucuagauaugaugucaacuucuugcauuaguuuuaauuuuuaaccaaauuaacuaacuucuauuucacauaaaaaaacugggggauaguuacgaucuuccuuuuccauaucagcauuuuagaggagaucaugaauaaacauaaccaacuuucuauagccacacacaucucuuaugcaccuucauaaauugacaacaaugaacacauucauuaacuugacccaaagauagucuucucuguagauuauaaaaauaaaaagcaaaacgaugaaauuuuaaauuaugauuagugcucaguguuuuaguauucuaucuuaauuagaaaugguguaacuauccaaugaauaucuguuaauuaauuuaauaucagucugagguuucaaauuacuuaaaaaucuuggaaauuaugcucaagccaacauaguaagaagcauaauuacuauugaagaaaaguuuuugagaauauugaugcaguuuggucaaagaaaaauaaagacaaacauaaacauaaaauagaaauaaugcuagcuuauuuggccaggaaaccaguauauuuuuagguaaauuaucuaguguagaguuaaaauguuuacucauguacuuaaaacugauaaagaagacuuacuguuuuuauuaagccaagauuuauuaaacuaaucuuauuuggcaaaguuacacguaaauuaagugaacuugaguucauaaaauguuuccgagguaauguaugcaagaauuuauuguuuaauuuaguacauuuaaaugguuagagauucaauucuuuucugugaauuuuaggaauauuuaguauauguaagcacuuacacugaauaaggcuauuagaacaaaacuccuuuagucuuagagacuuuauaaucucauuauuaauaccaucugagguaggaaaauauugugcacacaaugaaagguaaagguacuuuugaauuguagacccucagauguguagaaagcauacaguuccaauucuagaauuucagccauaggucaagaguaaauacagaaacacaaaaaguuucacuaguccaaauugcaaagagcuauuccucuucccaguagacaugcuguucuuaauuauuugagcucaaaacagacacauagaccaucagaaaauacuaacagacuagaacuuuuuuuucucaaguguuuuaagugauagaaaucuaagcuuacuguguggcacauuucuuaaagaagcuuuucuguguuuaacuguacauuuuguaguuagcauuuucauucucauugauaaauucaacagacagcaggccagucagccuguuuuagguucuguggauauagcagcaguaaauaagacaaaguuucucuuuucaugacacucauaguuaaucaaauuaaucccuaauaugccaggugauaauaggaaucuaaagaaaaauauucaugaaaagaguugggcuuucaguaaagaauaacagggacugaauuuauuguucuauuagaaacaaccaaaacaaaagauaaaauacaugacacaaugguuugcaugacacuggacauaaggcaguaaggacagugaucccugaaagaaaguaaacaaauguagucaucucuuugagugucccagcuuccugccuugagagaauuccaggccuccaugcagggcagagggaauucagaaguaccaaguggaacucaguagacuuucugcauuaggagaagauacugagaguccaggaagaacaagguagcaaaaauucaaaggacagaguauuaggggggaggggugaugcacggagaaaggaucccagagaucuucagaggauugcuuuccguuauucauuagagaguuaauuagcucaugcauuucaacaaacuuccugaugccugggaaagaaccauccagaaggauuagaggcaacagugccuuacauuaacccauagccaggaacagugcugauucucaccagcaggauuggaaaaaccacuagacucauggggcauagagucaaguacauaguagggucuugucucaguauugagaaauaaucagucauugacugagcagugcuacaguuugccgugacacuuuuuauuuuuuaucuuuuugagacaguuucauucuuguugcccaagcuggagugcaaugguacuauuguggcccacugcaaccucugccuccuggguucaagcgauucuccugccucagccuccugaguagcugagagcuaauuuuugucauuuuuuuaguugagaugggguuucaccauguuggcccggcuggucuugaacuccugaccucagaugaucuacccaccuuggcuucccaaagagcugggauuacaggugugagccaccacacccugcccucccagcacguuuaaaaugugaguucugauagggucaaacuauuucaagugacuuaacugaauucuaaaaccauuuuauggcauucaauuacgaauuaccagacauucaaggaaccaggagaauaagacccauaaugaagaggaaaucagucaaucagaacugaaucagauguuagaauuaacagagaaugauauuuuaaaaauuauagugguauuccguauguucagacaguuaaguaguauaagagcaaaauugaacuucuaauguaaauacuacaagguaugaaauaaaaaauauauuauaugggauuaacagcagauuagacauugcaggagaaaagauuaguuaacuugaauucauagcaacagaaacuagccaaaaugaaacaugaaaagauuagagaauuugcagauugaacagagcauccgugagcugugugaaaacuucauacagucuaaugcauguaaauuggagucuccagagagaggagggugagaggacaaaaguaauuuccaaauuugaugaaaauagugcagaacaucagaaacauaaagaaaauuacaccaacacauauuauaaucagauuucucaaaaccaauaagaaagggaaaaucuuauaaauagccaggaaauaguaaaaagacauaaaugcagaggaacaaagacugacagcagauuuuuuuuuuucuggaaaaaaaaaaugcacuggagcaacauccuuaaaaguacuagaagaaaaaauugccaaccuagaauuguauacccagugaauauaacuuucaaaagacauggauaagagaaugagaugauaauccacaggcuaggagaacaguuuugcaaaguuuguaucugauaaaggacuuuuaugcacaauauauaaagagaucuuaauauucagcauuaagaaaucaaaaagccuaguugaaaaacgagcaaaagauuugaacugaugugucacuaaaggcaauauacaaauggcaaauaagcacaugaaaagaugcuuuacaucuuuaauuauuacauaaaagcaaauuaaaaccauaauagguauauaguaauauauuauuacacaccuauuaaaauggcuaaaaugaaaaugacugacuacagcaaguguuggugaggauauugaggaauugcaacucuuuuacacacuagugggaauauaaaauguacaaccauaaacucuaguuucucuuuagaucauguaaaucuuuccccuuuuuaaagauacaaccaauugagagaacaguuugauaauuuauuaaaauguuauauauguauguacaauauauucuagccauuccaauccuggguuuuuacccaagagaaaagaaagcacauguccauacaaauauuuuacaugaauguucauaguagcuuuauuuguaauagccccaaauuggaaauuggccauauguucauuaucaacuuaaugaaugaaaauuugguauauucauacaacagaauacuacuuagcauuaaaaaggaacaauguauugauacaugcaacaacauggauucaucucaaaauaauuauccugaguaaaaaaagaagccacacaaaaaagguacauauuguaugguuccaauuuauauaaaaugcuagaaaaagcuguuuaaucuacagugacauaaaguagaucagugguugcuuggagaggcaggcacagaauugggagggaggcauuaccaaggggcaggaguaaacuuuuguaggugauggguauguucauuaucaugacugucaggauggcuccacagauauauuuauaggucaaaauuuaucaaauuuuauccuuuaaauaugugcaguuuauuauauuucauuuauacuucaguaaagcuguuuuaaaaugauuauaaaaacuauuucccugcuguuguuaacacccugagaugucugccucuuuuccuaucuuucuguguuuuaaauacaccagccuacugcacuuuaauaccucucuagcucagacagcuacacacaaaacuuacucugaagaaugucaaaaugcauguuuucaucagagaaauaucucaugguccuuuguuaaauguucaaaaauucaugauugggcuuuauaaggcaaauauguccuguuuuauagaauuacgggagagaaaaugcauacaaaagagcccaauccuuuuuuuggcuggcuuuuaugucagagcucaaaauugcucucugauaaaauguaggccaccagauugaauuacuucauugaaccacugcuguccucuguuaaugguaauugcacagauauagcagucuuucucggcaacaucucagauauuuaccucccacuguuuuucaauucaaaccuuugaugaaaauauucccaguacuucuuuaaagcagacauccaacugucuuucuugacaaaagcaaggucucuaaaucagauccugacaauuugugacacagcagucuauccaaaucaccuuuuaccuaugucacuaugucauuuccugaagaaaaaaguguccaucagacaagcaauuucuguagguuuugggggcuggaagguugguaugccagcaaaaaugagagaggaaaagggaaaaauaauuuuuuccuuugacuuguguggaaggaauucagugagggguugaccagaucuaauaagcaaaagagggguuuuguauauuuaaaagauacauuuuuauaaagagagaucuauagauauuuguuauuuucaagaugguaacaauugaaacuugaaucuagugauuucugaaagcugcucccuuuaaggagacagggaaacaagguuaguuuuuuuuuaauucuuaacuuuuucuguuagacuacuuuaauaugacaauauuuagcaguuuauuuucucgucagggauucagcucaguuucuggucuaccuccuguccugaacugagcagacuacauuuccucacaugaagguuguagguuguacaaacaaugccacuggcaugaaccaugaucagcgcucuccacuugacucauggugacuuuggaggcuggagugcagcacaugguaaccaggagaucagcuggaucagccucagagugaaacucgcugcuauuaucucuuuggcuaugguugguugggugcuuuuuuuuucccuuuuaguauuggaaggauauaauugauacuugcuuucuuggaucaaauuguagcaucauauguuugacugauggguuaguuguaggagcugucagagccccccugggaccugcuuuacagguuuggugaaugagcagcugacagcacagcaagcacacuuucugcugccagccugguuuuguucuucccagguggauguuucauuauaggaaugggccucaaaauaacauuugcccaggaauauuucuagagaguggucaucuuugguggcacuguuauggugguauguugcucauuuagaguggucucauucaagcaagacccauacaucauuuggggagaacagugaggaaaaccgugggcugagcucuggggaggguucgaucugggaauaaggcauguccuagaaucucagucaggauucuacuuucaagagacagugcaaggcuccuaggaaguuggggccaggagguaauuaaagagguagaaagagaaaaucuuuuaaaaucaaguuucugacugcaugggcucuugaauguggucuuuacuuugauuguggccucaacauacaggugguagcagaguccuugaagggcccuugacuuuuuuuuuuuuuucagagaucagggaauuuguaauuuagaaggagaaaacuggcacucuugugccaguaaagccucugcugauagcugugugccguuuguuuuuaauccuuucucgguauccgucucuggccauccuuaucuuuacuagaaaucaaaggcugugaagggaccaccagaaaaauaaauaauucauagcuuuucaaagccugagccccaaauacucaacuuucaaagcaugagccccaaauaucccuucccuugggcuugaauuugcuaaacuggagccuguguuuacucuacuaggguaaccaaguauucaagagcucagagaaaaaaggacuggccacuauaccucuuuggagguaagagaggagcccgugugaguucauguguagaagaaucacuuucaccuggaauagaaugucaaucccagaaucucacuaucuggcaggcaggaagugauaccaguuucuggcuuggaaaggacaucugaaggauccuguugguuuuguuuuguuuuguuuuguuuuuuucuccuguugguuuugucugcugacacguggguagugcugacccagugucugaccggauugucuccauccauaacuucaucuagcccuguuuacaaaagaaugaacacaagugacagccucagugaaccugcaccaugaggaugcccuuacuucucccacacucucacuuucuucucuucuuggcuccucuuccccuguacuucucucuguugacauagaauaugcaaaguccaagagauguggcaaugccaguaagagcuaaguuacuugcagcuggcggugccaccugugccuaucaaauuucagccaaagcaauugcuuucccagaaugcccuguuuuggggaauuggaaagugaaucuguaggggcggcaauggcuguauagaagagagcuuuucucugggcucaaauaugaggacaaaauugugaaguaggacuguagauaaucccaaauccccacuuuugcaucuuccugagcucagaggcaacccaagagauuuccgaguuaauccuuuggacuuuaggugaacucucagcuagaaccaucguuugcaagcagaucuccuguggaggugacaguuccauaaccuauccuggugguuguauaguugagaauguuugugauuccuucucucuccacaagaccucaccacuuccaguuauguucauuuuauuuuuguuuagucauuuuugugcuuagggaacaauuuuucagcuuuguacucucaccucauaaaaguccuuuguaucauugugaaaaagcaagucaaggccuggcgugguggcucaugccuauaaucccagcacuuugggaagccgaggcagguggaucacgaggucaggaguaugagaccagccuggccaacauagugaaaccccaucucuacuaaaaguaaaaaaaaaaaaaaaaaaaaaaaaaaaaaaaaaaaauuagcugggcgugguggcaggcaccuguagucccagcuacuugggaggcugaggcaggagaaucgcuugaaccugggaggcagagguugcagugagccaagauugugccauuucacuccagcccgggugacacagugcaagacuccgucuuaccaaaaaaaaaagcaagugaaauugacauuuuaauuuagucugacugcauuuuucuauaauuuucuaagaauuugucacuuuuuaguauuuucucuuuucugauaaacuguuccagcuuuucaucacuuuuuaaucagcuuucaucaguuuuaucauacucaaccucugguauuuuucuuuguaugcucucuuuuucuccuuuuuuuguuuuguucaugagacaggucuugcucuguugcccaggcuggaaugcagugguguaaucuuggcucauugcagccucaaccaccugggcuuaagcgauccuccuaucucagccucccaaaguaguugggaccacaggcacaugccaccaugccuggcuaauuuuuuauuguuuuauuauuuauuuauuuguuuauuuauuuauuuuuucuuuaagagaugggggucucucccuauguugcccagacugguguugaacuccuaggcucaagcaauccucccaccuuggccucccaaagugcuaggaggcaugagccaccacaccuggcucuuuucuguuguucauucucuucacccuuguuuagauccuaaagugacccaggcacuucaggaucugaagauagcuggaugaugaugagucuucuuaaaagguagcauuuuauagcaaacaugauguagagccacugaaggguuuuauaguugcuguccucaggggcuggauuuuuaaacuggaauauccauggggacuuugaaaauuccaccugcuggggcucuaccucauuugagaaccacuaccuuaauaaguucauggccuuacaaugggagugggaggagaggugacuuuggagcagacaauuacaaugugagugacaguuaucucuuucaugaguacugcuguacaaacugggaaugccugaucugguucuuggagagggaguggagguuaaccugauuuauguaaaguuguaguggucauggcgggggaggagguugcauuccaugaagcaccauuuggaaagacccaaaguguggggccugguuauuuggaggaccuggagauguuguuggaaugcuuagaaauuacaggaaugaggauaggaaggagccagaucccaaguggucuugacaagucuuguuaaagaguuuucauuucauagugcaagugauguagagccacugaaggguuucauguuguagaauuuauuagaugugugugagagauagcucacucaguuaguuuuguggaagauggcuguguaagcaugagauuggaggcaagaacuucaggaaaaauuaugaugaugacugggagagaagguggacaauucuagagauguuuagaacacaaaauugacaggacaaagucaacgagucaauguggcagugauuuauagagaggccucaaggauaaccaaguaucugcuuuauucaaccaagugagugcugguacaauucacuaagagaggcaguauaggggagugaauaagagcacauauuugaauccuagaccugccacucgccuaugaguuacauuuuggguguauucauuuuuaagacguccaugggaugagcaaagaaagagauccugugggaguuugagucuggagcucagagaagcagccuggaccucuggugcacgugauccaugcaguccauggaucagaacucuuucaggaaaaaaaaaaugcgguuauuaggacaaguguugaguaugugugauuuuuauuucuuugugauuuagcuggaggacuauagagcugaccagaauaaaggcaauaaauauauaaauaaucaucuaccuaugauauacucaaggcaauaaauauauaaauaaucaucuacauaugauaugaguauaucauuaucugcugucauuauuauuagugaaggcauguuacauauuuguuuggaccacagcauacuuucaggaaacucuugauaaacagcuuucuuuuuuauuuauugcccugcuuucuuuugauugcuuuugccguagcaucaaccugcaucuuauuuuaaucaucuccucucugaacauugaugauuccgcagcuuuguuagaauacaucuugggagauuccauuuuuuaaaggcucuuucaagggcauauggcauuagaugauuaugauauggcgcauuuagaauaugccaugauuucucuccugcugaaucccucacacguguuugaaguaauuauuauccucucugcuagcucaugagacuuguuagaucacuauuugugggugucauaaaauguuggcaagaccccagugugaaacgcagugugaaauacaugugguuaaacuucucugauuuuguaugucaaucaaaacaaaauggcuuaaaacaguagaugaauuucaaaagaaacuucaggauucuagagcaaaaaugacacauggaacucuuuaggucuguguuuugauauuuaauucagggagucauacacaggaggacguaugcaauauaguagaauuuagauguguuaugauuauaucugauaauguuacaaauacugagcagcuuuuuguuacaucauauuuggucccaaaaugucaugccaugcaaugcuggggguguuuaaauaccaaauuuaugcauauuuucaaggaagaagcagauaaucuucuaacuauacagacuguguuacuuaucagaaauaauaguuuaugaauugucaaacagugaaaauuuuaaaccauguaucccugauaauacuuuuaugucuucauuaagcaucacuaauacugaauaugaguaucuaucugaugaggaccuuagaaucuuauuauaguuagauauaacaagauuuuauuuauuguuuuuaucauggugaaggguauauaaugucagcaugaucucuccuuuaguuuuaccucuucugguguuuugcagucuuaaaugggugucuuuaggaauaucccuuauuucuaguuuuagagcucuuacuucuaguuuuagagcuucuaccuaauaaagguauaauuagauuggucuuuucugcauuuauuaaucaaagacuauucuuuuacaugugacuuuuuagcaacauccauaauuuaagugauauuugcccaaauauuaucuguacucccaccuuuacaagaggauuuaauaacuuaauagaguauguuauaguaaugaguuggaugaccaaauauauuucaacuaauagaaagaccaugauguagcugcugaaauaccugagaaagguagcuuaccauauaaagaaagacagcuaggauuuugaucaccuucuugcuuuagugaaugaugcuagaucuuccuccaacguaaaucuuucugcucacuuuaauucuagaugugugaauucuugacuugaggacuuugaugucagauuucaccuacuugaaggcccauuggaagaauaacuucuaacucauuaaacaauuccccauuuagccaaaguuagucucauagaugucugugauggcuuguuagguggcacagugacuaaauuugaugcucagaaaagauggucuuaacaaagaguucuuucuuuucacacaaguguaagcuuucugacaguuaucacccaaaaugcaucuuguuauuguugucuuuucuacucauggcugugagugucagacacugugcuuccauucacuaacaugaagacauuugugaaagggccuucaucaauaucugacacuggugaauugaagaauaauauacuagcuacauaaaacuguguuuauucuuccuaaaccaaucauugcuuuuugcagcauuuccaaugaaauugugauuuuuuagcagauucuucuuugauggagcugugauuugcaauaaucuugucaugccaggcucaaaauacuacuaaaugaagacauuuguggaagggaaugauuguaaauugcaugcaaauuucaacucggcuggaauuaaucaauauggaaacagaacuugugcguuccugauauaaugaugcugaaacuaaucccauggaguucuauuuccgugggaauuaggcaguuauuuugcuuuaaaucuaucucucucucuccuuuuuuuacccuugaagacaaaguccuguuuuugaguuuuuuaaaaguaacuucuuuggggauuuagagagguuauaaaggaaacaggaguaaaaucaagcaucugacuuccccuguggggacaucugacauuuccuauuuaauuugcugugcuuguuuaaugaaucuuucccccaauuuuucuugcuaguuuuuuuuuuucacugaaaauucuaaggcuuaugagauaguaggugaugcaaucuuuauucuauguuaaauaugcgacacuggucucuaaaugggauguucuuucuuuuacaccaguuucuuagggugaucccagcuuauccuugaugaaagcuuuuuguuuuuguuuuuuaagucgcuuuuggaggaacaggucaccaaccuugacuuuuuaaugccugcuuacauucaaauuucucauuuucuuugauuggcaagauuagguuuauggccuuuuauucuuacacuuggcaacuagaucgguuaaccuuagauuauuuguuccccaccuuuucuucagcuguuuaggucacaaauuuguagaaaggucuuaucauuggcauauuuuguaccaccagugcaucagugcuauacucauauauccuuagaggcugacaacuuacuucccagccccuuuggaguacuuuaagaaucccuuuauuuauagcccagcuuaagccccaguggguaacacuccauaaaccugcagugacauccaguggccucgugguguaauuuuuuacaaacuuuucuaaaaggaauuacaggggcaguauuuccugucaaagaaaaauacuguuggaguuauugaaggggguuuccuaaauacauuuauguacaauaguuacuggcauacuccuugauaggauuacuaggagaaugauuauucauuuuuugguuuuugagugaaggauuaacggccucugaugaaaucagcuuuauuccaagaucagauaaaaaauauaaaauugaggacaauauuuuuaagaggacaauuuuuaauuaaaaaaaaucaacaguguagaauuuccuauucuggauagauuuaagaaauaaaggagaggccgggcgcgguggcucacgccuguaaucccagcacuuugggaggccgaggcgggcggaucacgaggucaggagaucgagaccaucccggcuaaaacggugaaaccccgucucuacuaaaaauacaaaaaauuagccgggcguaguggcgggcgccuguagucccagcuacuugggaggcugaggcaggagaauggcaugaacccgggaggcggagcuugcagugagccgagaucccgccacugcacuccagccugggcgacagagcgagacuccgucucaaaaaaaaaaaaaaaaaaaaaaaaaaaaaaaaaaagaaguaaaggagaaccuuuaguuugugcaacugaucaugaaguuuaaaauucuauguuguuccccuucuugguucuugugcagucaaugucuuugagagucuucuuccacuguguuaacucuuuaauuuucucaaaccaccuaagacugcuacuauaaaucagagccaagagauucccaaucugauuacugucuuuaauuguauuauuaaacgaaaacauauuuuuauaaaaaugaugccccauuauuauaaaauauuuacgugguagaaaaauguacgaagaaaaugugagcacaucagugcaaaucuuacccuuuucacagaaauaaccagcguuaacauuugguaaaccucuuugaaaaugcucucuauaugcucuuuuauauucuuuccaugcauauauauugauagaacgauaaauaaauuggaagcuaagaaauaauuucaugauacugaauugaacgacuuauaacggcuguguuuauuugguuuguaauuaccgcaaaauguuauacuagguggggagaggaccaggaagagguuugcuuuuuuuaaaagagaugacuuugccuuucuugugacagggagggcuggcuaggcaggaucagguuugggagagggucaauagagaggaguggugugcagccaccucauggcugccagcuaugagguuugguuuagauaaguuaacugaggcuggaaugggacagcauaguucauauguuuaaacacccaggacgagauguucccagagcucagagaguucauacgaguaagucuagcauguagaaacuaagccaguagaauguuccaaacugaugcuaggcacauucauaccaaagaugaguguuagguuguggugguggggggggggggggcagagggggagggagaaggagagggagagaucuuuagauaucuuuagcaauugauacugaaccagaaauuugaaauuuagauuucgcucugucaugcccauuccccagacacuucucagauacaaugcaaaagccauaugcuacugggagagaggcaagaaaccuguuugccauucuaguccuaacaaagauuagcugcugugggggaaggacuaugaaucucccccugcuuugcaaagaaauggggcaaacgucguuugcaguugagagagaucauuuugcccaugauucugcacuaaugcacugauccucuaccucugguagaggaacaggaaacuuucucaugcccaagauauuccaccaauacaaggcaaaacuuggcuuccccgugggagggauguggggaagaaaacugauuguauuucauacccugaacugaguaggaagcagagauuacaugucauugggguggaggaagaaaugcuaagaaagucauguacuugagucccagaugugcagggcuaggcuaagacugugcuuggagcaggagaacugagaaauucuccuuccccccuccaagagccuucaaccauaacaaagaaacaguaacaggcuugcagucuacugcuagaggaguggcaagagcaugggaagaaacgcagacacccugcaaugcuuaugugcagguccuacuuagguccuacuguaaguuuaggguggauccugaacacugagaaaaccuuuuugacagcaaaaaauaaaauaaacuuucauuucuauauagauuuagauuacaaaguuaugcagguagaauucucguauaaaaucaaucuaguuuucccuguuguuacaucuuacacuuguaagauguaguuguuauaaguagauguaauuguuauaagauguaauuguuauaaguaguaaaccaauauugcuacauuauuauuaaaugaaguacauacuuuauucaaauuuucuuaguuuauacuuuacugaucuuuuucuguuguaguauccuaucuaaaguaggauacuauguuguauguuuagucauuauaucuccucaggugccuguaagacugugacaguuucucagauaguuuuucuuuuugaugauaguuuuaaggaguacuggucagguauuuuagagaauguucuucgauugguuggauuaaaaaauuuuuuugauguuuuucucaugauuagacccucaguuggccucuguuuugaaucuucuagacucacaaaagacuaugucacagcagucuaucagaggaggaauuuuuauccuguggugcaucaacacuaguuauagcaacaguaaaauacagacacaauucaacuacugaguagauuuauucaguccccccaugcuaacagcuugaaagaaguaguuacccauuuccagguagaaauauuauuuaccugaguuucuuuuauacauaaaguuuggguucaauuaaaaaaauuaugacauagacacacucacguaagauaaaaaaaaaaggugacuguucaagauguaaaauagucaacaaaaucugacaugcaaacuucagacagggaccuugaaauaacuaugauuacuguauuaaaagguuuaauggaaaagguggacaauauacauaaaucgugauguggaauuuuaguagagugauggaaucuguaagagucagaaaaaaaugcuagaaaugaaaaacacaauaucauauaugaaaaaauuuucuguggguuuaucaacagacuugauacgauagaggaaagaauaagugaccuugaggauaggcuaauaaagccuuucaacugaaauagagcaaaaagaguggaaauaaaaaauggagcauugccauagaaaauuuccugaccgccuaacauacuucaagagagagaaaauaggcuagaagaaacgcuagaagagauaauggcugagaauuuuccaaaaugaaagauagccaaccacagacucagaauaaauaugaagaaaagcauaccuacguacacugaagucagacugcugaaaaucaaagauaaagaagucuugaagacagagaaaaaaauaaauauucaugcagagguauaauagauaaaagcucaguacauuuuaugucagaaauuauguuagugaaaagaguuggagugacaucuuuaaaaaacugaaagaacaaauacccucaaccuagaauucuguauccaggaaaaauauauugcaaaacggaaaguaaauuaagucuucgucagaugaagcaagagaaguuuugcuagcagaacaggucuaucugaagagcuuacaggaagcucuucagacaguaggaaaacucuucagauagcaggaguacgcugcucuauagaaagaacauuuuguucuacacaaaggaaugauggacaccagaaauauaaaaauaugaauaaacagacaagacauuuuuucuucuaaucuuuugaaaugagauuagaguauggguugacaaugagccugguaugguuugacucugugucuccacccaaaucucauuucaaauuguaauccccacguguuggaggaagggccuggugggaggugauuggaucaugggggcaguuccccacugcuguucucaugauagcgagugaguucucaugagaucuggugguuuaaaagugugugacaauuccugcuugcuugcucucuccugcuccccuaugguaagacgugcuuguuuccccuucaccuucugccaugauuauaaguuuccugaggccucucagucauaauuucuguuaaggcuguggaaccaugagucgauuaaaccucuuuucuuuguaaauuacccagucucagguaguuuuuuauagcagugugagaauggaccaauaugagucaaaucuaacaucaggcuuguuuugugcagcccaugagcaaauaauuuauuuuaaggguuguaaaaaauuuuuuuaaauauagaauaauuaaugcauaugcaacaaagagcauauauggcuugcaaagucuaaauuauuuacuaucuggugcugguuuaaagcaaaaauaauaauucuauauuaugggguuuauaacauguuaaaauaaaauuuuggcaauaauaccuuaaaggaugggagggaggaaauggaaauauacuguuguaagguuuaaauggaaauauacuguuguaagguuucuguacaauacaugaaauaguauaauaacauuucaaaguagacuaugauaaguuaagaacguauauugugaauuuuagagcagccauuggggaaaaagauaaaguacaagauauaauuaacaagccaauaaaaugaaaucauaaaaaugcucagcuaauacaaaagaaggcaaaaaaauuaagaaaaaaagggaacaaaagaacagaugacuuuuuuuaaaguauaauaguacauagauaccauaucauccuuagcaauaauuacacuaaauauaauuggucaguuaaaaagcagagauuauaaaauuggauagaaaguaaaacccaauuuugugcugccugcaaaaaacccauuuuaaauacagagccaugacuauuuuaaagcaaagaggauggaaaacaguaugucaugcaaacccuaaucaaaagaaaacuggaguggucugggcuuaugcuuauaaucugagcacuuuagaagucggcuggaucacuugaguucagguguuugagaccagccuggccaacauggugaaacccugucucugcugaaaguauaaaaauuagccaggugugguggcucaugccuguaaucccagcuacucuggaggcugaggcaggggaaucacuugaaccugggagguagagguugcagugagccaugauugcaccacugcacuccagccuggaugacagagggagacucucaacaaaaacaaacaaacaaaacaaaacaaaaacagaagugguuuuguuaauaucaauacaguagacuucacaauauuaccaaguauaaagcaugguaucacacacaauauagugauaaagggaucaguccaucaagaaaacaagaauucaucaagaaaaaggccuauguacacaauaacagagcuucagaauacauaaagcaaaaacuaauagaauuauaggaagaauagacaaaucuacuaauaaaguuugagauuucauugcucaucccucacauugauagaacaaguuaacacagauuaggaaggacaccaaaaacuugagcaacacuaccggucaccuugacucaaucaacauuuauagaaugugcccuucaacagcaaaauacaguuuuuuguccaaaugcacaugccauacucauuguagacauauuuugagcuauuaaguaaauuucaauaaguguaaaagcauugaaaugaugcaaauuauguucacugaccacaacagacuuaaacuagaacucaguaacagaaggauacccggaauguccucaaauuuuuggaaauucgauaacauacuuuuaaauaacccauaucaaagaguaagucucaaaucuaauuugauuuuuacaguuuacaugccucuuuuuucuaggcauuuaaaaaauauacagaaguacagucuagacugcacauguguauauaauugaugacagugacauucucucggaauuuauauuaauguagugcacaauauauuugaaguacauuuggcauaaggacguacuaagucacaagacuuguuuggggaaugugauuucuuuggauaaaauuaaauuccuugaacuugacaacuaaucaggcugaaaaaauacacuugaagcuuucugauacauuauuaaggaaguuacagaauauccaugaauuuaguuagcuuuacacuccagugguacuccugaguauuuuguaauugaacucguugaucuucagaugugaauugguucuucagaucugugaccaucagucugucuacaaacauuuaugcaggcucucugagcaagaugccuuuccucacggugguuucuaaacucucccaauauuuucagcugccuggguaggaagcauuagggcagacgcccaggcuggaaugcaguggcgugaucuuggcucacugcaaucucugccucccagguucaagagauucuccugccucagccucccgaguagcugggacuacaggcgcugccaccacaccuggcuaauuuuuguauuuuuaguagagacaggguuucaccauguugacuggguuggucuuguacuccugaaccugaggugaccugcccgccuuggcuucccuaagugcuggaauuacaggugugagccagugcaccuggccugcucugcuuuuaaagaagcagaauuugucuagauguuuuugaagaacauuauguaauaaaauagcaguaagaguaugaauucucgauauguauugaaaauuagagucuuuaaaagucuugguguuuagaaauuaauauuaguuuuaauaugacucuuuaauaaugaagaauauaaaguucucugugugcuggugagaggacuuuuuauuuuuacuccuggaaauacaugauuuguaccagucacuuguguggccauaauauuuuugcccuaaauauuaggucaucauuuccucuuuauuguuagguaacccagaaugcuagguauucucuaacagaagaaaaaaaaauugguuugcaguccugguaagcuguuggagauuuuaauaaucccaauaaaauauuuccauuuuucaaauguguuuagauguccuuggcagauuuagauuaguuacaugagauggauagaaaacaggcucagggcuuaggguuuauuuugaugauuuuuaaaauuuguugaaauaagaguuguuuuauuuaaggaaaaaauaauauuucuggauuaaguauuucaaaugcguuauuuuuggagagaugcuacagagcuuaugucaaaugauuauuaauauauauauauuuuuuuugagacggcaucucacugugucacccaggcugaagugcagugucgcgaucuuggcucacugcaagcucugcuuccugaguucacgccauucucuugccucagccucccgaguagcugcggcuacagacacgugucaccacaccuagcuaauuuuuuuguauuuuuaguagagacgggguuucacuguguuagccaggacgcuuuugaucucccgaccucaugaucugccugcgucuaccucccaaagugcugggauuacaggcaugagccaccgcauacggccuauuaauucuuaaaaacaauugugaccaugauauuagcaccuaaagcacuauuccuuuucuuagccuugggaagacuucauggucaugaauacuauuaauuugauuuuuuaaaauuaugagugccauauggcuguagaaugcagagguuucaugaaauauauucagugagaaccagaagugauuuacuaaugccucaaacucauuuaaauaucuaccaauucaacauauaaaauugucuucacgagaaacauuacgggguaugauuuuguauuugaucauaaugcuugcuaauuauuuccuguuaguauuacugguaaaauggggguuggcaaauucuagauagugaugccacauaugugugguguggguuccuuacaaaacuuuauuugcugcuuaauuuuguaacauugcaucauucccuaaauagccucaagauccaaauacaauugcaguaauacuugcugaaaauuggaaacuauuaaaaacauucauuugcugggaaucaggagaggggagggaauuucaaauaauagagguuuuuuuuuauuaaaaaaaaaaacucacaaaaucuuugauccacugucucucaaaaggcaauuugauagcuaaaugcaaguauuuuuuuuuuuuuuuuuugagacagggucuuacuucuucgcccaggcuggagugcaguggcaugaucucagcucacugcaaucucuaccuccugggcucaagcgauccucccaccucagccucccaaguagcugggucuacaggcauauaccaccgcuaauuuuuguauuuuuguaguguuggggcuucaccguguugucaaggcuggucuugaacuccugagcucaagcaauccgccugccuuggccuuccuggugggauuacagggauuacagccacugcgccuagccuaaauauauuaauaaguuuuaaaguuuuauauuauuuccauuucuauuuugguaguaaagguaaaugaacaagcauuauagaucacagacauuuagguuaaaagguccaagcucuuugagaugggauauacuagggacacguuaucuuuuuuuuuuuuuuuuuugagaugaagucuugcucuugucccccaggcuggagugcgguggugcgaucucagcucacugcaaccucacugcaaccuccaccucccggguucaagcgauucuccuaccucaccuugccgaguagcugagauuacaggugccugccaccacgcguggcuaauuuuuguauuuuuaguagagacaggguuucaccauuuuggccaggcuggucuugaacuccugaccucgugauccaccuuccucggccuccuagagugcugggauuacaggugugagccaccgcccccggccggggcacauugccuuuauaacucuauuuaauucccuugcuugcacguugaauagaucuaaaugacugggggaaaaguaaaaacauagucuuuagucccuuucauugugguaaauucacugaaugauagacggaaauuucagccuucuugggucuacugccagguucuguaguuauuuguaugucucauggagaaauccucauugauuacacuguauggcuaaacugacuuaaaacagauaacugagccuauuucaaaauugaaaauucuuuaaaauggaaaguuaguacucuauuguucccaaacuguuggauugcaugccauuuucccaaacucacagacguugauaagauuucaggcaaggggaacaaggaaggggucacaguggaagcgaauucuuccccuuuuucugacuguguuugcccaccuguccuuuacccuucgcaguucuauucugagagguaugugaggaagaugggagccacugcugcuagauuguugccauuaaccagcuuucauggcuuuugugggagccuccuuuucauuaguauuugcaacauguucaccagcaaaaugauuauguuaggcagagacaucacaucacuuacauuucauagcucagugcaauuuucauaaacugcgaggcaacauccaaaaaaaacaugacucagaauuagaguuucagaagauuauuauauagacauuauuucccucaggucacgggcuuuagucaaauuuggaggagaaugaaauugccaacagugaaaagcagacagaaagguaugaguucaugagcagagaaauaacauuuucauuuguuccuuccccaugggaaagauucagcauuccgguaaauggagacgguuauaagaaaugaauuuuugucagcagggaugugauuuuaaggcucacuuauccauuggcaaucuagauuucuaaccccaggaaucugggaaauugcuacagaauguagucuuuauuauaaacaaguuuuuuuuuuuggggggggguaguuuuucccuccuucuuuucuuggucagagcuuuuuaagacgaaggacuacauuucuuucugcauuucuggggucagaugauugcagauuucccaucugcccugaguuucucuccauugcuguugcuuugugauggaaacccuuucuuuccuccucaccaagcuucccucacucugucguugcuuuuccuaaccccccuguguuuauccagcacgacacugacaauauugaaagcugcaaacuuccuauauggccauggagugguggaucuauggccugaucucucuguuccccagcauuuacaggaugucuugugcugcugcugauucuauauccucaguucuuuugugucuguggaccugaaagagcaaggcaggaaauacagcuuuccagguagcucucauuuuaccagguauaaagagcgaggauuugcaagguuucuguaagguaaucccagacaaccuucuucguaauuaaagaacguucuuucaugggaaauuuuauuuuccuucuucgauuucaucagaugcuucucagcccaucacucauucagauucuaugcaaugguucuuuuucuagcuagaguacauccuugagaguagaaaauauuucauauaaucuaaacccuucauuucuagagaugcagauagauucuguaacauuaaucucaccuuuauauuuuuucaauuuuuaauaacuugaaaauauguauaucuaaugccuucuuucccuaugcacuuuugcuuauuuuaauauuucucaacaccauaagcuauuugcccagcugcauccuuauuagacagugcuauugccugccaaagcuuuuugagagcaaauugcauugccuucauuauuauuaugucuacaauauaaugauuaugaaacaucauuauuauaguugauuaauaaaugauaauugaugacucucaguucauaggauuuggcccaugaaauucaucacaauuuguaaacuuuucuccaaaccuucaaggauucuaaaaggauugauuuugcugcaaaguauaugcgauuacauuuuuugauaccuaguaaguaguagugguugaggauucacuggccuggccagagugaggguguauacuaaaugucugugggguuucaauuucuuccuauugaauucuuuuaaaauguagagucucuuaccacugggaguuuggggaacuucgcacaguggcucaugccuguaaucccaguacuuugggaggccgagguagguggaucacgaggucaggagaucgagaccauccuggcuaacacagugaaacccugucucuacuaaaaaugcaaaaaauuagccagguaugguggugggugccuguagucugaggcaggagaauggcgugaacccgggaggcggagcuugcagugagccgaggucgugccacuguacuccagccugggcaacagagcgggaccccgucucaaaaaaaaaaaaaaagaaagagagaaagaaaauguugacggaaggcauucuaucucagucucugcaaugagccauucgcauuuuguggaauccuuucuggcauuaauugggggacagaaacagcaucuggcauauuuacaugacaguagcauguacuucucuuuuauaugucauucauucguacuuccaauaaguucuuuucuaauaugagcauacauugcuuuauugugcuuggcagauacuguauuuuuuacaaauuaaaguuuuguguaaaccuuacaucaagcaagucugucagcaccguuuuuccaacagcauaugcucacuucaugucucugugugacauuuugguaauucuugcacuauuucaaacuuuuuuauuauaauuauaacuguuguggugaucugugaucagugaucuuugauguuacuauuuuaguuauuuuggagugacauaaaccucgcuauauaagaacaguguguguucuguuucaccaaccugccuuuccucucucucucucuccuucccuggccuuccuauucccugagacacaacaauauugaaauuaggucaguuaauaacacuacacuggacucuaaguguuugagugaaaaaagagucucaugucacucacuugaauaaaucaaacucuagaaaugauuuagcuuaguaaggaaggcauguugaaagccaagaugggcugaaagcuaagucucuugcaccuguuggccaaguugugaaugcaaaggaaaagugauuaaaggaaauaauaggugcuacuccagugaacacaugagugauaagaaagugaaacagcccuuuugcugauauggagaaauuuuaggagucuugaugggagaugaaaccaguuacaacauucccuuaagccaaaaccuaauccauacaaggcucucuguucaauucuguggagagugagagaggcaaggaagcugcagaagaaaagcuggaagcuaucagagugugguuuaagagguuuaaggaaaggaacuaucucuagaacagaaaacugcagggugaaacacaagugcugauggaguagcuguggcauguuacccagaagaucuagcuaagaucauugauaaagguggccacguugaauaacagaguuuuacuguagacaaaacagccuucuauuagaagaagaugccaccuaugacuuucaaagcuagaaaggagaagucccaugccuagcuucaaaggacaggcugacucuucguaggaggcuaauguagcuggugacuuuaaguugaaaccauugcuuauuuuaucauuccaaaaauuguagggcacuuaaaaauuaugccaaaucugcccugugcucuagaaauaaaacaacaaagcugggaugacagcacaucuguuuacgacaugguuuacuaaauauuuuaagcccgcuauugagaccuacugcuuggaaaaaaagauuccuuuuaaaguauuacuauucauugauaauguacaugaucacccaagggcucugauggaguuguacaaggagauaaauguuguuuucaugccuggugacagaacauuuauuuuaccauucauggaucaagaaguaauuucaacuuucaagucucauuauuuaagaaaugcauuucauaaggcuuuagccaccguaauuagugauuuccucugauggaucugggcaaagucaauugaaaccuuuagcaaaggauuccccauucuagaugccauuaagaacauucaugacauauaggaggaaaucaaaauaccaacaugaacaggaauuuggaagaaguuuauuccaaacuuaauggaugucuuugagguguucaaggcuucaguagaggaaauugcugcagaugcauggaaauaucaagagaacuagcauuagaauuggggccuugaagguguuacugaauuucugcaaucucaucaccaaaauugaacagaugaggaguugcuucuuuauggaugaacaaagaaaguguuuucuugagauggagucuacuccuggugaagaugcugugaauguuguugaaacuacagcaaagaauuuagaauauuccauaaacucaguugauaaaucaguggcgguauuugaggauugacuucacuuuuuaaagaaguucuauguggguaauaugcuaucaaacagcuucccaugcuacagagaaaucuuucaugaaaggaagagucaguugauggagcaaacuucauuggugucuuacugcaagaaauugccacagccacccaaccuucagcaaccaccagucugaucagucagcaaccaucaacauguaugcaagacccuccaccagcaaaaagauuaugacuugccaaaggauaccugcaaaaauccauccaccagacucagguguuuguuagcauauuuuuagcaauaaagcauuuuuaaaauuaagguaacuacauugaauuuuuagacauaaugcuauuauacacauauagccuaauaugucuauuaguuuuagacauaaugcuaucaauuauguuaauaacuuaacauaauuuuuguguucacugggaaaccaaaaguucaugggacuugcuuuauugcaauauucauuuuauuguggugguuuggaaccaaaucuacaaugucuuagguauuccuguauuuucauuaagaaguaguaugacuaucucacauaaaggcugauaaccuggaagacacuuagauuucaauauaguuuggaaccugucuggauuccauguauuacuucaacaggagugaagaaucccauagucugaugaauuuuugcagguauucucuucaccauaaugagguuucauuaggguuacugcuagaauaggauuguuuguuauuaguuuccaaugaaggauggaauauucucaauguaggaauucauaguacguacaagaaagcuauagauauuguuaguauaauaauuauacaauaguaguaguauaauaaaauauucaagcaaucacuuaauaauuacuucaagucucacugucugcccuccagaaucaggagcaggaugucugaacuccucauucuuuacacuuuuacucaaaagcucuuaacucuagagacagucuuuaacuuuuugguauuugguuucuucuuuugugcaauggcaaugauucugccugugcaaacaacugucaacuguuuuucucagcagugcuaguguaaaugaaguugaauauuaggaauaauuaaccuuccuugcuuacauaugccauuugauaaugcucaaucuucuuuguuaagaaaacaaugcaguaaaaucuuuguuaauugagaugaaguguuguuuauuuaaauuuggaucauucugaaaaauauauuuguuccaacaggcuuauuccugaaaaucuuucuaaaauauguucagugucugucugccuuagaaugguccccaaauauaauugaaucucucucuggugauggguugucuugcacagccuaggacccaucauacuggagugcuuuucucucugaaucaagcagcagauaacggaauuuggacugcuuugaucucagaucauacccuggaaguuguguuuuaauaaguaaauuucuuauaugaauuguuuucuuaguguuguaccucauucuucauaaaaguaaaaaguauauuagcaaguuacagaacaagaaguaucauguugccuaaucaaugcaaaauaucaucauuuccuagacaacuucacaggagacauagcaugauuagaaggucagacuugauuaaaucccgugcuuugcccuuaguuuuuugaaauuucaaaggaggcaaucucucugucaauaaauuuucaaauuuuauaaauaauaguaauccugaugccagcaagcaguuauugagcuuugugugccaaguacuguucuaagcauguuucaaguaauaacucacuucuucacaaugagccuuucaaggagguacuguuauugacaucauuuuucuagugaggagccugaggcuuagauucagaaaccugugagucgccauauagcuaguagcuggccgagccaugauuugaacuuagcugugcucaaaaccaccacaccaugauaccucagagaugaaugugugcguggugguuaugggagaagagaaccacauuuacuuauuuuuugucugggucuugcaugguguuuuagaucauuucauuucuguuauuucauuuugaaacauuucuacuauaauuauuauccauauuuuacauauagggaaucuagucucagaaaaacugaagcuuauaaccaauauuuuacagcuagugauaaugagggagcagacauuugaacuugacaaccuaaauucagguucuggcuagggguuucguuaaggaaaggaaaaauucccuccaacaaaggucauuuuuaugauguguaagugauuuaagcuuucuguauaccaccccaccccuuacaaagauuuguguuuucauuuuuaauuaaaucugucuguucugcauucucauuguuuggacuuuuuucaaaucauugcuaauacacugguucuucuuccuguuagugguuugugguugacugguucaucuucuaccguuaacauaauucuguuuuuuuuuuuuuuuugagguggagucuugcgcugucaccaggcuggagugcaguggcaugaucuuggcucacugcaaccucugccucccggguucaagcgauucuccugccucagccucccgaguagcuggggcuacaggugugugccaccacacccagcuaauuuuuguauuuuuuguagagacaggguuucaucauuguucuuauuuuuauuugucauuccuggaaauuaauuuugcuuugaguuugggaccccuaacaugauguccuuuagccccgugaagagugaaugucccuguggugccauuagccacuuguacaguguccugagaauauuuuaagagaaauaugaauggcaguaccacuuggauaccaauuaaaaauacuuuuuuuuuucagugaaauacgucuuuaaaccugcaagacacagaggguugguucucuugguuuccuuagucauuauugacaucaucuauaacuuucuguugaaauaacaaggauuuuuauggaaagcuguuuuuguuccuguuccuguugccaguuuucacauccuuauauauuauuaaagauacagaaugggcuuuuaauagauccuacaggccaggcacaguggcucaugccuguaaucccagcccuuugggaggcugaggcggguggaucccaugaggucaggaguuugagaccagccuggccaacaugacgaauccccgucucuacuaaaaauacaaaaauuagcugggcgugguggcaggugccuguaguuucagcuguucaggaggcugaggcaugagaaucgcuugaacccaguagauggagguugcagugagcugagauggugcugcucacuccaaccugggcgacagagggagacugucuaaaaaaaaaaauguaggucuuauggagucacagagucuuaaugaaucuccauuguuauaugacagggucuuauggaugucuuuuggaaugcccagcagcaagugggcagcuucuuaacaacccacugugacucaugaggaagugugucuuuguguuguuuaugacuguguuuuuauggguaggacuucccacugucucacuuuccuggcuugccuucucuucuguuuacccuggccccaccuuuggcucagcugggcacuacggguuuuaccagagucaguuggaaugcaagugcaucacaccagcucuccaucucccuguggcauuuuauggcucagagaggauuggaacuaaaccuuggguggcucaugaucgguuguacccagccaagucuggagaaauggagaaaaugccuggguuuguuagucuacauguccuucacauucuuacagacacgucuuuugaguccagagaaauguaaaucuuuuccuuuuuguuuuuagugguuuauuucucaggcccugaagcaugaguuuuggucaccccuacagcaggggagauuucuucaaaaacagcugugauuauccgaagguguuacauugugcuuuucuuuucaugcauuuuuagcaccugcacaucauaguuuucccgggaaccuccagcagugucaccugcuaacuuggcagacuggagagacucucaaagccaugucugacuucuguguccaucuggauuauuucugucacaugaugauuuggcagauguuuucugcagaucucuagcucugguaaacaauggugaacugggcccauauacucaacuuguaaagagugauuuccccaaaaacaggagacagacauuuagcaagauaggggcuccuucaugugaaaguugaucucuaagguuaguauaaauuuucugaucuagagggaauuauaggacucugaggcccacccuuacuagcuugccaccaggcuugguauaaccuucauugcaaaugcuaggauucaugcuuugguuguacaugaaggggauuauuucugggugguauuuuaucuccuacucucagacucuuucagaucuagcuggauguucaacauaagccuuuuguguaauucccaugggcuguagcucuguggcuugaguaguggucacaggagcucuaaugccagaauaaaugaugcugcuaacagaaaaaaguagggcucauuucucugcaaaaugcugcacaaagaagacuuucuuugcuucuucugguacaugugguaagcguagaaauaguuuauuauggaagucuuucagccacaggucuuucuaaggcaaaauuguauccuccagggaaacuaaaauaaauaccagccuaauaaacuucagauuuuaaaaaauaaguuaucauauugcauuucuguaagaagaaaaauaugaaagguugauguguguuuuuauuccacuuugauuuacuucccaagcuguccugucccaauucaaucuuaaaauggaagaaaauacuuuaucauuugaagaaggaugaauguaguacagaauucaauuuuuaagaauucaagguaggggaaguaaauuuugaugccaacuuucaaguuuuuaaagaauaaaauaaaauaaacacauacacacacaguuggcuuuguguuggaaguuaaugauagaugucuucucgguauucuuugcaaaggaagucuuccauccaggcuuucccucauuuguuuuuaauuacagucauggucuaccuggccuucucacuagcacuagcucccuaugccuuuugcuuugcucuuaggccgggcuuuuggucccucccuccucaucucugguucucucgcuauuccuuggcuccucuugucuugcugcccaguuuggcucagguacaugaacugcaaccuacauucugccaucccugcagcugcacaagccugucguuuuccauacuauuguauuuucaggucuaacauguccccuuuuuacugcccuuucucagucuacuuuagugguuauuaucuugucaucaaucucuuuaaauauggcuaggcuccgaagauuccucuauugacuauuguguuugcuuuauuuuauaaaauuuauuauuaaauaaagcuaggaaauguaauauaauaggcuuccauuuacccaccacccagcuugaaaagcaauucugaauuugcuauuuauguuacuaauuucuuuauauauuuuucacauaugcaaaucaacaaauauauaguaugcuuauauuuuggaaaauuguaucuuauucuuuaugugcuuuuuuaacuuuuuaaauggaagaugaugcuugugagauuaauucagguugcuauguuuugcucuuccacuacugcauaguauucuauuuuaagccuaugccaccauuuauucuauuuaugagcauucagauuguuuucauuuuuguuauuacgaacaauguuucugugaacaugcuuguacagaucuccuugcacuucugucaauuuauuauuucagcauauuuuauugagcaccuauuagugcuuggcgugauugauacaagacugcuaaaacaagucguaucuugaagccauaugcuuuagagagacaaacaggcaaauucuguuguaggagucuucucaccuaucuucuuauuuuuauuucacuccuccuuugucauauuucacaguucugcuaaaguuaacuuuuuuuuuucuuuuuuuuuuugagauggaguuuugcucuuguugcccaggcuggagugcaguggcgccaucucggcucacuguaaccucugcuuccuggguucaaggauucuccugccucagccuccugaguagcugagauugcaggcacucgccaccacacccagcuaauuuuuuuguauuuuuaauagagacgggguuucaccauguuggccaagcuggucuggaacuccugaccucaggugauccgccccccucggccucccaaagugcugggauuacaggcgugagccaccaagcccagcugagcuaacuuuuuuuuuuuuuuuuuuugagauggagucucucucugucacccaggcuggagugcaguggaaugaucuuggcucacugcaagcuccaccucccagguucacgccauucuccugccucagccucccgaguagcugggauuacaggcacccgccaccacgccuggcuaauuuuuuuguauuuuuaguagagacgguauuucaucguguuagccaggauggucucgaucgaucuccugaccucaugauccgcccaucucggccucccaaagugcugggauuacaggcgugagccaccacgcccagcugagcuaacuuuuuaaacauaguuuuaaucauuacuguuauugucaaaaacauucaaagucucccuguugcuuaugugauaaaguugauacuccucagcuugccauucaagaaccauccuagcuuaaccuuuucuccuguuuacaucucacccauacaccuuucagaugccagugucauuucccuuucaugccucucagugauauuucuuuacccuuagcuaucuugccuguuuugaacuuuauccaggauguugaggcuuuacucaguuuucaagauccaaaugaaauaguuuauuauuccucuuauacccuucgucuaaguguuuauugcagauagugggauaugcauuuguuuagcugacuaggagcaggaaccauaugguaauugccuccaacauaguaggaccucauuaauuaaaauaauaauuuauaaucaaaucgaacugaauggaucauuugguucucagcuuugcuguuaaaacucuuuaaugguccuaaugggaggagggaguagaaauagagugaauguuuuaguuuucuguugcuuuucaaauguuucugacucucaauaagugcuuguagcuuacuaaccgagcaaccauucuaagcgggauccuuaccacaucaaagugggauagguugagaagaaaacuggcuuuaguaagagagacagauucuucauaaaaaaaaaaaaaagaccauauucucaccuuaguaggauugaacuaaagcauacuuaaaccagcuuccauucucaucucuuggucaccuccuuucugccuuuuggguggcaauacacguugauggccugucaccuaucaugcccuucuacuuaucuccaguccccaggguagaaggcagauguggcugcaugugaauaaggggaagcccgaguccacuguguccgcguuuccauuuugaaggaaaaugggagaaaugaggccagugguuugauaaauuauaucaaaaauagucccuucaugcuaauggagugcgaagaagcugauguacuggagaugaucuauaauauuucauauuucucugaggagaaaaaugauaaacuugaugaugugcaauuuauucauguuucuucagaugagaaaaaaaaauccucaagucaacuaacugccuguuucucacuccuggaagcuggcauguggauuuuacacugggauuggaggcugggcuuguuuagagaaaugccuagagagacuuugauuaaucaccagaccuuuggcaguugguugggagaggguaauuacgcuagcauugccacuauuuuaucaucgcuauuuuauggcucuacaccgccaggugacaaauguguuaauuauugcauuucuuauccuggacuucucuugccugcccccuccccucaugguuuuggcccuuaguccuucucugcagcucagcccuggacggcaguaacuugugcaaucaaagagcuguucuuugggagccaugcugagagggacagggcuaucagcccugcugugugcagacgcuaaccacggggagcugguuaauucccuuuccucuuccuucugcccaucacccuuugggucaagugcugcucagagccagaagcuccacuggcuucuuuaauaacugaaaauagcaccccuggacugggccauuucacucuaaauagcccccuggaggagguuagaaacagagguugucuuaggcaaagagauuuaggagguaaaauuguccuuuuucugucuuuuucuuuuuuuuuuuuuuuuguugccccuucugucuuucuguuacccagagaaagcuucacaagcaugccuguaauuuaguugcaccauuuuauuacagcugaaagaauugaauguaaagaaggaaguuuaauagaacauauaauucagcagauuuauugauggggagguaucuauuguaguuuggccagugaaggcaggucauagaggaaaauuuagguaagucggauuuucuuuaaaaagaggcccaagaguuaguaccucaggauuuuguuuucuucuguuccuugggcaugcuggaaauuuguuagcucuuaaaucaacaacuuguuauugacagucaucuuuuugcuggagaacguauuaaaauaaguauaauuauggugccugaccucaaaaagaaaaccaguugguuauauaacucuaaaaagaugaguagccacagaguguagaaagccacagagaagagcaaaugccauuguugggaagcagagccuaugcuggguaaaguuuccugggaguuucauccuccaagaacaagaauuucuucuucugacccuccaccuucucuggaaauggggugccacaucuuuugccuucuggcuaaauuuuuguuuauuauaugccucuuucacuagaaugcaagaacaugacuacuugguuauguucuugcuuguaauccuuguuuuuagaacaagaccugacaacucgauuauggucaguauauauauuuuuuggauguaugaaugaauaaaugaaaugagaucuuaacauguaacuaucuucuuuuagacuacacaggguuuugacuauaauugaaauuuuuaggcuucuucagcucucucuuuuuuggguccaaaggaugucucaaaccaaauaagaaauuccuucuuauugaucuagugguuacagacaagagacgccagccuucuuugucuuuuggaaguuaggagugugucccugaggaaacuaugcccugggaagguucuuuauuuauaauacaaaauuucuuuuuugugguugagcuagauacagauauuuuucaauuuuuccuuucuucgaaggcuauauuuuggcuuaaucuguacuuacagcauaacuauucaugcuaauuauaauucauauaugaaaaugcaccaaauaugacuauuagaagcuuuugaaauacuguuugauacuuugcaauauaguuauuuaugcauaucugcauuugauuuuaaacuucuugaaguaauguuuuauuuauuuuuguaucuccauugcucagcaaaggguggcacauaguagguccuucaugaacuaauauucacuagagcacugugggaacuuauuugcaacacccuuggcaucucucuuauccauuggggauagcaaguaauuugaacugucaaaaccagugguguugcuuugggccuaaaugacauuaaacuuuuuuuuuuuuuuuuuuuuuuuuuuuaagaaacgaggaucuuccuauguugcgcucgcuaguggucuucaaccucuggccucaagugauccuccuaccuuggccucccaaagugcugggauuacaguugugagccaccgcaccuggccccaacauucaacuguuuuuucugacaguaacuaagaaugggauaaaugccucucugaggccuuucccaguuugugaggccacuugucuuauuauuugugauugcaggaggacaugcaucauauucaucuaaagguugaauacauuuauuuaauuguggcuugugaagaaagaagagcuaauauguggucacguuuuaugcuauuuaggaucgaaaaucagucagucaugaagccauuucuuuucauucuacuuuuggagaucauauuaugauaagcuuuucagaagcauuaauaaccuagacucaagccuauguaguuuggaccuucaugucuuuacauguguagaaucaaagagcaauaggaguugguguauaugugacuugagaagccucacaucauucuuggaauauguugucacuagugucaucaguggggccuacgugcccugccugccaacucaggaaaggcgugagauugagggaucuagauuuagcauuuauugaggaaaaaguguuguauaaacuauugaaauuuuacauaaaaaacaaauagaucuguuuugggaaaugaagauuuucaaaagaaauaugguccauuuugaaagagauaauugcaggauauauuuuaguguggccuggagcuuaccaaucagaaugauauuuugacauucauggugucaaaagguaauuucuuuuugccuugaaucuuaugcuugaaguauguuauucauguagcuauauauaaugggauuacauuuuaggggaacuucgggaugauauguaaaaauccugaagaaguugucuuuguguuuuaaaacaagaaaaacuugacacaaacuggcuuacaggaauguguuucuugcagguuucccuuagaagccacacaggaggcaguuuucauuggcugaugauguuuauggguauaaaaaagaaacuuugggaggauuugauaaagucucuuuucagcuuaagauaacaucauuuuacucacguuagagcguuugugugugauuggaguuuugauggugguuauauuuuuggcuuuuuuuaauguuuguugcuuacugccauuccugaaccaaaagauaaguuguucagauaauugcaaagacagauuaugguaauagugauacuaauaucuaacauacuacauuaaauauguggaauuuaauuuaauuuuuugagauggagucucacucugucacccgggcuggagugcaguggcgugaugucagcucacugcaaccuccgccuccuggguugaaggauucuccugccucagccuucugaguagcuggaauuacaggcgcccgccaccaugucccaguuaauuuuugcauuuuuaguagagaugagguuucaccuguuggccaggcugguccugaacuccugaccucaggugauccaccugccucagccucccaaagugcuggcauuauaggcaugagccaccgugcccagccaauauguguaauuuuaauuauuuagcacuuauagcaauuuuauaagauggguacuuuguuuaucccuauuuuuuagauaaggaaacugaggcagcagagguuaaagaaacuugcccaaaguuagguagcuaauaaguaguagaagcaggauucaaacugagguauucuggcucuguaauccaugcucuucuaugcacugccuuugcaaaucuaauuucaacuugaaaugaguucaguggauugauaguagauuaguaggggagccauuccaaagaguuucuuauaauuaagugaacuugagaauguaacuggcaacagugaagagauucccacucuauuucaucuguaacuuucugaucuuaccgugguggucacauuuguuguaagaauauuuauggugguguuuaggauaaguuuaaggaaauguugaucacuuuuuguuugaucugagauauugauagauauuuauauacuuuauaaauagguaauuagguauauauguaaauauguaagauauauaccuauuaauuaccuauuaaaucauucaugcuggccucuggguauuuacaugaauuuuuuucaguaagucuugccuuucagauauauauaaacuagauuaugcuuaaauauuuauuuggacaaguguuuuccucuuuaguuaagaggccaucuucugaaaaauuagacugcaguaaagcaguaauuccgccucaguuuuccaugagggaagauuugucauggcuacuccuacuuuuggcauuauaaucacgugaacuuauuauucaaauuaauggcuucuuggcauaauuuucagaggucucuacugcaaaucucagacaucuacaaaucaguacaugucauaauaaaaggaagaauacagacugucagacauacucaacuagucuucuuuuuuuuuuuuuuuuuuuuugagacggagucacuagucuucuuuuggaaucacaucaggaaagggaaguuguuagugcuuaugccagguagcuggaagacaucuuugugauauuuaugaagaucagcccuguugggcaaucguugccucugccagaaugacuuacccauuuaucuaauaaagggaaacaucuaaauucuugaacauguaauaauucacuugauaaaauucagguuuuuauaaacaaaucauauuaaaaccccaaaaguuaauuaacaggugauaaaccuugcuuuuacuuccuugucccaucacauucauucauagucauaauacacugacaauuauugagugccuuugaugugccaaaagcacuugcuaaaugcuuuguuuggaaagggauguuuguuaauuggggugguaccucccaaauaaugaaacauacacacuuuuguuuuauugaggauaggguuuuaucauuccacagcuguuccuugaguaagauccgggcuugaaaggccaaguucuucuacaggggcggaucuuugaggaggaagaggcagguagcuaggaagggcuaggaggcuacagagguuaaaaguggucugagauuagggagaauggcuaaaagugagugagauuuucucucgugugugaauaauuguaggaagagauucuggacaacauaugcagaggaacaaauggagggauggucuuuagucaguggaaguggaaauccauuggaucauccaugagcccaucugaaaucagcagcccguuagguagaagcuugaaaaaaagaacuguuguguuuggugaauauaucacgauuuuggagaaugaugagggcagaauccugcauccuuucuagcuuucuugagaacuuuguacgagagucacucuuaccaucaucuaaauauaagugauguguccugcuguuaaggaauuccaccauuugcuagcuaguggacauaaaugggcaucuuguuuucuuuucuuucuuucuuucuuuuuuuuuuuuuugagacggaguugcgcucugucgcccaggcuggagugcaguggccucccaaagugcugagauugcaggugugagccaccgcaaccggcugcaucuuuuuuucuuuauuaauuauuuauaugucuggaagucuagauauauauuugucuucgggaauggaaagguaccaauaggaaauuuugaguaagccagaguauucuagcaaauauaggaauuacgccaagaacagccagaauugcccagcacuagugauaaccuggugaaaagaaagaccaucaauuuauguguuccaaaaaugaugucagcauugcaagaggagagcugacugcguaggcucauccucauuucucaggagagugugccuguaaaugaccaaccaauuacaagcagaugauaaugaagcaaaaugauguaaaucaagaucugaggagugacauuuauggccaagacuugauaaauauggaauuggagaaagaagauaggaaacaccagaggaggacagcaaggacuguaguuuuuuuuacuguggauaagcccaacucccuacuguggcauugaaucuuggccaggcaauaguuugauugcugauuuccuuagaagggaaggauucuuguguaggauuaaaguaaaaguaauuccaugacaacuuguuacugaggaagacagccaaauacauauuucaugaguaagcaacagucauuuugguggaauaugguguguuacguaaagcuuggugcuagauuaaugcccaggugaccacuuggaggacaaucaguguagcccugugaaagauacaaaguauugccugccuaagucucaguuucuuugucuguaaaauguguguuuaaguggagcugugagacaaugagaauauauguaaggugccuggcacuuaacaguuguucaguuucucucucuugagcauccucaaagcuccuuuuauugauuucuuugaugcugaaagaaagagaauaaauuuugacugcacgaugagcuucauuuuuugaaggugcugauucucacccccauuuccagcuacauugacuaucguuagccacuuguuacccaucuagugaagccaucuucuauagugcaguguguguuaguaggaaaggcuuauuuggccuugaagggcucguuuggccuugauccgguacugauugugguuugagguugagcauguuaaggaugaauaguagcuggaaugguccaugaugugugcuuaguauccuucagaauguuuacauagucauauuuagauugcuucugagaacaagagaauacagaacaaaauguuauguuccaaauaaagaucacaauaagaagaaauauugcccuucuagcuuggcauccuuuuucugccaugauuucccuuugcauuuucuucccauaccuuagcuuuagccaaggauacagcaguaaguguugcuugguauuuaaucaaauuaaaaccugugcuagguaaugccucauagauuuuauuuugccaagauagauguuugaacggaaaaagaaauaguguauauuaaggacuaaaggggguacucuuguuuucuuucaaauaugauaauuaguauaaaacugucuuuuuccugccaguuggcucaucucaucuccuagcagcuguuuuaaauuccuuaauugucuauugcuuacucagcuaucauuucacaaauuuccucacugccgcauuuucguugaagcaaauucugacagugggggaugcucaccucacaggcuggguugagcugaguucuaguuauccucuuugaguaacaggauuaacuaucauuagacagugcauucggguaaggugaugguucccuaggucucuuuggaguugauuacuauagaaaugggcaucugguggagccucagguugccaauugcauuacucuucauuuuacugauguuucaauucuguuuaacccaacguagacuuuuuuuuaugcuuauaaaguaauaggaguuuccuagaggauuugcagcguacacuauuguauaaucucauugcuuauaauuuuuuuucagaaugaaggaaguggguauuuuaaccauagcauuuucauuccaguaucauuaaccauuuaaauacacuuuguuaaaucuaucacauuuucuguuaaaauaauguaaaauucuaguagaaauuuuaacaguaucuuacuguaaaaauacuguagguaauagacccugagauaagacagucugcugcuuucagaagcaucaacacagagcauuccucaagcauuugauuuaaguaaauauuauugaagccuuacuaaauucaauuucagauauugugcucuuugauagcacaaugacagcuuacauaugaugcuuucaaaugucauccacuuauuucuuuuuuuuuuuuuuuuuuuuuuuuugagacagagucuccucuguugcccaggcuggagugcaguggcgcaaucucggcucacugcaagcucugccucccggguuuacaccauucucccaccucagccucccuaguagcugggacuacaggugcucgccaccaugccuggcuaauuuuguuuuuguauuuuuaguagagacgggguuuaaccauauuagccaggauggucucggucuccugaccucaugauccucccaccuuggccucccaaagugcugggauuauaggcgugagccaccacacccagcccacuuauuucuuaaugaugggaaaacugguaauacaagaccaaauuuuuguuuauacaucaaauuaucaacuuucaugucuuauuucauagucaugcauugcaggaaugugcguacugcauaaagugacuugcuuuaucagguuugaaauucauaauacagucagaagaugauuaacagauuuguucaaauuuuuaugcuacgauauguucuuguccccaugugaauaaaugcaacagauuguuuguaaccauuuuaauugcucugauuuuacauggacaauaguuuuguauaagaaaagacaaaaaaggccaggcccgguggcucacaacuguaauccuagcacuuugggaggccgagguggguggaucacuugggguuaggaguuuaaaaccagccuggcuaacaugguaaaauccugucucuacuaaaaauacaaaaaaaaaaauuagcuaggcgugguggugggugccuauaaucccagcuauucaggaggcugaggcaggggagaaagaaaaaaaaaaagaaaagagaaaaguagucacuugguuuaaaugccuggauuuugaaaccuaacuccuuguuuuaccucuguaguuuuaggcaaaucacuuaacuugauugaaucucaguuacucucacuauaaaaaugggaccaguaauaccuucuucaaugugaucuugagaagauucacuggaauaauggugaaaguacccuaucacagaauuuauaguaggugcuaaaaauguuguguaccuuccuuuccuucccuuagaaagacagucucuuuuauuuauugauuguacuuuugccaccacagggggaaaaaaaucccuguuucuuauaaaacuuucuaggaaauucaugaauuuagugugggcccucuaauucugacaaauacaauauugauuuugaguuuguugcuuuaaauuugccaaaugaaacgaaaguuuuacgguuuuccuuuuaagucacuucugauauguggagcaaacaagucuguauuuaauaguaaguaguuugcuaauugcaaagcacuaccaacuuaacacaacuuaaaaugagaagcugagagggggccagagcaugaaauaaguaaguagguuaagaacugccacacaguccaucaugcuugcagagaagaaugugagacuguccgaggcuacagugcuggucaccuuagccuguguaaacucucacuuucucaguuaucaguggaagacagggguuaauccuuauuagucugaacacaucacauugcaaugaucugaaagcuaaagacauggcauaaaggaacucugaagaaaccaccuccacugagacugcugaugcuucgaauggaauuugggcagauggaaugcucauuuaaggagcaaaugacauggacggggggagucaaaaugauaaagggagccuccuugcauuuguuguaucuuacuucugugugaguucuggcaaaaagcaagcaugacuagaacccuagaaaaacaaccauuagguagauacuaguuauagucaaucagagaaagccaguaugugcgaagagagaagagaagaaaaccacaugguaaaaauguaaucaaccagugggauucuuuuaguucauaauuguaaucauagauggcauuccacuaccuuugucuuccaucuggaccaaguauggcugugucuagagguucuguuguacuauuucugugguccuugaacucugauggcaaccuaccuugacaaggccaaaaaccuacacaacucugagccuuucuugguaguggcauuaucuaaacguaugcauuuguaccuuaucaggcuuaaugagggaaaagaaacggcuuuugaagacacuaaugggaaauuauuauaagucaaugaaguaaaaaugcaaauagauuuguaucuuaaaacaggaauacugcuagaagcuaaaacugaguaagaucuugcucugugccaagcacaugcuauuuugcauuaaaagagaccccugccuucuacauaguauccucauuuuacggguagaaaucuugagguuuagagacguaaaguaaaguaacucaccuaaaguuacauagcucaugagcaauguggcagauguuuaaggacaccucgucugauuucagcgccuaaaugaagagccuuuuacaaggaugaugauuuuugcagcaacaagacaaagauguccagcaauaggaaaaagauuguaaagaaauguuaaucccuguagagggcacuguucagauuuaacucauccaacauaauuuucuaacaugauaaagcagaccugcgccagcuccugacuguuucagauagguuugccucuggggaagaaagugcagugauucguguaaccuacugucaguguuauuuaaaucucagaccuaaucuagaauuuacuuuaauaaucuuuuauuauuuuccuguauauucuuaugauuucucccuucucaaugaauaaugaauuuagcauaaugaauucaguuaguucuaggcuucuucauaucuauauuuaauauucaaagcacuuucuucucuuuuauuccugauuuaccaaaaucugugauugugccaugaaaagaugauaaaggagaccaucucuuggaucuggaaagugcugcguguuaguuuauaacugggcaaauguaagcauaacguuuggccaggguugggugcgguggcucacgccuguaaucccagcacuuugggaggucaagauggguagaucucuuuaggucaggcauuugagaccagccuggccaacauggugaaacccugucucuacuaaaaauacaaaaauuagcuggauguggugacagacaccuguaauuccagcuacucaggaggcugaggcaagagaaucacuugaaccugggaggcagagguggcagugaaccgagaguggcacugcacucuaaccugggcgacagagcgagacccugucucaaaaauaaauaaauaaauaaaaaauaaaaaaaguuugaccagaggacuaccuccauugucuuucuuuucuacaauccaguuuagauacuuucuggacuaaccauaacuuacaugcuuguccaggaguauuggccagaguuagaguggucacauuaauucuaggcaagggugaagaugaaggaguagagccauguuuccuugaaggacagugaugaugcuuuuuagagcuuauuacguguuugcuaucucucccaucccaagcagucagggguuuuaacuuugaagauaauaauaacugucuucagugggugaauuuacaucuguuuugacccaaaagauaauuuaggaugacuuauggaaucugaagcuaaaugucaaauguaauuaaauguuacuguugugucuugccuuaagaagagagcuggugaguucuagcaggguuugggaacuauuuggauuaacugcuuugauucuuucccacauuauauaagagguguuaucucagacagcacagaaauugucccugggggacagggaggcaucacauuucagaaguaccuauaauauuucuucagcaugucuuugggccuggcuuucucaauauuucuaccuuuucuugaaaucuccacuuggauauggcucuggaagauggcagaaacgccaucuuaaaauauacauaauauuuuuaagaaaucaguuuugaaaaacaagaagucucuuuuccugacgguccuuccucaauaugcuuaaauuauugaauaggaaagcuucaguaagacacaacuauuaacauaagugcuaaggauuaagaaaaagaucugucacaaauuaugucugucuguaggaagguaaaguugugccuuugauaugacaccuaccccuggaaaucauauucuuuuccaagauauaaacccaaaucagaauagggagugagcuguuaauaugaauacugaaucuggacaggcacgguggcucacgccuguaaucccagcacuuugggaggcugaggugggcauaucccuugaggucaggaguucaagaccagccuggccaacauggugaaacccugucucuacuaaaaauacaaaagaaaauuagucgggcacugugcuguguaucaguagucccggcuacuugggaagcugaggcacaaaaaucgcuugaacuugggaggcagagguugcagugacccgagauugugccgcugcacuccagccugcacgacacagugaaauucugucucaaagaacaaaacaaaaccaaaagaauucuaaaucugcucugaauaguagaagacaaugggagacauuuaucuuugguagcaacauauuccaaagacuuaagaguuuaaagaaaucaucauuuuccuaucgcuuccuuccuuucucucucaauccuaaaauacucucugggcaaucaauuucggaauucuuucaaggaaaggaaaccuugauucgucugccuguuaacuacuacaaaauguguagauuccugcucuuccauguuacuacucagaguaauaacgaaacaccuauuauugucauuaucuggagaaaagaagcuccuauacuggauuaaaugauguugcugugcccauaagaaaggcagguauugggcaguaaugaagguauggcagcaggaauuuauacuuugucucuuucaucagaguagcuccccccuccccuuuuuauccuguaggaggaaauuguggagugagagaagaggucugaucuguuuggggaaaaaguaucacagccuauuaguuagaagcaaugaaauugagacagcuuugggacuccauuaagugugugguguuuaggcagacugugucccuggguaaagugugcuguugaagaggauaguacacaaugaaauaauugggcuugggaaaucaacugggcuucagcagccucauaucuccuuguggggaaugggugagggagcuacagcuuucccucccuucuuuuagcauaaaagcuauaccgaauaaaauagaagggaauuucuugcugaguagauggacugugaauauauuuugaauaacacaaacaauggagauaauuaaauuuugucuggcacaggaaggauucagagcaugucacuuggaacccccucaugccauguucuucucuaggcgucuggauauaugguugcagcaacugaauaaaaauaacucagauuugaucaguaauggcagcaucuauagggacauguuuuaaugcacugauguguaugaaauuagguucuuaaauaaaacauuauuccuggauauuuucauuucaaaggauaagcugaaauucacgaacagugugaacuagacugacuuuucccacugagauuuacugauaggcaaacuuuugugcacauuguggacacugguugaggguaggcucacuaguuuugguacuauuaauggucaguugccuguagaacuugugaaguaagaaaagguauaucuauagcaaguucaagguucagauaauuguuguucucucuuaagaaaaagguuuugagcgguugucuucuuuacacuuaguguauguaaugauaguuuggcuaaauaugaagaagaaagagaaauagcauuacuacuguuuauuaauaacuuuucuuugugccacacauuuagcuauucaggcacuuuguguuuguguguauacauauacauucucuuauauacauuugcgacaugugguaaaaggcccuacuuuuuggagucagaaauugugcucauuucuguaucugccaccuuguagcuguuggcucuugaacaacaacuaagccucuacuuugaacaucaauuuucucaguaaaaugagggaacuagacuaaauaguugccaaaauucuuaguccacacacacacacacacacacacacccauuuuguacuucuaaagacacuggaaagaaguuuacggauggaggaggagccaagauggccgaauaggaacagcuccggucuacagcucccagcgugagcgacgcagaagacgggugauuucugcauuuccaucugagguaccggguucaucucacuagggagugccagacagugggcgcaggccagugugugugcgcaccgugcgcgagccgaagcagggcgaggcauugccucaccugggaagcgcaaggggucagggaguucccuuuccgagucaaagaaaggggugacggacgcaccuggaaaaucgggucacucccacccgaauauugcgcuuuucagaccggcuuaagaaacggcgcaccacgagacuauaucccacaccuggcucagaggguccuacgcccacggaaucucgcugauugcuagcacagcagucugagaucaaacugcaaggcggcaacgaggcugggggaggggcgcccgccauugcccaggcuugcuuagguaaacaaagcagccgggaagcucgaacuggguggagcccaccacagcucaaggaggccugccugccucuguaggcuccaccucugggggcagggcacagacaaacaaaaagacagcaguaaccucugcagacuuaagugucccugucugacagcuuugaagagagcagugguucucccagcacgcagcuggagaucugagaacgggcagacugccuccucaagugggucccugaccccugacccccgagcagccuaacugggaggcaccccccagcaggggcacacugacaccucacacggcaggguauuccaacagaccugcagcugaggguccugucuguuagaaggaaaacuaacaaccagaaaggacaucuacaccgaaaacccaucuguacaucaccaucaucaaagaccaaaauagauaaaaccacaaagauggggaaaaaacagaacagaaaaacuggaaacucuaaaacgcagagcgccucuccuccuccaaaggaacgcaguuccucaccagcaacagaacaaagcuggauggagaaugauuuugacaagcugagagaagaaggcuucagacgaucaaauuacucugagcuacgggauaacauucaaaccaaaggcaaagaaguugaaaacuuugaaaaaaauuuagaagaauguauaacuagaauaaccaauacagagaagugcuuaaaggagcugauggagcugaaaaccaaggcucgagaacuaagugaagaaugcagaagccucaggagccgaugcgaucaacuggaagaaaggguaucagcaauggaagaugaaaugaaugaaaugaagcgagaagggaaguuuagagaaaaaagaauaaaaagaaaugagcaaagccuccaagaaauaugggacuaugugaaaagaccaaaucuacgucugauugguguaccugaaagugauguggagaauggaaccaaguuggaaaacacucugcaggauauuauccaggagaacuuccccaaucuagcaaggcaggccaacguucagauucaggaaauacagagaacaccacaaagauacuccucgagaagagcaacuccaagacacauaauugucagauucaccaaaguugaaaugaaggaaaaaauguuaagggcaaccagagagaaaggucggguuacccucaaaggaaagcccaucagacuaacagcggaucucucggcagaaacccuacaagccagaagagagugggggccaauauucaacauucuuaaagaaaagaauuuucaacccagaauuucauauccagccaaacuaagcuucauaagugaaggagaaauaaaauacuuuauagacaagcaaaugcugagagauuuugucaccaccaggccugcccuaaaagagcuccugaaggaagcgcuaaacauggaaaggaacaaccgguaccagccgcugcaaaaucaugccaaaauguaaagaccaucgagacuaggaagaaacugcaucaacuaaugagcaaaaucaccagcuaacaucauaaugacaggaucaaauucacacauaacaauauuaacuuuaaauauaaauggacuaaauucugcaauuaaaagacacagacuggcaaguuggauaaagagucaagacccaucagugugcuguauucaggaaacccaucucacgugcagagacacacauaggcucaaaauaaaaggauggaggaagaucuaccaagccaauggaaaacaaaaaaaggcagggguugcaauccuagucucugauaaaacagacuuuaaaccaacaaagaucaaaagagacaaagaaggccauuacauaaugguaaagggaucaauucaacaagaggagcuaacuauccuaaauauuuaugcacccaauacaggagcacccagauucauaaagcaaguccucagugaccuacaaagagacuuagacucccacacauuaauaaugggagacuuuaacaccccacugucaacauuagacagaucaacgagacagaaagucaacaaggauacccaggaauugaacucagcucugcaccaagcagaccuaauagacaucuacagaacucuccaccccaaaucaacagaauauacauuuuuuucagcaccacaccacaccuauuccaaaauugaccacauacuuggaaguaaagcucuccucagcaaauguaaaagaacagaaauuauaacaaacuaucucucagaccacagugcaaucaaacuagaacucaggauuaagaaucucacucaaagccgcucaacuacauggaaacugaacaaccugcuccugaaugacuacuggguacauaacgaaaugaaggcagaaauaaagauauucuuugaaaccaacgagaacaaagacaccacauaccagaaucucugggaugcauucaaagcaguguguagagggaaauuuauagcacuaaaugccuacaagagaaagcaggaaagauccaaaauugacacccuaacaucacaauuaaaagaacuagaaaagcaagagcaaacacauucaaaagcuagcagaaggcaagaaauaacuaaaaucagagcagaacugaaggaaauagagacacaaaaaacccuucaaaaacucaaugaauccaggagcugguuuuuugaaaggaucaacaaaauugauagaccgcuagcaagacuaauaaagaaaaaaagagagaagaaucaaauagacacaauaaaaaaugauaaaggggauaucaccaccgaucccacagaaauacaaacuaccaucagagaauacuacaaacaccucuacgcaaauaaacuagaaaaucuagaagaaauggauacauuccucgacacauacacucucccaagacuaaaccaggaagaaguugaaucucugaauagaccaauaacaggcucugaaauuguggcaauaaucaauaguuuaccaaccaaaaagaguccaggaccagauggauucacagccgaauucuaccagagguacaaggaggaacugguaccauuccuucugaaacuauuccaaucaauagaaaaagagggaauccucccuaacucauuuuaugaggccagcaucauucugauaccaaagccgggcagagacacaaccaaaaaagagaauuuuagaccaauauccuugaugaacauugaugcaaaaauccucaauaaaauacuggcaaaccgaauccagcagcacaucaaaaagcuuauccaccaugaucaagugggcuucaucccugggaugcaaggcugguucaauauacgcaaaucaauaaauguaauccagcauauaaacagagccaaagacaaaaaccacaugauuaucucaauagaugcagaaaaagccuuugacaaaauucaacaacccuucaugcuaaaaacucucaauaaauuagguauugaugggauguauuucaaaauaauaagagcuaucuaugacaaacccacagccaauaucauacugaaugggcaaaaacuggaagcauucccuuugaaaacuggcacaagacagggaugcccucucucaccgcuccuauucaacauaguguuggaaguucuggccagggcaaucaggcaggagaaggaaauaaaggguauucaauuaggaaaagaggaagucaaauugucccuguuugcagacgacaugauuguuuaucuagaaaaccccaucgucucagcccaaaaucuccuuaagcugauaagcaacuucagcaaagucucaggauacaaaaucaauguacaaaaaucacaagcauucuuauacaccaacaacagacaaacagagagccaaaucaugggugaacucccauucacaauugcuucaaagagaauaaaauaccuaggaauccaacuuacaagggaugugaaggaccucuucaaggagaacuacaaaccacugcucaaggaaauaaaagaggacacaaacaaauggaagaacauuccaugcucauggguaggaagaaucaauaucgugaaaauggccauacugcccaagguaauuuacagauucaaugccauccccaucaagcuaccaaugacuuucuucacagaauuggaaaaaacuacuuuaaaguucauauggaaccaaaaaagagcccgcauugccaagucaauccuaagccaaaagaacaaagcuggaggcaucacacuaccugacuucaaacuauacuacaaggcuacaguaaccaaaacagcaugguacugguaccaaaacagagacauagaucaauggaacagaacagagcccucagaaauaaugccgcauaucuacaacuaucugaucuuugacaaaccugagaaaaacaagcaauggggaaaggauucccuauuuaauaaauggugcugggaaaacuggcuagccauauguagaaagcugaaacuggaucccuuccuuacaccuuauacaaaaaucaauucaagauggauuaaagauuuaaacguuaaaccuaaaaccauaaaaacccuagaagaaaaccuaggcauuaccauucaggacauaggcgugggcaaggacuucauguccaaaacaccaaaagcaauggcaacaaaagacaaaauugacaaaugggaucuaauuaaacuaaagagcuucugcacagcaaaagaaacuaccaucagagugaacaggcaaccuacaacaugggagaaaauuuucgcaaccuacucaucugacaaagggcuaauauccagaaucuacaaugaacucaaacaaauuuacaagaaaaaaacaaacaaccccaucaaaaagugggcgaaggacaugaacagacacuucucaaaagaagacauuuaugcagccaaaaaacacaugaagaaaugcucaucaucacuggccaucagagaaaugcaaaucaaaaccacuaugagauaucaucucacaccaguuagaauggcaaucauuaaaaagucaggaaacaacaggugcuggagaggaugcggagaaauaggaacacuuuuacacuguuggugggacuguaaacuaguucaaccauuguggaagucaguguggcgauuccucagggaucuagaacuagaaauaccauuugacccagccaucccauuacuggguauauacccaaaugaguauaaaucaugcugcuauaaagacacaugcacacauauguuuauugcggcacuauucacaauagcaaagacuuggaaccaacccaaauguccaacaaugauagacuggauuaagaaaauguggcacauauacaccauggaauacuaugcagccauaaaaaaugaugaguucauauccuuuguagggacauggaugaaauuggaaaccaucucucaguaaacuaucgcaagaacaaaaaaccaaacaccgcauauucucacucauaggugggaauugaacaaugagaucacauggacacaggaaggggaauaucacacucuggggacugugguggggucgggggaggggggagggauagcauugggagauauaccuaaugcuagaugacacauuagugggugcagcgcaccagcauggcacauguauacauauguaacuaaccugcacaaugugcacauguacccuaaaacuuagaguauaauaaaaaaaaaaaaaaaaaagaaguuuacggauaaaagaaugagaaguagacugacauuguacuuuucauuaacguguugaaugccuaaagaauggaaggaaaauaagcuuaaaauuuugaaucuaugauaaagaaaacuauugauuaaccauaugcauauuugacauuaaaauaauucauaauuaggacuaacagauuucuggcuuaaaaaaucuaacaauuacuuuaagaagcaaaagacauuuccagaauaaaguagggggauauauagaaaaguugguaccuuuuuuaaacagagucuucuuuuguaaggaaguagaauuuauucaucaaaggagauuuaugaaaaguauggugguauagugaguggccucacuaguuuuaaugauugauauuugaauauagcuuagucuuauaacaacuccccaaauaaaaauuuaaaauucauuuguaucccuuugauuuucagugcuaaaaacuagauugugaaugucaaggaaauauuuaaguuauuucugaacuaauguauuuguagagagaagaagggagugugcacgugaucgagaauuauguuuugaaaauaaaugaaugauuggcuauuaaaaaaauuuuuaagccuuaaaaaaaaaaaaaaaagacacuguauaaauguuaguuguuugagcauuuuuguauauacguguauguccacacacauauacacaacauuuuaaaauaacaucaguuauuuucccucuuuuauguuuuuauuuuccuaauaauucauaccagugauguaagauagugguacccagaccccauaaucuaagaggaauuuguugccauuugaacaaggaauguguugccucauucauauuuucaaaaggauauaaauacauuguuguauaucuuuaggggaaauauauauucaguauuuuaaccagaguucucacugcuguguucccacauuguuaauaucagguaguuugccuagauguucacaguagaaguacagggauguagaaacauggucuuucuucccaaagaagucauuuuucuuuaaaauuugugaaauaaaugaauuaauugagucagccuuuaacauaguaauccauuuugcauuauucagcuuugauugaaagagacagagaaaauauguuuugucgggggguggggagaaugggagauagagauuucucagaauuaacagggugcucuauagcucaauaagaggcccuguauauacagcaggauagauuuguaguuaguuaaggaaaucuuaagucuaaagguuguaauucccuuagaauuccuguaaguuaauuguuuuucccccacuguaaugcauacccuugaaaggcaggaaccuucuguuuaucauuguaucccaagggccuaucauaagcaccugguaaccaauaaauguugaacugauauaugaaauuuuccugaucuuagagauuaaguauuauccucauggucuaggggaauaaaacauccacacguccaaaccauaguaauucuguuuccauauucugcuaucuauggguuucauuauuuuaaguauucuaaacuuacagagagcaagacuaauacuuuaaaauuuuauuuuggucuauagggaaaaaaaaagguuauuugaguuuggugacuguguccaucacuuugguuuaccacugaauucacagcagauacuaagaaguaucugcauuguuuuguuugguuugguuggguuuuuaaaacagggucuugcugugucacccaggcuggagugcaguggcaugaucauagcccacugcaaccucaaacccagagugaauggaucuuccugccucagccucccaagaagcugggacuucaggaaugcaccauuugugccuggcuaauuuuuauuuuuuuauuuuuuguagacaugggaucucacuguauugcccaggcuggucuugaacucuuagccucaggugacccuccugccucugucuccugaguagcugcaaucacuuaauccuuuaauagucccaccaaucuauuauuaucucuguuugacaacuuaugaaacugaggucagauagggcaaaugcagucaugcaccauauaacaacgugucagucaacaacagaccacauauauaguggagauccaauaaauuauaauaacauauuuuuacaguacuuuucuguauuuagacacacaaauacuugccauuauguuacaguacuguacuacauaggcaacuaugcuauucaguacaguaacaugcuguagagguuuguagccuaggagcaauaggcuauaccauagagccuagguguauagcagacuguacaaucuagguuuuuguaaguauacucuaugaaguuugcacagcaacgagaucacuuaacaauacauuucucagaacguaugcccauuguuaagcaaagcgagacuguaauugaccuaaggucacacaguuaacaaguagugagguuuuaaacuaaggccuuugaccagugcucuugaucauuacagagugguaccaacaugguagcauaagcuuuaagaggagggaaaacuugguucccguggcuuuaucagggaagacuucuuagaggagguagcaguuaagcuagcccuuaaagaauaagucuuaucuugaacugaauguaugcuagagucagaauuauagaggauuagauucagaauaaaaggccaucuguuucaaguuccuaauuugcagaggagaaaacugggaucugugagguuaaauaacuuguuguaggacauauggcuaauuaaguggcauuagaacuguucucuucccuccucuauccuguguuauucccugucccccuccguuaaugcacacuagcucauguuaagucuguuuuuucaucaacacuuucuaauaagaguuccuaaaaacauuuuacagcuugaaaguggaggcuuucuuguguaucuauguauggugaugagguuaaaccaggaaagggucagggcaggcauggaaggagauacuagagauacguggagacauggagagacagaccuuuucuaucuguuuuuuguuuuuuuuuccuagcauuuuacuuuauuguuacaucuguuuccuuccauaaguauagauaauugaguguugagagaaaggggacaaaugaaauucuaaugagaaaaaaaugauuuaaaauuccacaaaaucuauggaauuucagccucuuaaguaaccugggauguuuuuaacuuucacuaauguuuauuagccaguguccuuccugccacccaccuacaaggaugucucaaggaugaaaugaggucauauaugugaauacacacuuaggauacaacugccauguauuggcagucuugucuguucccugggccuacacuguuccuugccucaaaauguaguacuaucagguaguguugauguuucauuagccaagugguuauaucagauuuauguacugcuaaacaauugaucugggacuuggguaaauacucauuggaaaaacauuuguuguauucugagugcucccuguuaaucuucuccuccucagauagcaagcuagaucugggacuuaagguggauuuuuuuccuuauuuuuuuuuccuuuguuuuacccaaugauugaaaauauaaaacuaaaccuuuuucaguaaagucugaaucagcagauacuuacauuacuuuggcauaggcuuuuuauagacuagcuagaagaauacaguaauuagcauaugcauuuccucauuaaaaugucauuagugaaggcuuuguucuuuuaagguccuucaaauaagguuuauugcauugcauuccaucacuaauauuuuaccaggagucagauaucuuacuuagguguguugaagcaaggguuacuuuggacuuucuauaggguaaugaccuaagagcagaccuggacacacauaaaucucuaugcuuacauugggugggcccuacuuuauguacuaguaauaauuaccagucucuucucacacuguccauucagaauccuuuggauauauagacauuuagcaaaccuagacuuguuugaaagaauaaacuguuaucugcacuaaacuguuuuccuugguuaucuugguaggauuugauuugaaaaaaauguaugaagaauuagaagaaaagaaauuuauaauguacuauaaucauuugagauacaguauuaugcaggaguaagaauacaggcuuuagaaucagaccauugaggauucaaauucuugcuucaucauuuacugguuguguaacuuugugauacuuagccuuuauaaaccucaauugucugaauguaauacggaaauaugagugguccauaccuuauaggaauguuugagaauucaguuagauuaugcauguaaaguauuuagcacugcugccuggaauauaugaucuauuauuacauuaccggcugggcaugguggcucacgccuguauucccagcacuuugggaggccgaggaggguggaucaccugagcucaaggguuugagaccagccugaccaacauggugaaaccccaucucuacuaaauauaaaaaauuagccgggcaugguggugcaugccuguaaucccagauacuugggaggcugaggcaggagaaucgcuugaacccaggaggcagagguuguagggagucgagauugcgccauugcacuccagccugggcaacaagagugaaacuccaucucaaaaaaaaaaaaaaaaaaaaaaaccaacaaaaaauuaucuuuauaauagaaaaaaggaguguguguauuuucauauguauuguaucugcuuucuacacaucuuugacuuaagaaauccuaacaugaaauuucaaaacaaguaagaagguauuuaaggaguggucauuaauaucauuaauuggcuuaaggcaaacuuucuuuaaaaagucacacacaugguguauucaaaauaaacuacuucacuuaaucauuuuaacauuucugcuaugcagcgugacuagcaacuugaaggagcaaguuaggaaaugccuuugaugaccccaugacaucacuauguuauuaaauaacuggaaauaaacugaaaauuaugggauagucuuuaaggcuuucaugacauuucagcauuuuaggguugcaguauuccaaggacuuuuagaguaauugcaugucauccuuuguguguugugggcaaauuuggguuagcuaaaaguuggucaguuaaaaaaaauuuauauuaagcaucuacucugagccaggcauuguucuuuuuugcugugaauauagugcugaacaagaacagaagccuugcugucaaagacguaacauuccaggguaagaaaauagauaacucauaaagaaggaaaugauuaauucagauacuugugaggcuauggagaagauaaccuaggcuaacgugauagagauggguggugaggaugugaguuaaggggaggccuuuugcagguuguugggaggagaugcaaguguuccaagcagaagaaagaagaaguacaaagucccugauacacuaacaaucuugguguguucaagggacaggaaaaaggccgguguggcuggaauuugguguucaaagcaagagaggagagauaaaggaagaugagucaugcagagccuuuugaaggcuguggguaaaauguauguuauacggaacuuaguucuaaaucuaguugcaguggauuaaccuggagagugaugcaaacugaguuuuacucuggaaaaacacugugacuguuguguggagaauaugcucccaaguguagaaacuagaucaccuugcaugggccaagagagauggugguaguuuaagacuaggauuguagcagugaaauguaaagugguugcauucggacauauuuuggauagagauuugacaggagguagguggauuggacaugggauguaaaguaaaaagaggaagcaaggaugacuuccaggaguuuagcuugagcagcuggauggcugauaucauguguaggcauagggaaagguuguaugaggaagaauuuauagggugugagggugugaagcagggaauaauuuuguuuugacauguuaugaaagaaaugccaauugacggcuaagaaaagaugucaucugggcagguaaagaaucuaggagauugggaaaauguccagcguggagguauaaaugugaaaaccaucagcauaugggauugaaagcuauggggcuguuuggauucccuaggaagagaauauaaauaaagaagggggcugagaacagagucucauuuauaauauccugauaaggaagaagacccagugaaggagaugaagaaggagaagccagugauguaacacaagcauggaucauggcaaaagagaaaaagguguuucauaaacaaggaugcuugguauggccaccugugucaguacugugaaguugaauaugaucaggacaaauaauauuaauuggggcuuuauauuucuccuuuacuacaaccgauuaaugaaacaaaaaauuaaccuagcacccaagguguuucuuauaguuggucucuccagucuguuuuaguaucauuuguuaguuauuuccccaaacuaauguuuagcuucuuucuccaaaaagaauauauuuuuuuuccugguucugcuuguuggaaucccccccuccaccaugauauaaaaguaauggggcuuauuguaagaaaacagaaaauacaagaaaauaagggacaagauuuuuaaaaauggauucaauucugggaacaacaaaugacauugggguauaggaauuaaaccgugugcauucugucucucaccccaauuuuauagucauuugcuggggaccuuuucuccccaggguacuugcauagcuuuugucaagaauaacccuucucacuuccccaccuccuucuucuacaugcagaugcagcacuuuucuggguaaaguuuuagcaaugccuuccuucuaaaaugaaagcauuuucuccucacgauuagcaucuguuuauagaauaguucguauuuucguaauuagauccugcauagaaaugcaaaggcugcuguguaaaaggauaaugaaucuuuauugcacaguugaaaucagauuugugcaaaaggcacuuugaaaacaguaauaagcagagacauguauuaaaucacccagauaaggcacccacuuuauauuuucuauuuauaaauggaaauuaugacuacccaguggauuccauaugacauuuccuauuaccagcaaagguuuuuagcuuugaccauaaaaguuaucuaaauucaaaagccucuguggauucauggcucuaagaauacuucuggaaggggccaagacagaguggaaaggguccuuugucuuuuucuuuuguguguguaugcacucugcagaggggaagguuagcaagugguagaagaaagaagccauuugaaauaaccaugauaagaucuaaucaggaaacccaguguccauuacacacaugugguaacauuuuaagacucuucugguugggcuccuugagaaccaagcucguguucuuauaagcucauccuuauauuuucccauuguaugcaucguugcauggcaaacacaggauuuauucccaagcuaaaccugucucuugggguuucuuaucuuuuaccuccuuggugagccucgggaagcuagagcauugcucuauggagaaaggaggguggcauugggaggaaggguaggaaaaacauuauugggaagcagagaaagucaaugucaaaugaacugccaaggaugaauauuauggcugcugggagccucggagaguaucgugugucuuaugugucuauuucacagucggugcuucaugugagauggcagucucgccuggaccgugcuuaguaucgauuuacucucaggcaugccagaccauuuuagcauugcugaaggaaggaaauccuauguauuuccccuuauaaacagacauaucaaaaguguaucuuuuaaaccuuuuucuuucugucuucuuacuguucuuucugucuuacuguaacuccuccucccucccugauuuaaaagaauuuuuuuuuuuuuuuuuaaaagaaaaaagacuuucuggccgggcgcggugguucacgccuauaaucccagcacuuugggaggcagaagcgggcggaucacgaggucaggagauuaagaccauccugauuaacauggugaaaccccgucucuacuaaaaauacaaaaaauuagccggaugugguggugggcgccuguagucccagcuacucggaaggcugaggcaggagaauggcgucaaccugggaggcggagguugcagugagccgagaucgcgccacugcacuccagccugggugacagagcgagacucugucucaaagaaaaaaaaagaaaaaaagaaaaaagacuuucuuauuaagagagcauuauacaggccaggcgcgguggcucaugccuguaaucucagcacuuugggaggccgaggcagguggaucacgaggucaggagaucgagaccauccuggcuaacauggugaaaucccgucucuacuaaaaauacaaaaaauuagcggggcgugauggcgggcgucuguagucccagcuacucgggcggcugaggcaggagaauggagugagccugggaggcggagcuugcagcgagcugagaucucaccacugcacuccagccugggcaacagagcgagacuccgucucaaagagagagagagacagcauuauacagagaacaaauugaguagacuuuuuuagaaugauagagugucaguaacuacucauaccugugggggaaagaaaaaggcuucaaacuuugcacacuucuagcccuuccaugaaaauagaaggaccuuauuugaggcuaguuuugugguggugggaucugagcacugcugaguguuaacaaaagggaauaaauugaugccaaauuuagagaccaaaaaugccaucauuuucaccugccugaacucuucuguuguuuucccuaguugcugccuugcgcuuuuuccgcaguacagggagagaaaucaguugucuggcugucuaaacucacggcaucugcuuagcaguuucaccagcucauaguugggacucaucccucugucagaauccuuugcuccauuagaagggagacugggaccacguuccugaauugauuugcauacuucuacguuaccuagcucagacaacauauggccauguggagcacuuggauuuauuucuguuuccucaaauuaaauuccuaaaaaauuggauaacuccacaguuuguuugguguuacaaaaaauuuuaguuccuuuuuuggucggcaaagcaacacaauuuuggcauuaaaaaaaaaucucuggauuacuuuaaaaagaguguugauuugauuugcuuccccucuucucuuaccccuuucaggaaaaaaaaaaauguauguugaaucuuaaaacacugcaucauguugcaaaauguccauuuaggcacacugaauagaaaguaucaucgagucauuuuuauucuuguaauucaguaaucuuguaucuuuugccuuuuucuuuuuccuuaauguuaauuguguaacuaaaugucucaaacuugggacuuuucacuuuacacauccauguguaaaaauacauagauacauacagucagauagaagaaauaagacucaguguuaauagaucagugguuggggugggggaacuauacuuaacaauaguauguuguacauuucacaguagccaaaagagaacaauucaaauguucuuaacauaaagaaaagauaaauauaucaggugauaggcauucuaauuacucugauuugaucuucccacauuauauaaauguaucaaauuaucacguacuccccauuaauaauacuguauaucaacgaauuuuuuuaaaaaaagaaauagauaucauacaaugaauaacuggauuaaugugaaaugauagaaaaaguuaccauuuuaggcuggauguggugacccacgccuguaauaccaguacuuugugagucugaggcaguaggauugcuugaggccaggaguuugagaccagccugguuaacgauacaagacccccuuucuaaaaaaaaaaaaaaaaaagccaagugcagcagcauaugccuguagucccaacuacugagggcauagagguaggaggaucauggaucacuggaucacuugaggaguuugaaguugcaggaagcuaugauccuaucacugcacuccagccgaggugacagagcagcaagacccugucucaaaaaaaaaaaaaaaaguuacuauuuuaaaugcacuucaacuuugaacaguacuaauguaugaaaaucaucuugucuucuuuaggaaauucuuuguugccuaaauuagggauagguaucauacacuggaaugagcucuaaaacgauggcucuugcuaugggaaacaguuuuauuuggguacucaugucuucucucuuaagggaucuuaggaagaggcuacaugguaaagaagaaauagcaugggcuuuagagucaagaggccugaguuuuaauucucaggcuuuauuuguccuucugcaguggccuuagcaaauauuauaaccucccuaaaguuagaguuauuguaauugucguacauacaauguuaucauaagaaaacagugagauaacagauaucaaaguaccugggcaguguuugacacuugguggucuauaaauauaaauaucauuucauuccugaagguaacugcagcacuuuugaaaggcugguuugaugcuaacacaggaggauuagaccuaauuauauauuucuaaggucuuagaaauggggagcuagguuuuucagacaauauacuguauuuuguuuuuccucccuuuugcuuuaaaacagaaggcaauuuguuucaaacucugugcuccaaacugguggcuuaauuaggcaaguuuauugacugucacagaggcugugguuaaaaacuggcaaauaucaugugacuauauuaguaucucugagcaaauaaagggaaaagacaggauuccacccaaccacauuuuuuucuuucucuuuucucccaagcucauucuugcacugcaacauuccacuuauaaucuguuaauuaaaucauuucacuccauuuuauauaauuuuuaauuuagcauucauuuucaacuuagcuuuuggcuucauuuacugauaauaaacaguguugcauacaacacauguuccacaaaacacucagucacacacauacagaugccaauaauuuuuuccaguaugucaggcauauuaaaauuaaaggcagcaucuccccucacccuuuccauuacugaaugugcacccuguuugaauaauacauacuccccgacagccagcaguggucuaauguguaaaaauuauguguagcgugucacuaguaccuuuuuuuaaauucgugguuuucucagacaugcucuguggaagguuucuggaauggucacuucgauaccuuggaucuguauauuuggcuuaauguauacaaacaguaauauuuucuagacuuauuacuuuauggguuuauagcuaugugauaguuauugagaaagaaaacucuaguguagcauucaaauuacuuuucuuguagcuuauuuuuugaaucauagucugaauucuaaauauaugaauaucuuuaaccguagaugauauccagaaguuuccaagacugcaagcucagggguuuauggaccacuuuuaaaagauagauacuaagccaggcacaguggcucacgccaguaaugccagcacuuugagcaagcaagauggacugaucccuugaggccaggaguucaagacuagccugggcaacauacugagaccccgucucuacaaaaaguacaaaaauuagcuaggugcggugacaucuuuuaguccuagcuacucaggaggcugagaggagaaucacuggaguccaggaguuugaggcugcagugagguaugaucaugccacugcaguccagccuggguaacagaguaagacccuuucucuaaagaaaauaaaaauaaaacauagauaccuguguuguuguuauagcuguucauauccuuagaauuaauuuaccuugucugcuccugcauauuauuugucuccucauaauuagcaaaguuccacagggccagauaucaccaaauaugaauaguagauuuuauucuaaggucagugagaacugaagaauguuaggggcugacucaaucagauuuguuuguauuuauauuuggaaaaauauuacucuccggagaauguuuuggaauguuuggcagggugguuggagagacauacuacaggaaagaaaugaugguaacuuaguuggcagugggaaaagugaguagugaauuacucagagcucuuugggggugaaauggacuggacuuauaucaguugaacuugagaaaaggagaagcaucaaggaugauguaacuuuuagguuucuggcuugagcaguuguguaggugguaguaauuuuucauggugaagaugaugaaauacuuuuuguaccugucucaugauugcuuucuguacaucaaggucagaggucauaagcucauaaaaugcuugguauuagaauucuuacauaaaggaugucuucuguuuuaguuuaguaauacaauuuggcuuaaaucacagacuuucucuaaucuuuguuuugauugucaucugccgagagcuuaagacagcaacucacagguuggcccauugagaaucugacaaaugaaaaauuauaaaaaaaauucagaaucccuauauuguagcccaacuuucuuuagcacuucuauccuugaaugcuagggcaguguuguauacugugaagaucuuuguagauuuuucuacucuguaacauuuuaauaguuccauuuugggguauuacagcuguucaguccuccccauaccucaaauuauaguuagucuccuucaagucccaaauuuccaguguacauauguuucaucuuauguuuaaucuggacagaguguuggaacgaaauauggacccugaaagguguaugacgggcuugaagucucagcccuacuacuugcuuaauguuugauuugcuaauccaaacaauuauaaucuguuaauuaaaucauuucacuccauuucauauaauuuuuaauuuagcauucauuuucaacuuagcagaugcuccuggugucccacccauaccccucuuucccuuccacuuuaguucacaauggcccuccuuccucccgcuaggccuuauauucauucaucuucaggguuugucuagucaaugaauucugcuuugccuaaggaguaggcaggaaguaggugaaaugaacugcuaccugagcaacccacagucaaugacuaaugagaguuguuguauaaauacaccagcuuccuugcuucuuaagugggauaacuuugagguauacauucuacacuggcuuccggaguccucccaguggcauuugcuucuaguugcccauagugguaguuggcugaauaauuacauacccuuuauucccugucugcugucaugaucuuacuuucccagucuccugcuauuguuuaccuccuaaauaaacuucucauugucugcuucugggagaaccccagacuaagacaaccacugcgaacauugguuuccucaucuuuauuuauuauuacuguuuuuugagacagaaucuugcgcugucacccaggcuggagugcaguggcacgaucucagcucacugugaccuccaccucccagguucaagcaauuuucguguuucugugggacgucuuacauaggcguauuuuuuuuuuccggcuacuaccacuauuuggacuaauuauucugaaauuuuacuugccaaguuucagcuuuuauuagcaagaaaaaauguuauguccacaguuuagaauaaaaucacagagaagaaaaguuggaugaggauauugguuugcagucuucugucuguguuucugucuucugagcauucacagauguuccuauccuucuuuccacugguguucacauaaccugggaucuuguguuguaugcagucacucucaagguaggaacuggaagauaaaguaugugggugacauggacuacuuagaaggaaacugaaguuuacauguugagcccaauuagaagcagcugaagagaggagagaaaaaauuaacugagaaguuuaauaggcacuuagagcauggcgaauaaagcugaguggcacccacuuuucauuuccuaguucauucuaguugugcuuuuuuaacugcaaagacuaaaaaacgaaagccuuuauuucccagucugucuugcagcuaggauucugggugugaaucagguauauuugcucaagauuuggaaggucgacaugagguaaagguuauucaucuucagcuuuagcucuuuuuaucugauuagccagggcaggagaaguaugauuuuucuguggugauguuucaguuuucaacucagcuuccuagauguugaaaggcaguuaugaugcgauuuccugaucccagguugcagcuucgcuagugcauuuguagcugggcugcugcaacaauggacuucuguuuauggcagaagaaaggccauacuuuaaccuugucuagugauuuuuuguaagagguugguucucuguauuaaaucacuuccuacagaaaauuucuuaaguguuuucugguuuuuguuuguuuguuuguuuguuuuuaccagaacccuaacugauauagaugguugaagcaaacuuuaugcuguaaagguccagacccagauaaaaacgagagacaggaaagaugcagcaagauggucugcaggccugcccaugcauacacuacuccaugaucuggugucugcaagaaaacaaagcaacugcucauuaaguaacagggcagcuaaugcuuuagcucuugaggcccugugucauauaacuucuaauuccucuaauucauccaccaagggggcagugaggcaguucucuguuugaaugcuacaucguuucugacuuagugcuuugaaguggaugacaucuuacuuuuuuuucuuaucuuagagauaaggugaacagaggaaaaggagaaugauuugcccaaccuuuggcuaaaggagaaaggaaagauuuagaguccagugcuucugacuucccucugaugcgguaacaaggauaauaugaguaucuaauaugcuggggcacaguaagauggcucugaagguaugcacaguagagaaagccaugguccuugcccucagggucugugaucggccacugaggcacacauuuccacuuccuguguuccauuaauuaugcuaauuuuccaacaagccccagccccaccucugucaauuauuuuugucucagccuucuaauuacaacauuauaugaccauucagacugguacuaauuaaaucauuacuuaauucacaaagugugcgauaaugcuaaugcuucuugucagcugaaauuacaacauggcaccuacuuucuucauucuugguagauggggccaggggguugcucuuuuaccaaacaucuuuugcuuacccucugauagccaccugaccaucagccagaaccuaccuucuuccagaacugggaaaacagugcaguagaccuagcgauauguaccuguaauucaucacuaucauaugaaaucaucaucccaguuuuguuuguggaguaaaucuugauacucaagaaaaaaaaauaguaguaagauuuagaguacuauuugcuacauuuuuugucauuuguucugcguauuauuuuuaacagaguaaacaguagcuugucucuuuuucucauuucuaaaacagauuuguuuuccacucaauuagacuugugaucacgagaacacaaaguaguauuuuucuccuucuggagagagacauaccguaugaugggcaaauugucaggaauaauuauaccaaaugauggaauaaaauccaauggaaaacaucucucucauugcuagugauacauuuuuauuuaagacacaaugagcaucaagcacauuuaugacaaggugaaauugacaaguggcccucugccaugauuuuauuuuuaauugcuaguaaacuaauuagccagaacaacauguuguauaauccacaaaacugucgcucaugcguucuccaauaaaagcaagauauaugauguggaaaaguucucuaagagcuagccaaaaaaaaaauuauuucagaauuuugaguguauagacaucacaguaaaagaugucuccucaccaguggaagaacauuuguauauaacauuuguuuugagaucugaacagaaauuaaggacaaacaguaaauuuuuuucuuuuccuuuuuuuuuuuuuuuugagagagagucucgcucuguugccuaggcuggagugcaguggcaugaucuuggcucacugcagccucugccucccggguucaagcgauucuccuaccgcagccucucaaauagcugggauuacaggugcuuaccaccauacccagcuaauuuuuguauuuuuaguagagacaggguuucaccacauuggucaggcugaucucgaacuccugaccucuugauccacccgccucggccucccaaagugcugggauuacaggugugagccacuguacccagccuguuuuuucccuuuuuaagaucaaaguaugcaucaaaauagccaaccacuuucuuacauguaauuaaguuuuauguaguugagucacauuaagucuaagacauacauucuaggacuaagacuuuacagucauucaguaguuacuuauuugugcaaggcuuggcaaccuuuuccuuuaaagggacagauaauacauauuuuugucuuugugggcuguucagucuuugccacaaccacucagcucugauguagagcagccgcagucauagauaacgcaaaaauaaauguggcaguguuccaauaaaacuuuauuuauggacacaaaaauuugauuuuauguaauuuuuauuugucacaaaagauaauucuuugauuuuuuucaaucauuuaaaaauauaaaagccauucuuagcucauggguuauacaaaaggcagggguguggauuuggccuacaggcuguaguugccaaccuuuccucuguaccugcugcaugccagcgucacuccucauucuuuaguaucagacguguguuaggcagggugcuaagcaucgagggauauucagagauagagcaaagucccuucccugaugaagcuuacaguuaagcuagaaaggaaccauagaugggacagagacacauaauauuagauguuaaauggugucccucugugacaaaagccaccauugcuuuacaaguuuaagagagagggaagucacuucagcugauuuaggugaucugcuaaguaagacaugaccuggcuagcuacggaugcauggaaaugaugggauaucagcuggauccugaagaaaaaggcuguggaccuuugaaaagguaacagggcauaaugccuccuuuuagaggaagggggaacugaggauggcgaaaaugucaaccaugagucacuuauuccuaucauuuuucccccaauucuuucuuucaugucuucucaugaaaauuucaaacauauagcaguuuuaaagaauguuacaguuaauacccaaauacucaccauauagauucuaccauuacuauuuugcuauacuguuuuauuguauaucuauccuauccucuuuuguuuuagaauucuggucucgcucugucacccaggcuggagugcaguggucacuacagccugcaacugcugggcucugccuccugaguggccaggacccuauguguguuucaccaccauguuuggcuaauuguaaauaauguuuuguagagaugaagucucacuauguugcccagaguggucucaaacuccugggcucaagcugucccccugucucagccuccugcauuguugggauuacaggcaugagccaccacaccuggcugcuuuauuauauaucuguccuucugucuauucauuaauccauuuuauuuuugguuuauuuuaaauuaaauuucagacaucaagauacauuuucauaaauauuuaagcaugcauaucauuaacuaaaauuuaauguuggcuuauaguuuuucuucuuuugguguaaaauuuauauacaauuaaucguaccaacauuaaauguacauucucugagauuuggaaaggcugauccuuuuguagccuaaauuggaagauacauaaaguuuucaucaccucaggaaguuccuucugucaguccuugcccccagccuaccccuggaggaaccacuacucuaauuuucucugcuuuagguuaguuugccuguucuagaauuucagagaaauggaaucauacagaaccuaucauucggugacucacgccuguauucccaguacuuugggaggcugaggugggcagaucaccugaggucaggaguuugaggccagcuuggccaacauggcgaaaccucgccucuacuaaaaauauaaaaauuagccgagcgugguggugggcaucuguaaucccagcuacucgggaggcugaggccggagaauuacuugaaccugggaggcagggauugcagugagccgaaaucaugccauugcacuccagccuaggugacaagagcagaacugugucucaaaaaaauaauaauaaauaaagaaucuaucauuuggguuuggcuuuuuaucaucauauauuuugucuuuacuugcuuaguaucuagcaagaauauaaaugcaauuauuuugccagagaaaaguauauguuugauuaaggaaaacauaaaauacaacuuuguuuaaauaucuguauguauauucuuaaauuauuguaaaauuaaauuaccuauggauuaaauuuuucacauuaacauuacuuagucuauuaugcuccagcauuuuacauauuuauguuauuuaauuaaaaucuuugcaguagauauuucccauuuugaagaagaggaaacuaagacagcgaauaaaauaauaaacaauauuauuucuuaccucuuacuguugccacuucagugucagggaggaagagggauagcaaauguaggaaggguguuugcaaggugagugaaggugaagcugcuuuguuacaaguuuucuuaucaagaaauggauagaacauaggaguagagaaguucaauaggaacaugcaaaauuugucuauuguaaaagaaggaagaaaacuggagaauuuaaggacuauuuuuuaacaucuaugauuaaaauauuaugaaacaauaucuuuuuaaaaagugauauuuuuccucuaguauaacacaaguuguuagaaacuaaggaaucacccuaucuucuuuaguaaaagccuacaacugguagaguuuuuuuuuuuuuaaggaucucaagauacuucaugaaccucaaaagacuuuaaguucucugcaauguuaggaaaugacuucaugaauaucacaguucaagguucugcuacugcuuuuagaagcccccaaagugugaagacaucuaguacaguauacaguaagaggagaacuggcuuuuauugcucacaauaggaauguucccaucuaucuguuugcaaaccaacucauaaaauauuugaauauucuucacucugcuuuaugauaauauuucuuggcuuggaaauuugcuuuuuuuuuuuuuuuuugagacaaagucucgcccugucacccaggcuggagugcaauggcgugaucucagcucacugcaaccucugccucuuggguucaggcgguucuccugccucagucuccugaguagcugggauuacaggugcccgccaccacacccggcuaauuuuuuguauuuuuaguagagacgggguuucaccauguuggccaggcuggucuugaauuccuaaccuugugauccuccugccuuggccucccaaagugcugugauuacaggugugagccacugcgccuggcugaaauuugcauuuucauuaauagaucauccuuauuuaacaaugaacuuccuauguguuugugacacauggaaaauaaguaggcagcauuuaaugucauuugggaagcagugcuuauaguaguucgguuuacauuccucauacagccaugugccguauagugauguuuccaucaaugacugcauaugcaacagagucccacgagauuauaauggagcugaaaaauuccuauugccucaugacaucauagccugguaagguuauagugcaacaaauuacucucacuucugugcugaugcugguguaaacaaaccuacugcgcugccaguuguauaaaaguacagcauauacaguuauauacgguauauaauacuugauaguaaaagacuauguuacugguuuauguauuuacuauacuguaauuuuacacuuauuuuaguguaguccuucuacuaguuaaaaagaaaaaaguuaacuuuagaacaucucaggcagguucuucaggaaguauuucagaagaggcauuguuaucauaggggaugguagcuccaugcauguuauugccccugaagaccuugcagugugacaagaugugcagcuggaagacaguguuauugaugauccuguuccuguguaguccucggcuagugugcauguuuguaucuuuguuuuuuuuuuuuuuugguugguuuguuucuuagaaggggucuugcuauuuugcccaggcuagucuugaacuccugggcucagugguccucuuaccucagccucccaaguaucugggauuacccacaugcaccacugcaccugucugugucauaguuuuuaacaaaaacauuuauaaaguaggccaugugcaguggcucacgccuguaaucccaacauuuuaagaggcugaggcagguggaucacuugagcccaggaguucaagaucagccugugcaauguggugaaaucuugucucuacaaaaaauacaaaaauuaagugggcaugauggugugugccuguagacucagcuacucuggaagcugaggugugaggaucacuugagcucaggaaguagaggcugcagugaacugagauagugccacugcuauccagagugaagcccugucucaaaguauaauacaauacaauacaguacaguacaauacaauacaauacaauacaauacaauacaauacaauacaauacaauacaauacaauacaauacaauauaauaccauacaauacaauuuaauaaaagaaagguuauagaauauggauauaaaggaagaaaguauuuuuauacagcuguacauuuuuaagcuaaauguuauuaaaaaggauucaaaauuugaacaauauauaaaguaaaaaacauuacaguaggcuaagguuaauuuguuauugaagaaagaaauuuuuaaauaauuuuaguguaaccaacauguacaauguuuauaacaucuacaguaguauacaauaauguccuaggccuucacauucaugcacugcucacucacucacucaccuagagcuacuuccaguccuguaagcuccauucaugguaagugcccuauacagguguaccauuuuuuaaucuuuuauacuauauuuuuauuacgucuuuucugaguuuagauauguuuagauacacaaauacuugccaucagguuacaguugccuacaguauucaguacagucacaugcaaguuuauagccuaggagcaauagguuaugcuauguugccuagguguauaguaggcuauaccauuuagguuugucgaaguguauucuaugaguucauacaaugacagaaucaucuaaugacacauuucucagaacauauucccaucguuaagcaacacaugacugugcuuagucuucuacacaggcuuagucuuccuuguuaauugaaacucuauguuucuucucaguuuaagaagcuuauuucaggacuaauuuucccccuuuuagaauaaguuucccacaucacuugguuacaugacaaaacaaguuaaaucacugucccuuuuuggguuuaauauguccagaugcaaauuaaagaaauaaaaucccuuagauuuuucuguaucuugucucccuuccucauuuucugcagaacaguuuuuaaaaguuaauuuaggaaaucuccaaaauauuagauuagcaugacuucagagcuauaagguuccugaaaaguuuauguagaaauguuguuuuuagugcuuuaauuucucuuauagcaucuugauggguagucauucugccuaaaggagaacugaacucauccugugucccaggagcuuugucauaugaaaaguuguaauccauucuggugcuucagauguugaaggcccagugaaauucuacaagauggcugccacuugagcuuuggccuugcaagugguuaggaagauguugguccuuuaaucucuguacagggguucagaaguaguugauaguuuacuaaugaaaaauguuauauguagcaaaacacaagcaaaaaaaucaaaaacacugaugacuuauauaaauuauuaacuuaaggaagauuaugguacuugaaaaauuauuuuacaaaaaaagauuguauuaggaauuuuuucugcucuuuuuucucaaguuaguaccaauguaacauggcuguguucauguaauuucuuuucucaauuugguucaagauuuguguagcucccagugguagauuuugcgguuguauugcaugauuaaaguguccaucaaaaucuuacaguugguaaacaguauuaaaaauccaucuccagccucuguaaacuguacagagagcuaugaauacuagaagaaauggaaguauuuuaauuaacccaaguaggacuaaucaaagcagagcaaccaguuuauucaauugaacauguaaaugucuauucauucuugacauggcagaacauuuaugucaucuauuaaaagcuauucuguugcuuguaugauuauaagcuauuguucaacggggaacugaaucuuguaaaggcuuccccaccccacuuuuuguuuuuuugagagggagucucacucugucacccagucuggaguacaguagagcaaucuuggcucacugcaagcuccaccucccagguucaugccauucucuugccucagccucagccucccaaguagcugggacuacaggcgcccaccaccaugcccggcuaauuuuuuuuuuuuuuuuuuguauuuucaguagagaugggguuucacuguguuacucaggauggucucaaucuccugaccuugugauccgcccuccuuggccugcugaagugcugggauuagagucgugagccaccauaccuggcccccccuuuuaauaauuacauauuacagauuauuuuuuaacaugcuuuuugcuguauucaggccacuucagauaacccagcuucuugcaugaaagaauacagacuuggguaacuugguucagcuacccugccaucaccucuuuccuucaaaggguuuucucuucuucauuucuucauaauaauucuuaguaaauaucuacuacaugcuggguacauguauucuaagcauguuauaugcaguauaucauuuaauuuuugcaacuauauuguuauuuuuuccauuguaugaugaagacauggaggaagaguguugcauagugcuguaagugguagaaauaggauaugaacacaaaucucagaagauccauuguguugaaaugaauuugaguuguaccaaaggugauugacauuagacaccaggaagaaauuuuugaaaugaguggaugcucuaaggagccuuuuaagugaguacagcuaaaagggguuggggugaagguaguuuccugggauuuuuuauuaccauuaagacacguaaaaacaguuuguauaaaaucccauuuuucaugaauuaguuacauucuuaccuugagccaggaaguuaaacuagauggcugucugaagacccggguaauacauuuaauacagucuuauauguguauaaaaaguggaaacaaugauucuuuuaacuuuuaaauaugaauuuuuauugcaacaacaauuagaaaauauaaauaauacuuacaccccugccauucuaauguaacacuuaguuuugggccuacuuuuuucuggucacuuuucucaugcauuuaaaaaaaaaaaaacaaccuuuuuaaagguuuuaaaaacguuucuuaaaauguaguguauuauauuuaugcccaaaaaucuauccauguuaagcauauaauucaaugaguuuuaguaaauuugcagagauuuguaaccaucaccacaauaugauacagaacauuugcaucauuccagaaagguucaugagcagucucucuucuucuccauucuuugauuucuuaagguggaagugucuguuacugguuuacuguuucuuccuuuccaacauagguguuuauggaacuucuuuagcugaagucaugaaaauuuguauauucuauuuuuauuucuauuccguucaaaauaucuucugaucgcucaugugauucauucucuuaacucauuggcuauuuagaagucuauugacauauuucaaaauauuugugaauuucccagauuuucuuguuguuuguuucuaauuuaauuagcaauacagaaaauauacuuuaugugauauuagucauuuuaaauuuauagauaguuauggccuagcauaugaucuauuuugaugauguaccaugugugcuuaaaaggaguauguacuauacucauuugggguggaguguucuuaggucaguuuguuugauaguguuggucaagucuacuauauucuuguugguuuucuaucuagguguccuguuuauuauuuagagugguauaucacagucuccaguuauuuuugcauuguuugugucucccuuuaguuccguuagauuuugcuccaucuguuucgggguuuguaguuagguauauccauguauaucauuguaucuucuugguggguagacccuuuuaucauuauaaaaucucuuugucucuaguaacaguuuugcuuuaaagucuguuuugucggacaguauucucucuccccuuuauuauuaaacuacauuuaauuuguauuaaacuacauuuauuguucacauacuguuuuucaaucuuuuuuaaacuuauuuuugcauuuguauguaaaauguaucgcuuuuagaaagcauaucauugggucucuuuugaaaaaaauccagucuaacaaucucuuuuuuuugaauuuuaaauuuauuuauaguuaauauuauuauugauuugauuggauuuaugucuccauuuugauuuucaucuuuuuuuguucaguugauuuuccuuuacugcuucuuuuguaacuaaauagguguguuuuaguguaucauuuuuauuacuuaguucauuuuugcucuaugaaaauauuuuuuucugaauggguuaggguuuauacaugcauucuaccuuaacacagucuauuuuaguuuaauacugacuuuguauuaaacuuugucaguuuaauaaugacuuuguauuaaagucugugcaguaguaugcacaaacuuugcuucacuauagauccaugucaccaucuuuuauagcuauuauuaucacauacaucuauauaucuuauauacccaacaaugcaguauuguaauuauugcuuuguauaaccuaugcuuaaagaaguuaagacaaagacaagaaaauagaaaaauguauguaugauuucuuucaacauauaaaaaccuauaugcuuacuguuuccauuacucuucauuuuuuaaauguggaauugauuuauggcuugguagcauuucuuuggcacacauaacuauauucuuucucucuuucuuugugcuacuauuauuauauauauuaaucuuucuauauuauauguccuacaacacaauuuuacaaguacugauuuauguagcucuuuuuuaaaucguuagagacaagaaaagacaaaaauuauauagccuccuauaguuaccuacauaguuaccuuuaacaauguuuauuuuucuucauguggauuugaauuaaggucuguugucauuuuguuuaauccuaaugaacuuuauguuuuguaaagcaggugugcuaacagugaauucuuucagucuuuaauaggggauuucuuaauuuugccuucauuuugaggaauauuuuugcuagauacagaaauuuugguugacaucuauuuguuucuuugagcacuugaagacauccucccacugucuucugccuuccauuauuucugauuggaaguuggcuguucaucuuauuuugggugccuuguacauagugagucauuuuuacccuugauacuuucuagaucuccucuuuuucuuugccuuucaacaguuauauaugaaauguguagauguggaucucuuuguguuuauccuacuuagaauuauuugauaauuuuggaaguuuagauuaauguuuuucauuaaauugggggagguuuuuaccauuauuucuucaaauacuuuuucagaaccuuuuucuccucuucuuggaaucuccauuauguguguguuuguuauauuugaggugugcuacaggucuguuauguucuguuuauuuucuucauuuuuucccccuguucuucagauuuacaaccuggaucaaucuguguugaaaugcacugauucuuucuucugccguucaaaucuccuggugagguucucuagugaauuuuuuauuuguuacuguacuuucagauuucagaauguccaauugguucuauuuaagaauuucuacccuuuuauugcuauucucuauuugaugaauuaugacaucaugcuucccauuaaaucuccaaacuuuuucggaaggggaucuuugaauguguuuauaacagcugauuugaagucuuuuucuguugaguccaucauguaggcucccucagagauaguaucuauugacuuuuuuuuccuuuuggaaugguaaaauuuuaauuuuuugcaugccuaauauuuuugcugaaaacugaacauuuuagauaauauauuguagcaacuguauaaucugauuuccccaucucuucccucacacauaccuagaguuaaugguuguuucuuuuuuguuuuuuguuuuugcuuguuuuggguuuauuacuuuaguuucuuacuggaaugguucugugcagcauguuucccucauaauguguggcugcuguugucucuacuccauugaguuugccaccacccuuaccacuuauauaagccuagcuuucuagggaccaccccugaaaucaaaauaguugagugcucaguuaaagauuggcuagagauuguaucuaaacacuuagaaccccuaaaucacugccuucugcuuuuaugauggauccauaaaugauuuggggaaugaaucagcagucagccuauuuaccagucuggcccaaaucuuaauuuuuguguuguaaggccucaugcucagcagaaauaaguagcuuacuaaggcuuucugcaggcucucugagcaagugugcagcuuugugcauaugcacagcuuuccaggccaucagagauaaguaggaucgcaucaaugcccucuuucaguuccuggaucugccuauuaauuuucugacuggccuacugguuuguugcuugcuucagucaguuaugagauuucaggguagcugcaguguuguccuuuccugauuguuugcauuaagaucacuauuguuuuugacaauacccuuugucauagaauuuuccacauaaaaucagucauuucuaggaucagagccuucaucuucacagcacacccaccccgacagcacuucugcaucaggaagcagggguggaacuagggagugggaguagcaccgcacuaaagugcuauagacucucacuguugucaaugagguucggugaguuuucuugaagaaacacuucucaguuuauugcaugccuuuggucaauuuccaguguccuuuagagauuguuuuugacaauuuuguucuguuucauuguuuauuuuuguggcaaggauuugccaaccuccucacucagccauuuuggaaggucugcugucuuggguauguuguuguuguuuagaaacauacaugcuacaaaguacacucuugaguauacagcuaaagauuucuuacaugugaaaacacacucguaaucaccacccagauuaagauacaggacauguccagcacccguuaaucuuuccuuccuagccuucuaguuucaucccagaguuaaccacuguccugaccucugucauuacagauuacuuuuuguaaucugugugguuuuuuuguuuuuuguuuuuuguuuuugagacagagucucacucugucgcccaggcuggagugcaguggcacgaucuuggcucacugcaagcuccaccucacagguucacaccauucuccugccucagccucccgaguagcugggacuacaggcgcccaccaccauguccaacuaauuuuuuuguauuuuuaguagacacagcguuucgccauguuagccaggaugaucucaaucuccugaccucgugaucugcccgccucagcguccaaagugcuaggauuacaggugugagccaccacaccuggccuagauaugagguuuuuuuguuuguuuguuuguuuguuuuguuuuuuuucuugagacagagcauugcucuguagccaggcuggagugcaguggcgcgaucuuggcucacugcaaccuccaccucccaaguucaagcgauucuccugccucagcuucccgaguagcugggaguacaagcaugugccaccaugccuggcuaauuuuuuuguauuuuaguagagacaggguuucaccaugguagccaggauggucucaaucuccugaccucaugauccgcccaccucagccucccuaagugcugagauuacaggcaugagccacugcauccagccuauaaucugugugugguuuuuaaacuucauuugaaugaauauuuaaaauauguccucuuuuuccucuagcuucuuuuacucaacauaguaacuuuugaaauuuauccauguuuuagguguagcagggauuuuuaauuuuuuaauuguuguauaauacuuuauuaauagauaugccacaguuuccuuauugugggacauuuggguuauuuccaguuuguggcuauuauuaaugaagcugcuaugaacauccuccucuuugucuuucuaugagcauacauacguacaguuuuaacguggucagcaacauaaugcauguguaauuuaggcucuugcucuuuuuuuuuuuugagagacagagucccacucugucacgcaggcuggagugcaguggcacgaucuuggugcacugcaacuucccccuuccagguucaaaugauucucgaaccucagacuccccaguagcugggacuacaggcgcauaccaccaugcccagcuaauuuuuguauccuuaguagagguggucuugaacuccugaccucaggugauccgcuugccucggccucucaaaguguugaggauuacaggugugagccacugcgcccagccuggggucuugcuuuuuuaaacuuagcauuauaucaaguguuuuuccuuaucucugucauugucaugacaagagucauuauuuuuucagguagguauaccgaaagcuauuuccauuucuauuuuuagaaaaagucaaaggccuguauuuaauaauuacucuugacaacacagguagcaguugaugcucaauucaauaaauauuuguuuucaacuuuuaaagaaaaacuccagaaucguaugcuuuuuaaaaauaguauuugauugaagauuaaacaaaacuuacugcuuuuucugccccuugaaauguuccauaacucuaugcaauucacauauuaguaguaucacuuuuuaaauguacaaaagcagacauuacugagagccuuggccucaaaacauucauuugauugccuuucuuuaaaaacauauuucauacuggguuauggaaaacucagcauuugguuuuggauauaaauaaagccauaugaccuuucauauuuaggagcugaaucccucuuguagaaacuugugauguugcuuugcccacuuuccuacccucccuaccacgucauccaacacaugugcacuuaugcucauucacauacaccucgcaggcucucuguguccugggaccuacacuucacauaguacuuggaaauauuuucucuugaggaaauggauauuagaguugcaaugguauaggaacuguauacguuuuuccuaucuauacugugguuuuucuuuucaaacauugucgagauuucugauggauaacaguaguugugaaagacacaaggagaaugggagggaaaggaauugcuuaauggaccucacauaauugugacuaugacuccaggucugcugcguuuagaaauggaauugcgggcagauacauuugucaaauuuaacuuaaucccuuggcuuuuaucugauguauauuuuuccauuaacacaguauaccuuucaucucuacuuucacacagucaaacagcgucuaauuuuugguggacuuucuuuucuucuuuuuugaugcuaacauuauccccguaggguccuaaucagguuuuagacuauggagagaagaccauaagaaucaccaaagcggaauuucccauugcugguaaagagaugcccaagaugcagaaggcuugaaauaaaucgggcaugaaauaaguggcguuacagcccuauacuggcuuuaccgcaaggguuaaauuugcucagugucugcaauuucaccuuuccugauugucauacagagugagaucauuguccaaagguugaucauguggaggauguaugugcuuuugaagugaucaaacuaaaagagaaaacaaagcucauggcugaagucaucacaccugaauaccaucuugugaugucaugguuuuauugguaugaauucuaaccaagcugugggcauuuaagucauauuuguggaucagaagccauagauauuugcgcuucucauaggcugugcuuuucugauacuuugaucauuauuauaugguaacuaacauauauuaauauauuaauguauuauaucauauuuauuuagaccccaguauggauacuaaaugggauaaagcauaugccaagauuuuuuaggucuugggauuauuuaauuuuuuuagaacuggcguucauugauugucauucacguuucucuucacuuccuuaugaaaaguuucucaacucuucucucaguauuuucuuuuccccugugagauauguuuccuuuuacacuuuuucauuccucuaccaaauaguaauaauugcaaacauuuauugcauguuuauguguguaccaggugcuaugccaguuguuuuuauguguauuuucucaguugcugucuuaacggcucugugguauuuuuauccuugguuuacagaugaggagacugagccucuuuuggucucuuucccccuuuaaagauaaacuccuccuaucuccuuaaacugagcuuguaaccuggaccucugauucaacagcccacaccccaauuuguauuuggcuauuuguauugggcuauuuggguggugguccuuugaauguuguugugcuaauggaggccuaaacguugaaucccgugaauggaaaccucuucacaucuuuacugcuuguccugggaucuucacaccuggaauauugaucuucaccgaguaauuugggaaaaacagaggcagaggcuggaagcugcucaccguccuauggcagggcagguaauguccuuaaugagaugggcuuauuccaguggagcagugguggggaagcaaaagcuugguguucucuccucaugguugcgaaaauauucacauaaaagauucacuagcuacuguuaauaauugaaggacuuuccucaaaauccauguauuauaacgguuuaauauacuaaaaugauuuggaggaaaucggccucagcauuggugaauguguugacauaugaagcuauuauuuuuauaauucuuauuuuagagauggagucucacugucucacccagccuagaguguguuggcaagaucauagcucacuguaaccuggaacuccugggcucaagugguccuucugcuucagccuccugauuagcugggacuguagucacaugcuaccacccauggcuaauuaaaaaaaaaaaaauguguggagacaggaucugacuauauugcccaggcuggucuugaacuccgggccucaagugauccuccagccuuguccuuccaaagugcugagauuacaagugugagccaccccacccaaccuaaaguuguuuuaagcuuauugugugcauguugguugugucaccagccgggaggggcuuauaggcugcaacacuguuuucuuuccuauacuaccuuuauuaucacguaauaacuaaaauacguacuaucuguuuuuagguggaugcucugcuucucuugauagauaugaaagcaggauaccuaucuuccaccccuguguuuuucuuuuuucuuuucuuuucuuuuuuuuuuugagacagagucucacacuguugccugggcuggagugcaaugguaugauuucggcucacuccaaccucugccucccagguucaagugauucuccugccucagcccaccauguagcugggaguacgggcacccaccaccaugccgggcuaauuuuuuguguuuuuaguagagacgggggacgugauuucacuguguuggccaggcuugucucgaacuccugaccucgugguccgcccaccuugggcucccaucuacucagauguccugucuucacaggggcccucuuugaccacccucuguaaaacuguacucauauuauucacuauucuuuaccuugacccuguauuuucuuagcacuuaucacuauucgauauaacauuuuauauucuucaccaccaacccagacuagaaugucaggucccugaaagugagguaugugccauacucaccacuuucuccccaguauccagaguggugugugguacauagcgaaacucaguaaguauuauugaaugaaugaaugaacacagaugacuagaaaaauuucuagaaaauuuuaaaacaugggcauauuagccaugaauuuaauuuauaguuuuguuguuuucuuuuggguauucaaaaauauaauuucauuuguuuauaucucuaaugagauaguacaguauuugugauucuucuagugugauggcauguacaguuucauuggugaguauaugugaccuacugugccagguggaaauggagugaaugaacauuuuggggggaacuaaaaagcaauuuucaaccuuuuugauaagcuagguuaauacugucuucucaauaaaaaguacuuuuucuuccucuuauaauguucauggucuucaucuguauguguauauugccgauuuaggaacuaaagccgaaauggaucucagacuauuucccacagacugguagcuguauccccucugucagcaaguauuugauaucuucagugaaaauuguuucuuuuuccacuuuuagcuucuguuuaguuuuacaagucuaaacaauuuuuggcaagugcuaggggcucaccugaugcacuuuuuaaugcauuccacuccucguuguuauuuucucuguccaguacacauggugcuccuucccccucauugccaucccacuuuggcagaaagcauuauggaugcuguguauguagacucaucacccaagccagcaugcaugggagagggggccucuagaauaauaauuguuacuugguguucucuguacuacucuguuuaaucucccugcuuaccacuuacugccuucguaaaguaagcucaauacaauuauuuauugcaauuuguguagaaugucagauguggaacagacuuugcacacucaucagauccagccccuuuguuauuuagauacaaagacugagcccucagagaggagucuugcacuagacucuagaccucccuugggcaggggacuuucuuguucacuguugauuccugcuugucuaauacagugucuccauguaauaggugcucaauaaaaaauauugcauuuuucaaagucucauauguaaguagugauggcagggccagaacuugaaccuugcaucuccuaguuauuuguucauugucacugccacaauuaucucauuguaguuuaaagagagucagcuuccagucuuuuaaaauacaauuaccuuuaauucaucugugguaaacaaacagcagcugucucucauuggcauggccgcaguuccaccacugagcaauucuagaaacugacacuauuaaccauucugcuaaaaaggacucuucuacucauaugauauccuggcuguguccaaaguguaauauuuaauugcauuuucuuaaucuuuaccacuguauugcuaagcuuucuaauaccuucaaaauaccaaaucucaggcuuauccuaauuaaagaaucucaauuuaauccauaaugcaugacaauucaauuuguugauugcuuuuucucccccucuuugugaaauucccgucaaauguauuaauucaacaugaugaauccuguauucaacccacuggagugaauaauuaaaauuagcugauaaaacuuucagcagaauuacuuugugaaauugcugaacagaugugucauuuuaaugaaaauccacagacaagcuccuucucccccucggcaggauaaaaauauuauccccucggcacauacuuaauuuggugguaaauacacucggagcgauugcuggaagggaagaaaaagcaacuugucacacuuaguaacuugauuuuuccccagcaugcaguaacagcuaucuacaguaauucauagugcucuauuguugcugcaagucccaaagagaacuuauuaaaaugcaauaaucuccuauuuaaacagaaacaauaaccauuaaauuuccuguggauccaaaauugagcacaagccccaucugguaagagugauuagaggccugaugagggaauuuaauuugcaacauucaaagacuaaaucugagcagaucuugucaccugggacucgagugcugcuugcugucuucuuaaaaaucucgaccuaaacugaaaauggaauguagaagugaaaauguuacccaggggccacccccaacaguauuguguuucauuaugucuccagcaggccuagugagcagaggggauuuuagugcuguccgcuuuagcuuugccggcaaggccuuuugacaggaccaacacuaaugcugucauuuccucuacugcccugugcaucugucauguggcugccccucuuagaucguggacugccugcucccucccuucuuauuuacuuuccucuuuuagcuuagcaaguccucucucuaacuuuaagaguucucuagaucucaccagucucccuuuccuguccaaggagucagaugcuuucagcaggcuacuuugagcaccacuguaucaugcuuuacauuuuaugucuccuccuugccuauagacaguacccccucugaguuuauuauuaguguuuuuuuuuuaacuguaggaggacuaagauuuauugcauguuauuaguaaauacaaauugucauuuuccuccucuucuuagcuuuucucuuacaaucccccaccuuauuuauauuacuucugagcuccagagaaacaagauaugcgugcacucaucaucagagagauguguuucuguguauguguguuuguguguguguguguacaugcacuuguuugugugugguuauaggccugaucagacagaugucaguuuaucaauuaguagaacucccuaauuaaguauuugcuuugagcaauagagcucuuauugguugugagguaacuuggcaggagggaggcaguuaccgauguaauagagaugccugagcagauaguuucguugagcagauacuauuugauguccuuuaaucaucagacuccuccacuuuuccuucuucugggcuccugauuuaucccuaaacaaucagagccucuccuccauaauuuuaugaacuacaaaauuuacaaaaauguuuuacaaacccucugccuccccaguaucuucuccagcccccaugucuuggggcaggccacaucaggucucucuggcugcuuccuuucccaggcccuacuaccuacucuggcccaucauaugucuuuugagaagaugauuuuucaguucuuuucuuuaguuuagaaaaucagaauuaauugauuaauuuuuaaccccuucuaccuuucuccuccccuaccauaugaauucaugcagagccagcccugcaaccuaauuuuuuuuguuuuguuuuugagacagaguuucccucuuuuugcccaggcuggagugcaauggugcgaucuuggcucacugcaaccucuaccuccggaguucaagggauucuccugccuaagccuccugaguagcugaaauuacaggcacccaccaccaugccuggcuaauuuuguauuuuuaguagagacaggguuuccccauguuggccaggcuggucuugaacuccugaccucaggugaucugcccaccugggacucccaaaguguugggauuacaggcgugagccaccauacccggccccugcaaccuaauuuuuaaggagaggugguaagguucauuccaugaaucauaccacuuggaauucuugaaaaauuaauugcauuuauugcacaccuacucucuguaaggcaauguacauaagaauggaggagauacuaagaaaauugagucccacuccuauugccgaucgggaaaguacggcauaagcacaugaauauuuagagguccugugguuuaaguaacgguagguaaggaaucauugggccagaugggaucagugacucacugaauauuauaaucagagaugugagugcagaauaaggaggagauaugacuggggacugguguaguucuuagagguugccugagcuggcuagcgugacauuccuacuaagcaaugagccuagcaaccagaaucucccagccccgguagccaaggagcacaggugguaggcuauagaaggagauuuaaugcaacacagcuggguucaauauggugccucuuucagagcccuggcuacaauugauguaaccugguaacuaguagcuuugacuuugaugucagacacaucugguugugaauauucccugaaccacucuuaagaguuucucaacucuuugagucugaguuuucuugauuguaaaaugguguuugauaauacauaugugguuuucauggggauuuuguaaagugccuggcauauggaaggagcuggguaaaugaugguaguacacuuauaaucuuaagggcagaaggaaugaauuaaauacagagugaggccuagggacucuugcuaugcucccuccugacuccggucuaguauuacuaacaucuuuccagaaaccauucuucuuuauguugguuuuggcccuuuguguccccaucucuagcccuuuauucaguuggucugcucaaggcuugcaugccauuuuuggcauugaacaugugauccucuaguuuaauauagcaugugcaauaugguaauuuaagaaaauaaaugucuguaugcauagaaaacacagcauccuccuuuaauucauggguuuaugggagauuacaguuuucuuuuaguuuaagccuacaaaguguuuauaguaaaaaaguuucaaugaaaugauuuccaauuuauauuuccuuuucacucaccaccacaagucagaaaucaaaucuuaugcuuagaagaaagcaacuccaggacuguauccacuucggguuuugaauaacaacaguaagguggucugacuccaagauuagguccuuguuguuuggacauaucuaacaaggaacuccauccccaagugcuggagaauccaugaagucaguggugucuuaugaagcuugagcaauugggaagccuucccagucagcuuuuuggccuccucuaggucuuaauuacaaagcggauucaugguccugccugaaaucugauugagacauagacuccucuaucccaaaugauaucauuaucaacauugguucccugugguacacauuugucauauucauuaugauuuguaccuaagauuccaggccacaauaauaggguaagaguguauaaugggaaaaauaacacaaaucguuuugauuuucuuuaaggaaauucauugccuuaacauuacauacuugccuuuguuuuaaaacucacucuaugccuuaucuaagaggagucaauauaaaagauuuuaauuuuagccccauaugcuguagcuauauauaaauguucuguaaaauauauccccuagauaaaaguacuuacuacuuuuuugaaguuuuuuuuaaaaccuuucuuuugguaaauaaaagucuuuuuagcuuugaugugacuauuacacccuugguuuggguucuuucuccauuccuucaucccuagccccugugggaccccuguaagaaaaaugggaggggagagaagcaugaauuccuuaauaagucccaaagguaaucaaaagaaagaaaugcaguaugaacaaacucacaaaauauucuugugcuucuuuggggaauacuuaaugcacauaaggucaggccuuuguaauguuaauuugagaguguuaggaagaaagccaucauuuuacaggcaauguugcucucugaaaaaagcuuugauuuacagagaaaugcuguucuaacacaccugcauuaaaccagugccugccgacuuugagaggccugaguugcuugagcagaggaaaugcuucauugaggaugcuuagggcauuuggcugaagugguaggaaguuugccagagguccuauuuuccuguggucaaaacaaccuguucaguuuggauaugguacagccccuauucuuuagacaugugcagagugacagcacaauuccgcaauggccuccuuuccaagauuggccuuagggagggaagucuuaccagacacaguggcaacauaguuaguauagguaucuugguuauagagguuagacaugaauagccugguuuccaccucaggugguugcccgugccuucucaucaacuuguaaaccuccauacuguguagaggagauuguguggcuagaaggaauggauucaucccaaacccccaaaacaggauucggauaagugaccauccagccugcaccagagcauugccagagacuggccauuaauuaucuucagaggccucucaguucaucuuuggcucuccucucucauccauuucuguuucuuccuucuuccauccauacuuccccugcucuuuccuccugccuuuuauauuggucuguauucuacuuuuggguguuauacaaaucagaaaacauuuuuauguuaaaacaaauuaaauaugaauacucuuugugaagugccugacaugcaguaggcacucaauuacuuccucucuuccauccuacugugugauaacucuucuaguaauugagauuauguuaucaugagacuacaugaaaauauuaucaugccccuucugaguuaaucuuauucaaccugguuucucaucccuucaucuucuuagucucccugcccucaaauaguccacugugugugcacgugcgcacaugugaguguaucuuaaaguacaguuuucaaaacuagcugcacuucccuauguugggucugauuugccaauuuuuuaugaaggaauaagcaaaaagaaagagagcaagagaggaagaggggagaaaugccgugcuuuucuagaggagcaaauauauggaaauuacccuuguuucuucucuaaaguaguaaaggucacagcaguaguugcaaaacccguaggccgccuacugccuuccacacauucagcauuacuauucuugccuauuuuacccuuaggcauccuuuauuucuugcacagauggucucacucaggccuaacaaaauguuuuaagcuuugcauaaauuaaaacgaggucucugaguacaaaagugcaacuuguuuuuuacuugaaaacaacuaugcuggcaucuuuuacaaaauuacagccucaagccagguuuccauaaucaguuuuccuuuaaaaaauagagaggaaagaauguauccuuguguguguguguguguguguguguguguguguguguguguguguguguaugaguauauauauaauauauguauguauaccaaacacaaaugguccuaaucaaugggauuauggcuuuuaugauguucuguguuccuuugaagguugaucaggcaugagugguggaugauucaguuugaauaaauagauuuggaaauauuauuuuggggguccaggauuucugaguuucuucauuaguuuaguacaugauaacaacuguugagacauuucagugugcggagacucccuccuagaacucuuuacuauguaccuuauaacaggguuuuacucaggcuaaccuugacugugcucaauugaaagaaagugaugagucagcucaaagagaaauagucuguuucucccaacucugcgauaaugugucccaaaguagugacacauggcauauuccauucuuaagauaacuggcagacaauuuguacaaucuucuagacacauugcuucccuuugauucacacaucaucaccaaaaggguaaugcuacaaaucuuuucucuauucaugacuacucuuaacagggauauggcuuguaaagaagcuuauugaugugcuuugcuugaaauagaaucauuagacugggccugcccucucauuuuuaccuugacaguaauaguaagaguaugggagauacucuuacucuuauuauuacuauaacuauaauaguaauacuauuacaguauaguaauacuauuacaguaauaguaagaguaugggagauacuccuauucuuacuguuacugucaagguaaaaaugagaggguacugugugaguuauuuuuuauauauugucaucuuuuaauaacccuaugugcccacuauagagaaguuggaaaauauagaauagaaagaagaaaaaguuauuuuuuuauuuuccacaguuaauauuuucacauauuauuucauuauguuuauuuccucacacacuagugaucauacuuucaacagaucauacuguagauauuacuguagauguuauauucauuuguucacuuaaacuaauaauuugaauauacuuuacuauuauuaagaacucuuuguuaaagaucaaauuguuuuaaaacuuaaguuagagaggcauuuauagcauuagauaaugccagccaggacauauacacuaucuuuaaaaaugaaucuaacccuuaaaugaaauccagcagccaaucuaauguuucuuuguaauaagcaaaauauuuuucuguguuauugcaucucacaggaaucuauuccuaaaggauucaauaguaaagaugcucaguaaucaugcucuagaguuucucaucccucuaaagaacacacagcaguucugugaaugacuaaggaucagcaggaauggaugucaggugaauguuggcacuacuggauacaauugauaugcuuuauggauuuuuuguuucaaugugauucugcauagauggcaccuguaauuaugaccauuuggaucaugugaaaaaugauaaauuuucggugaaagggaauggugcuugauccuuuucuuugucuuugaacuguuuagaaacacuaaacuuaacugauaaaaguaagugcaagauggccgggugcggcgguucacaccuauaaucccagcacuuugggaggcugagacagguggaucacuuaaggugaggaguuugugaccagucuggccaacaugguaaaaccccgucucuacuaaaaauacaaaaauuagcugggugugguggcgcaugccuguaaucccagcuacuugggaggcugaggcaggagaaucacuugaacccaggagaugaagguugcagugagccaagguugcaccacugcacuccagccugggugacagagugagauccugccucaaaaaaaaaaaaaaguguguguguguauauauauauauauauauauauauaaaaaauaaaaaauaaacaaaaauuaaaaaguaagugcaagacaucuuagaaguauugcaguuuuuuaaagcucuugacagaguaacuuuauucaugcagguaaauucuagcucuuuugagcaauauguuaauaagucacugcuaauggccuaauaguuuuuaacuuacaauuaaagacccaugauggaaacuggcagcaauuucauaacccaccagucuaauuguuucacagugaacaauuauuugccuugcgaauacuuacaguaaacauuucuguaaaguuuaucuuuguuuccuaaacagugauauuuguuuuguacauucuguagauggaauauauucugcaguuugguuuuucugcugcuuaguugcugagaauugacuguguuguugcacauagcuguaaugcauucauuuucacugcccuguaguguuccauuguaugaauauacuaugguuuacauauaccuuguauugauggacaguggacauacagguuguuuccauuuuugauuuguuagaaauagugcuguaugacuguucuuuuaugugucuccuggcacauauccuugaaauuuacuuagcauuagaauugcuuggguuuaggguaugcacauaaggaacauuacuagauaacgcuaaguugauuucaaaauuaauuguaccaauuuccacucuaacuagcaguguagaauuguugccaucguuuccacauuuucaugaauacucuuaucauacuucauaugaaauaaucuugugcacauguguauguguguguguucaacagccucauugugguuuuaauuugaauuuuucugcccugguuuccucuucugagcauguucuuuuggguuuuuuaaucuaugucuuuauuuuaauguugaacuuuuucuuauucaguuauaagagugcuuuauauauuuugaucacuauuccuuugugaauaauguguguuccaaaacauuuccuaaguuaugguuuaucagcgcauucuguuuauggugucuugugauaaaaaguucuuaaugauagaauaguugaguuuaucaaacuuuuccuguauaguuugagucuuguuuugagaauucaucccuacucugaggucauaaaagcauucuuacauguuguuuucuaaaaguguucuaguuuuaucuuuuacacuuaauucauugcuuuaucuggaauuaaucuucauguaugaugugagguaagguaaggguucaacuuuauuuuucuccauauggacaagcaacuauaauaccauuaccauaauauauuuuaaaaguuucuucaucucucagugaucugauggaccaacugucauaaauuaugccuccaaauuugccuagguuuauuucugaguuuucucuuucauuuguuugcuaauuuauauaacaacacaacacuguugaaauuauuacaacuuuuaauuauugcuugauauuuuaaaauucagucucccucccccaccucuuauuauuuuucagguacacauuggugacucuugucuuacuacucuuccguguaaauuuuagaaucaacucaucaaguuucauauucucaaaaaagugaaauuuucauuggaauugcauuguuuauuggauaauuuagaaggaauuggcaucuuuaugauauugauucuucuaguccuugaauauaauauuuaucuuuauuuauuuaaaucuuuuuucuccuuccggaaaauuuuaugguuuuucucuauauguuuuuuuuauuaccuauuugcaaauuucuauuagauuuguucccagguacuugauuuuuuuugguccuauuauaaauggugucuugaaaaaccauguuagcagcaguucucguucuucguauauacccaaaaucauucauagcagggacucaaacagauauuuguucaccaauguucauagcagcacuauucagaauagucaaaagguagaaauaacucacauauccauugacugauaaaaggauaaacaaaauguaguauauuuauacaauggaauauuauucagccuuagaaaggaaggaaauguugacccaugcuacaauauagaugaacuuugaagacauuaugguaagugacacaagucagucacuaaaagaauacuguauaauuucacuuauauccagugccuaccacugucaaagucauagagacagaaaguagaauggugauugucagaggcuggugggaagagggaaugggcucuuauuguuuaacagguaugagguuucaguuugggaagaugaaaaaauuucuggagcuggaugguggugauaauugaacaauauuaugauauaauuaauacuauuaagcuacacacuuaaugguuaaaaugguaaauuucauuuuaauguauauuuuaccacaauaaaaauuauguguucuaaaauuuacugcugguguauagaaauacacuugauuuuuguauauugauuuugaaucuagcaaccuugccaaacuuaccaguuauaguaaguuuuuugcagcucgucuagauuucuguauaugcaguaaugucauaaugagcauuuuguuucaucuuuuccaaucuucauacuuuuauuuauuuaucuuggguuauccaguuaccuaugacauucaauaaugucaaauagaauaauaauagcaggauuucuugccuugaucuuaaaagaagcgcuuagaauguuucccauuaaauaugguauuuuguuuuguuuuguuuuuagguagcuuuuaucagauuaaggaaguucccuucauuucuaguuugcugagauuuaauuuuuaucaugaaugacugucagaugauuuauugaaaugaugaugugauuuucuucuaaucuguuagugugauaaacuacaguaauugauuuuccaauguuaaaucaaucuguaauucggggguuaaacacaaauugauuaugacauauuaugccuuucacacaaugcuagauucaguuugcugacauuuuacuuaggauuuuucauccaaguucaugaguccaguugucuuguaguguuuuucucaaaucaucauuuugaggauugguaucaagauucucccaccucagccuuccuaguagcugggacuacaggcacccacuaccacgcccagcuaauuuuuguauuuuuaguaaagauguucaguaaaaaaacaucauuuugccauguuggccagauuggccucaaacuccugaccucaagugaucugccugccucgaccucccaaagugcugagauuacaggcaugagccaccgugcccagccaugucucuguguuuuagguauguuucuuauagguacuauauagauugauuuuuuuuaaaauuuuuuucucagaccucacagggaugaagauguuuuaaaaagcucuucugaccagauaauauuugucuguuaaauggagcuuuuugucuauuuauaauuauagaucaguuagaauuuauuuugugcauucuauuuuugcccuuucuacauuuuuuuucugauuuccugcuuuucuuugaauuguuucuucuuacuucauuuuuuucuucugcaauuucagaaauucuguaaaccauuuucauucuuuugguuguuacucuagaaauuuaauaaaaacauuucaaagucuaaaguuacucaggaggaaaggaaagauaaugaugaauacagggacuuuugaacacuuuaauucccaucaguuuguuaucauuuaccuuaauucuguuguauacacccagcagaugauauuguucagaauuaaccacauauuuucccauguucuacucuucauuuuuauugcuuucagaccauucauguuggaucacuuuuauucuagauaaauuauauuuuuuagagaauuuuuacuauggaaagauacuuuuuacucuaugauauuuuaaguuaacaaguuucacuuugaauauugaagaugucauucuagugucuucaagauucuacacuguuacuauugaaauauaagguguuauuuaauuguugcuuccuuuaauguaauuuguucuuuuucuggcugcuuuuaagucuuucuuuugucuuugguguucugcaguuuaaggugcauuuagguugaaauuauuuuuugcguaaccugcuuaggauuuguugucuucuuuuuuuaauuuuaaauuacguuuuauuuaacccgguagguccaaaauaucauuucaauaugugucaucaaccacgcugcaagcccucaaaagccacauguggccaguggcuaccacacuggaaaccauaugggacaguucuauagaauggaguuuagugcgcauuagaauaaaugggaaaucuuacuuaaaugcaagcuccuggggcgcguucuuagaggcuaugauucaguaggucagcaaagagacccugggaucuucauuuuuaacaaguuuccccaagugacuccaaugagaguggucugcagaacacucuuugagaaacacugauguaggagauuguucagggcaaagcagaagguucaccugacucucagggaaccagaauaaccuaguaaccaugggaucauuguuacaggauccacaucccuaagaggauguuccacugcaguuuucauuuuucucugacucaaacucaguaaguggauuagauacaugcaggugaugaugcaggugcccauaugggacauaaaaauuucaaguuggguccauuuguucuugcaucaaauuauguuuuaaguaaaauauuaauauuuuaaguaaaauauuuuaaguaaaauauuaauauuuuaaguaaaauuuuauuuuacuuuuaaaauauuaauuuuuuacuuaaaacauuaauuuacuuaaaauauuaauauuuuacuuaaaacauaauuugaugcaagaacaaaauauuaauauuuuacuuaaaacauuuaauauuaaguaaaguauuaaugauccuaauaaauggggaaggagcucagacagaaccccauucccuucaaagcaagacaacuuugaauagcugugaaucuucauaauggcuucucuuuaugaagccauuguuuuauucaaggaucuacuaauuggguaacaccaucuccuaugcacaaacaugcccuaaacuuggacucaguuacaaauagggaugaagguaagaauggucagacugucuggauuuuccuucucuuaguguuucucaaagcauggucuaaggaccagauagggccaugauaccagacaugcaauagacagaccugcacauuugcagcauucuccuccagagacagauucacauggucagguacagacccagaaucugcaaggucugccacccaccuccauucucugccccuggauaauucugauacaggggauuagggugaaacuaguggaacccauauauaccacgcuguucucaucagaaugaaacuacaaaauucacuaacaucucucuuguuuuuaauuuuaauuauacauguacuauuuacaauagcaaagaaauggaauccacccaaaugcccaucagugguagacuggacaaagcaaacaugguacauauacaucauggaacaccaugcagccacuaaagaaugagaucauacccuuugcagcaacauugacagagguagaggucaccauccuaggcagaccaacacaggaacagaaaaccaaauacugcaaguucucaccuaugagugggagcuaaacaacaacaacacacagacacuaggaggggaauaacagacacuggggccuacuugaggguggagggugguaggagggagaggaucaaaaaacuaucagguacuaugcuuauuacccaggugacaaaauuaucuguacaccaaaccucuguggcacgcagcuuacccauauaacaaaccugcacauguaccccugaacccaaaacaaaaauuaaaaaaguauacaugucauaugaauaaauuuccaguuauaaaauauuucuuuuuuuuuuuguugagacggagucucacucugucgcuugggcuggagugcacuggcacaaucuuggcucacugcaaccucugccucccagguucauacaguucuccugccucggccucccaaguagcugggauuacaggcgccugccacuacacacagcuaauuuuuuguauuuuuaguaaagagaguguuucaccauguuggccaggcuggucuugaacuccugaccucaugauuugcccacuucggccuccaaagugcugggauuacaggcgugaaccaccacacccggccaauauaaaauauuucaacaaauacaaguaaauuaaguaaaaaguucccucaccucuucucuaaauguacucuucccccggggugaccacuuuuaucaguuaaauuuaaggauuucuugucuucuuguaucuuuggauugauauuuuucaucaguuuuggaaaauugucuauucaguuucuuuucaaguauugccaacuccucauucucucuuucccuuccucuucucugggaacuaagauuauauguuuguuagaccuucuuucucacugucucuuccuugacugucauaauuucuguacuacauuccagaugauguuuuauuuuagcuuccaguuugcuuguuggcucuucaccaguaccuaaucuauuguuaauucugauuacugagauuuucaauuuugauuaauauaguuuuuguuuuuauaauuuuuuuaaauuuaacuuuuuauuuggaagugauuucaaauuugaaaaucauuguaaggucagaaacugugugaauaauaccauauacccuuuaccuagagccucugauucuuauuucacuccauuugauuuauaauuuguuuuuucucucucggauauauuuuuuucugaccauuuaaagauaaauuucauacauuaugaccuuuuucacuaaauaauuuagguuauauauuucuuaauaggcauauucucuuaccugauuacaguauaguuaucaacugugaauauugcugcaacgaacaugagaauauagcuaccucuuuggcauacugauuucaguuucuuugaauuuauaucagaaguaagacuacuggaugauaauguaauucuauuuuuaauuuucugaggaacuuucauacuguuuuccuucauggcuguauuaaguuacauucccaugaacaaugcacaaggguucucauuucuccacaccacugccaacccuuaccuuucauccuuuugauaucucauuguggcuuuaacuuuaauuucccuguugaucagugaugaugagcauuuuuucauaugucugauggccauuuguaugccuucuuuggagaaguaucuauuuaggcccuuugcccauuuuuugacuggguuauuuguuuuauugcuauugaguuauuugaguuccuuauauauuuuggauauuaaccccauauuaaauauaugguuugcaaauauuuucucccaaucugcaagcuauuucuuaacucugcuaaucgcuuuuuuuugccaugaagaagauuuuuaguuugauacaaucccacuuguuaauuuuugcuuuuguagucauauucaagaaaucuuuuccuagaccaauguuguggaacguuuuccuauguuuuuuuccaguaguuuuacaguuucagaucuuacauuuaaguuuucaguccauuuugaguuuauuuuuguaaaaggugugaaguaagcauccaguuucauuguucugcuuguggauauccaauuuucccaauaccaguuauuaaagagacuaucuuuucuccauugugugcuauuggcaucuuuguagaaaaucagcuaaccaaaaguguguggguuuaugucuguguucucuauccuguuucauugguaauuugucuuucugccaguaccauaccuuuaugaucacuguagcuuugugauagaucuugaagucuagguaacgugauguuucuuuuucauuuuuucuuuauguagucaauuuaugaauuccuauuuuccuaagcagucuugaauucauuacuaaauaauuuuaguacucauuucauauuuggccagugguguccacaucuaaaauggcuccuguaaccuagugaugugcucaugucauugauuugagcaguuguuuauguuauggcauaacaagaugucauuuuguaucuacucugccuuaguccuggaauggaaaaaagaaauuuuuugaauucaaaacuguugauucuuuauuuaaaaucuuuaacucuguuaguacauacuaggugguguugauuuuuuuugagacuguuauucuucuugagacauuacauauacuuagcgugucugaaauuucaaugucugaagcauuuccaaugauuuauguaucugauuguuguuaucugccagcuuucacucauccuuuugccuuuccuuacuuguuugguaauuuuuacugugaauugcuuauuucccugagaacuuugugugaguauugcuuguuuuuccuggaauuuuuaggaauucuuugacaccugggagaaggugguuuuuaccagauauuugauuauuucaugccucuagugaaacuaccugugugagaccaucuuauauucucagggugagguuuuucuuuucagaccauuuuauguaaauuaaggcuuuaaaacucuaugagagucagcuugucauuaugcauuaucagaagagauuuuuuuuuucugccggcaauacuauuugagaugagaaauuuucauugcaauuuacuugagggagaggguaguuuauuuuuaguucaucuagcacugaauguguaguaggucuuuuguguauagcucuguugggaucuucuacuagaugucuuaccuggggugggggccaugugcuaugcucuugaucccuggauuugugaagacuugaagccaaagcugaaguucuaacuaguuugggaaauauucauaagaggaaacaaaaacuaaauuuuuuuucuucucuuugcuuuauuuuugaccugaguauugcuuacuuucugucuagcucauggauguagauuagaauaauauuuuaaacuucauucuguuuaguuuuuaaaucguuuucaguggaaguaucagucuuaguaccuaaucucccauggcauaaggcuggaaauagccaugauccugccaaacacggacacucugcaaccuggaacaaaauauucuacucuaaaaaucaaguaauuaugucuuuuuucaauaaaauauaaaguauaaucauuaauguaauuuacuucuuucauuccagucuucacucaugcuuucaaacauagauuauauuauuccaacccuucuuaaguggaauuaguauuucauuauuccauaagguucuacaaauaccuacaaagaccaucaugaauuccaggugcucuguaaccugaucagguuggagaacugcugaugcaaccaaauuuaaucacuuaauguucuuacuaagcacucauuuguuuuucugcuucuaugacuugcucucacugcuugcuaucccaaacacuguccguuuguacauguuccaaugucaccauuccuuuuucgggcaaaugcuucaaaagcuacuguuucuauaaaacuuuccuuuacccuucucuuuugacuuguuaugagcuccuuuuguaguuuguaaucuccuuaagagcaaauuucacaaauguuauauuuguaauaucuuauguagcagaguauucucacagucuagaacagaugguucuucuguaucuguugaaagaaaugggaagauagcaaagcaacauaauaggauaauuuuauuuuugccuacuagacuaucucaggauguauguguuuuaaauccuaaaacugguuagugguauuucaguugaaaaggucuugacccuuucccuucuaacauaacaauccucaucauaagugagagagaagauugggugaguagggcucagugggggaagcugguuccuuucacccaccuucagaaauccagguauggaauacagggguuguucuggaccucaaaauuaccuuuuuuuuuuuuuuuuuuugacggagucucacucugucgcccaggcuggaguacaaugguaugaucuuggcucacugcaaccuaugccuccuggguucaggggauucuccugccucagccucccgaguaguggggauuacagggaugugccaccacgccuggcuaauuuuuguauuuuuaguagagacaggguuucaccauguuggucaggcuggucucgaacuccugaccucguuauccgcccgccucagccucccaaagugccgggauuauaggcgugagccaccacgcccagccacgaaauuaccuuuaaaaagguggucuuuaaaaggcaaauagggagauacuaauugcaaaaaaaaauaaugaugaaauaaguuaucuuucuguuuuccacuuuuucugugguguuccuuuugacauuugcauuccaaaccagagccccacaaauaacugaguuugcacucuuuuggcaagcaaggacugcucucagauguauuuuauaacuucagcuuauaugggaagaacuuuucuuuccagagacgguuucauaguaauauccuucaaaagcucacauuguagaauaugacuuuuuuuuuucuuuguuguuauguuugcuuuguuuugguggguuuuauucaucauuucagccagcuuauagaaagagauagaacuuuuguuggauacuaaaucaugucuaucaaaagcacuauugaccuuguguuguuaaaacuaaaaauguaagaacaaaccauuuucuaagguuuuuaauuauaugcacuaaaacagaguaaggccuagauuuauuaaucauuggguuaugguuugauguggaaagaaccagccuauaacuuuucccuuuguuuaacaacguuauugcugaaaacuuuaauagacuuaaguguacuggaacuagggagugaaaucuuaucuuucccugaacaccagggcugcuuuguuaugguguuuccauuuguggcauaaugaauguguaggacgcuaaugauguggucucuagguguucuccuacuacacagagcacugauaaugagcugcgaguaaucuaguacgagucccugaagaugaauccugauuaccuucauggggccauuccgcucugcucccuuccuccuugauguuucuguaaagagcauuuggauuuugaagagaguauuguguauuugacuuuuaauuagauuugcaguguguuggguuaauaaacuagggcuucuucuucuucaguuuccucuaaagggauguguguaaauguugcacagugggccaagagaacagagggucauaacaggcagcaaugguggugucgcccacuucaugccccaguccugaaaagaaggcuuauaguggcugaagguugauuucaucccaugguccauaguuacaaauggcuuccaagcugccaaggaccugcuaaaccuauugcaucuguucuguacgaggaagcagucucagaaugaaauaugacaguugucugucagggcugccccagaguccugcaaguugguauuaucugcuugcguucagaaaacacaucaccguggcugaccacagcuuuguacuuacugugaucuuagggcucgcauuuuuagggacaacuugcccuuuaugccuuuggucccuuucugccuucugcuuuuguuuuucugccaguuggguucauuuaucuucuuuccuguguguuuugccaugcuuuucuuauuauagcuuucagauucaucauggacagagauagaaaguacucuagugucuuuaucccaccucagcucucagucugguguagagcuaagggaaggagaauugccuucacagucaacuuucaguguggucccugaacuuuuuauuuuguucagugaauccagcacaucucauauugugccccagcuauaauggguaguccuuuccugaucuucuaagaaaauuagaugccuggcuucugccuugcucuucauuguuuuuuaagcauaguccuuacaugaugguccgggccuuccuuacaggucuaauuguguggcugggccuuccuucugcaugccuauucuguuuuuuaguuuuuguuuuucuuuuaagaauuggggucucacucuauuacccaggcuggagaucaguggcauaaucauaacucauugcaaccucgaccuccuggacucaagagauccugccacuucagccucucaaguagcugggacuacaggcacacgccaccacacccaguucauuuugaauuuuguuuuuguuguuguuuugagacagagucuugcucugucccccuggcuggagugcaguggcacaaucucggcucacugcaaucuccgccucccggguucaagccauuuucccaccuaagccuucuuaguagcugggauuacaggcacaugcuaccaugccgagcuaauuuuuguauuuuaaguagagaagagauuucggcauguuggccaggcuggucuugaacuccugaccucaagugagccgaccgccucgaccugccaaagugcugggauuacaggugugagccacugugccuggccugaaguuuuuuuuuuuuuuuuguagagacggggccucacuguguuacccaggcuggucucaaacuucugggccugagcgauccucccaccuuggccucucaaagugcugggauuacaggagugagccaucaugcccagccugccuauccuauuuuauucugaggcuacuacuacuccuuauggguagauccaaggaucugacaucauuuucauacauccuguucagugugugaguauagaauugagguaggcugacaacacaaaagugggcagagguuucccacucauccccgacagggauucucuguuggcauaggugggcucugguccaacuccuggccgacaugagcauggacaauguggcacaguuguggcucugcaucuugugugugacugcugcccuguuuuuguuuagcaagcugcugugccaauuuacuaugcauguuguuacauauucugcucuaauuugacugccauuuugcuucagcgagacgaugauuguuuauggcagggcuguaauguguugucagcacagguuacucgcuacuuguuggcaauggccuaacauugccugagacauggugucacugugaaaugguuugacaauguugagacuguaguuauguugagcaguaacaacuguagaggucaagaaagggcaucuaagaggaacuguguucauaggggaaagauggagaaggaauacuaaguaggacaguagcaaaugucaucaaagagcuucauuuucacgcaauuuucauaauucagucuguuuucugugaacaguguugguucagcuguugcucgggaguagaagcacauuucugaguuagaaaugaauugugcugaucaugacccuaucauuuucuucuuugaacauuuuuagaaaguuauccagcuugcugaagaaugcacuagauccuuguccaugugugaggcaagggacucauugggccaccuucacaggguuucauuuuuggaacauuuaucuaaggacuaucuuacuacccugagagaccaagauguaggcuaccuuaagucguaugaggcugcugugaaaauggcauuuguuuuuuuggcucuaagaaauuuucaggaccuagucaagcaugugacaacaaauauuuaaugauaguggacaagguaaacuucaaaagugacuagaaacccuuguggaaucuaagacagagggacucuaacaagcuugaugacauuuugaauacguuuuguauugauuacugacucuuuucccaauaaucugugaagcuggcuuucuguuuggcaaggcagccccaaaaggaaccuucaucccauaccuccaugcaggaguagcacagaacagcacccagcaucgggcccuccagagucugggaggguucgguugucucaugaauuauguggugcccuucaggaacucacuuugaccucugaugccuuuccuuucaagcaagugguguggaaaaauauuaaaacucucaguaaugacaguuuccagauaugcauaucuuugaguggacaaugaaggcaacauuuauauucuguccacgaugcgagcaugguaugcauucugcagcugucacagagccuuccuucugguaccaaauaccuuacuuccugacagguaugaccucugagaccucccuaaccccuuucuuucauuucauacaaaaaucuagagcuuggcuuuuuuuuuuuuccuucuuuuuuuguaaaaagagguuuuuccauuuuaaaaagccuuuucaguucuuaaacuugaucauugauauguuccaccucaucaaaaagaggagugcagcuaaacugacaaucaguucaugccauuggccucacucaucaucaugucaaggaccuggcaugcccauugagaagggccucugugcauucuguccucaccaagccuaauuccuuccccuguugaugguuuugccagauucuuugccuguugaugcccaugccagggccacggugcuuaugccaaagccuuugacagaaugagucaaaucuggugccagucacccuuggcauaugccaccuuguucuugaccacuuccuaccagggaugggcugaaaagaauagugucugcuaagagcuuguagaggacuuuucuguuaagugcuaaguguugacauuacuccaguuugaaucagaucauuuggaacucuugcuuggaucucucaaagcuguugacucauuuguaucuuggccucacauuagugggguagauaggagccaaaaaguuugagugaagucagaauaaauauauuuuaaguguggaucuguggagaagaaagaggucccaagagcauaaugaaaacugugguuaaaacugugaaucaagagguuuguuuuaauuugccauuuucuuacgaaguuuuaaaauauuuucuaauaaagcuucuuauuuauugccuuaguacauuuucuguuacuuauaacagaauaccuaaaacuagauaauuuauggccaggcgcgguggcucacaccuguaaucccagcacuuugggaggcugcagcaggcggaucaugaggucaggagaucaagaccauccuggccaauauggugaaacccugucucuacuaaaaauacaaaaaaauuagccaggcgugguguugcgcaccuguggucccagcuacucgggaggcugagacaggagaauuaugugaacccaggagguggagcuugcagugagcugagaucacgccacuguacuccugccugggugacagagcaagacuccaucucaaaaaaaaagaaaaaauacuagauaguuuauaaagaaugggaauuuauuucugcaguuauggaggcugaaaagucuaagguagaggggcuggggcugcaucuggugagaggcuucuuggugguggggacuuucugaacagcuccaaggcagcacagggugucacauggugagggggugagcaugcuaacaugcuagcucaguucucuuccuuuucuuauaaagcuaccugucucucaauauugcugcauuggagauuaaguuucaacacgaguuuuggagggggcauuuaaacgauagcauauauauagugcagcagucccacuccuagguauuuacccaagagaaauggaacuauaugcuuacacaaagaccuguacccuuuuuacacuuuuuuuuuuuuuaagacagagucucacucugucgcccuggcuagagugcaguggugcaaucucggcucacugcaaccuccgccucccggguucaagcgauucuacugccucagccuccugaguagcugggacuacaggcacgugccaccacagcuggcuaauuuuuguauuuuuaguagagacagguuucaccauguuggccaggauggucucgauccccuaaccuugugauccacccgccucgggcucccaaagugcugggauuacaggugugagccaccgcgcccggccaaccuguacacuuuuuguaauagccaaaaacuggaaagaagcaguauacauuacuaggugaaaauuacagcauauagagauaaugguuauuucuaagcacaaaaaagaaucaaacugauauuccuaacaacauggaugaauuucagaaacauugugcuaaguaagagaaggcacacacaaaaagguacauacuuaauaauuccacuuguguuaaauucuagaaccaacaaaacuuaucuguaguaacaaaaaguaguuccauguucaccugggugcaggggugggaacacuggcuacagaguugcaugagggaacauugugggugauggaaauguuguuucuugauugugguggcaguuauauagauacagacauauuuguccaaacucaucaaacuguauacuucaaguggguacauuuuuucuuuuauguguauuauaccucaaguauaaugaaguugauuuuaaaaauauauuuguuguaaucccacuuuugccacauaaacaggguccagagaaauauuagguauuccuucucucucucucauguauauccugaucaaaacauuuauaugaacauauugaaaucagauuuaaauaucaguuucccuaauggacucagcuggacucaaguuaauugacuuaauaaaauuucgaaucucauuuguuccuauuuucuccucccuacaguuguuaucuuuacuguuauuugaaggacuugaauaagugaauuuugaauucagauaauacacuauagggaguaggaaagcagaccccuggccucaggagcgccucuuugaucaugaaugucuaugacugccauuuuguucucuagauucaugucuuuauauugucuauuuggcuuauaguuuuuucuaucaccauuuuuguuuucaacuguuuuuucacuaaaagacaaaauuugauuuucaugcuauuaauuucguacuaaaaagagcacagcaggcauaauuaaagcauuuuaagauguaguaauuugauuuaaaauauuuuacuaagcgauauauuacaaaaaguuauuuaauuaucuguaaacuuuaaaagcagguauuagcauucuauggcuauugucuuuaauaauuacauuuuaauuuuaauuuuaguuuuuuaaauguauguuucuuuuuguuguuguuguucugagauggagucucgcucugucacccaggcuggagugcaguggugcgaucuuggcucacugcaaccucugccuccuggguucaagcaauucuccugccucagucuccggaguagcugggauuacaggcaccugccaccacacccaaccaauuuuuguauuuuuacuagagacgagguuucaccauguuagaaaggcuugucucaaacuccugacgucaagugauccaccccccuccgccuuuuaaagaccugacaucuuaguuguuacugugaaauugauuuucuuguuuucuccucaucuuaaccuuguuuuauauaucaaaguaaagaagaggaacuguuaaaacuuauaugaaguauggcugaaucuucaaaaagauaucaaauauuuagaaacuaauuuuaagcugcauauguuuuaugaaugguagcaauacaauuuauaacugucauuucugaaaucuccggauuuaggucuccauugccaaaaaauguaaaaaauagaauuaugacaagugaucucuugaauuaaaaccaaauguuuuuguauuacaauaccugugaugaugauuccaaacaggcuucucuuuaauaaguggccacaguagagucaugauguuagcccuuauauuuauaaugaggacaauucugggucaccaagggccuggauaugggacccuuggggcccacugugauauuuauggacaugaaauacagucauaggccauuuaucagauuuaucaaauuuggaaacuuccaaauaaauuaauuugacaaauauacauaaacuucaguaaauuuuauuaguuuuauuuuuugcccuguguauuugcauaaauguuacuaggaaauauauuuaauaaaaguagaaggauuuuuuuuuuuugcgugauacucagcuauauucuuccaauaguuguggaacagcuuagugccuucagcaguggcagucuccuaaaacgauugucuaucaguuaaagguuaacugaguauuuggaccaaguagcaaacuagaauucuuuucaucuaaucucuguuuaauauagggauauccaauauaacauccuugggucaguguaguacaucuuacguuaaguuuugucucuaaugaauauuuauauuacauaaaugggaaaauugguggguucccuugguagaaacaugauauugguauuuuuaaaguaaacuuaaauaggucagaauuuuuauccucuagagaaaauuucacgucugauuaaauaguuuacauaaacuuaaucuuuuucugcuagaugcauuauaaucucagauauuauucauguagcuauuccucugugaaccauaaaauguucauuucuucaaaaugaauaugaagcucaaagcauuaguggucuuaagagcauaaaaacuuuauuacuuugugcuucacauuuuucaagugacuuuggaaagccgaaacaaauuuugcauuuagauuaauggaagauguuuuccaugugaaggaacuggcaagggagcaacaauaacaaaaaucccccaagguuaaaaauguagugcuuuugauucuucccagaacuguguuagcagaacaaucauuucucagcauggaaagguaucauaauuggucuauacaguggcaauacugaaaacgaguaugcuucagagaaagcuaauaugacucuacuuaauaauuuccuucaagagccugaauuugaauguauguuccacccagcuugaggcaaacaauuuguuccuauaaguucuaguggaaguuaccggggggucauguaauuuauuuuugucuugaaguuuucaaaacuguguagaaauaaagacacguuuacuugcauuguuccacuaguaauuugauccaauuggcaaugcuccuuucucuucuucucaauucuauuauguuggaagaguggaagcguucauaaaauguugugacaaacaauucuuccuagagacguuuccucuuucuguuugaaccucugauccacuugcgaauguuagcauucuuuuuguuuguuuguuuguuuuugagauggagucuuguucuguugccagacugcaguacaguggcacgaucuuggcucacugcaaccuucaccuccuggguucaagcgauccuccugccucagccucccgaguagcugugacuacaggcaugcaccacuacacccagcuaguuguuguauuuuuaguagagagaggguuucaccauguuggccaggauggucuugaucucuugaccucgugaucugccugccucagccucccaaaaugcugggauuacaggcaugagccacugcacccagccaaauguuugcauuauuuaguaagugguuuuuuauuaugggucuuuacuuacaugugcuguuauuguccuuuucacugggauuaucuagguuuucaaucuguuucuuuguauuaauuuuuuggcuaugggacuaguuuuaaagcccuaccacagaaguagagggucuguaguuggaguacggugaguaacaugagagaauguuuccuuuuuuuccuugaagaauggauaguuuuaggggaaugugugcagaugucagaagauggcuacauagagaaugaagcaucagaagguagacacaggucucugcauugcaaauaucaguaacagggaugaagaaagaacagcaaaauuuuuagaaaaaguguaaaggaugguuagacacuuagacccucucuuuuauaaguuugauuguguacuucuaagaagcagcaauaaguugaagguaaaguuaucucaauacucugauaagauguggucucuggauucauaccaaacauuagaguucaaggcauuccccuucaguuuauuuuauauuccucaaauguaucuaauuccuuaggauuaaugauuuguuucucuuaaaaacagcauuuauugcuuuaaucugagaaaaaaauaagacuuccaguguuuauaucuacaaacacaaggauugaaaaaaauuuuauaaucagccucgcugcuaauucuuauaggugaagcaaugacuuagaagaauggggagacuggaguacaugauaguuuuguagacagccacaguuggcaaaagaugguggugaggcuguccccguuguaaauccuuuaucuccaugagagcaacuguugcuggcuaguuucuugugaauuaaguaugcaguuugucuuuuuuuuaaugugauaaaugaacguauuuucuaacuggcuauuugcuuaauaaaaaugaguaauauaauaaggaauuaggggagcauuggaaagauaaucacugggaggugagaaaaaaaguuaucucucugcuucagucccuuauucucaucuuuauagaucaguucucccagugagaagccaaaugggaugucauucuuuguuuguuuguuucauuaauucuuugcaaucuauaguaggacuguugaggagaauguauaaacugcagguuaccagcagguggaaggaggggaaugagggcaggugguccauaagcagaaauauuaauucuugacugauugggacagugaauauugaccaacauugaaaacauuauauuauggucuuauuuaggccugaacacugacagccaguugacaagucuaauuuuuuauaacuuaaaugugguucauuuaggaaaaacugccaucaagggcaauucaauucuauuaugacaauuaacucugacuuugaaguaaguagaauaaaucaguuuauuucucaguaaggcccaaauaaacugagauuguugugaaaauuaugcaguuugugacuacaguguggauguuguguguuggguugugcaguguacaaccugcaaagcuguaugaggcaaccuggacauucuacuccuagcuauauacccaaaagaaaauacauguuucuacaaaaccuuguacagaauguuuauaguaccaucauucauaauagcuaaaaagugaaaacaacccaaauguucauaaacuaauaaguggauaaacaaaaugugguguauccauaaaguagaauauuauguagccauaagaaagaauggaguaccacacgugcuacagcauggcugaaccuuggaaacauuaugcuaagugaaagaagccagacaccaaacggcacauacugauuguaugaguacauuuagauaugaaauaucuaaaauagguaaauccauugccaguggcugaaauggggagugauugcuuaauggguauaggguuuuccuuugggggugaugaaauguucuggaaucagacaguggugggguugcacaaccuugaaaacuacugaaaacccugugaaauguacaguuuaaaaugguuaaaaugauacauuuuauguugcauaaaagaacauuuaaaaaaauuaauccaguggggucugauggcaaauugacaugagggaacuuuuuugagggugauggaaguguuaucaaucuagauuagagugaugguugcacaacuguauaaauuuauaaaaacucaucaaacuguacucuuaaaauguggguguauuuuaugguaugcaauuauaccucaauaaagcuguuuaaaaaaaacccucucugagucauuacugaaaucagugccauuuucugaauuucagaaauaucaaaggagagcuuuccuagugugaauuuaucauaaauaauguuugguauuuuuuuuccuuugacuuaacgagagccugagaugcagaaacaaaucugcacuuccauguuguguuacccgcuuugggccauggcccauuugccaguugcagauugccuccuugucugaaaauggguguguuucuucauaguaacucucaauucuauuguuggugacagcgcaauaauggaacuuucuucuguguggauaagccccuucagugauauuugcaaaucaaaucauaucugcuuuuugugcuacauuguccucaaaaucuucugauugguuugguuauagacaucccuauaucagcuuuccuguucucuuucaguuuaaauaucuguaugcuguagcaaauugcauuaugaaauccucucacauuuaucgcuguuuagugcauggaaauggcauuuccucauuaccagucaaagauaaacucuaaauguuucuuuuuuuuuuuuuccugaaguaucaaauuauguauucaaaaaacuuuucucuauagcauuauuucucugagcuguuucuuuuuucccuccugaaugcugacaccagaugcagucugcauggacauuagucccagggaaaucuugucuucuacccaggacaaggagauuauaggaagcaaugcugacucuuguuguagauucacaaugugcugacacgauaauaggacaugaaugggcuuuuggaaugccuuuuccuuugagcugggcugagagggggacagaggcagacagcuccauggccugaauuucguuagcugugugacaaugggagagauaaguagaugugacaguuaugaaugauccucugucaugcacuuucacguucagauucagauaaacugacacugcugucaaacacaagcuauggagagcugagaccucugaugaaccuucuaauaugguaaaugggagucuuaauucuucauuaacugaaaaaaggagauuuggccauguaauuuucuccuugcugccuguuuuaaagauuccaauaacccagcauuuacaguugacuaggcagggauugcuuuucccccccuacacuugcaacaugcagacugugaaaucugaggaaacgcugcuuaaacccagacuuauugccuugguuaucuuuaaugacuuugaaauguauuggccucauuauggaacagugcaguuaucaauuccucuaauuaggugaugugcucccauaagaaauuuaacauuaaagcacaaaaaugaacucguuagaggcaucuauugcugggaacuucaguaucaauggugaauugaagauacuguguuucguuaccaacucuucugcaccauacaucugacuccuccuugaagacuagagcaugggcauuuuuuucuuuuuccuuaaggguuuaauccucauauagcaccucuaacaccuuugaugacauuuuagugcuucuggauaguaaacugugugccuuugacuaaaucgacuaggagucuagggaagggaggaggugagcaguuuacauuuaaaugcuccacauaucagcccaucuuucuuucuuggaauuuaacccauggcuauuuacucuuucuuauguaaguccaauaaacuuccuuucuauaaguagcuuaguacagucuuuguuuuuaucacgauagggaccauuauuuguuuauuaaauagugaugcuguuucacucauaaauauuucagcuguauuucuagagaaguaggaugggguuucuggguuuaggcuucagugaagggacuuuaagucucuuaacccuucuuuaccucaaucauccaucugaacaaaaaaaaucauuauagccuccccuuuggggaaacuacauaguuuaauuaguguuuucuaauaacuuacaaauccuuagagaaaaguuauaguagaagcauaagaaauuaucuuugggguuaguuuauuauuauugcuauuauuaucauuauuacuauaugggacuaguuguuuuuuuaaauuggcuacuugaaaauguguuucagaucucauggagugaaauuuaccuuucauuuaccuuagggcucaaauaagaguauacugaauauaaaaauauggaacacuaauuucuuuaaaauaccugaaccuauuaauagccaggaguguuaacuucgucaccuggaagaagauccuguccuaacuugaaaauguuagaaugaaaaccuuaaucgucuccucucaaagggucauugaggaagcugggcuugagucugugcagcuguucuucaauaauguuauaucauucugaaccaauuaucauccuuaacccagauuugcuuugaaucucuguggcaucuugacuacugucuauaacaacggugauugccagacacugccugaugcucagguuucuaucaauccucuucuucuccucacagcagguaggagcuucuugguguuccgcuccuuacccaggcuugaggaauaguccuacuuuuugccaugaugccuugcugcaguucuggcucuucccuugugcuguuguucucuuugucaugcagguuucccaguaucuuaguagaagccuugaacaauuccuauuaccuuuucagaccuuccuuccaagaacugggggauggggguguucuggucuugucacaggugggugccacauguaaggacccacugguucaugggauucuuugagagagucugacgcucacuugucuggguuaaaagucuggugcugacaccugcuuucugaaugacuuuaagcaaguuauuugacuucucuuugccucaguuuccugccuacaaaaugaagauaauagcgccugucuuaucaagguucuuagagaagauuagaugcauuaacacauguaaagcacuuagaacgcuuuaagucacauaguaagcauuaauaaauaucaguugcuaacagcuuuugcuucugcucuguuaccauuuuacuaucucaccucucucauagcccauaacagcaaaccaaacucuuuggcucuugguagauauauuauucuuaauguuugagcccuacuauuugcuauugcuuccuuuuuuacuccuauaaugugugaaauugaaauaaaaaacagaauugaggccaggcacagcagcuuguuccuauaauuccagugcuuugggaggccaaaguggaaggaucgcuuaagcauaggaguuugaggcugcagugggcuaugauagcaccacuguacuccagcuuaggugacagagcgggaccuugucucaaaaaaaacaaacaaaaacagaauuggucaccaugauauuaaagagccaugaaauauauuagcaugucuuuuuucugccuauccccucuauccuaaacauuccauguagucuugggaaauaaauucuuuaagguaggccaguuauuaugaauauaacaugauuaucuauuguguuauguuuacuggguugaugccaaggaaaaaugaauauggcaggucccagcaaauaacaacaacaacaaaaauaguauugucuacuauuucacagaggguguggaguuaguauuggguuuugaaggaugaauaggaguuuaucagaugaggaggauugagaagagcauucagggcaaagguauguggaaaaauuggugugguaguacacgccaauccugggaccuucaaguugaacauuuaggaguguaguguuuauguuucagaagcagaggaugaguggagagggcagcaauagaauggcauuaagacccuuguacaguauacuaaggaguuuggacuuaauccugugggcaugcaggacccuuugaaagauuugcagugggaaagugaucggaucugauuugcuaacucauugcaauggcucuguggaagaauaucuuggagagggguucaagacuugagccaggggacauaucaaguaguguuucaaaugcuaacuacccccuccugcuucucacauugcuaaauagagugcagcagaaugagguguacuucugaagacagguuuuugaaucagcuuuccagcagucccuugaguacauugagagggugcauggagggaagacauaucaucuuuacccugcccucuccccauguuaaucuauuaaaagagaugggagcaaagcugcuaucacauugggcuugacugaagacagaaguccuugagcauccuuccccugagugcgggcaagccucgugcuugcagaggagaggagauuagaauaacaucuucacucuucggugagagggcaggcagacccucacacuagaugguuccaccccggaguucaggcuucuccugacaaguguugcgagcaucugauguccuuggccucucuucugcacugcuuaccuuacagcaguuaagcaugagggcauucugugucuuccuuucuuucccuucaguugcuuaaagaagaugagaauuugcuuuaaagaaaaauauuaauaaaucuuuauaaaauggcauuaaauagaaaaucucacacucuuuucuucagaaugcuuuucuucaauugccauuguaucuuuuugccccuuccaaagucuuaccaauuauuauuaauauauauuaucauaauuacuuguagaaaaucaauagaauugcuugucuuuaucagcagugcuaccuuucuaccucucucucccuuuucauccucucuucgucucuugcgaauuguuguuucuggggguauuauuauuguaauuacggaaauugauaaaaauaccaugacaauuucaugccucagaauuauuacacaggguuuauaaaaaaagauuauuauacaucaaugcaguauuuguuauuccuaaaugauuauuccagaaauacuaaucaaaaacaucucccugcagaauaguacuguggcuuuaauaucagcugcuguuucuuugaaugggguugcccaaucuuucaucaaagaaacacaucacccauaucccugucuuuaaaaacagcaauuauguguaaaugccuccugauuuauuugagccagggccacuggccaguaugagucaccacaauuuauugcuaaccgucacuuuuacaugauaggucuguaacaaauaucugccgcauauuguuaaauuaaucuuccauuuaaaauuaauggaguuagacuccccagguucaauguaauuucauguucacgggcagggagggaugugugcugcauacaaaaugagacaaggcccaacgcccuaaucuuucaucaccuugaaccuggagacuaggacgcgucucagcaccaacuaaugagauugagccugcgucucuccugaggaugccggcucaaagaggcuuuucugcucagaaauagcaggcucugucuuauuuuaauaauuccucagauaugacaagucugauguuauguaugaaagagccaggcuugaaaaagagauaaaaugaauuuuauaucauuacuucaaaaccaaaccaagggaaguguguuguaguuaaauuaaaaaaaaaaaaagauaggacacauuuuagucaugaaauauacugacuguaaaccaggagucauccuuucauuuauuuuaaugcacaaucaccuuagauuucucuucuguaauuuuuaaaccuauucaugcguuaaucaaaauaauguggaugaaagcaggagcuuguucaauaaacauuuagaugaaaauaucagaggggacauguaauuccugaugggguaugucauacugaaccucugaagucccaucgcuucuuuugguggcaucuuuugaaaaugcaucuuuuuucuguguaccacuaaccuauuacuguuuagucucuuagacuuuaaaaaugccuaagccaaauuacucagggguauuggguucucucguuuuuuuuucugucuuuuucacaaaccagguaacuauuuugcauccauggaaaagaagguuuuacagaacagauuucggcucucauacaucuauaguacuucuggcaaaugguugcuguuuuuuuguuuguuuguuuguuuguuuuaauucuuagggaggacugagccccagagacaaugggacccuuuuccuagguaaagaaaacgucucuagaaagacacuaaguuaagagccaggcaagguggugcacacuuguagucccagcuacuuggaaggcugugacagagaauugcuugagccuaggaguucaagaccaaucuagacaaacauagcaagaccuccagauaagguaaacuuccugguuuuuaaaaauucugugaguugaguucugcuuccucagaggggaauucuaaguaucugcacuuugugucugauuuauuuauuuuauuuuuuugagacagggucucacucugucucccagucuggagugcaguggcacgaucuuggcucacugcaaccuccaccuccuaggcucaaacaauccucccaccucaggagggagcugggacuacaggugccugccacaacaccuggcuaauuuuauauguuuuuguagagacaggauuucaucauguugcccaggcuggucuugaauuccuggguucaagcaaucugccggccucagccacugugccuggccugugucugauuuauaauacaacauaugauugauuuuaaagcucuuuuuugugauuuguuguaauuugggaccacaauaauuuuuuuuccaaccccuucuucagacauacauaauaaaauuucuaaagaaguaguauugguauuauacuaccuauagcuuuuauuauuauuauuauuauuauuuuacuggcauucuauaacuuagaauucuauuuucuuacaaucuuuguauauuuaaaugaacauuagggauagaaaaaauguaaacucuaauacaagaaucaaguauagucacuuaauugacacgugcaguuuuaaaaauuauagucaccccuugguauacugagggaauugguuccaguacccccucaccuucacccccauauauauucaaguccugcaguggguccugcagagcccuguguaugaaaagucggcccucuguauguguggguuuugcaucuuuugaauacuguauuuuaaaucugcauuugguugaaaaaagucugcauguaaguggaucaaaacccaugugguucaagggucaacuguguaucacuuugauaggcuauuuauaagagaagauuuuaaaaauauugcuccaugucuguacuugaauaagauuuagaaaaucuuagggguauuuuagaaccagauaaauuaguaaaaauaaugauacuguaaauuggaaaauaaaugaauaauaguagggcaucuuucuccaugaaccugaauugcuuugcuuuccucucuuuugaugucuguaagcuguugcguuuuguacagugggccucagggugcuucgugagucccaaauaccagauuucuuuuucucucuucuacuuauaguauauuugccuuaaguucuugauauuuucuucugcccucuuuucuucuuuuaauaucuucagcauuuuucuucuuuuuucuuucucucccucuuuccuucccuuaaaagggcuucuuuauuuuauauagaaacucaucuuuuuuuguuuugagacagggucuugcuuuguugcucaggcuagagugcaguaguaugaaucaugacucuacugcagucuaaaccucccuggcucaagcgauccucccaccucagccuccaaaguagccuggaccucaggcaugcaccaccaugcccagcuaacuuuuguauuuuuuuagagacaggguuuugccauauugcccaggcuggucuugaacugagcucaagcaaucugccugccucagccucccaaagggcugggguuacaggaauaagacacugugcccagccuucaauuuuuuuguuauuguugugagugagugagugagaaagagagagagagcgcagguugauaugcucaagcuuaaggucuguaauggguuuaaagcuccaaguuuuauaaucggaaugguagagacggaaaggaucucugaucuaauccauccuccauuucauagguaaugccauggaggccugaaaagguuaagguucucaaagaucaaaaauguauccuuuuggaaaguauuauagugguuccucaaaaaaauuuaacagauaauuaccauauaugauucagcagucacacuucuggguauauaaucggaauuaaaaacagggacuuggacagauacuuauauuccaauguucauagaagcauuauucauaauagcuaaaaaguggaaacaguccacauguauaucaguuuguaaaugaauaaauaaaaugugguauauccauagaacagaauauuguuguuacuuuuguuuuugaguugcauuuuauucugucacuggggcugaaguacaguggcacaaucacaccucgcugcagccucaaacuauggggcucaagaaguccuccugccugguacuacagacaugagcuaccaugcucagccuggaacauuauuaccuagccuuaaaaaggaugauaauucugacagucugcaauacgaaugaaucaauguaauuugaaaacauuaugcugauugaaauaaacuacacacaaaaggauaaauauugugggauuucacugcuaugagguaccuagaguagucaaacucacagagacaaaaagucaccaggaacugggaagaacagugggauagggaguuacccauucaugggcacaagguuucauuuugggaugaugaaaaaguucugcaaaugaauguuggugaugauuaauaaugugaauacucuuaaugccacugaccauauacuuaaaaaugguuagaaugguaaaaaaaaauuuguauauuugccacaauaaaauacacagacacugguaugauuuggcucuguccccacccaagucuuaucucaaauuuuaguucccauaauccccauguguugugggagggaucugguggagagaauugaaucaugggggcaguuucccccauucuguucuugugauagugaguacucacaaggucuaaucauuuuauaaggggcuuuuuucuucucugggcacucauucuucucucuccugccaccuuguaaaaaaggauguguuugcuuccccuucugccaugaucguaaguuuccugaggccuccccagccaugcagaacugugagucacuuaagccucuuuccuuuauaaauuacccagucuugggcaguucuuuauagcagcaugagaacguauuaauacagacacgcacacauucuuuuauuaccugagaaaauuucuggcaauuaguaugucuguccuccucugccuccaucucuguagcuaacauuuggacauuccucuguuucaguuucagauuugcucucauaauguuuuugaauguuacaucuuucccuuucuuauuucaguuuucuuuuuuucugacauugaguacgugcuuugugauagucacuagagauacaaauagcucagaaucaaagaaagaguguacaugaaguauuuucaagaauaugccuauaaaauauucaacgauuucucagaaaauaucaauuguaaaauaaauaaaauacaacaaaacuuucuuauuugcacaaaugcguaaaguacauguagucuaauuuaaguaguuuuuauuuuuuuucucuaaaguaaauuuugugacuuuuuuuuuuuuuuugagauggagucuugcucugucacccaggcuggagugcaauggugugugugauuucggcucacugcaaccucugccucccggguucaagugauucucccaccucagccucccgaguagcugggauuagaggucccagcuaccacacccaacuaauuuuuguauuuuuaguagagauaggguuuugccauguuggccaggcuggucccuaacuccugaauucaggugaccugccugccucagccugccaaggugcugggauuacaggugugagccacugugccuggcccaauuuugugaccauuucauauaauauuauaaguauuccuuuacuaaggcaaccuguuaauauaggucucucaguugcaggcuuuucuuauucuauggauugacuaagaagcccccaaaaauccuuaugaggaaagauagagucaugugucauaagagaaggcuaguaauaggcuugaguuucaaagaaaagaguuuaucagacugaggaguaaagaacguugguaacuggccuucaaaagauaguuaagauugcauccggaaagauguggggaaggggauguaaaauggauagcaaggcaggauagcaacagggcauucuuggaauagacaaccauccauuuguucucagugugaaauauacaugguuuuguaaugggaauuaaggccgaaauggcaugucaaggccaguaguugagagcuuuguaggucacauugaagaguuuguauuuggaguuugauggacuccuaggauggaucuguccaguggacaacuggauuucagaccuaggagagccucuauagagguauuaauugaagccuuuggaugaucgagauugugaagauagaauauaagacagagccucuugagcauuucucccuuagugagaagaagguggugauacacagaaggaaccuucagcaaggugagaaugauagauaaaggauggacuuuccccaagaaaccuggcaagggagugaucaggaguguuaauacugucacagagacuuuaaagaggaucacaaaugaggggaaaccuuggauuuuaaucuugacucuuaguacucaaggaaacugcauguuaagaugugguaauuaaaguauuaaaauauucuaagggucccuugcacucucccuuucugugcccauugugacagcauggucacaucauugcuugaggcaugcaagagugcuuuauugaagauaguauuacggggggagauuuuauuuugauagagaguaacaaauagacuaauaaucuaucuuaaaguaaguaucuuaaagucaguaggcaaaggagaaaaaaagauauugauaaggaaagcaucugcaggacagauucuagauuucuguuuuuuguuguuguguaugucagggcccagacuauguaaaugauagggcaaaaugugaguagcaacauagucuuauuagaaaccuaaauaucuacaaagagagcaaaaaacuaucaagucaagaauauguuacccauuuuaguaaaaagguuagauuucauuugccuuguguauuuguguguguguguguguguguguauguauguauguguguguguguguguguguguguaugacaguacuguauuaggaaugcuuaguaggcauuuggagaaguuuugggugauugguaacaugaaccauucuucccuuuaaucuggugcaucugaacauauuccugggcagaagguauaccugugcacauuacagacguuuguggguacuuuuauuucauuauccucaagcaagaauacgagauugcuauauucuacauuagaccaacuuguucuuagcaagcacagaauaauaaccuuucagugugaauguuuguacauaauaguaguaggauguauuuugugguauuuuuuaaaugaggauucauuuuaggcuuggcacaguggcucacgccuauaaucccagcacuuugggaggcugaggcaggaggaucgcuugauugagcccaggaguuugaagccagccugggcaacauaguaaaacuucaucucuacgaaaaguacaaaaauuagcuggguguaguggcacauaccuguggucccagcuacuugggaggcugaggugggaggcuugagccugggugguggaggcugagugagugagagugugucacugcacuccagccugggugacagaguaagacagucucucaaaaacauacauacauacauacauacauacauacauacauacauacauauguacaugcauacauacaugcauacaaaugaggauucacuuuaaaaagcauugaaauguaaauaucagcuauaccugaauguuuauaauuuaaagguaagauugucauuaaaggaaaccuuaggaauuucucagacauacugaaaaucagcccgaaaguguuuucuguuguuugguuguugucguucuuuuaggauuuuauggaguacucucauuacuuaucacuuagaccaaaagagaaugucaaacugccaacaaaguuguuuuuucuacauuucuacuaaauaauguuaaguagucagguucaucuuuggaaggaagauucuuaagugcuuuggccuccaguaguuuagaugagacuucuuaaaacucaaaaucauuuuauuggaaaaugcuuuauuuucugucuuugugaauuauauuuauaauaaugcauuuaauuuaggccuugggauuuuguauaccuuugggugggccucuuccucuucucccccugcaucucuaauaagcacugaauaucaaauugaaaccaugauauucugaaaucggaaaguuucugccuuuugcagcuuauuugaugggaauaaaaaugacugauggcacucucucuuggacccuuuuguucaacucaccuaugauuauggagccuauuagcuggaguuacaaccuauuuaagagcagugcuuaccaguaaugggggccaaaugauuuuggaaaguucagauguacuggacucccugcagaaaugaauucagcacugaacauauugaugcagaacccgaacgaggcuacuccagugggacaaagagaauugugagcucugcaagaaaugaguggguaguagaauuaaagaucagauagauguucggcucaagggcagucucagcucuuaaguucaucacagcaauuuaaucaggcccaaaugagcguugcccagaaaggaaucagccuucggugugacaggaaauggaguuuauuuaaaagauucuuuguuucuaguaauuguguguuaagguuuuccaagucuacacuaaaauuacggaacuacuacauuugauaggugauagcacuuugguuuaccuugguucagaagauguacuguugagaagauuuauacaagucaugaucuuguccagaaggagccugccaccucaaaaguuccagcucuaucgucuuuuggauuaaguaggccagagugcaucuuuggcuauagcuaucugaugcccccuuccauuguaaaauuauuuucacaaaaauauauuugucuacaguaagaguuauauaauauagcaguaaagaccacaaacuuuagaaugaggcacaccuggguuggaaucccaccuccuccacuuguuagcuauaugaccuugagcaaauuacaacuguaguugaacacauaguucuuuacuuacgaaaugagaauaauaauuccugccucacaagauuauggggagaggucaauuaaaugauguaguauguaucaguugcuucacaaugucugcacauaauaagggcucaauaaauaguaguuacagcucuagagcucucucaucuugucccucaccucauuugcccacuccucuacucucuucaugagccagaguguucacugcuuuaggaauaagugagggaaacuuuuuuuuucuuuuuucuuucuuucuuuuuuuuuuuuuuuuccgagacagagucucgcucuguccccaggcuggagugcaguggcacgaugucagcucacugcaacuucugccucccggguucaagcgauucucaugccucagccuccugaguagcugggauuauaggugcccgccaccaugcccggcugauuuuuuuuuuuuuuuuuuuguauuuuuagcagagacaggguuucaccauguuggucaggcuagucucgaucuuuugaccuugugauccaccugccucggccucguaaagugcugggauuacaggcgugagccacugugcccggccaaauaagggaaacuuuuuagaggaucuuuggcuucagucauggagaaaaagaagaaacuauaaacacuuggaggucugaacaguucauugauuguuaagaacccaaacaaaaacacuccguccccaaccccgacacaacaauacagugggguauuuuggauugacacauuauuagccuggaaaccuauauugacagccagguuaugauuuuacacauguaauaagaagagucuauugguuuuucuucuuuguugcucacuaguucuuaaguuugcucacuaauguauagguauuuuugucuaacacugacaaaauuugaaaagaaguauaauaaauuuauuaggauuuuacuucucuccuucauggaccuggcaaauaguguaucuaugucuccauacccauauccacguucuuauuuuuuuuaucuguaucuauuaucugucucuguguguguggaaagugauaaugaaugaaugaaugaaugauaaaagauccaaacuaugaacuuuauggauaucgggguaaacauccaacaaucccuuaaauuuggugcacucaaguaaaagcugaacuggagagaguugaccagauccucuuaaaguuaagcuuuuuaucccucugcccauaauuuguaccuugagauccuauagggaugugccuaggccugugugaauggcagccucaucuaugcuguaccugcaguacagaccagccucaucugugcuuuaccuguaauacagagcgaaacauaucuagagaaagagauuaguuugcaauuagggggaucccacccauuccacagcuuggcccaguggagguucccugcuuugaucgucucuuggugaagagaagaagagacagcaagugcuguagaaaguuuucuucuuuguaguuaaagugauaggguggaaacaggagcauagaaaagacauucagagaauagaaagugaccaaccauuugaaaaccuaaaggaagaccuggguucaaacauuuguuaacauacagagaagaaaaauaugaucuguuugggguauuacaauccaguguguauuuucuaucauacuuaccaaauguacuuacuuguuguaaacauuuaauauuuguuuagugcuuugaagauucggaguaauguuucagaucuacauauuguaucaauaagcaaauaacauaugcuaagcacuuaaaggcuauugucauucuccagcuaguacagagcaaaugugaaaggguaaagacuauguaauuucaggugcgguuucagugaggaagccagaacagcagucuacucuuaucugcugcuuucuuccaccccaacccccugacccauaacaacaaaaaucaaacccagaacaaaccgcauagauugaucaaagagcauaacaugcauuguuaggauuucagauauguagacagaaagucagauuaagcuuuaaugauaauuuugaguucuuggagcaaugcucauugauuacaaugugugugugcuggggagcaauauuugggguacccauaccuucccugggcauguuaaccuuguggggcuugccuuguuucagaacauguuuccuauuaaaaaaagaugacuguaaaaucguaggccuuuucuagcaugcaccucaaaacucuuccagccucuacccaucacccaguuccaaagccacuucugcuuccacauuuuaguuauuuguuacagcaguacccucccuucuugguaccaguuuuugucuuaguccacucaggcugcuauaacaaaauaccaaaaacuagguagcuuauaaacaacagaaauuuauuucugacaguuguggaggcugggaauuacaagaucaagaugcuggcagguucacugucuugugaggccuaguuucugguuguagauggcaccuucuagcuguguccuuuacaugguagaagggguacacgagcuccuagggccuuuuuucuaaaggcacuaauucacucaugaaggcuucacccucaugaccuaaccaccuccacuaaaggcccaccuccuaauaccaucaccuugguaguuaggauuucaacauguagauuuugaguggacauaaacauucagaccacagucccugugaagaagguauuuguuauucuggcagugcaggagcaagcuagcacacuugccauauuuagcugauagaaguaaugugaaaugaaccguuaggaggagggauuuuguggaagaaggaauggcggacugagcaagauaaaauauggagaauugcucccucuucaagaaacgccuccauccugauguauaucagcuuucauauccccauggauauuuuacaggcauugcuaccucuuuaaacauuuaugcuauuaaaaaaaucagaccaauuguugacauaaagcuaacauagcagcuucuauauagacagaauaugaauuuuuuaugcuguugaugagaaguuuaugucauuuauauacuauaguaggguagaagauggauuuggaauccugaaaaagcuacuguuuguaccauucagaauauuagcuugugcuuugaaucgaaauauuaagauaccuguauugucaaugugaguguuucugugcaaaguggcuuacauauggguggaaugggagaaauugcucuaccuggagaaaauagcaauaguuuucuuucguuuauguuuuguuuugugaaaggaaggguuaauagcauuuaauaccugauuuaucugugcuucucugcaccauuaaaagaaugaacuguugugguaauaaaaccauauuucauugaauuaaaagugccaucacuugcaagaugcaacauuauuuuauguaccucuaaaaaacuacacuaacaaacugacaugucaaacugacaugccauugauguuaagaugcauuccaauuucagagauguaaauauacuuuaaaauguauaucuuggaaucaaugaaauacugcauauaguucuuuugugguauguguauauauguauguauacacacacauauauacauaugccacaagagaauaaaguauacuucuauuugguuauagucuauaauauuuugaaucauuuuacugaguuagguuuuacuuauuuuuuaaaguugcuguugacaucuguuugauaccauucauuuaacauggcaugaauuuagaaucucuacuuagaauaguccuuuggaagcccuaguuuguugaguuuucaaaagaaaaaagagucuggugcaaggaggcagacugacauucaagucagaucauuuuuuaaaaaaggaaagaaaggagggagggaggaaggaagaaaggaaggaagagguucauccugucaguuaggaaccagcuaucuuacuuuucaaagacaaaaucagaucauacuaguauaucacaaucccguaguuuaucuaauugcauauuuauaauucuucuuggauggugucucucaucuuggauuaccucucucacccaaaaucauauuuuauuuuguuuugucauuauaaaauuuacuauaugaucauugcaaaacaaaaacaaaaaauuaccaguacauauaacaauacuggaugucauauauuaaguucacaauaaauuauggcgauuuuuccacaucaauaccuuaucuucauguuucacaucaauacauaaucuuaauuuuuagugacugcauauuauaucauuguauaguaaaacauaauuuuuaaccauuucccuauugauggacauuuagauugguugcaguuuaucacuuuaauggcauggcugccauguacuuucuuuuugucacacuuacccagugaucauuuuaggaucaauuccuagcaauuucuggauugcuggaucaaaggcucugucuucauguuauuauguguugggaagggaccauuuccucaucuguucaccaauacaggauaucagccaucucccaccccaccccaucuuuaccuacuugauugguuaaaaaaaaaaucuauuuuuguuuuuauuagcauuuuuaaaauuguaguugagguugaacaccuuuucauauguuuuggccuuuucagagugguucuugauaauagaaagcacagcaggucagagagcaaaaggucuuaaugaacuuccauucugcuucacagaagccuaugagguuuugagguaacuuucucaaguucguuauaaagaagaugaaacugauagaaaauaacugugauguagagauggggucuggcccacuuucagcuggucuacucuccagcacuggaaaggaagacugagcaucagaaagccagggaagaucccuccagagguccaggauuguucugaggaauacugaaaucaaaaacucuagacuccuuccugcuuucugagaugcagggauuugacagagaggucaaaaaagggccccuuuccucugcaugugcagcuuuuauuuacuauuguuuccuuuuuguuguauugaaaugucuucauugcuugccuuuauggauacaaauaaccggauacuguaauuugaaaguaguuaacaaugaaacugcauaguaugagccaugcugauuuuuuuuuuuagugggcaaauggggugauuucucuaugagccucucugcugucagaagcucuuaacauuugagucaacaugggaauuauauuuggaauaaauuaguaaauucccauucagcaugccuauaccauguaaucuucaggaaccguaaugacuguguaguagaguauauuuccaacuugguauuuauaaaacacauuugcucugagaaacccuucaguauuuguuccucaaggcccagcccucaugcugccuccuuuguuagucaguguuuauuuuguaauaguugggacaguguuguacaguggaaacccauuugucuuuggaguuagcccagacauaaauggacucuuaggccugcuauuuacuagcaguauucucauguuuggaaaucaggagcaauguaauuguugagacaauuuauuuuaaugagaguaagucaugcaguaagcaucaaucuuagcacauauacauguugucuuuuuuugucucccugaaaucuucuucagcugcuuccauguacugauaucuucuuccaaauuccuuaagagccuucaucugggucauacauugacauuuauuugauacuuaauauugauaguuaucucuugauguuuguguaugucuuuguauccauaggauccuccauuagcacauguauucauucaucaaauauuuauugagccacuucuguauauuaggcauagaguaagaugcuggaauauguuaaugaacaggagauguggucacugugcccuccuaaugcuuacaucccagcaggcaagaccuauaugaaacaaaguuugaauuacuaaaugaaagacauggcaguugcuauuagcaauguuguaaggggcugugaauguagacuagcuuguacaugacauuugagcugauaucuauuggcugaguaagaguuagccagguagaggugggagugauaagucuuuaggcagagaaagcagcacguucaaagacucugaaacaggaaaggacuuguuucaguggugcaauagaggaugagcaaaauguucucagagaauggagugcagaaagcaggccuucagagaggucauuggcagcguaaaaaugggguaagaacggcaaccuugugcagggucuugaaggccagguguagguuccagucugucaccugagagcaacaggaagauacugaaggguuaaagguuuaccuguggaagaguaucaguaaaacauaaauggauagauucuaagugagucuacuuuaagcuggaguuuggagucgcaggguccugcguguguaccaccauacucucuacacuuuuaaaacuaaaacagaaaguauucuaaaacauaaaacaaaacuggauuguauuuucaacuguuccuucaacucugaaauacuaugauuaugcuagaguaugagaaauuuuauuuuccaaacaaauauaaagauguauuucugaugaaaaacauuuucaaccuaagcuaaaaggaaaucuaaugaaaacuuuaaggauccuuuaaaauacuaauauuguguuuaaagagaaaaugauacuugucuuuaaaauguuuuaaaacauuuaaaauaugcuacugaauauaagugaagagugguagauccuaaaguaguauuucuuagaagaguagaauagguuauuuccaaaaucuuuuucauggaauuuuagugaaagcuaccauagggaucauguuguccagccucuuuguccuuauaaaaacaucaauaucuucauaaaucaagaaaaugagucccaaaauuggacacaugagcuacccauuuucuaagauuuugcugaacggaacuuugaucauaggggucucuuucuaaggcaacguauuagaaacucccagcaucacuguauuccuuauaagaaucauauuuuuuacauuaaucuccagaaucaaacuacaagacaauuaaguuguugcuuuuaccagguugaaacuugccuugauuuacuaugaauguugguugccuugauuucuucuacuuuuugucucaguucuacauguuguuguucuucugguuuugcuccuuaugagauucgcuggaucucuguaucucuucaacuguggugaguuucauggacagggucagaacuuagggaaauguugagaauagggugugguccuaugauggguccuccucuucuuacaccuucgacuguuguaccacucuuugauguuacaaagaugaaugacuugugguccuuggcccagaguuucauauucuggauaaauuauuauuuauuuguaguguacuucuauauuuuuacaugcugucagaauauuagaaauacaguguuuccugucagaaaugccagcugagcaaaagccaguaagucagauacuaaugaauggauuagcaaauuauagggacuaaugaaauuaaauaaagauuauucaacuaaacuaguggcuccucccaguaguuuagagcguugcugaccaccuucuuuuuguccacucacauauuagaauuaaaaaugucaaaguaaaauuaaaauaacauucucaccuacaagagguagggagaaggaaaguaauauuuaucuuuaauguuauuuucaguugugcauuuauuauguauauuuuugcauaaaauaacuuguaguuuuuguuuggacaagccaaucaaaugagucuuuaagaugaagaaggagagcgaacccacaagagaugaguuucguaugucuucucaaaaaaaaaaaaaaauuuuuuuuuagcucaccaaaaaauguuaugaaaugagaauuuugaaaccuuaccuguggaaaucacagugguaauacuuauauuucagcccuuagauauucccagugguguuuugaucuuagauauucccccaaagguguugauuagauucuggcuacagcugaaggaagagaauuuuugcuuuuuagcugaauaguaaaacaagccucuaaagauaugaggcaugggggaaaaaaacuaaaggcuucuucaaggugguguaagggcauaauuuuugucaucuuuauuuuaagagcucuaccaggccagacgcggugacucacgccuguaaucccagcacuuugggaggccgaggcgaguggaucacgaggucaggauauugagaccacggugaaaccccaucucuacuaaaaauacaaaaaaaauuagccaggcaugguggcgggugccuguagucccagcuacucaggaggcugaggcaggaaaauggcgugaacccgggaggcggagguugcagugagcccagaucgugccacugcacuccagccugggcgacagagcaagacuccgucucaaaaaacaaaaaaaaagcuuugccaaagguuuccccuuaguaaagaauuuaauacuugaagucaucagauuagauuucagacuucauuuacccgcucuaugcauuuuuuucgucuuccuggguuuggucugccugugcuucuuagucuacaggugucuuuucucuguacugccaaccucuaauuggagauuuauuaggugcucuuaaguaagagaggaggaaggccaaaggagacagaaaauggagaagcaagaagaaacugaucaaggcaggagagggaggaacuggagaggauggagauaaaagauguauaaaugaagacaaauggaagaacaaugagauagagaggccugaaugguagaaaaauucuaaaacugagcuagugagaaugcauauaaaauaggggucugguagaagaacuucagcaaaagugguguaaaucaaugaugaguaaauuaauagggcaauugugcaaaugggacucacucauuuauacuaagcguaauacaucaugaaugauuuagagauaaugcaacccguagggcauaccuuuuaaucuacccaggacccgguagagaaugcugucacuucaagaguaaaaaggcagaggaucagaauauugggugugucucuucauucuaacaguguuaaugagauagauucugagcaacaugaaaauuaaccagacucacaagcuuaguuugugauuuauagauugaaaagaagcuuaauauauuccaaacaucuuccuacaaacccaaaauauuuaaguguuuugaaaguauucauuugaauagguuaacaugugugauugccauggauggaaaugaaaguaaaaugagucacugcacauaugauccaaggaacaucugaguguuaaguggguuguaacugcauaagaauccagugcuauuggaagaugcaucagaguauucugagaccagggaauaaaauucucuuccaugugcucccuucucuuucauucgugugccuauucacucaccauucaauaggugucuaucgacagccuucuguguggaagguacugaggaauguccuauggguugcugcuucuaccugaaacagaaacauaagauuuacaucccucaggcccucuuaccaguauuuuuaugggaggauauugaggaagggaagggagaaagugaauauaagaaguggagagaagucuugguuuauagagcuguuaggguuccaagucugcuguucuuucuugauucagaaauggaagcucacaaagguugugucuggaccaaagacccaagauaguuggaguguugaggauuagaugauuuugggcuucccuucuaguucauucuuagaauuuauucccaguuuuuguguuuaugaaaguuagagauacagucuucaaccauuaggaguuagaggugaaaauaauaguaauuggauguuaccaaguauguaaacacuuguagggaagggaaauacauaaauaacuaaauucucuauuaaauucugauucugaaaacuucaaaacagaccuaauuuaguaagaggggcugcauuuuuauaugugaucccacagaaugcuucuagacuucugucacugauggggaaaaaucaaauuauucaaagucuugcaccauauaacaaaaaagcuaaacuaagacgagauuucagggaguauagaaaccagcaauuugugaaaaaucuuguguaugaagagucaugauguagaacauucaaacaaauggaucacaagagauuucucaaagcaugucuuagaggugagcaggcaggcaucaauuuuaaaauucucuguuauaaaugaucauaagcuuauguuuuucuguguaaaggagaaauaauuucccaauuuuauaaaacaaauuaccaaugauguaaaaaaaacauuuagcacaguauuauaucagagggcauuuaacauucuuuugaaucauuugagauuuucauguuuccauuucagagaucagggaagaugugccuuggagaggaagcaugucuuaaaucuggaaaugauaugaagagggaugucagcaacacuucauccugggccaguaauagggagaguuucuuuucucucgucaaauugcuuaaaggauucuaguuccguuugguguggucacucacauuugaauucuaauacucuaugugauauagauucuguugacuacuguuagcgugaccccaaugagaaauuaaacacuucccuccuuuucauuugcaguguguuuuaguuuaaccuucauuuguuucucuuuucuccauuccucaucccaauucagguaucagauccuuugacaauuguuaaccugcccagcugggauuuuuggcauuaagcuaugacuguaacguuucuacuaauaaauuagauuuuuuaaaagagugcugcuugccaagaagcaaagucauuacauaguguguauauguucaauguauggcuauaaaagucuccuuagccaaacauaaucgacaguuaaaauaaauuuaaaauaaccgugcuaccucuagauuuuaaaauuguuaaggugaagauagguggucuaauuuuacucuauuuccauuuuucuuauucacaggguauauuuguucuguaaaaccacauauguaucuuauagucugcagcugauguauuuaucugccuaaauacacauuucuccaauggaauauucuguaauaucaagcauuucuuuuuuagauggaaauuaauuuuauaacaguugaacaucaucuuugucaaucagcagcuuuaucuaccauaaagaacaaaaacguacuuggcguggccugcuuuaacuuuuguaguuccuauguuuaaacugaacagaggaauauuaugugaacaaauuggaaaauuauauaaagaaauaaaaaucuuuuuacuauuauaguuaucuuuaccccauagcuuucaaaaaggcauuugaagcaauuuaauaaaauaggaauaacaguaaguacuagaugugagaggugagaaaacaacuuuguaaaucacccaucucacgaaguugcacagagguuccugauagcccagacaaugaaauaaugugauaauuccuauuuucagaaaagauaacuagcuccuuauuuuguuuuggguguagaaugggggaagugguauauuuuugcuaaguucuaaauucuuaggaaaauguucacauggguuuugagagucacuguauaacugacaauguccccaguuacagauuuccagaaaauucagacauggaauucauguuacucauuuuaguucuaaccuuugaugaaagauuagggcauuagauugaagcuuaaguaagcaaaggcauucuucaggugaugugguucauucuaaucaguaauuuuaugaugguguucauauuccauuccaaugaucaaauggacuaguaagcuugagaaauaagacaaacuagagagagagauuauuuuauaaauaugaaggaggcuagugaaauuuugguccagauggaaagccacccacucucccaggucaggacugcauagaugaaguauaagcaaaaccgucauucacacuuugaaggugcugcuuuagagagaugucauuauauguggugucagauuuuucacccuguucaguacugggcacugauuuuuaaaaccacuuaucuauauuuuuuaaaugucuucugacucauuggauugauuuuguggaccuacugguagucuuuggauaucccccaguuaaucuuugcuuccaugaugagcauuuauugaauucuauucuuaugccaggcacuguacuagauuuuaggaguacaguagucagguuuuccuugccuucauggagucucuggucaaauacuuugguucuuauauagcgguucauguuccgacacgugguuacccacacaggcuuuaguuaacaucugcaucaccugcugcacauucucaucuaaaaugcguaugugaaaguacaguuguagccacucagugucacucaccaguggggcuuuaggccugagacuuuccgauagccucuaauuauguaaaaccaugccuguauucaggagucagaagugaucaaaauguuuuaggaagcacaccgucagcauagaugugucaacucagcagcaagauuuuucauucuuuuaaaguuacacauuucauaaagaagaaggguaucaguguaaacuucuaaaugcaggacaaaaugcaugauuggggauggagauuggaguggacuuguucaaagagcagcagcaaaugagacauuaaaggaauacauaggaagccacuuccaaguacuuccauuuuucuuuaguugugauugugagaugguucccuacuaguuagagaaggaaaauuuuaaaaugcuuugcuaaacagaugauccuuaaauuggucacuguauaccgugaugcagccuaaucaaaaugguauuccuuugagugagugagccacagagacucucgccaaccccuugugcagcuuucuauuaacaguauaaauacuccauuguuguaaagcaguuuaugguuaacaaagcgcugucacagacacguuaucuuaguuuugcagauugccuuuguacauguuauucucauuuccuagcaugcccucuaucccugcuuugccugcuuagcaagcucauucuuauccuucaggacauaacaccaacucugcaaaguccucuugagacccuucugagcagguagauggucccuuccccguacuuacacaagcccugaucucaucucuguugucauuuguucacaucacuguuucucccuggagacugagucucucaaggguaaggacacugugugcucuucauuuuucuucccagugccuuuguaaccagucuuccugggggauacuuuguaaguaaaggugaauacuguauggugugcagcuuaggagagcuuaagccacuuccuaaguuaagauacuaaguaguagauaagaguaaaacuuaagugucuuaacuccuguuuuuaucgguuuuucugguuuaucaguuuauugcucaucugaaaacaagcuguccacaucauacucaugcuguucuaccugucagagauauauuacaugguaaaugugagugauaaaggaggauaaguucuuugucagaaugaggacauuucgguucugucaucaugccugaaaugcaugauuucacaugauuuccaugugaaauaaaacauugguauaaaagggauauggacaaauuuguggauguuagaaccacaccuuuuucucugaauuuauuuucuucucacuccuacuuggcauauucccugucauuguuugagagugugcaccaauguccucgucucagggacaccauuucuuucccgcuauuagagugucuggaugaugccguacccuuagugcacuguccuguugaaaauuugguacauuaguuauuuuaagguuuaaaaacauugcugccuacauaauauuccaccucuuuggagcauuugcauuggagugaccaguggcuugaagcucuguaugguggagugacugaugguaguugaagacugcaaaaguagguaucugagggcuggaaggcauuccuggcaccccuaaaacuaccccacugggggccauccaagccugugauuaacaaacccuaguuauuugcuagguaguuuccacauggcauaguaggauauauauaugugaggcacaauacaguguuuaugugagaauaauauagauuauuugaaucuaggcugcagaaccuaccugaaaauggguuuuacaguuuuguguaauugccuuuucuuuguguuugcauagaaggcauugcauagcuggaagaugauggcaauuauaauuuauuaugcuguaauuguuaccuaaauguuuuugaauaagcaaaaaucacaucuguuuaggaauaaguugcacagcaagagaauucccuuugaaaugaauaccguguucucauauucuguaacuguacacauaaaacaacauauuuauuuccccacugaguccauuacauucccaagucaaacugcauccucucuuccuuucccauauuaaacccuuugauuuaauggagguuuuaacuacugguucuuuagggaauuuucaguaggcuuugcacagauuagguuauuggaaaguauaguuauuugcuuguaaaguggcaguucugugucaaaauugcuuuucucuggagcugcaacaguaaaaacgauaagcuucugcuuugcauccaaaaugcccugauguuccuagcaugaucguuuuuccuuugcuucuugcucagcaccauucggucacaggcugguuuggacaggcgaauaugagcacauguagcccagaggacuuugauauccaguggugauaauagacaaggccugucuuccauucugguugccacuggucugugacaaccaguguuccgggcauggugagcauagugcugcuucccuucuccguuaaauaggaaaugcauaagccuggagucguuuuguuuguuccacagaaacguagcaguugaaauaauugccuugccaugcccaggcuaacaggauuuaucuuccauuauagaucaugaagacauaggcaagaauaguuuacuccucuaaauuuacuaggcuacucacuucgaaaugauuucacuguguaaaagagaacaguccuagcuguggcuuagccuagaaaggcuuugauaccuagaaagaugaagggcagaaguguauucucuauuuuucugcucccagcucauaaaauagaauuggaguuuauguaaauagcagauagccugauuuuauuuuuuaugccccaguugcaaguuagugucuccuuaagaugggucuuaaucacugacguugugugcuuccauucagcaccuaucugucuauuaaguggcauucuaguggccuccaagaguugaguacuuuauucugaucagagucagccugggugaccaagaugggcuguaucaaucuguuacaccucagacccacuggaggccacaaucuuugagugucuuuuggaagauacuguccuauguuguucuagaaugcugacuccuacugcuuaaaccuccguucucucucuguuuuuaucuuaggccagauguccuuuauaaauuuugauuuuuuguuuuuuggguuuuguuuuuggaguuuggaucucuuaguuuucauccugaauacuguuccacacugcauauuuaaucaguuaaaucuuggucuccuggcuuugaccaucaaauguuacucuauugccucaacucuauugaguuacuccaacucaacugcucccaccucagggucuuucacuacccauucauaggcaguagccccuuguuucucuucuucgugaaaccugaguuuuccuuauuguacuuaucucaggcauuaauggaucugugaagaaguaugacguuaagcuuaaaggaucaaaaacugggcuucccuauguauguuucaaguuucauuugugugaccaagagaguucauaguauagauuugaagaguucaaucaagaagcuaagauauuaacucaucuuaguaauagccuuuugucuacuucauccaucugcccaucugucugucaaucuguauacauuauugauaacuuccaauguuguaaacacugggaauaccaaaaaaaaaagaaugagccaugcaccuuuccuucguaaugacuacauuaaagccccaagacaugaagcuacuugcugagccuugcagcugaccuguggcauaguggagacuagaacccauuucuagagggaucuuccucauacuucccaaggucaguucucuuuaggccuuugguauuccugucuuaguuguuguaagaguagauuucgacucaucaaacauuugugauuuggaaguaucgcauaguugaagaauugaagaaagcugaugggaacaaagucauuuucaaguuuacuugagcacauagauaucauguugacuacuuugcugaauauucagaaucauuuauauuuaguauaguaaaagugaaaaguaucuguuuuuaaaauuuggaaaacacacgaaauacaaugaagaaaacuaaaguaacaaccauuuuacuacucuuuuuauguauuuccuuugaguagauaucaaauauaucagcauuuucagcauauacguacaguuuuguguccugccuuuuucccuucaacuauauaaucagcaucuucccacaucgugagaugugaauuuuuugaaaacaugauaauuaaugcaauauguuauuucaaaguaaaaacuuuuuauuuaacuauuauuguguguguaacuuuauuuucuguguuuagguuguuucugauuuuucacccuuaucaaccaugcugaggcaugaacuuccuauuaauaaaucauuguguacaucugucaguauuuccuuaggauaaauuucuuuuaguucuauuacugcaucugaggaaauuaacauaucaaagcuauugauauguauuucccuggguauacauuuuuuuuuuuuuuuuuuugagacagugucuugcucugucacccaggcuggaguucagugguguuaucacagcucgcugcagccuggacugcuugggcucaagugauucucccaccuuagccuccugaguagcugggaccacaggugugcaccauaaugccugacuuuuuuuuuuuuuuuuuuucaauuuauagagacaaggucucacuauguugcccaggcugguuucgaacuuuuggacucaagccauccucccaccuugaccucccaaacuucugggauuacagauguaagcugcuaugcuaggccucccaggguauacuuuuaacccugccuuacaccacccagaauucaaagcauggaauccuugacccaguagccagaguauuucuuaucuuaaguuuaggaaagacuacucuguggucaaauguagucacagaauuucuuuccaacaaagcugucuacguaguuaacugagaaccgucuccaaaggguuguuccucuugagggagguuucagagaagagauggcauugauguaagucuugaagaaguuagagcucaaaauauugugaagaggaagauaauuuuuuuuuuuuuuuuuuuaucgagacagagucucgcucugucacccagacuggagugcagugacgcaucucggcccacugcaagcucugccucccggguucacgccauucuccugccccagccucccaaguagcugggacuacaggcgccugccaccacacccggguaauuuuuuuuuuuauauuuguaguagagaugggguuucaccguguuagccaggauagucucgaucuccugaccucgugauccucccgccucagccucccaaaguguugggauuacaggcgugagccaccacaccugaacgaugaauuuuucuaccaggacaaacaggauguucagaaggaagacauuguuagaacuguacauaaucuuagacaucaucuaucccagugguuuaucaaauauuuucacagacaaaacauuuuuucaagccaaaucuugucuagaguacuacaaacugauugaagugaaaugucuccaguuaaaucacaguggaugggagagcucggaauugaggguagaaccuccuuugcucagcuuucuuagagcuuccuaugcaccugaaaaacccaaagccucuuuuuuugguuuuuuuuggguuuuuuuuguuuuguuuuuugagacggaaucucacuuuuuugcugaggcuggagugcaguggcacugugucagcucacugcaaccucugucuccuggauucaagcaauucuucugccucagccucccgaguagcugggauuacaggcggccaccaccacgcccagcuaguuuuuauauuuuuaguagagaugggguuucaccauguuggccagacuggucucgaacuccugaccuuaggugauccacccaccucagccccgcaaagugcugggauuccagguguaagccacugcaccuggcccaaagucucuuuaaaaaacaaauuuuaagucacuccaguuugaaguuuaggacacagagacaaacugugacuuuccucaaggucagucagaagugauucugaaaccaccuuucaguacuuuaacccuguccaaaagcagccauuuuagugcuuuuaucacuagauguucccaugcagguugagagagauuauuucuguucuguuagguuaugcauuguugcagugucccaagagauaaagucccaagauauuaauguaaguauuagcuucuguaagauguuaccccaauccauauuaaccaugucuggcugaggcaugaaggaucuauuaaauuauauccagguuccuauuaaaucacuacacuggcaguaauaccugggcucaccuucuccuuaacccaaauuaacacaugcuguuaguggucucaagucuaaggcaaguuccugagaugaacaagugacugggaaaacaggagaggagaaaauuaaaauaaaugauaggcugaccuucucacaccacuugugguuucucaauuaaccaaaagccagacagcuccacguugcuguucucucaguaauagguuucacccucccauuuaaugccagcccacacgggugcacacacagacacacacuuugcuaaucagauuggcagcaaauagaauuaaaccauuaaggcaauuaagcaauucuuagauaacauuugaucaguucaaugaaaaugcaaauucauucuucuuuuggagaaauaaguugauggaaagucauuucguguucuauaaucauaauuaacucuuuuccaaauaaagauugcaauguuuugggcuuggagcuacacagauggaaaugauuuuuuucauuuuuugcuucacucuguucauccuuuuguaaugcaccauguuuuucugccuccagacucuuugggacauuuaggucaucuuaccuacaaucucuuccuugugccucaaggcaaacucuguuauuuacucucacacaugaugacucaugcauuaaacaccuccuuagacccugaguucggaauagauccuacagcauucuggaaugauuuuggucggauauucauguguuguagaugcacuacuuggcugcuucucauuucucucuauuccccacacuuacgguuucuccucucucacaagcugguggggaagagaauguugcacccaaaaauaggugcuugaaaaugagcguguggugucugcauuuucauuucuagauugguaucauugaagccuacguuccauucugccaccacagccugaacuuucagcaagaaaaugaugagcaccuugcagcccgugcuucccucaccugccaaggugccuuugugcucuagcucaggguuuccaaaccugguacaucaucagcuggggacauuuggaaauauuuauaguccacaggguuuuaauccagaccuauagaaucgguaugucccagguuuggcuuagggauuuucuuuugcuuuuguuuuuuuccuuuaaaaaaaaaaaaaucuuucuguuugauaauagggaucagccagucuuaagucuagaugccauuuuuuuucuacauuggagaccauaacauguagucugaugcaugaucugucaaugacacagaaaucacuuggauccaaagaauuuuaugauagccuugcuuauaaagaaaaauaacaccuuauguggcaggucauuuuauagauacacacauaugaauaguccacugcaucaugcguguguauauguguauaucaagugucuuuagagguagguaaaacauaagaggcagcuguuaucaccuagggcagggguguccaaucuuuuggcuuccuugggcuacauuggaagaagaauugucuuaggccacgcauaaaauacaguaacacuaacgauagcugaugagcuagaaaaauaauaauaauaauggcagaaacaucucaaaauguuuuaacaaaguuuacaaauuuguugggccacauucagagcuguccugagccacgugcgggcugcggguuccacaagcuuggccuagcuagauauuauauuuaauguaucuccuuuucagucuuaauaaaguauugcagccaacucccauccagcaggacacauggacuuagugugccuaccugcagguuuuugagcaugaauguaaauauuaauagaaaaauugugaaugcuucucaggaaugucaccagugauuuuuuucccccaaagaaaccuuuaguuuugcuaaucccuuuacuaguacauguuuguagaacacaucuuuuugagaauuuuuuggggauacugaucagcuacuauuaaagccaucaagccagcggugccaccagugucacaaggaagaacgauguuuugggaagggauugagcucagcauuccaggaaauauuuuuuaccuauucauuacugcaugcauaggcuuacauuuucucaauuuaaaaauacuucuaaagggugggcuuuugggauguagacacauaauguucucagcaauacuguaaagccucauuaauuugcuaaacaaauaagugagaugguaaaggauauugcauagauuguaagggcacauuuaaucaucugagguuuaacuggcucuaaaggcaacaccuuuucaagcucuuaagagucuauauuuacauggauaguaggucuucuuccuucauuaaacuugcccucuaagaccuuuuagcuguuaguuagaauuacauuuugaacuucaggauaauucuauauuucuuucuuaaaauaaauucuuuauaugagcauuuagaccauaauucaaacugagguuuccuauaaguucuguguuauauuuuauuugcgugcauagugauauucauaccacaucuguuaaaguaugaagggaggaaaaugucagcaaguguauugugucucugcucacaauaauuuuccaaugaaaguucacuuaaaugagggauucauauauauuaaggacuguuguuggugauuaguacauaaaaauguggguuuuucucauaagugguuuuaaaacuucagacugaguaccucuuuuguuuaauuuuugcacuucuuggaggcauaagguauuuuaguauguguggaucuuuuuuauugaguuugcauaguuuaggaguuuuuuggcuuaaaauaaaauagggaaaaaaagcucucuuaaaauaguauccuuucuugaacccauaaaguagggcuuugaagacgugcaacauuugugagguucuaaagaggggauuuugugguguucuuuccagugcuuccuuccuuccguccucaccacccugcuguaaucugauaacaaauaacuuuccagucagucaauuuaaauuauauguaggcugcaauuuuuuaaaauuucauaauggaugcuauuuaaacacaaacauacauuuaaaaaaaaugccauacuaaaguccaaaaggaauggugacagacauuuuauuuauuuagagacaaguucucgcccugucacccaggauacaguggugugaucuuggcucacugcaacuucugccucccaggcucaagcaauccucccaccucagccucccaaguagcugggaccacaagugugcaccacgaugccuguguuuuguuuuuugugguuuuuuuuuuugguauuuuuuguagaggcgcauucucgccauauugcccaggcuuaucuggaacuccugagcucaagcugucugcccaccgcacccagcugacauuuuaaauauuuauuuauagagcuucauuauuuguacagugcccuuaaagccaaaggcauugauuaggcuuauagaaauugcaauuaggccaugcacaguggcucaugcuuguaaucccagcacuuugggaggccaacgugggaggaucgcuugagcugaggaguucgagacuagccugggcaacauagcaagaccuugucucuaguaaaaauucaguuuaaaaaagugggcaugguggugcaggcugguauucccaggaggcuagggugagaggauugcuuaagcuggggagauugaggcugcagugagcuaugauugugccacugcacuucugccuaggugacagcaagaccuugucucaaaaaaaaaacaauguagugagucauaguuauacuaaaugggcuugaauacuauaacuaguuuuaguguuauagucauuaaaaaacaccauaauuccaaauggauauaccaauuacugcuugcuuaucuuaugcauccuuuuccucuccucucuaucccccaaaaccacucuugaaaucuuccuguccuuuugcucuuauccuaccuggccaucuauccaccauuuaucuaguauaauuuccauaauaaaaccaccagcuugcauuaguguguugguuacuucaaagguggcuaaauuagagacuuugguuaaggacaccaaauucuuaccaauuugauggucuugaggggcaggcugucuggcucaucucuuuucuaucugcugcccaccuuuuacugccugccccacuaagcacuucucaucauguccgaggagagaguaagugggugcgugcaugcgugcugcaaguaucugcauggcauucuuuuuccugaaagaucuucuuuuuuuuuuuuuuuuuggccaucauuuccauucuguccuaauauauccuuucucuuuaaaaaccagcaucuagccaaggcauugaugaaaaguuuucuuugagcucccuuguggcugugcagaagaguuuauuccugagguugcucucauuuaggguuggaaucuuugaagauaaaauacuucuuccuaccucucacuugagaucaaggaaaccuacauaagacucccagagcaaaaggacccuguaacacuugugccuuggcauugccauaugcucuguugcgcaggaauggggaggaacggccauccacaugccacccccacuuccacucggaaauaauagggggugacaaauggcugcugcauucuauucuguuuuaccaggcuguuucuuuccugcccucaagagguuucugacuuucugacagcagggagcugagguugaucuagcaacugggaggauugcaccuggauuugcagaaauacacaugcacaugugugcacgcacacacacacgcgcgcgcgcgcacauacacacacacacacacacacacacacacacacacagugcugcugcaacucccagaguaucacauaaucacucuucuggcuuuagugguuuuccuuuggccacacucugcucuuguuuggcuugcuagcacaguaaucagaggaaagacagagacucuuugcacucuaauccccuuguggguuacaguaguuucagauagaagacacuccagagggugcuauacaauuuggagguuuauaaaggccaucuucuggcccccauuucccuuuaagaaaugagccccucaaucugcauuauacauguucccuuacugcuagaaggguuuuacuggugcccugacacucuucucuuccucaccccucccagagcaagaacuacaaaaacauaguuuuuuucucauuuucuuuuagauguaucugcugccauuuauuuucucucuggugauugugugauauaggaaggggaagcaucaauggcuucuuuauauccuaaccacauuccuugacugggcccuguuucacaucucugacuccucuagagauuacucagccaacaugcugccccuccucagcgcaucaccuucuugggucucagggcuuggcauuuucauucagccuugcaguuccaugcucaucaccaacacugcagacaucugcugccacuuuccugccuaaagcaagggaauuccugugauucacaccgugagcagaagcagggguccucuucuacucagcauuaucccaguuugucucacuccuuuagccaauaucaugaaacucugaaacuuuauagcaggaugaaaacuuaagccuguagucuaaagacccagaauuaugagugaggaaacugaggccaggagagccaugaaugauaguguuuacuugauugcuguuucagauuucaccagcuuuuauugauacuucagcauuuuacuuagucgauauaucucuucgugugacucaaaguaucccaguggagcacaguuaacugcccuggauccgaauugccacuggaggccguggcagugucggcaucaauagggaucacccaugaccuuuuauuugggauguaguagggggucugaaguugggaaagucugaggugguacucaguucuggguugaaugucuugugaaaauccugugaauacaucuugcggagaaacacagaggggaaaacuuccuguugugagagcagggcugguucccuuuuaaaaagguauaggaugaauauuccauauuugaaauacuugagaccagaaguguuuuggauuuuuaacuuuuuuuuuuuuuuuuuuuuuuggaaaugcucuggugaacauuuccuuagagugucaugugacacucaaauaguuucagauuuuggagcauuucggauuugggaugcucaaccuauaauacccaaaggcucuauuucaguagaauuuauugguuugcugauuauagcagugacauaguugcauucuagagaccuuagaaaaugcagaaaauuucaagaaaaacauuuaaauugugcucauagugaaacugagaggugaccacucuuaauauuuuguggcauaagcauuccagucuuuuaucuuucucaaaguuucacauaaacuuucucaaaggccauuaaauacuuuuccauagccugauuuuuugugaccacauaguauccuauuauauugauaauaccauaauuuaccuaacccauuuuuauauauuuggauuuuuuccaauucaucauuauuaugaauaaugguguaucucagugguuauuacuuugcacugcauuucuuaugaaaguauugaguaaaaggaaguaaagcccucucagaguguuuuguaggcugucacauuucacuccauaauguccuaguguuuguugccaccagugauauaugaagguacccacugaaaugucacaccuuuuugguuuuccuuuuuaaaauaaaaaauaaaaaagacauuuaaccauauaauauuguucuuauauaugauuuauuauaauguagauucacaucuuugaguucauaaaaauauugaauuuggauucucuccaauuucccuuuuaguagaaaggcuaaaguucgguaagaaauucuacuuggaauuuuauugaauugagaaacauacuuggauuucuguaacucaugacaaguaacaaauaaacaauuagccaauuaauuaaaauaucuguuaaaaccuugaguaaugcagagauuuaguuaggcaguguaguuuaaaaaaaucaaacaaaccagaccuaugcugaucuccuuggagaugaccaucaacaggaaagauagacuuuaaacaguguauguugacauagagcaaguuucuaauuuuccaucauuucaaggugcuggaaauuauauggacauaaaugccuuuauaauauguguacaucuggugaguauaaauucucagauuugaggacauuuccaauaaaagacucacauacaaaguauaaaaccaguaagcaauggaaugcuaaucaaguaaugaaggauucaggaaagaaaauaaaauuaugccaaaccauguaggccaagaaaugcaagugggaaaaaaaaaaacuuaagcugaugucaaagucaaaauaaaauguagagacaaaucucuaaauuuaauguuuuauuugggaaucauagaaucacauuuggggcaugcaaacagacuggguggucuucagcauguccaaagaacaaaggaaagauuggggguuuuauuagaaagggaaauguuacuuacaguuuugaaagaaagcucauugacccuagagaagcuugugggagcugcccgggucugauuggugagugaugguaguagauaaaacuagucuuaaagucauagcagguuguuucagcagcugcuaaguaaaacuggucuuaugguuacagcaggcuguuucaacagcugggcuuggagaaaacucaauucuuggagcaugugcugugucuugaguacuuuuucccgcugcucugucaacucuucuuuaguugggcaugacaagaaugaugcaauuugcauaaucaacuuucacacugaguuuccuguagccuauacaaaacauaaauauuaguguuuuuuuaccuuuuuacaguuuuuauuguauugucuauugaagugaaacauuaaaguuaucagaauagagaaacauuugccuaucacuacacauugagaagauacuguaaagagacuugaacaaacacugggcaguaugaugcguagaacuuucagucuaguuuuuacaagaaaaagaaaagaacugugcuaaccauuuuguucaucaauauaaacucaaguaaugagguuaaauuguaguucuuugcagagugccuggccaccagguccguaaucgcuggagguuugauuagauauugagaaagaaaucugcaaaccuuggcaaaauuugcugcauaauuccaagacugcugguucuuaaauuuaucuccaucaaaacacagauguccugugagcuggacuaagccaucucacuaucuauaaucaaauuauugcuuucuuuuuuuucccacugaaagaucgaaaaagaaaaaauggguaaaaauucuuagauaacuguuuuuguaauguguauuuuuguugaaccuugccucauuguauaaucaaguaacaaauaugaauagaaaauacuauugacuauggaugguacuuagcucaacagcuuauuuugaagaggaaaccaucauguuuuuaaauaugaaacauaaucauguacuuuacgaauaaaauucuuccuauuucuuacaacaaaauugaacauuucaggauuuaaugguguuccauagccacuagcacgcaguagcucauaauuucaagguguuugaccacaucggucaguuugaaaaucauaccugaccaucacuauugaacaccugaagugcaagcauccaugauggagacuggagcuguccauuggcuacugccuuucagacuagggguggcaaaccugacccuuuguuauaaaaaugaaagcccucaaacguguucuuguccucacgaagauuuuugucucuacugaaaugccuguaggccauuuuuggaaauuauagcuagugugcucacuaaaguuuuucuuaugugccagacacaugcucuagcuuuacauacaauagcuguaaaccucacacaaccuuguaagguagagagcauuauuaucuguauuuuauugguagggaaacugagaggcuaagugccuuggccaagaucaccaaguuaugaaaucacacgaaaggagagccuagaucccucuaccagcacuccuuccucuauaugcacugccuugcaguaaucaagacuucacuaaaagcaauuucagaucucugcaaauguuugaacaagagcucuguugaaaugccauaaaauauaggauauaaccuuagcuuugaaacauuuugaggggaguuaccaacuuaaaaaaaaaaauguuuaccuuugagcauaaccacauccgaaagagucacagagcuagucacagaauguaccccucgauaaguaaacaacauaaccuguugaauaaguaaguaguuuagucuucucugccugcauguugcuaaaaauaacuuuugcuuugguauagaaguuuugaaaguuguguaguucaaugaauauuuguugacagugauugaaacuuacauuguuucucucaugcuaaucuugccaagcuuugguggucuucaaguauuugaaacaagaaagggccaggccagagcccucguuuucagauaugggacaacaaccaggcuuucuccauuugaaggaagaggaaagagauaagggaauuguugcagugaauccugugggccccaggaguuauaacaauuguuuucuaggacauacccauuucacucuucuuaauuuucugccaucagcauuucuggggauguacuaggaaaauggaaggaacauacccagcuuccaggguuucaguaguaaaguauagacuaguuuaagagcaaauugauuagaucacuucuacuccuaugauguccauuucucauauaaagauaagcugagaaagguuuauuuuaaaauuaaagcuaguuguuuaaaagugcggcugaaguuaacucauggauugcccuaaaguauugagcugugauuauaaaaaaauguuuaccaaauauugucacuauggcucuuauguagugaagagaagaauuuagccuuaaauuaguuaaaaugugcaaaccguuuagaacagugcuuaacauauaguaagugcuccauagguauuaccuaugcuuuagaacaguaguucucaacugguguaccacacggcacaaguauaucuuuauccuuucucagacaugugccgaaacaucuauacacauauuaauuuuuuuuuguauagccaaauauguaggugaagugcacacugauguuucacuuggcugaauaaaauaagaggugagagacacaguguaaugucaagucuuugcuuaccagagugaaauggggcaucgccuuucgggucuauaggggugcacugagcagucccguuaaaaaggcacauguucaaaaagacuaaccaggugagcagcauguuaauuaccacugcuuuuaagaacacuggaaaggcaagugguuguaugguaguagcaauuacauuguaauuacugugacuuaguuagaaguuuuugaaccccuuuuguauuucaaauugcccuguacauacaaagugggucagaaccaucaguuaagaauuaguggggucaguuccugucuguagcuauuaaagugauuuauuuauugucuuauaacauuauacuauauuaauuuacacauagccuuggaaaaacucuuucucagacuucuaggccagagucuaaauacauuuaugaaacuucucaggaccagguuuugauagugcggagaucagggagagccuaaaaucauaagacuucucuaauagaguuaggucauuaaagaauaugaauauaugaagaguagggcauuagagacaacauucuauaccuaacauuuugguccaaauccuauaaagguuucucacauagaaagcugccuuuuugcauguacuacagcuugugucucuaauauccuuucuguaccaauacacaccacauaucugauuauuguucaaauacuccucuuaacuuaccaaugaaagcuucagaucacuuaaagagauugcagauacuauagugaacauaguagaaaaucauuauucuauuguauaguaaaacccaugaguuacaucuaaaauguuacuacuguuuuuauguagucuuuaaaaaaagagauuaugaagguuuacaauuauaguaaaacuuauuaaguagaugcaucaauaggaaaagaaaccauuauccuuucaacccaguccuauuucauaaauagcacaucagcgcuucagugauuaagaaacauggcucaucuuugcagcauguugcuuuuauuacuuuuugcccacggaccuaagaggggagagguaaagugauagaggaaaaagcuccaaggcaaaucaaguucacauauuuuuauuuaaggauucuaggaacucgaagacugaaucaaacuuguuacuuaguuuuucacuggaauaauggcucuauuucuauaguagagugaguagaagguuaaugguaucugccauugaugguuuacuaacugguuaaauaacugauugaaaugugguaaagggagaugaaaacaaacuaaaucuuuuuuuuuuuuuuuggcccagauuuucacguuuagaugccaugaagcuuuugauugugggucuaaagacaaacugugacagugauuggaggcuucuuuuaggggucgggagauauauggaaggacaaggaggacagaggaauucaaucuccuaugcagucucugcaccuguucacuaagaaauaagucagcugaggccggacgcgguggcucacgccuguaaucccagcacuuugggaggccaaggugggcggaucaugaggucaggaaaucgcgaccauccuggcuaacauggugaaaccccgucucuacuaaaaaaauacaaaaaaauuagcugggcgugguggugggcgccuguagucccagcuacuugggaggcugaggcaggagaauggcgugaacccaggaggcggagcuugcagugagcagaggucgagccacugcacuccagccugggcgacugagcgagacucugucuuaaaaaaaaaaaaaagaaagaagucagcucaguccaggcaguagacuuuggggugggccuugauggaccauaagaccuuugcugcccugugacuucucccuuaguucucagucuguucagaaaacaauuugcaacaacaucagagagaaauagaaugcaaaacacagcucccuuuugaugaauuggcuccuggcucggccugcaaaagauaacaugguuuuucccuuagaauacuugucaugccaaaaugaugguaucguccuacugggguuuuuaaauguuaauacaaguaaaauaagauggauuuuuuuaaaaaauggcaagcguuucuuaguuuggcucucuuggcuuuuguuuaaaacugaagaucacuaagccuagauuuuugugucuccaguuuaaaaaaaaguaaauuucaaaagcaguuccuagaacucucccucuccauaggccuguugugagaugccuaugucccuauaagugugcuucaaucuaccagcuuuccuaaaacagguugauggcuuaguggauaaagaugggacuuacaaagccuauugauucucuuauuguacucaucuguagaaugggaauagcaaugguacaugcugaucuuacaugaugugaggaugugaugaaauaauacauggaagguauugagacuacugucugggucauagcaagcaguuuugccauuauuauauuugucaugacaguuuugccauuauuauuaacccaauaauaaugucguguccccuuucuccauucuugucucccaaagaugucacacauucauuauugccaaaaaacauuuuuaaagcuuucuguuuuucugguacuugcaguguggcugacgccaguaggguauaacuccucugagaaugggugcugaauucuguucccaaggccuauggggaaaucucuuuuuguuguuguuuuuuguuuuguuuuguuuuguuuuguuuuuuguuacagucucguucugucacccgggguggagugcagugaugcaaucuuggcucacugcaaccucugccucccgcauucaagcgauucuugugccucagccucccuaauagcugggauuacaggugcccgccaccacacuuagcgaauuuuuuuuuuugagacggagucucgcucuguugcccaggcuggagugcaguggcgccaucucugcucacugcaagcuccgccucccggguucacacuguucucgugccucagcuucccaaguagcugggacuacagcacccaccaccacgccuggcuaauuuuuguauuuuuaguagagacgggguuucaccguguuagccaggauggucuugaucucuugaccucgugauccgcccgccuuggccucccaaagugcugagauuauaggcaugagccaccgcgcccggccacacuuggccgauuuuuguauuuuuaauagagaugaaguuucaccacauuggcuaggcuggucuugaacuccugacuucaggugauccaccugccucagccucccacagugcugggauuacaagcgugagccaccacaccccgcugggaaauaucuuaaaagaaucaaaauaagaaaguuacucuacuuaaaucgugugcuuuuucugugugugauuuaugguaaucuuaccaugggguaucugauuacuuuagaaagauccauuuagcuuauuuuuuucuucuuuggguuauuuuuuucuuccuuccauuugcacagccuccccccaaauaaaaaauaaagauauaaagucuaucuucucccucuugucaguuuaaguaaaaagaacuuuugcuuccauuuuaauaauagaauuuguguguauauaauauaggcagugauuuggccucaagcugaguuuagauuugaaaagaugagaauauuaaagcuugucagccagcccacaaaccacuuaaguauuucugaucugacaggaugugggguggaguucuuuuucuuuucuccaccaacaccccucacaauuaaaauaaaucagauaaaauagacacugugaaggugggacugaaaguaggugauaggaaaggguggccccacaccaggaccaguacauaugcagaaauuccguccaaaguacuucaagggucuaggacagugcuguccaguacaacuuucugucacauugaaaauguucugcauggcccaacagaguagccacaagucacacggggcugaaggcagauaguguaacuaggauuugaauuuuuaauuuuaugucauuuuaauuuaaauagccacagguagcuaaugucuugaacaguguaggacuagaaaaaauagauuuugacacacauucucauguaugaaaaacugccaaagagcaucagauugcucuaguuguggaagauugauuugggaguaaaagaacgucuaaacugcuauccuguggaagagaaauagauuucuauuuuguuguuccauagggaagaaacaggacuacuugggagaaacugcagagcaacacauuuaggcucaggcuaaaaaaacuuccucagaauuagucauacaaaauucuacucagaucucuucgaguuuaaggacgacccccaauucugagaguacucaggguuagacuugauggcaguuugacgaggaccugcaguuccccauuuauaacacuugucccacacagagucacuaguugugcuaaguauuagcugaaacauuguuuucauaagugcucugaagcuaccaagaccauugguaucauuuuauuagacaugacuauuauuuagcuaaagacaauguacuuugagucacuguaaggccauuuguucuaaaagaaacaaaaagauucuccuugggaucccaagcggaacccuguuguucuaacaguaaacaugcuccccaugacuacgauagguggcacuggucauucaguuguuaaucuuaaacuuuucagugauuauuucaccuggaggggaugcugacauuggcacaauagccuuuccaaauacccagaaaauuucugauaauaagcaaauggaugaacucacaguaguucagcugugguagaugcucucguugcugguuaguacuuguagcauccaucagccacggacccgccgguuccuacuguuggauguaacagauucauggaaaagaagccuuguagguaaugucacagcaguggucuuaaauugcaaagaauuucuaccagccucacgaaccagggcauggcauggaauucauuggcccugcuuauccccccguggagacgugggaauggcaggacugugaauguggagcucaguuacccagcagagggguaacgcucucauaaagaacucccacagaauuaauuagccgcauuuuagcacuggagacugcaccucuuacauaguaggagcgaugguucagaaagauaaugaaggcccuuagguuauuauugauagacccugccuucuuuuuaagcaggaggacauuuccucguucuuucucuuguuaaaaugauaagugcagagcacucucauuaggauguagccccuuggcucccaaggacacagugagauuuccuuuccuuccgugcauguugucucucucucuuucccugccaucucauucugacauuucaaguaaacaggcauacauuuaccuguugguaggugauuacauacuaauaaaaacuacaaguaaggaacacuaggcagcccccauuuuacaaauuggcauuuagucccucuauaaucucuucucuggagaggaguaauauccaccuggauguaaggcuggguggaauuauaaugcagcccuguuacacagauggcugucuucgucugugacaugugugcacacguagacauucuugcaugugcuuuucugucagcccagauugaugugugcauagguuaaauugcuagagaaaucagcuuucuacaccaguugcaucugauacaaauuucuaccucuggcugggcccuggugccaaguguuugcucauuuugacaguccucaaauuuguugcuuuagauuuuuuuccucucaucuuaaacccucuaguccagacuuucguaucacacuuuauuauguguagauagcucuaccaagaauaucaaggguaucuaguaaaaucacccucaacuuccaucuccgccauuuaacaugaaaacauuguuauucauguuuaugucacucccucuggagaaaaacauguucuucauucccaaggucaaagccauguucuucaaccaacgcuuacagucuccuccaugguuuugucacaucagucauuccuuucccuuugccuuguaccugcugucuuuuucaccacuucccucucagcucaugaacucuagcgaguuuccuccaaucuuuaaaaaucuaaaggagaaaccaccuccaucuugugugucuccaucccucaaggucaaagaacuuuuaugcuugcugucacccuucauaacccguggaugaauaguuacuguauccuauugugcuaauaaaauaguuucuuaauacccaccaaugacuuucuaauaaaauagcuucuuaaugcccaccagugaccgcauucugccuaguugacaagcuguuccacuuuggaucucucucaucccauggacugccugacuuugccacuccuuguucccauccuuuucuguaucuuugucaggcucucuucucuuucuccuuaaauauucgucaguaucccaaaguuuauagagaauguuacuuaacagcauggauaugaggaacagguaggccugaauucaaauccuugcuccacuacuuauauggcuauggaaacuugaguaaauuaguuuuucugaguauguuuucucauacugacuucagaugguugugaggaugaaauuagcaaauacaugccaugugcuuagcagagugccuuaggucacugccccuggccugucuuuccccucuucccacuguucaugcucuuaccugccauuguuauucuuucuguuccuggccuccuucgggaacccaaaagccacauugucaaccaccugccagacaccuuucucaaauagaaauaacuaucccuuuuucccaaaguaaauuucuccuuccccaacuuggcuugauagucucucucaaguaggaagcacagauguccauuugaccuccucccucucucuuacccucauauccggucgacaauccaugucuauccuagccccuggauucuugagucuagaccuuucuuugauucuuaauaccaccaucuuggcuaaggcuucuccuaccuccagcuuagauuauuguucuggcaucccaagucguuccccaucucuauucuauuguaagcauucucccugaaauuguacauauauuauuuaguugccuucucaaguuguucuccuuuguacuuuccaaucccuuauuaacuuuuggcugaagguuucauagccaaucuguagcucagggguagaaaggcaaaaaugguugaugcccugcauagaguuagaacucauuaaaugcugaauuaaugcaguauaaaauaaagcaaaauaggaaguguaguaagucauaauguaauaagaaguggggauaagugguugauuaaccaaaaguuagcuuuccauugauaaauacuacagaauuaguuguagaaaaaagagauuuauaacuugaucuucauuucucaccugagccuaugacaagaggguaauggauuggacaaacaaguggaaaaucucagcuggcaucaaugggcugucuucugcucccacccagugggugugaagucacucucuggcucucuguauaccucuccuuccagccauugcugauggagccaggucucuauuuuuuuuuuuuuuuuuuuuuuuugagacagagucacucuguugcccaggcuggagugcaauggcaugaucucagcucacugcaacacccaccuuccagauucaagcgacucuccugccucagccacccgagcagcugggauuacccgccaccacaucugguuaaauuuuuuguauuuuuaguagagcugaguuuugcuguguuggccaggcuggucucgaacuccuggccucaagugauccacccaccuuggccucccaaagugcuuggauuacaggugugagccaccacacccagccuggaucuccauucuugauauagguguuuugauccuaaggagacaaucguuggugaauuugaaacagauucuucaggaaauauagugcaagaccaaaauugggucccaggaaaaaucaugugauacuucguaaugcaggucucuuguagacacaagaaggcacacuugcucguuucccuggguuugguuuuuguuuuguuuucuucccccuaugucucacauccucuccugcaaccccaacccuccguaccgcaggcaagaaaacauugauguuucugcaucuggcagcaugucucugggagaagaggccggcggaagggaguuugaugugugagugacagauccccagguaacaccacuggggaacacuugaucugaccuguuugaaggugaaaacucaccaggucacacuggaaacaguugcugcugggcauggcuuugauccuuguuuaucuuuuucucuuuuuuuuaaccuucuugaaaaaaauguuuuguacaaauggauacuuuuuccuguguauauuuugucugcuggagcauuuguauauuuuguguguguguuccuugucacugcagggcgggguuuuguaaccuuuugaugcagauugugaaucuuaaugaauuugucauuugccauggaaagauguuuguucaaauagagcagagacauuuucguccaacaauauuacaggaauauuguguagaaaauaaugacuaauacuuugagcauuccauguuggcucccauuuuaaacacuucauguauuaacuuguuuaaucuucagaagaauucauuuuuccugguuuuccuguugacauuugaugaaacuaaagcagagggaaguuaaguaguuugccugaggucacacauuuaguaagugagagacccaggacucaaacucaggcagggguucuaguaccagcaguguuuaucaacugcuuuccaacccugacaagcaugagugggcacaagcauggagcacuagggcuuacaaaaagcucccucaggcuggcacauugccugacuuaaagguaccgaaggcauggcccugccuucaaggucauuauugcaugcugguuagaggagaaaucugucugucucauuugcggacgugucuccguugcuaaguagugucaggcauguaggagaugcuuaguacaaucuuuuuggauuguaucaauguagguuuugaaagguuauuagagcuugugaaucaucaagguugaaccauaaucaauuaacaagaaaggggaaucugagacuucuaaaauguaauggucaugacuugcuaccuuuagaaacaccagcgaaaaaaaccuguggugucgguuggaucauggcucuuauucacugcggcguuuuuaaagcuuuuucaaggauuauguggggaucccaggcuccuuuaugauuuauaaaucuauuaugcaugucacguagagauuuucaugacagaaucgucagaugaacucauucaggguauaauauuguaggagaaggguuggcgagguugagggggaugccauaagaaaaugccuaauucauagguagaguguaggacagaaauggauggggacuggaggccaguuaggacgacacuguagaggccagugugaggagcaaggacgugggcuagaggaggaggagaugagcauggggaggaaaguccagggagaguuaacaggaccuaccgacuagacaagaggauccagggaaagagaaugaagcauuguuaggaaaguuucacaguauagcggcccaccgauaaccuuaagaaccuacaaaccuaacaguuuuaaaacgaugagcuugaggcucagaaggaaaggcauguuaagcugucauaucagguugauugaauagauuggguaagucuuucagacauccuaccaccaccuucugccccaugcuguuaauucuuuaagcauugggaccaugaguucugucuagcaguguggguguugagaccacaugaaucaaggaagagggcuucuagaggcccaagggcuguuugcuguagaggaggcagaggaggguuccaagaauuucagaaggcacuguauagcucugccaggaaguguuuagagaacugaggugcagcccccacuucucauuacaacauuuuacuaccaucaaccucucagcagaacugcugcauuagguaccuaguguuugauuugaacuuuguauuuauucuccaugaaaaggcaccgugcccauugaugucacuuuggugcugcugagacagaaagugaguauuuuaugugcugucucuuuucaagcaagauggaagggucuuguaaaagugguuucuaaggaauaaccuaacauuuuaaagauuuauagaacaagcauccacuuaccaguucauuuaaguuuuacaaaacaucucugcuucugccuugccaugucagcaaaagauucugacauuuaaauaaauaaaauauggugggauauaauaaagugcaaaaaaaaugaugcaucaaguuacuacugaaaggaauauugaggccugagucaucucccugcugcugucucccaaacagaagauagcuuuaaucuucaggcucuguguuauuuaaauaagcugagggauuugcgaguugggggaugcugccaaauguauccacugaagauaaugaucccauuucagaucugcaggucuauuuuaaugaaaggagacaggugagggugcagaacagaaauguucauagcaccugacccuccuucuuuccuuaggaguuucucaacccagcgaaauuggugagauuuuuaaaaauaaauacuuuggaguauaucaugagguaggauuacuguagugagacagggagcaguaauggcagucaggaaaaccuguguauguuaaaaaguguuugcuaagucucuccuguguguuuaguguuguggggguuuuagucgaaacaaauuagggucucagccaaccucaaaggguguauuuucucagucuuuauugauuccucuugguuuccucagggcucagaacauccaacaccuuaggagcaaauguccuuugaaugaauagguuugggaugagguucuggaagacacuaacacaaacaaccuugauaaauuacaugguagugacuucaucacauucuuccaucuagucggaguagcuggccuuugaaaauuacccuuaugaagcuuacauuuuacuggagaagccagacaaaagaauacguaaaugaaugaaugaaugagugaaugaacaaaacaaaauuaucucucguucauagaucaaauuguccuaaacuugcucauuaagacuuacuuagcuaugcauuuuauaccacugucccugagcacuuuaaucauuuauuaauuauucaaccucuacauugcuuuaggugaacuggaggcaugagacaaguuugggaugcagacuuuuucuuuuuauuguccuuaagaacuauaauauaugcaguuaguuagaaacccuguccuauugguacuuuuguuucagugaacuugaguuuaaacuuuaaggcacagagguuauuacaguaucaucuucaggaagcuacugguacugaaaagagcauucuucaugccaccccaguaucaucuuuguacucuuaccuuuguguugagaagggauacaugucacuuauaaaaccuggguaugacuacgcaagccaccuucacauuugggauagaagauucuacaaaaguaaaauucacaaucuuuguacauacacagaagccagacuuaccagcauguauuaaaucugucuuuauuuuggaucauggcauuuauggagaucacuaagcaggcagcucauuugaagugagauucagaacacuuacuuauuuuauccauuuagcaaacauuuacuuaacuccuacuguguguacuacaucacuggggaagacaauuaggacccaguccuuguuuucaaggaguaaguacucuaguccaacaugaaacaacuaaugaaacugagcagggauaggcaaggcagagguaagugugccuuggaagaaaaggggaagaagaaaugguggauguugaccaaggcuggcacuagguaggcuccagguuccccugggaugcuaguuuuagagguggaagggcaguuuugaagucucauuucaggagcagggagaggcugugcguugaugguuccaguaggauggggaaaggaggaggagucagugcaguuggaccaggcucuugucuguccaucucaucucuccccagggauaggaugacaaggaccccagaaaucaacagugacaccagcugagugaccacaggcaguaaacaccuuacaauagcugcuuugauuuguauccuugcuggcguaucuuaacaacaugacgacauuuaccaaaugaaugacugcuuaccaagcaccagucuaagugcuucacccauguuaucauguuuaaucuucccaauuuugugagauagguaguauuauucccauuugaaagguuggaaaucugaggagugaagaggucacccagcuaguaaaagguagagaugaugcaacagacauacauguccaugcuuguuugacuguaacacguuuacucuuaaccucuaagcaauggugcuuuccuuaauauagaauguccuucgaaacaucccaaugccaaaauucagcauauuuucauauuagaauagcuuugcguuaggucucuuuuucccugaacauuucuuuucucuguuuugcagaaucuuguuggccuccuuuaaauaucauuauaaauguuggcaguguuguuuuaaauaauugugaacagaaaguaaggaagcauaugcacucugaucuuuuuaaagcgauuucauuauuguaaaaaauucugguuacaacucacuaaauugguaguuuggagcaccuuuggguguacucccagauacucucuacuccccucuccucccucccacaaaaaaacagcauuucuaaccacagugacuaagucaugcacuucuaaguuagaaaauuuauagaugggggaaaaauguaguugaccagauaaauaugcagauaguugggacaugucuaaagugaaacacugguuuccugacacauauucauuaaacauacagucaugucacaaaaagagauuauggucaggugaauuuauuauuauaugucccucccgccccgagaauaguacccuauaguuuaugaagcauguugauaaugaaguuaucuguuucauauacucuuuaugaaaauaauauuuucccaagaagccugaaaaacuuacuuggucaguccaagugagaaaaaauugaauuauuuuguauuuagcauuuuaauccccaaguuagaagggacauuuaacaacuguacuaaauucaaaagguuacuuagagacagaauuccucuuuagaucuaauaugauugucugguuuuaacaguuuggcuuuacaggaagacuuggaagaccagcaaaacugcccuuuauuuguauaaacucugcuugcauuugugacuuuuuuuaaagggaaaaaauaaaauucuuuauaggcauaauuuuuauaaauuaaaauacauuauaguauauuuaugugggugaagcuuaggaaauucuuuauaaaaugaacuguauuuugaauuggucaacugcuacauuguccaaaaaugggaauggugauucuguggaugaaguggaagaacaaggcuauucuuuacugucaaaaagggccuuuaugcuaugguuuaaaaucuuucugcaaagcccuuggauguuauaccacacauccuguagcuccuacaugccaaacucccagcuuuuuuuauguggagccccaggaaaaggugaucacuuaccuguuagccucaugccugguggugauaagaaagauggcuuuggugauacuaacugaaugccuacuagaagucaaauguguuguuguuucaauuuuauggccucucugcuggugaguauuuaaaaugagaaucgagcaagugaaagugugucauaguuuuuuguuuguuuguuuuuuaauuaagaggaccaaaccaaagaaauaggcccauuuuguugagagaggcaguccaacacaguggcucaaaguuccagagcuugccugcaagcucaggcagaugcugguaccaggaaugcccuguacggauaccaauucauucgugggagauaguacaggggcagguaaugcugaaucccagcuccacuuauguccagagcacaagugauggcacaaagcccuagcucucuucauccuuccacucucagcacuuuacauguguugccuuccucugauuugauuccaagcucaggccccagaugggggccucccagcaacaugucccucucccuuuccuggcuuaaaccaauuagaguggguucugaaacuggagcuggaguuuaucccacagaaauugaaaguacagcagggauauuucccaaaggaaaguuaggauacuauuuuacuaagaagauugagaggaggaggugacaaaaacaacagaugucuguacauaugugaggguggagcugaaauugcuugguuucuacaguuagcauucgcucaaaacaggcagaccuaaguuugcaggugaggccaguccacaacccaacucagaggcugagacaagcaaaguaaguggaaaggagacggaugguagaaagaaauaauaucuauugggugucuguucugugccaggaucuuuauguuuguggcccaguguacgccuugucacccucaugaagugguauuggaagguuuaaaggguuuggagauaaggguaaagauagauguagagucagggucagccacuguagccaagagcuuuggguaguuccagggcaaacugaggaagcagaccucuuagaggguaaaauggguuaugauuuucuaaagaggaaauucuucuguuugaccuagaugugaacugaauaaucacuucuguuguuuggaaagccauaaagccagccaaccaugccacaauccugaucucgcaacucacauaucuuauuuuucaacaaggaaaauccuuucaaagagauaaaugugaauucugugugccauguauauauuuguaccacauuuaauuucauuagcuauaauaucauguagcugugcuuauuuaacugcuuagcccagaugguaaugccuucugaagaaaaauggcuacacaguguaauugaacauguccuauugacagaguuacaacaacccauuuuccccauuaaauauaggugauucaauaaaaugaacacagagucuauuacucugccaccauuucuagcugaaaaugcaaggaggaaauguucuacaaggugaagaaauggcacaguuauguugcaugcagugggaggacaggcguaaaggcaggccuccuccucccgccuuggacaaaagaggagcuauuuguugacacucagauuugguugggaaccaaggggagaaccuuggcgucaucagcuaagaccugucugaaagugaugaugauagcagaugugaacaugaaaacuaggccguacauuuuggaaaaugauguaaaaggauuuggcuucuaaauggaaucaagugguagaaacaguuguguuggcucucagcagaugagggucuugggucuuaugaauguugucaaucacuaguauaaaaauauucuggccaaauuaguauaugagaacaacuaucugaugaagcuaucacugcaaauauuuuuguauucauugaaaaaaaauugccaaggcagaaggauugcuugagcccaggaguucaagaccagccugggcaacauagcaagacccuaucucuacaaaaaauuuuaaaauugacuggguggggugauggugugcaucuguggucccaaccacucgggaggcugaggugggaggauugcuugagccuagcgguucaaggcuacaguaaacugugaccauaccacugcacuccagccugggcaacagagcaagacccugucucaaaaaaaauaauaauuacaggguuggccucccugauccuguauauauugucuaugaaauugacagguuugguguggucuaagaaaguaagucauacucgacacugaaacuuuccuaggaagagcacuagagaugaugugagaagauguuauugaggaaaaguuugggaauggcaccuugccauguggcgggacuuauugcaguugcuauguguauauuuuuucuuaguuuucuucauguuuuaugaguaaagacuuacagucguucucugucuuugcuuauggggaaguugagaauuuuagagucaaaaagacccaaaagcccacucuggcuuacccucucauuuuccugaagaggaaagugaggcccagugaaaacccacacaacucaggagagaugagccaggguccaauugucccuucucucauuacugcauuuugcccuuauuccagugcuaagggacuuuuggggaugaaaggagagaagugggaggcuggaaggagugagguuucuuguccucacagcuagucacccagagaagcuuaagaaaucauuacaggcauuguggcucacaccuguaaucccagcucuuugagagacugaggcgggagcaucgcuugagaacaggaguuugaggcugcagggagcugugaugguaccacuucacuccagccggagugacagagcaagccccugucucucaaacaaauauaaaaauaaaacugaaaaaaagaaauuacuuaaaauauuuuucuuauguaaagaaguacaaaauuugaaacccacucuccuaaacaauaggaauucguacgaagagugaugggcauauauuaugccucccucuucuucacuccuguccaguguguccuagauaugggcgucacaauggcuaguauauaccuaaaugaaaugacaaaaagugaagcugaaccuugucuucuuauggagaauauauucagaagguagaauaaaaagauauuuuagggugauugaguuuaaacaaguagaaccuggucacuccaaccccacccccgaucagauucucaaaaauuagacuuagaaaucauaguccuggauguuagucacccuuucugcaagggaauugcuaucugaccuugcauauugcauguggacaaguucagagccaucagauccaccugagaaaggaggcaggaaaagagggcaagccuuaucaagcugcuguggggaugaauccaguccgguggaagaaacuaucccaccucugagcccugccagcacaagccaucugucugcaucuaacaacaccaugggccucagcucugaagccccucccuuggugacucagcaaucaaacuguucauuuugcacauguuuuguguuugauucauuuagucacugagucuucaguuucucugccugcuuuuugcccugcugauggggaccagccuccaggucagcacagcagguugagccuagagaggcaaucacagucccaggaugaacuuuuuuuuuugucccugaaaggggccuuuccaggagacuccccaggggcugcugauaugcucuuccaaggcuuuccugauugucuguccacccauacccaaggggaacugauguuucuauccucucccauaggccuuuucuaggcuuuuuacccacuuccagccugucuccuaggggccugauuggcccucuccacuucucccaaggcagccuuucuucacuugccucagccaccuaaucucugucccaccaguuuugggguuuuccuuacuccaugcguuuaccuuuccacacuugcacaugcacacagcaccgcaugaaaacuccuaggaaucucuccuucaacauggcuuaauaguccuucuuaccuaauuucccagugaccucugacucacaguuacacaaaggaaauggacguacaccuggagcccagcugacuugggcuaagguuggucauggcucuagguuugguuuaccuuauuggcuagaagacaguagaggcccaggcacugugugcuuuauggaucgucuuucuaauuuacuugaaccugggauccauggucacuucuaagagaucaagucuauuuuacucuaaguaguuucuuugaguaagguuggacauuuauuucccuugacauaagguaaacaagugugccuaugaguguggcaacaaugaggagacauugaauccucaagucacauuggcaugcuuguugaggcuuuuaaacgaucucaguaucacaguucuugguaauaacuguaaaaacauaaucacagguggcacuuggcaugaaagguaugcuugguucuuuuuuuuuuuuuuuuuugugacggaauuucgcucugucgcccaggcuggagagcaguggcaugaucuuggcucacugcaaccuccaccuucuggguucaagugauucuccugccucagccucccagguagcugggauuacaggugccugccacugcgccuggcuaauuuuuauauuuuuaguagagacagcauuuugccauguuugccaggcuggucucaaacuccugaccucaggugaucugcccgccuuggcaucccaaagugcugggauuacagguguaagccaccgcgcccggccgcucaguucuuacauaaugagggcauccauggauuuuuaaauggaggucuuuauguuuccaguuccgugucuucccaccuucagaaagcacuauuuugcugaauuugucuaaagggcaguagcuucuagaguaaccccaggagcaggucuucucaaaaugccuauuuaucagccuuugcaugaguuuugugggagcuggauagaauggaaaaagaaaugaggaauguucuucagauaugacauuguacagaucuauucuuccaaagaaauuugccuugagaauaguacuccagacauggaaggggcucuagguauuuaggcuauggcagaagguaacuuguaacaucuuuucagaauuuuugcaaccucugauucuuuauuugacauuuuucuuucuuaauaagaugcacagcuaguacagcagcauccuguaauccauggauuuggauguucugggcguaaucaucccucaaaaugcaauacaggugugguuagucuaagccaucuuccugcaaaaacuuucuauuccucauccccuccuuagacucccuguuuuuguaauauguugucaacugaaccacauuuaucauaaaauuuaucauuuucuuuguauuucuacugagaucuagauagucaucaacaugggacaucuuuccagcuugaagcaaaaauucuugguacuuagguaucuccuguagccuugguagaggcaugugugguuaggccuuucugaauauugaaaagagcucccuuaucccccaguuggauccauggaacuccuggucccaaccacugaauucagcacugccuuguuuuugccucaauaccacaaugauggagagaagcucuacuuuaggauucuuaucugacaaauuagacagcaggaccccuucuaccuucuaauauauuagauuuaauaaaauaggcauauacucucuacuccagagaaccaaaugccuuucagcuugggaaacuaaaauacagggguguuugauuugugugugguuuugcuuguuuguuuugagacugagucuagguuugucucccaggcuggaguaugguggaaugaucauagcucacuguagccuugaacucccaggcucaagcagucuucccaccucagccucccuagcagcugggacuacagauaugcaacaccacaccugguuuauuauuuuuuuuuuaauagagacaaggucuugcuuuguugccuaggcuggucuugaaccccugaccucaaaugaucuucccaccuuugucucccaaaaugcugagagugcagguguaagccgccaugcccagcagagugaguuguuuuuuaagaucacacugcaaguuuauguaagaaucacuugaauaacuuuuuguuccuguuggguuaagcuggugggcuagaugcuuggaaguuguagaccuuacucucaagaaguuucugugcaagagagcaaauaagcaauaaguaaaauuaaccacauucagcaguaaagaaugauuuuaagccaacaguuuaugaugcaagauuuaagagaauggaaaagaaguuauuucuuuuaaaaaaaucguuugagaugaaauucacguaauauaaaauuaacaauuuuaaagugaacaguucaguaggauuuaguauauccacaguguuuuacaaccacugcuucuaucuuguucccaaauauuuucaucacuccagaguaaaaccccuuacccauuaaguagucuguaccuaucccuuccuccccauugcccuuaguccccaguaaaccucugaucuguguucugccucuucagauuuaucuauuuuggaaucauacacucugugaccuuuuuugucuggcuucuuucacuuagcauaauguuuuggagguucagccauguauguguguauaauuacuccacuccuuuuuauagcugaauaauacuccaguauuuguauauaacaugauuuguuuaucuguacaugcacugauggauguuugggcuguuuauaccuuuuggcuauugugaacaguacugccaugaacaugugucacauauacuuguuuauguaccucguuuugguucuucugcauauauaccuaggaguggcauugcaggacgauaugauacuucuacauuaaacuuuuugaagauugccgaacuauuuucuagaauggcugaaccauuucaaguuccuaccagcaauauaugaggguuccagugacuccacaucacuuccaacacuugauauuuuccuuuuucuuaaaauagccacucuuauggguaugaagugguaccucauuguaaauuugauaugcauuuucuugaccaaugauguugagcaucuuuucauguuuuuuggccauuuuuauauuuuuuuuuagagaaaugucuacucagguuuuuugcucauuuuucaauuugguuauuugucuuuuugucauugaauuguaagcauucuuuauguauucuggauacuagauacauaugauuugcaaauauuuucacucucuagguugucuuuucacuuucuugauaauaaaugccuuuugaugcacaagguuuuuaauuugaugaagucuuagccuguuuauucuguuguaacaaacuacuugacacuagagaauuuauaaacaaaggaaauuuauuucuuacaguuauggaggcugggaaauccaagaccaagaugccaguagauuugcuguuggguguggggugcucgcucuguuucaagauuacaccuuguugcuguguccaagugguggaaaagcaaaaaugccaaacucugugugaagccucuuguauaaaggccuuagucccauucaagaggaaggagcccucaugacccagccuccuccugaaggccucaccuuuaaaacuauugcauuggagauuaaauuucaacaugaauuuugagaaacauauugagaacauagcaaaguccaguuuaucuguuuuuucuuuuguuguuaaugcauuugauaucacaucuaggaauuuauggccaaauccaagaucaugaagauuuaccacuuuacuuucuucuaagaguuuuauggcuuuaguuuuuauauuuaggcuguugauccacguugaauuaauuuuuguacaugguaugagguagggguccaauuucauuguuuuguauguggauauccaguugucucagcaucaucuguugaaaagauuauucuuuuccuguuaaauagcuuaggcaucuuguugaaaauaaguuggccauaggcauauggguuuauuucucaacucucaauucuauuucauuggucugcgugucuauccuuaugccaguaguacacugguuugauuacuauagguuuguaauuaaguuuugaaaucaggaaguauaagucuuccaacuuuuuucuccuuuuacaagacuauuuuggcgauugaggguccauugcaauuccauacaaaucuguggaucagcuuuugcauuucugcaaaaagaucacuagaauuuugauagagauugcauuggaucuguacauuaccuuggguaguacugacaucuuaacaauacugucucccaacccaugaacacaggguguccgucuauuuauucaagucuuuuaaaauuucuuuuaguaauguuuauuuuauaauuuucagcauauaagucuuucaccuuuuuggugaaauuguuuccuagauauuucauucuuuuuggauacuaguguaauuguauuauuuucuuaauuuccuuuuuagauuguucauugcugauguguagaaaaacagcugguugagaauuuuugcaucaauguucaucgcagauauuggccugaaauuuucuuuuuuuguugugucucugccagguuuugguaucaggaugaugcuggccuuauaaaaugaguuagggaggagucccuuuuuuucuauuguuuguaauaguuucagaagagaugguaccagcuccucuuuguaccucugguagaauucagcugugaauccgucugguccugggcuuuuuuugguuguuaggcuauuaauugcugcuucaauuucagaauuuguuauuggucuauucaggaauuugacuucuuccugguuuagucuuaggaggguguauguguccagaauuuauccauuucuucuagauuuucuaguuuauuugcauagagguauuuauagcauucucugaugguaguuuuuauuacuguggguucaguggugauauccccuuuaucauuuuuuauuguguccauuuaauucuucucucuuuucuuauuuauuagucuggcuaguggucuaucuauuuuuguuaaucuuuucaaaaaaacuagcuccuggacucauugauuuuuuuuuuuuuugaaggguuuuucaugucucuaucuccuucaguucuguucugaucuauacuggcaaaccaaauccagcagcacauaaaaagcuuauccaccauaaucaagucggcuucaucccugggaugcaaggcugguucaacauaugcaaaucaauaaacauaaucgaucauauaaacagaacaaaugacaaaaaccacaugauuaucucaauagaugcagaaaaggccuucgauaaaauucgacaccccuucaugcugaaaacucucaauaaacuagguauugauuuaacguauauugaaauaauaaaagcuauuuaugacagacccacagacauacugaaugggcaaaagcugaaagcauucccuuugaaaacuggcacaagauaaggaugcccucucucaccacuccuauuccacacaguauuggaaguucuggcuaggcagucaggcaagagaaagaaauaaaggcauucaaauaggaagagaggaagucaaauugucucuuuuugcagaugacaugauuguauauuuagaaaaccccauugucucagcccaaaaucuccuuaagcagauaagcaacuucagcaaaaucccaggauacaaaaucaaugugcaaaaaccacaagcauuccuauacaccaauaauagacaaacagagagccaaaucaugagugaacucccauucacaauugcuacaaagagaauaaaauaccuaggaauacagcuuacaagggaugugaaggaccucuucaaggagaacuacaaaccacuguucauagaaauaagagaggacacaaacagauggaaaaauaguccaugcucauggauaggaagaaucaauaucaugaaaauggccauacugcccaaaguaauuuauagauucaauguuaucccuaucaagcuaccauugacuuucuucacagaauuagaaaaaacuacuuuaaauuucauauggaaccaaaaaagagccuguauagccaagacaaucauaaggaaaaagaacaaagcuggaggcgucaugcuaccugacuucaaacuauacuacaaggcuacaguaaccacaacagcaugguacugguaccaaaacguagauauagaccaauggaacagaacgguggccucagaaauaacaccacacaacuacaaccaucugaucuuugacaaaccugacaaaaacaagcaaugagagaaaagauucccuacuuaauaaaugguguugggaagaccugcuagccauaugcagaaaacugaaacuggaccccuuccuuauacuuuauacaaaaauuaacucaggauggauuaaagacuuaaacauaagaccuagaaccauaaaaagucuagaagaaaaccuaagcaauaccauucaggacauagacaugggcaaagacuucaugacuaaaacaccaaaagcaauggcaacaaaagccaaaauugacaaaugggaucuaauuaacuaaagagcuuccgcacagcaaaagaaacuaucauuagagugaacaggcaaccuacagaaugggagaaaauuuuugcaaucuauccaucugacaaagagcuacuauccagaaucuacaaagaacuuaaacaaauuuacaagaaagaaacaaccccgucaaaaagugggcgaaggaucugaacagacacuucucaaaagaagacauuuaugcggccaagaaacaugaaaaaaacucaucaucacuggucauuagagaaaugcaaaucaaaacugcaaugagauacgauuucaugccauuuagaauggcaaucauuaaaaagucaggaaacaacagaugcuggagaggauguggagaaauaggaaugcuuuuacacuguuggugggaguguaacuuaguucaaccauuguggaagacaguguggugauuccucaaggaucuagaaccagaaauagcauuugacccagcaaucuuauuaccggauauauaccuaaaggauuauaaauccuucuacuauaaagacacaugcacacauauguuuauugcagcacuguucacaauagcaaagacuuggaaccaacccaaaugcccaucaaugcuagacuggauaaagaaaauguggcauauauauaccacagaauacuaugcagccauaaaaagggaugaguucauguccucuacggagacauggaugaagcuggaaaccaucauucucagcaaacuaacacaagaacagaaaaccaaacaccgcauguucucacuccuaagugggagaugaacaaugagaacacauggacacagggaggggaacaucacacaccagggccuguugggggguggagggcuaggggagggauagcauuagcagaaauaccuuauguagaugauggguugaugggugcagcaaacuaccauggcauguguauacuuauguaacaaaccugcagguucugcaaauguaucccagaauuuaaaguguaauaauaauaaaaaaagaaauacagcugauuuuuguguguugaucuugcaauuuugcugaauuaauuuuauuagcuuuggauuuucuguacauagaauaaugucugcaaauagagaggccauuucuuucuuuuucuugucuaauugcccuggguagaacuuccagugcaauguugaauagcuauagauaaaagcaggcaucuucaucuuguucaugaucuuaggaagaaaagcuuugucuuuuuccacugaguacaauguuagcugcagguuuuucauaaauauucuuuaucauguugaggcaauucccuucuauuucuaguuuugugaguauuuccagcaugaauggguguugaauuuugucaaaggcuuucuugcaucauuugagaugguccugugguaaguaaaaucuuaaagaguaggacugauaacagauacagagaaaugcgauucuggagaaguaaguaacuaacuuacagugguaggugcaugacuaguaucugcagagauuagugcacaaucuaaaucacuguguagaguauugggggcagaggacugaaugcaguacaggcaagggcagauucugaguagaucagggaggacuugauugacagauugccuucaucuugucuccauucuggagauccuuaugguuucugagcccagucaaacuaggaauuguacgccuugcucauuguucucuccuucugugucuucacuucucuuccuucuauugacuuucaugucccucuaacaaucuuuccuuuuuaauuuugguagaaaagugucauguaaaacaaagaaaaaauggaguuuuuugguacugugugauaaaucuuaugauuuuuuagaauuuaggaguacacauaaaauugagaggugagccaacuuuuuuguugguuuauuucuaguuauguauggagauagaccugcuaaccagccaacagcuagugucagggcuguaaauuagacuggaggaaagaaugaacugcacauuucuagcuccugggccaagguuccugagauuuuugccagcccucuucuagacagcagcuugguaccucagcuguccuucucaucagggagacagauggaaccucugagguuuccuguugaggcgucucagaauucaaaguuguuaugaugugugggcuuugaaaaugccacacgucagggaagcugaguuuuuguuucucaggcuuucuuauauugagcauguguuccuuucugucuuuguggcauuaaguuucauuauguguguccccaagccuuuuccuggaaucucaacagaggauggguuuuagcucuguuggaaguuacauuccauuaagugugcucaaagaucugcuuuacuacacacucucuccugcccaauucuuaggccagccccuuuuccucucccuacucuugucuaauuaguccucuccuucaaaaggcagcccuuucaugggauucugcuccccgaaguagugggcccugacuuaagggccagcccaucuuuguccauggccauacuuaucagggaugugacuauuuagcucuuuaaccaggagucuguccuuucuagagaccuuccagcauacuauuaaccuaagugcauaggcagaggagaccaggagcacuugguacaaauguuaauggcuuuuucauuagcguacuucaucacagaauuccagcuguugguggcaggaggugacagugaggcgucucuuggauaagaaggacguggagaucuacggagaugaaaacugaaaagaugcauaugauuagucaucagaaagauguuugacuucuaaguuuuuuccaacagcagguauggcugcauggaaaaugcauacauccauuguugcaaggccuuuauuuccuuaucaccaucaucaagcaguauuaaugaagaagccaauugugcaugacauagugcaggucucuguauguaguuauggaaaacgcuuccacaguuaaauugaguauggauauguaaagugauuaaccaagacuugacagcucacacaauucuuuaauugcagcaagcaucucaaguaaauacauaacuuuuaagaaaauccagaacuauaaagucuuaauuuuugaaacaaaucaugaucuuucacguuacaaacagaucuuucuuucuaaaaagaugauucacaaucuuuuaugcuggaacaucaaacauagauuuuacuuuacuucuuuuuaaaauaauugguuuguuaacaguuaggaaagccauacguguuauuuguuaaaaaaauaaaaauaaaauggaacaauaaagaaaauguauccaaacuauaaaaagcaaaagucaccaacuugucccagcugcacccccuccaccccacccauguuucuguucccacaggacaaccauugcuagcauuucucucuguaguucaucucuuuugaaaguacauauguaaguguguguuaaaugauuauuucagaauuuauauugauaaaugccuauguuuucuauuauuucaauuugcccacauggagggugauuguuuuuuaguguguucccuuagcuucuggaauacaaaagcugaugccuguauaccuugacuuugcugacggcagugguagugaguuuagugcuuucuacuuuuagcuuuauguuuugcacuauuuuugaauuauaucaauuagcuaugauguauacacauucaggauucuuuaauuuuggguaaaaauaauucuucacucugugccuacuuagcuaagaauaucuuuaacagaggcagagcugugaaaccaccgagcaccaacacugccucucuggcuuuugcagggacgcuuggguuucaggcuguaacucuuaguugcauuagccucugauaacuuuuuuguuaauugauaaguauguguaugacucaucaagaugcugguugcucaguaagauaaaauuauauucucuaacacuacuucuccuuuagaagcuuacuuaccugccuuggugucuucugucucggucuuacuuuguuuuuuaguuuguaguuuguucuucagcuuacuaaaccucuuucauugacugugguauuggcuaccgauuuaaaaauccuugaagacuuaaaacucagcagacacguacaggguggaccccugcuuuuucucaagucucccuucaucuccaggaacugaauuuuucaugcaguaauuaaaauuuguaggucaagccucccauggcaccguuugcugcuaauaugggaaagcagugaucagauucgcuuaugcugcucuucacugagcugagacuuaaaggaugaagggugacauuuucccccauuuuguaaauuaaugccauugaucugccuaacaagaacaaaguuaggcuucaaaauaccaaaugauaaagagauuaagacuuuaaauggcuuuccaaaaggcaaccucuauuguaaggcuccgagcugacuauugaacuuucaauuagaauuucuaauaggcuauugacuuaaauggacaaaauguuacaagugauagcuuucaagaugacaaagauugcuucuuacguucuggaauauuacuuuauguagcgugcacuguucuggagggugaauaauaauaaacugcccucccccuguagagugucuucugcaucugugcuauaguuuucucaaaggugaauaaaugcauuuuuuaaaggcauuuuugaaauacuugcuuuuucauguguuugcugaacacagguuuuaugaaaccuuucauggcagggaagucccauuagucuuuagcacuguggcacuauucuucuuuuaugaaaaauagcccaugugguauguauuucucugcacacauguguguucaugcauguuaacauguguguucacaguugggacaccagcagaucuguugucuaucauugccaugaggaucagucccugaggccuugcucucugccucaguuuacuguuguuggaagcuaugauucuuuuccacaaugggcuugcaguguagugugacucaauuuaggccuuguugugaaacacuagcucuaauacauuuuuaaauacuaauuuuacaaagaccagcuaccucuucuaggauaaaggguuaauauuaugcuuauguuacagugcauuaaaaacucuaauuaaaacagcauuacauucccaucugccaaucuccaguaaucuucuuuaauugcaguaauuaaacuauauuuacauguucagaauacuuguaauuuagcaaauugcacucucugcucuacauuuaaucaaacaaccaguuccaguauauuuaguguggaaagaaguaauuucaauguuuugauuacuauagcagauuugacagaguaagugccccucuaguagagggcuugaaagggaaggcaaacaugaaauauagucaugguuuugauugucaugugaaugccuaauuacauguuggaggauuaacuauuaaaggguaucaugguugcaguugauguuuagaaacagccgguauuacagauagcauagacugucuuuuaggaaaauuucacaagaaguuuucucuuuaaagguugugagaucauaggaaaauuuagugaaaagaucgccuacauuguauaauuguuauuaugucuucuaccugugaucccaaagccugcuauacaagaugguuauuuuagucuucccaguuaaagcccagaagaaauucaaugauaaacaaccaagagaaauugcaaugauuauaucaauucagggaugaguauucccucauuucgguaucuuuuggcaagucugguugacucuggagaggacaugugguuuccuggaaaggacucaucaguagaagucaggcuuuuuuuauuuuaccuuuugcugcuguuguuguuuuaaaccaugacucucuacuaggcuguuccaccuaacccaucuccagccucaucucuuauuuauuuauuuauuuauuuauuuauuuauuuauuuauuuauuuugagacagagucucacucuguugcccaggcuggagugcaguggcgugaucucggcucacugcaagcuccgccucccggguucacgccauucuccugccucagccucccaaguagcuaggacuacaggcgcccgccagcacgcccagcuaauuuuuuuuguauuuuuaguagagacagguuucaccauguuggccaggaugguuucgaucuccugaccucgugauccgcccgccucagccucccaaagugcugggauuacaggggugagccaccgcgcccggccuggccucaucucuuuuuuucuugguuuucucauuuuaaaaacaaguaacaguguugugaauauugauuagauucaaaggaacaaugucuuagucaucucaaagcuauuuuuaaaauucuuauuguuauuaucucuuugcaccaguaugaaaguuucuguuucuuuaucuagauaaauuugacugggauauuggguauugccaucaaaucucuguuauccaaaacaacgugcuaauuuauucaacacagaaauauaaguaauacucucuuuuucaguagcuucuuuuuaauuauuugauguuaacaguauuucugagaauuuuucucucucuccacuucggggucaucuauuguauuaauaaggauuaugaauuaaugaaaacaaaaagcuagucuagcguaccuguuuaaaccaaugugaaaccuugcuucuugaccauaugaaagagcaaagcuacugaauuguuaaaaugauaugcaggagugaggauccaagauuuucuucaugggucagcuaguaacuuacugugauacugagagcaacauguuugacugauuuaagucucagauuguucaaggugggguagagaauagggccuggauuuuuuugguucaugaagagucuugacauaaaguaaguauuagacuuuagacugucacaggaauaaccauucaguucaaaucuacacucauuucuguguuagauuagugagaauuuaacuucugaaaaaaguucaggcaaaauaccgcugauguacugcacuaaggagauuugagagugccagagauacuuugaaaggaaaagagauguaauuugaaguggaggacagggcuagccaggguuaaaauugcagcucuuuuacuuagcuauuuaauaccaagcaaauuaccuuauccucugaggucuugucuguaaaaauggggauaauaauacauacauaguacuacacuauuaguuuuucucuccuaugacuugccaucuguguccauguauggagagaaacacacacacacacacacacacacacacacaccccguaauaaguuaagagucuuuggaaugguaaaugauuugaacauaaauaccaguacacauuuuuuuuaauaaugcagcauaaaugucaagauauauaugcauaagggaugaggugugccuagaagcuguaauaucuagaauuuucgcaaaccuuauuuauaaccauuuguuucugaacccuaacaauucuuuucugaaacuguuaacugaaagaucugaaucucacuauuuauuucacacucuucacauagaggugcuaaugagcagcagaauaaccccaaaaaugguccuuaauccaaacaccgagaagucaaguuauaaguaauuaagaauacacuggauggaacauaccuacauggcagcuagcaucugugcuuuccagagguugcuggggacgguuaguucaguucucauuuuugauccucuuuggaaacucaggaguuaaggucagcauccucaguacaaagguacuugaacauguaugaaucuuugccuucuugaaaacuuuuuaucuugggaauaaggaaccugauacaaagagaaucucuaguauuucauuccaucgagagaaguuuugacauuuacaauucugcuaauuucacacaucauuucgcagcaugcaggauuuuggcgccugccaaggggacugcaaauucuuuuuggaaaaaguacuuuuuuggguguuggaagaguuuugaguuacagacacauuucuuuaauaguguucuugaaauguccauguggucuuaauauguaaaucauaugaaacucaaaacccacuccugaacuuacucuuccaagaaagcuuuaaaacagcccucauucuaauaguaaggcuguuuuccucuuuuccaauguuuauguauacuguauaauguuuacuguauaaugaguuuauuguauaauaagggacucugauuuauuagcucuucauuauucucauucugucagcuucccaauaaaugcuacaacccuuggcagagacaugagucucaaucaggugauaucauugcuuuuuaaugaacucuucuuaccggaguaacagcauuacaugugaaauaccuuauccugcauuauuaacggaccgcagcauaaaaggcacaaaggcacugagaagguugcacugaaaaauggggcagaauucauuaccaauucgauauacugucagcuaacagucuuugauuaucauauuuacccuucugaaacugugaaaaaucaugggcggagccgcugugaacaauagcauguguaggcauuuuguaaauguugccuuaguuguuuaaugcccaggcugacugcuggaauuuaacacagugacaacuuucucagauggggcaugaaaaaaacugugauauuuuacuaccugagaaguuaagcacugagauaguuaggacccagcucucauuagcugaaugguagauuuuucuaauuaguucuuucuagugcaauuagcacgaaaagagucuaaucaccucaugugaaaccaaucuaaugcucagaaaagaauucccuuggccucucuuucagauuggaucuuaggauuuucagucugccuccuuaaagaauggaaucuguuagugacugauuauuugaacgguaaggacagaucuguagaaaaggcaagaaauggacaacuuauugacuugcagugcaaguuuggcuggagaagguguuuagaaauauucauuaauuggcaguuaucacuucaacuauagguucugguuuucuugauuucuuucauuuugaaaugggagacuugggcccgggacagcuauaguucagcauggcugccucucuggagggcaugaaacauacugcacauuagaaucaaaugcauucggggccugggacuacugggcuugcuuucuuagccucugcagugcccagauucccccaucaguuuuugcuaaucuguguguucagggcuuugccuguccucucucucucccugccuugcagucaucuguaggcaccacauucauuuuugaacuguucucuaauuucuagugcccauccaucacuucacauuucuuaaguaagccaacucugggcaucucaguugauauuguucauuuuuaacuggaaaggaaacuauaaugacagcauuucuggcacauaauuuuuucuuuuuuuuuuuuugcgggggggaagucgcuugccagaagaucgaugagaaaaugcugaguauguguguauuuauuaucaacuaugcagaaaaugggcauccuugcucaucaggcuacagagggugacaauauugaauuuccauuguucaucccaucacugcccaguagaacuucccaugauguuggaaguguucuguaccugcacuguccaauacaggaggcacuagcgacauguggcuguugagcacuugaaauguggcuagugagacuaaggagcuaaauuuuaaaauuucauuuaauuuuaaugaguuuaaauuuaaauagacccauguggcuaauggcuaccauacugaacagggcagauguagaucucuuccaccuccuaaccacuguaccccaccuuacacauagcugcauccuuaacagagaauacacugcccuccgcagccucuugcuauccauucucuucagcuuugccuuaaaagcaaucagacuuuuuccagugcugucuggaguuugacacaaggcauucccuuggcuugugcuaucuguagaucauucuguauuucaccguggcaguguuuuguucuaaaguuggaaaagaccuuguaguuuuuuaaagagccaaaauacaggauuguuucuaagaaaggagguggccagaaucaguaaauuuaagcucauuuguggaagcuuccaaaucucaaaccuagggcaguauugaacaccucuccaaaaagucagauuaaguauuugcaaauggcuucaacaaacucccucucuaugaaauuuuaauuauaguugauuaaauauucacuuuaaucaucuuaauuaaugauauuugacaaauauuuuagcuuugcuuaugauauucacuugcucugucagaacucuccaguucacacugaaaggguaaaguuaacaaccuggacagacaggcccaucauguguguuaugaccuaucugguuuccuacucgcaugguuagaaggcucauuuuauugcuuugaacucuggaauuaauccugcuuaaaggagaauaguaagaauacugugguuuucugcucaacagaaugcauguucauuuauuccacagacacuaauugaaggcccauugugugcuaguaauugugguagucacugagaacgcauggauggaaagacacuaucuaucccacuggauuguaaccucaagccacuggaacauaaacaguuaaaaguacuauaugauaaaucuucuggaagacgggugauggaauguaagggaagaaacacuaaguggugguuucaaaacagaaagacuuuuaagauguaacauguaagggaaauuuuauggauauaagggaauacaagggagagucuuaaggggauuacaggauuuugcccgggauaaagagaagguggggcauuugugaaggggauuauguuuuccuaauuaacuguauucuugaaugucuuugaagaaaggagucucuccuuucuucauuuuguaaagcaacaguguguguuagaggaauugcuguuaggaaaggaaugaggauauuugguguguaacugugagugcugggaaaugaaacaaaaggcagcccuaccucagguccuggaaaggcacauaguggugugaguguugcagcccauugaagcuacauccucaauucuggaaacuaacaagaacagcauuagggugaggccagagauccaccuaaggugcaaaauguaagggggcacucacuuugagggucgugcagguucaggaucaguacugacacaacccugagaaugagugucuccuaaaauugugugcccuagacaccuuacuuacgcccugaaacaucccagcccuggguuuuugugcagugaaugggcuugaaaagcaaguagauaagaaucugaaccauggaaauauggcagacauggcagaauagaaaucaaugagaccuauuugcaagguaaagucaagagaaccuagggcagaaaaaaauacgaggcaugagagaggggacccuaauuguccugucacugaauucuggggaucuuuucuauugccugauacugacuuuucuccaauuucucauauuccucagcuccugcccuguccugaaggucaugcccaguucaaauucagcccuuaccucuuugcuaagucccaugcccucaaccuuguuuucagagaaggccaugagaacuggaguuuuuaaaauguccaacucuagauagaucugcuuuacugaguggucuuaacacauucagagaacugcauucuucuuggcucucuaaauucagugaccuuauuuuaaaagaugaucaacauggguuagaaccuuuugaggauuaggagacauuuuagcaaguuuaucaagaauaagcaaagaugacauuuggcuagcaguaugucucccccaccccauccugcaaaaccauuuuuuuuggagugaagcuuuuccauuugacaaguuuagaauuaccaauacugcuugcaacuccuuccuuacuccaaacucugggauguuuucaggagggacucuuuucuucaaaggcauccaagaauauaguuaauuaggaaaacaugcaagaaaagacaucuuggcuccucuggccgccuguuguacucuuccagcauaugcuauuacuugucucagauaaguagacagguggcuguuugcaaagcaggguccaaugugccuuugacucagagaaguuuggaaacaaagcccucuguauaauaagcuucucacuguaugcugacgucuucugaucuugccuauuccccauuaccuacagucugaaagaauuuuguagggagugugugguauucugcagaaggcuauuguagcauaacuuagacuuagccggcauuuauugggcuuagaaucacaaaaucucaagauugggugacuacuggaugguuaucuaauccaacuucccuccagaaagucucccauacaguuuuucccgcaaaguggcccucgagccauaacuuccuaugacagagugcuuacugccucuuuguucaacgcuggugaaaccucagugauacuuauaaguuaacuuucauuccuucagcauucuucucuuuaguguuaauuucuuugauggugguaccacuuuccaacuuuuauauguggccucuuaaaaucagcuuacccagagaaacuuccugccuagcuccugauuuauguagcuucucaccaccaugcccuuucucccuucuuauaggggcaguuucacaauuuugaagcuccuugauucccuugagccauuguccuuuccaaaacuugucacuaugaaaaguagacuauguuuuagccuuugaacuauaaaaucugccuuucaguaagcuuagcuccauauuuugaggucucuagauccccccuuaguaugcaucaugagacuuguauuacucgccaagacucucaugacuuucuucaagcauucaguuuugucuaagaagccaucguuugauccagaauggaguagaccuaauuauaucuccuguuuuuuuggacuugaaauuuacuucaagccugaugauaaccuguuggucagaugcucugccauuaacuaaaugacaccaucagcaaauauccagauaguugaggucccaguguccugaaucugugguuuuauaaucuaugucagaagucuaucauuuuuuuuuucaccuggcugucaucugguauauucucaaaaggauaucacuuuucuucuuauccagguacgugccagugugcuucaucucucaugcucauggaucuccaugcaaauugaucugcuuuuccaaaaacuauuuauuaagcauuauuaugugucugguacuaugucaggugguagagcuacaguggugagcaauggaaaucuacguguuuuuugacauaugacacugcuuuuccacaauaccuuucccaccuuaaauccuaucccaugagccugggugauacucaggagauuauuuuuaucaugucucuaaaaaucucugcuuauuuuauaacugaugauacauagacaucuaaagagaugagggccucacacagggauuggccaugagagaagcuuucagugcugcgaucugaggccagucugaucugacacccucuuaaaggcuuucaaguauaggccacuggguuccacaucccauaccucuuaccuccauuguggcuaguuucucauuugcggaggagguuagagauguuacucucuuccccuccaccuucaguguaaauuucucuuaaucaggucagcucaccuccccaggcaagcaaacacaugucucucugucuuccugagcuacccccgggaaagucugcauuauuuuaguaccauagacacagucuagaaaucugauuccuauggguugacaacauccucaugacaaacccuucaccuaccacaucaucuuauuuuuauaaucaccgaacuuuguuaggaugaagaacuagagcacucaccaggcacccaacucugcgccaggcuccaugguccccaaaugaagcuuccuaggucucuuguguccaagccauuccccucacgugaaacaacaugaauagguagagauaaguggcuuugugacuuggaacagacaguagcccaagaagaccacaugccucccuucuggccacgugaacuacaugaagcagucuccuuucuguucagccaagaguccgugccaucucagugcuuguuuuccuuccugucccuuuaucuggcucugugcaugacuguuugagcagccugugucuucuccuuccagccacacagaguacugguaacuucucacaggauauugcggugugccuccguuuacacugucucuucuuccuggaugcuuuccucuauccccugcaaucacuucuuacuuaccugaaacuuacuucuuguauuacugcuuaaugacagcuuaacuuccaugauaccuccccaccuccuucugcucaauucuagguuugaguaugugccuucacuaaguccucccauaauaccuaagcaggucucuaucacaguccauacauuguuuccugugugugucuguuucuuccauuagacuauaauuuccuugaggacugcucuugugccucacucaucuuugugaguacagugccaagcauacaguagaugcuauuuaaugaaggugggcauguaugggugaauauucccaguguuucaggauguuuuuucuuucuccucuggcuuuucuauucucugcucaccuggaaugagagcggauaaaauaauacagacaggaaaccaggaagcagaagagaaccccagccaccuaccuacacuucccccucuuagaugcccugcaacagagaucuguccuggggacuccaccucaucuuugccagcggugugcagcuggcuuccuaaaauccacccagaguagggguuagcuugucagaaaaauacaaauuggaugucuucugcagggcuuugcacaguccccucagcacccacacuucugugucagggaggggaugcagggacacaucuccuucuacccucugggagacuuguagucuacggcuccaggagaugacucccuggccuagaggacuguauccuuaaaccacucucugcucugcuggcuuaugucauccuccugcuccuuuggguagaaguucuagagucuuauccacaaauugucaccaguuauaggcuugaguaggcacuaaauaugaaacaugaauaaugacaugagccagcagagcagagagugguuuaagagugguuuaagggucagagggaagggaaaugaaagccuuggaggauuucagauucacucacucuucuuuaccuuauagccugugcugcaaagucagaguaaagaaacuucuguucugccucauugcauccccaccacaacaggcuguaagcaggagcuacuccauguuuuaauauaaggaaacugaggccccaaaaauuaaaaauaacuuuauaguaccagcuagccauuggcaaaacacgauuauacauucagauuuguccaauuguuuccccauguaaaugagaccacagauuaaaauuauuauugucaauuaagaaaaaauaaaagaaaccccugaaaagaggaucugauaugugucuaacuaccuuuaaaucuccuugagauaaauuauaagguguuguuucuauugagccacccccaucaccaguuucucacaauucagugcucagcaggcaguggcuacucaagaauuccagcuggcugggcacgguggcucacgccuguaaucccagcacuuugggaggccgaggcggguggaucacaaggucaggagaucgagaccauccuggcuaacacggugaaaccccgucucuacuaaaaaauacaaaaaaaaaaauuagccaggcgagguggcgggcgccuguagucccagcugcuagggaggcugaggcaggagaauggcgugaaccccgggaggcguugcuugcagugagccgagaucaugccacugcacuccagccugggcgacagagcgagacuccgucucaaaaaaacaaaaaacaaaaaaagaauuccagcuaaguggcagugaacuaaugagauuucaucacagagcauggugaacgcuuuucuaaggucuaaauaugugcucuauaguugucauggagggccaaagaaaugaagaaaauaaagaacaauauuagucuuaagaacuuuuuuaaauaacaaaaaugacugaguuacuaaggucaggaacuauucuaaugcuuuuauacucaucucaucuaauugcuccaaaccccauaugaaguagacacuacuacuacuaucaugacccauuuuacaaaugaacaaacugagucuugaagaagcuaaguaacuugccaaagcacaucccagacuuacaggcagucuggcucagagaccucugcucacagacacuccucuuccugggucuaauucaagaggggugacgugcgacuuagagcagccugugggcuuagugauucugcugcuuggugcacagcaagacagaccauaaucagcacuagaauaauagaauuuuuauaagugauuaaaguaaaaccaggauuuagagauugagaguugauuguuaaaggauaaaugauauuuggaacaucuuacuggauuugauuaaagugaaauucaaaaaccaucacaaagagaaugauuauuuaccagugguacuugaaggacuuuuuuuguggcuuaagucauuggcacuccaaugcuuaaaaucucugugcucaaaaccagaauguaauugauccuuagaaaaucagagguuagcgccuucuuuggcaagcuacuucugagcuuuguuacacuguaacauaaucauccuuugaagacugagaucugguuuuccaggcuuuuuuuuuuuucuucacauggugccugguaucuucucuugaacauaauagauacuuugagauggguggacaaaccgaagucauuuuauauugcuuuaggggcucugaauuuaagaaagaguugauuucugaaagaaacauaauagcaaagauuacuuaaacacaaaaaucucauuucuguucuuaaucagcuggacgucaauacccagguuccaguccaagugucacacugugccucuauaaguuaaucuuuucuggaagggaaaccaaauaugaaauaguaucaagaacugggacaguguuggaacacccugcauguccucuguuggccacuacaaaagguuaaacaacaggagaggcuggauuaggguuuguguuuggaagugcauuugaggcaagcuugacaguuaagcucauggccaguacuacaugccacagcaagaggacaauaggagauuuaaaagugugagcaggcuguggccaaaugcuggaauucaugggcuaaguagaugaagaguggauggaguuaacuaguaaacaaguuucaugguccuugaagagaccuauuuuuuuuuaugguaugaauuuaagauguacaacauaauguuuugauauacauacaauuagugaaauagcgauaauuugauauuucauauauauaccaaaaugauuacucuggguguauuauuuccuucucaugcugcuaauaaacaaauaccugagacuggguaauuuauaaagaaaaagagguuuaauggacucaguugcacauggcuggggaggccucacaaucauggcacaaggugcgaaggaggugcaaaaguacgucuuacaugguggcaggcaagggaccaugugcagaguuuauaaaaccaucagcucuccugagacuuauucacuaucacgagagcagcacaggaaaaacccacccucaugauucaguuaccucccaccuggucccucccaugacacaugggagcuacaauucaagaugagauuuggguggggacacagccaaaccauaucaacagggaagcaauuuaacauaucugucaccuuccauauuuacccuuuuuauguggcaagaccaccuaaaauuuacucuccuggcaaauuuucagucuacaauauuauuaacuagaguccuccugcccuacauuagaucucuagacuuaacugcaaguuucugcucuuugaccuauaucugcccauuuccuccuccucccuaccccugguaaccgccauuguguuuuuuguuucuaugucuuugacuguuguuuuuuagaugccauauaugagugagaucaugcaguacuuuuuuuuucugugucuggcuuauuucacuuaucaucguguucuccauguuguugcaaaugacaggauuuugucuucuucuuuuuuuuuuuuuuuuuagauggagucucgcucugucacccaggcuggagugcaauggcacaaucucggcucacugcaaccuccgccuuccaggcucaagcgauucuccuuccucagccucccgaauagcugggauuacaggcgugcgccaauacgccuggcuaauuuuuguauuuuuuuuaguagagaugggguuucaccauguaggccaggcuggucucgaacuccugaccucuggcgauccacccgccucagccucccaaagugucuggauuauaggcgugaggcaccgcgcccagccgauuuccuucuuuuuuaaggagauguauauguguacacacacacuacagcacauuaucacauuuucuuuaucuauucauccauugauggacacuugguugauuuccuaucuugguuauugugaauagugcugcagugaacaugggggugcagguaucucuucaagauguuaauuucauuuucuuuggagggauugcuguguuguaugguauucuauuuuuaaauuuugguggggucuucauacugguuuucacaauagcuauaccaacuuacauuccuccuaacaguauacaaguaccuuuuucuccacaaccuuaccacauaaguguugacuuuuucuuuuucuuuuuucuuuuuuuucuuuuuugauacgaagucuugcucuguugcccaggcuggcgugcaguggugugaucucggcuuacugcaaacuccgccucccagguucaggugauucuugugccucagccucccacguagcugggauuacaggugccugcuagcacacccaacuaauuuuuguauuuuuaguagagacagugguuucaccauguuagccaggcuggucucgaacuccugaccucaggugauccaccuguuucggccucccaaaaugcugggauuacaggcaugagcuaccaggcccagccuugaccauuauuuuuaauagcuaacaauuauugagggcuuaccauuucuaugagucuaagcacuuuacaaauauuuaaucuucauaacaaucucugacauagauacuacuguuaaucccaucacacauacuaaaaaacugaggcacaaggaguuuaaggaacucgcucaaaaugucacaauuaguaagucaugaagccagccagaacgcaugcucuuaaccccugcacuguucugccaacucuuuggagugguuuguuucaguugucaguuuuuguuugcugucucugaaaauccuugcucuuacagugucagccagaguccugcauugaucacauggccuaacuugccucucucaguacagugacuuuuuaaucuucggcugcaauccuuuuuuuccuagacuguaaacucccugaggguagaaagucugucucauucauuugugcccauuuuaaugaauguugaaagggagcgucaggagggguuaucuagaugccuguggaucuagauuauucaucauccacugggaucuuuauugguguuccuuguccccaaggagggagucagcagcaacagaaggcagcagagaucucaucaguguucaucaaacacauguugagugccuacuacgagguaaacagaacagacguuaucuucugugcccucucagaacuuaagguacagcaaagaaacaaaugagauaagcacaggugugauaaaugcuuguuuaaaaaacauuuuaaaugaaaugcuucguuuaaaaaaagcgaagaggcugagguagagaauaauggagguugggugggguaggaccuacuuuagguagguaggcaugggaaauuccucaucgaagaagugacauucuaagcgaagauuuaaccaacaagaaugacauagcuaagaaugagaagacugcuggggaagcuccuuguuggcaaagaaaacagcaucugcagaggcucugagguuggaaaggcuuuguuucaucuguuuaauaguggaauucagugacacucauuaguuaccucuucacacauucccgccaaacacuugucccugagucuguucuuuuucauuagugguuccuaauccaguuuucaaaacugcucaauauuuggagagguuuugaccaguugcucuggaaacagaggcgguuccaccauagccaacagaguucagaacauaaauuguccauuuauauccccauuuguaucuuaagcuuagcuugcauaggacucagcaaagcaauaugucaaauuccuuauauuuguuauaucucuuuuuucacugacucaaagcaugaaaaauuugaaauuaauaaaacaauuuuuuagaugaucagagauucuuuuuucuaaaauuuucuaaauacuaugguugugucccuuaaccacaggcauggugguuucacugcauuuuacucaagagaagauugcuuacaaauaucacacaggagaccuuucuagucuccugcaggaggguggcugacccagggaaccuccaggcaagcaggacauaugccaaguauccuacauguggacagugucuaacuugauccgaucuuucuccuuccccauguuuuaguuaaguccccugaaagcccccauuacccacuguucauaaagggucuguaaauuauuuaagagaaggaaacacagccuuuaucccaucggauuuuuccucucaaucacuugagucuuuucucugagcacacacacauggcccagacucacugucaggggagauguaaugccagcaucugguguuaauaucuauuguugacauuuugggaaugagaacaugagcuguuagggaagauguuugcuuguaccuaauuaaugucccauuguauccucucuuguugucagcucugccucaccauccugccuuggcauuuucuuuuacuggcuaacuuuaaaaguuaauuauuucucuguugaauguuaaaugccaccgguuuuuaaugccguuccuuggugugaguuauuaguuaucaaaaaucaaaaugaucugugcaauuaucagcucuuuaccuaaagccacuguucuugcuaaucgcguaaagugugauagcauuugcugaugucuggcaacauggaucuuucuagcagauuuaaguuucucacucaguacauuccugucccugucuggcuuuccuuguggagaucagauacaaaguccugguacaucaucuaauggaaacaauuacugacagggccaagucuucaaggcccauuuugcuugaaucucaaaucacuguuaaaauucauuuggcaacuccaauaaguacagagaguaaugaggaacuucaaauagaauauuuccuaauagcuuucguaaaacaugucuugguaggagaucacaacucuuucuuuacuugagauugguuuauaaaaauaauaguacaaguuccaacuaacagcuacuaagugcauacucugugccaggcuuugucauuagcuuuucgcauggauuaucuuaauccucucaacaauccugugagguaaagucuuauuauuauucccaacuuaaagaugagcaauuugaagacuaaagacuugaguaauuaaugcagcaucacauggcugguaagucaugggccaggauccccagccagcagucacugcagagcugcacugucccaggcagugacugugacucacacguggcuacugagcacuugaaauggggugaguccaaaugagaugggccauaaguguaaaaccuacgcccuguuccuaagcuuuagucaauaaaauagcguaaaaugucucguuaagaauguguucauaccaauuacauguugaagugauaauauuuuggaugcauugaguuacaggaaauauguuauuaaaauuaacuuuuuguuucuuuuucacuucuuuaauguggcuacuagaaaauuuuaaauuuccuguacugcuugccuuauauuucuauuagaaagggcugcuguguguguguguguguguauguauggguguguguguguauggguguguguguauguauguguguguguauggguguguguguauguauguguguguguguauguauggguguguguguauauaugugugcguguguguguauguauggguguguguguguguguguguauauauacggagagagauuucuggaguuuuucuugucuuaacgaguuuccgauccuaaacuauugaggaauaggcacaaauuucugacccuuccuccccuuucugguuguuucacuuccagaaauccgacagaaaguacaaauuuuuacaucugagucucuaccaagagcccaucuguuggcucuucucaaguauggaaagaugaaacacugacaugccaggcauuaacgagaucaaaagcagggcuaaugacagaaauguggcugcuguuaaagugucuccagaggauuaucggggaggacuuuuuguucuccuuacggcgacccccucaaaugucuuccagagagugccucucaguuccaguuccugaaguccuccuuugccuuccuuuccaauccuuguccaccacuuuccugguccaccucccucucucuccuggacgcccaucucuggggugucugugcagcugaggcggccccucuguuaagcacuucugacacgaggcaggucuuuuuucccugccagugagagcagaguguauaaugguguugcccuccaccggggaucuuugagaagcuuuauggcucuagcagacaugggggaaccaaucacaggcacugcagcugauauaugacacuaauauaggguucacuuuuauucucaaccuaaaaaaagauagauuguuccaaguuuagacaggcuguaaaaucaugugcuucuggaaccaugcugccuuaccccugggaccacuguaauugcuuuacaucuguacaaagguuccuuguaaucgggcuuucugccuucauuugucuucuuuucagccucuuaguaaagaccuuaauuggucuuaguggggcuuuuuucaguuagugcaacuguaccuuuagggcugaacaaguaccagacacuaccugcggggagaagugaggagaugggaaagacaucaauacuccuuuaccuuuaacaguuuaauuaaugugcucagaacaaggagcaguuugaagaaauuuuggcuccucugggacccugcuacagaucagacauaacuaggguuagguggaauuuucuagauuucuuuccugcuucagucucugugaacacucauuagccucauaauugucucacaguaaacugcuguaucaaguuucagucugucucuuuggaggaucaaguugcuuuauaucaauagacugaaguacuaggggaugugugugaagggaaguagccucuaauuucuucuguuucuuagcuacuaauuauuuaauaauacauuuuauugccuauuaaaauguggcauaacuugcuugucagcaaaacuagauggaaccuaaucauuugaggagaaggauaauuggcacuuguacagauggcuuuuauugccaguuggguuuguuauugcagauagaauuccuugccagguuucuugguucuguuugugggcuggucaguguugugaggggguuacuuacuguauuacaacccaggcgguuaaaugugguauuauugcaaaugcaguguguacucaguuauagaucauaaaggcuucugcuguguagguacuuuuuuucuucuccuccccccaccuccccaccccugguuuuaaaggacccuagugaguuuuguaccacacugaaaauuaccuuaugugcuggaaaaugcaucaguggagacuuuguuuaaacaaagggcguuuuuaugauggauagaaguggccaaaacuucuggauuuccaucuaguaaaaauuuguguaggaaaauuggaccagucccaguuccuuaguagaauuucacgaagguuuuccuguugcuucaaaaugaccccuugaggaauguuguauaaauuccagaaaauugcucccaauguuuccuggagcacauuaaaaaaugaaggagacacauugugugugggauaguuugguaacagaauuaguucacuggguagaacagaggggaucccagguaguugggcucuaagugggaagcguuggccaacauuuguaacuggaggcagauuuggcaggcacuuggguaaggaacauuuuggugguaaugaaguaggcaggaacaaaccgcgcaggggaagaaugcuucacacugccaggcuuuguggcccagagccuagcauucucauccccaggugcccagcuccucugccuucccaaggugcucaaguuugcuuucuacucagauauggcccaguuucacuggcaaccaccucccuuauuuguugaaaguauggcuuguguucugacccaagagagccauuuaaaaccuauaaugauguccaucuuuguacguuuucugggucccaucuucccauccauuacuacuuugucauuguucuuaugucucauaguugaacuccugaggucuaauugugccagaacaacaugucucccaucugucuggcaacucucuuggcaacugcauuccucuucccuugaaagagguacacacucuugaccccucccuuccaaaagccucagugaagaccuauguguuuuaccuguaaacgcacggccuuuuuaaguguggaagggaaugucuagacuugauacuuuagaaaaucauuaugaaguaagcuugacguagguagcuuuguuucuuagggguugaacuugggaauuacuguaauuuaauaccuacaauaaauguguuaaaauagggaagaaagccaauucugagguuuuguguguuauaugaaggguguguguuaugcaucgucauuaaauuuucuuaagcaaaagcuacuagcaaguggaagccaauuuaaaagguguauauuggaaccagaacauguagccagaaacuggcuugggaggugcaaauccuuuagaccauugagagcauggagguuggcgagaccuagaaugucuauaaccuuaguggucacagucuacaguccacuccggaugacguggggcuauggaugagcagauggguggguauguguuggggacacgauuuuggacaacguuacaucuguugauuucuuucuguccuguaguugacucuucugaguuuauuuguaaaucaccaguuaugccaauaguauuuucuuaucagcccucacccugguaacuuuucucuuguugaucuagauggacagacccaaauggagggaaaggauuuuaaacaguaugccauucuuuauuaaaugaagcaccauuaaaacuacuuccaucucugaguuuccuuuuuccaggcccacgccuaacauuugcaaggcaagcauacacauggaggcccagcuuacuucucuucacuucucuuuccagcaccaugaggagcuuugcuccucaccucacucacuccauacauccaagcuccacccauacuuuuugcccucaccagcccaguaaacagcugccuguugaccacccucaagccuauagguguguguaccaacagcauggccugcccuugggaggauggcuuccaggguaggaaccugccuaugcaggcccuagaagcagcuuaggccaucugggaagaggaguccugucuccuuggugugcaccacaugguccuaagggggaaugugucagcuaggugggcccauccccacgacuucauggauucuugccccauguggagggacacagcuggaggggccaagaaggauccccuuaugcauggucucaaggcaggggcuggaucuaaccuguauugccucugccuuuucauuucagucuucauaaccucacacuucauguccugcaaaaauaaaaugaaauaaaauggauccagcucuccuucagaaaagcuaaauggaugagcuaguuaacucaucagugucugcggacacaaggugugaaggcuuagucuuuagauucaauacuggaaagucagcuggggucuugugcaaaagaugugaugcauuuuguguaagaagucuguuuuuuccauuagcauuuaaaguauagcauacugcuaaccagacacaaggaaugcucuacuauacagugaaagaacuaugcaagggaaaauugcagcugaaggaccaaauuaggaauguuuucaauuucaagaguccagagaagaaacaaagcauuauauugacauaguuugaacaaaguaaagcacuucgaaccuugcuaacauuuuuaaauacaccuuuguuaaaccucuuuaaagaaugacgauaauugcguuguuguuguuaguauuccuaauguccaaaggguugcuguaauuuacucucccuucaaauuugaauaugguucauaggcuucugucuuaguccauuucauguugccauaacagaauaccugacacuggguaauuuauaaauaaaagagguuauuuaguacaagguucugcaggcuaggaaguucaaggggcguggcacuggcaucugcuuggcuucuggugagggccacaugcuggucaaaacauggcagagaaggucaaaggggaaguggacacgggugaagaaacccaaggggcgcccuugcuuuaucucagccggcucuugagggaucuaauccauucccuggagagugagaacuuacucacuuccaaggagaguguucaucuauucuugagggaucugcuuccaggacccaaaagccucccacuacaccccaccucccaacacugccacacuggggauuaaauuuccacgugaguuuugguggagacaaaccacauccaaaacacagcagcuucuaaaauuagguuaagaggacacaaacucuauccagaagccaauguaguauguguuuucuauugugcugcuacccaaauuuuaacaaugagaauucugacuuugauguggcagugauaguccuuaaaguauuugaaggucuuugucaguugccacuuauuuuuguguagcagaagcacggguuuuuaugauuuugaucuuccuuuaaaaagauguagguuaauuauucugucaucuuuaucugacagacaauggcuaauauuguuuauuguguaaaugagacgcuuuacuuucaaagaaugcuaauauuggcuuugaaaggaaaaaauaagcaaguaucuuuuuuuuaaagaaaaacagucucacucugucacccaggcuggagugcaguggugcgaucauagcucacuggagccucaaccuccugggcucaggcaauccucucacuucagccuccugaguagcugggacuagguacauccaccaugcccagcuaaguuuuaaacuuuuuuucuagggaugggagccucacuugggauauagaaaccccuaguguuguccaggcuggucucaaacuccuggccucaagugaucugucgucucccaaagugcugggacuugaggcaugagccacuaagcucggccuaagcaaguaucuuuaaauggguccuuguuagucagcuuuuuucauuaucucaagagaggagaguauuaggagagcacauuuucagacacacuagaagacaacaauaauaccugugacagguguaugaccccggcucaugguggccuucucacucaccugacucaaaguugggcagcgggacuaauuuuacauaaucuuaaaucuuauaaaugacuuucugcucucuuuuccuuacaccacugauuucucuucccuggcacccuugcuagugagauaaaacagggaacagagccaggaccagugagcugccauguggagugcugcaucucccugaaggcugaccgugagcuguguucaugaaggacucauugucacauucuacccagaggccucuaagcugcucuuuucuggaguuuaagccucauucuuaggacaugccgugaauuugcucuccaaaaugauuccacacacaaaaguccucucucuauaagcccuaccagcauuagccagaguccuccugguauucuuucucaucuccaccuggguuaaaaagugaguguguagcagauuuguuuaaaaggguccucagcuacacccagccucccauauaaaaaucgauucuuggccaggcgcgguggcucacgcguguaaucccagcacuuugggaggccgaggugggcggaucaugaggucaggagaucaaaaccacagugaaacccugucucuacuaaaaauacaaaaaauuagcugggcgugguggcggacgcccguagucccagcuacucgggaggcugaggcaggagaauggcgugaacacgggaggcggagcuugcagugagccgagaucgcgccacugcacuccagccuggguaacagagcgagacuccgucugaaaaaaaaaaaaucgauucuuggaaaaucaagucagauaaugacgauagagcaaaguauuuugcucgugucuuuuguuuggcucaguguucauuugucauuacgccucagccuccuuuucuuuaagcacuuguugugaucuccgggcaugugcuuauguucgugacuguuuuccagagcauugcugggcugcuuaacuuuugaugcucccgucuaaauaaugacuagguuccuaagaugccuuuacgcuuccuagaagaaucugccaccauuugaauucucuagcagcaccccaaaagugcuaaauuauacaguccaaggaggacagucauccaccaaagaaacaaggguaggaugaacagaaagggagaaagauguugaauugagccaauucagggaguaaguaauacaugcucucugguugaacugauuuuucauauggcuagguggcuggguucugccugugacuuguucaacucugcaagcuacuaaauagaauaaaacuugcugaaaucagagaacuucaagaagauaaguuuuauguauauguauauguauauaggcauauauucauauacauacccaugcucucacacacucauacacaaacuuaaaggauucuaguuuaggguagacuuaacccuuugacaguucaaagagagaaguuagagucuacaaagugauuauuauguaaacccaacagggccuuuccuggaaauaccacaaaaauuucuuagaauugaaaagaugacaaaugcugauuuaugcagaacucgggacuucauugauagagcacugucacuuacuacuuccaucagcaggaaugguuccuuuuaacaucagauuggguguuuacauggaugacaauuagggcuggugaaauaguucaaauaaaagaagaaccagaccggcauggggagugaaccuaguuaguucccaaguauuaaauaccugucuucccucccuugucucucuccucuucccuuccuuucuccacuuuguuucucacuucacucccuuuccagacuguucuucccugucagggaaggcugaacagagauugaaccacacaauacauugagauucugcagcagagaagacauucaaauccugaaauacuguagugggaucugguuuucaaauguuucuuccccgggaaagugaaacauuccuugcagucuuauaaaauaaguauguucguugauauuucaagcaggagaaauucauuuuaagaaguuggaguauuuauaugugacaggauaguaguuccucuuucucucccccgucccucccucccucucuccuuccucccguccucucuuccuuccucccucccuuucucucuccucuuugauuuuauuuuuuaaucagaaaguucuuuuuaaaggaagagaaauaucaacauuguacauucuaacauuccaaaugcuucauauaguuccuuguuuuauugcuuuaaacauuuuuucaacagauacuuaaggacauuuuucaggaguugugcaaggcaugaacaccuggagauacguaagcuacaguggugaacauggagguguccacaguaagcgggagagaggcagguacucugcaguaagagacggguguuaaagaaagauaaauuaucucaauaacucuggaaugacaucaaccccacuuagaauuaaaggaacagaagucuuugugauaaauauucucucagucuuucccucucuguguguguauaauauuuuuguuaauacacagaugguaaucuaaugagaugcauuuauuccuccugauauuuguaaguacaguguaucuuuucauuguauuaacuguuguucuacaucuguuuggauccauucuguggauucaaaaucauguagaucaccagucucuaaugguuggacauuuaggauuuaucugguuucucaucugaguguuuauuagaugacuauuggauuuccuuagacauauucuuggaaauagaauugcuauaucaaaaauuauggaaaaucugaagcuauugauauaccuaaugcuagaugacacauuggugggugcagcgcaccagcauggcacauguauacauauguaacuaaccugcacaaugugcacauguacccuaaaacuuagaguauaauauaaaaaaaagaaaaaaaaaaaaaaaaaaaucugaagcuauugauagucuuauuuuuaauugcucuaaaauaaguauuaauuucuuagaaagaauuauuuauuuaaauuaagauauuuaugcagaugaaauacccaaauauucugguuugcuguuuauuuuuaucccauaacucaacggguauuuauauaauuaauuauacuuuucaaguuuuucaccccuauguucuacauauauugcuacccauguacuccauacucuauucuuuuaugcuucuuugaauucuguaauuuaaaaaaucaaagcaaacuaaaaacaaaacaauucagcucaaauaacauuuuuuccuaaaaaccuaagucucccagcuucuuugaacuccuccuucuauggacucuuacaguccuccucuagccuauuuaucucauuuguuaauuagcuagcuagcuuuuaugcuauguuuuauuauuagaauccuguuucuuuuaguagauugcaaacuacucagagccagagaccaugccuuguguuauuuguguacacagcuagcagagcaccuuacacaucauaggaaugggaucuauuuuagugauuaaucuguucuguuuuuauuucagcaggguuuguggaagggcauggccaaguugauggugaucauaugccuucaaauaucauguugacaauuaucacguugauauggaaggaagggagacuggcuuacuaaaaaagcauucuaguugucuagauuggaaaaaaaugcauuuagucuuucaacugucuagcaccuaguaggcagucaguaaauagaagcuuaaaaaaaaaaaauuaggccgggcgcaguggcucacgccuguaaucccagcacuuugggaggccaagaugggcagaucacgaggucaggagauaagagaacauccuggccaacauggugaaacccagucucuacuaaaaauacaaaaaaaauuagcugggcaugguggcacgugccuguagucccagcuacuugggaagcugaggcaggagaauugcuugaaccugggaggcagagguugcggugagccaggaucacgccacugcacuccagccuggugacaaagcaagacucugucucaaaaauaaauaaauaaauaaauaaauaaauaaauaaauaaauaaauaaauaaaaauuaaaaagggcucaaaaguccuuuuaaauaaguauuucaauuuaaauaaauuuauuaacuucuuuuuacuccauuuccuugucuaggaaagguggaucagacucauucauuauaaagaacucuuucugauugaaaacauuuaguuaacucucucuggucaugggcauucacauauuggagacagaagcagaaccaguuguguaaacacugaccaauguguucaauguaguuuuaaggaaauaaaauauuuuuuauuuauggauaagucuugauacuaaaaugcuaaaaacuuuucaguuagcuggcuggcacauaucucucagcaguaauacugcuguagguaaaguuggcgugcuacuuccuuuuucaucagguacaguagcucaguuuagacaucauauguaaauggagaaagguacugggaaagccuauuaacaaaaaggauuaguaggaauuuuaaaaauuaacugugaaaaaaauucuuucugcucuaagacaucaucucugcagaaaagauauuugguaaaggaauaauugguucagauuuucuccccuaguaucuuuacuaucugcccugaauuucccucuuuacucuucagaagagagggucaguuccaucaccaacccggauacaaagauucucauuucccguuaggucauagcauuuagaauaauguuuauuuugguauuuuuaaauauuuugugguuuuaugaggaaccaauacauguggucaagcauucccuuauuaagggaaauaaagcucaagcucagaacagauggagaaacuuguccauacauuugcaugugacgugugguguagaccagaaguuuaaagaauauuauauuccaaugacacauauaaagcaccugcaauugacagagaacguaaaugguauuuuuuaaaggcuagaaguucauagacuccuuccauucaugucugacaucagcaagcucuuaauaaugcaguguguacuuaucuauugaucagaccauuuaaguaguaagacaugagaaaguagacacuauugucugguaauugaccauauuggagaguuaaguguucugacaaggaacuaaguguauuuaaccuucagauaagaucaauuuuaagauaaugccuacuuuaguaaugaaccaaagcuguuaagaaaacuuuguucuucuaaagcagugcuguuuugaugacaacuaucauaguuuuaaugaccagauuuguuccugaccagauuggucuuccagggcaaccuggaaaggaguuacuaacauucauccuuuacuuaccauaaaagcucaaauggaaagagacggugggaagcagcacugcccaaagagccacugauugguuuaggagacaucuuuuggguaccuaccauaagccagucaucaugcuauauuguagggcuuccaaguuuaguaacauaucugacuucaagaaacuuauguuucaguaaaaugguuuuccaguuguauuuuauauguuaaaucucuaaaaccaaagcuuauguuaguccuucauuuauuaaagagagagagagaggaaguucuccuauauuugccucugagucuuuucccugugaccuaauugaacaccacuugaaaccuccuucucuuagagacagauccauaagcaaauaacacauuauaaguuauauaauacaaacaugaacaaaauugacaagagaacacaaagaaggacguagcuaaagcggcucugcauuuaggaaaggcuuccuagaggaagcaauguugaacucuugucucguuggaugaguaaagcuccccagagagagagaaaguggaggcagugugagcaaagcaggugaaggcugugguauguuuguggaaguagguagcccuacuuauaugucuggaauagaggcuuuugaaaagaaauagugagagauaaaacaggaaaguagauuaggccccaaauccuccagagguuuuuaagcagaagacuaaaaaucagauuuggauaucagugaggugaugcugauaaacucggggaaaucacaggagcuuuuuaagaagagaguugauauucaccuagggcagcaguagugacauuugagaagaaggaauguuccaaagguauuuuagaggugauaguggauagauuaagugacugaccaaauguggagaacggagaaacaaaagaggagaggagguaaggguaauucugagacaccuaaccccaaagacugcaugggagaguauguccaauacagggggaggauugaguugaagaugagaauaaggaagaaucaguucauuuuggagauguugaguuugagguaccuguggaacauccaaguggagaacuuuggcuaacaaaguuuggguccugaagauaaagguuaggauuagaaauacugauuuaugggcugggcaugguggcucacagcuguaauuccagcacucuggguggcugagaugggcagaucacuuaaggccaggaguuuuagaccagccucaccaacauuugcgaaaccccgucucuacuaaaaguauaaaaauuagccggguguggucuacucaggggcugaggcacgagaaucacuugcaccagguggcgcagguugcagugagccaagauggugccacugcucuccagccuggguaacagagcgagagucugucucaaaaaacaaaaaggccaggcacgguggcucaugccugugaucccagcacuuuggaaggccaaggugaguggaucacgaggucaggagaucgagaccauccuaguuaacacggugaaaccccaucucuacuaaaaauacaaaaaauuagcccggcauggugaugggcgcuuguagucccaacuacuugggaggcuaaggcaggagaauggcgugaacccaugaggcggagcuugcagugagcugagaacgugccacagcacuccagccugggagacagagcgagacucugucucaaaaaaaaaaaaaauuguaaaaaauaauaauaauaauaauacugauuuaugaaaucacugaugaagaacguaguuuugggaauguucacuaaugauggcuagaagaggaauauucaucaaaggaagcagucagagguauuauuugauaucuaggaagcaguaguuuugcaaaagaagagaguucucagaaagugcaaauagcaauaucugauaccauugggagaacagaaagauaugaaucuucugaagaccacuggcuuugcuagcuauuauagaaggccacugaccuuuagcaacaacuuuuucaggagaaugaugagaguagagacuggguuagaaucauucgaaaagaaugaaauaaagaaauggagacaaugaauguguguauucaguguuuagggugaugagaaauggagaacucuggcugaaaagagaagcaaaguggaguggguguguguaugagagugaguugaauauguauauaggcuagggauaccuguaugucucugggauaguaagggguuuggaaucacacucguggaagaucaaaccucuggccuacuauuuaauagauauggaccuugaucaaguucuucugugagccucaaguuccuuauguauaaaaugagauuaguacuaccuaccucuuggaguucuuuaaggauuuaaugaaauuaugacauagaaaacaccuagaacucagaaggcacucaguaaguauuaguaggauuuuuuguuuguucauucuugugaggaagggagauauuaaaggugcaagagagggaaaggaugaugccuaugaugucagagaaaagagaugaguagacaugggauuugaguagagguagaggaguaguuucaaagugagauuggaccuauuuuccuggguaauagaagggaaggacagugauaaaaugaggcauugggcaggauaauuuagguuauguugcaguaacaaguagcccuaacucuaagucuguuaaugcaacagagguucucuauucauacuguauggccaacauuaauuaggaaggguuucuguuuuaucucugccccucagagacccagccugaugggagcuccaucucgguauuugccucugcagucaucauagagcagucacauggcuaccucugaccucaggaggccaagaaagugccuggaauuggggaagcacaggaaauauuuggugaucagugcucaagaccagaacaaugaguagagcuauagguauaaguaaauagggaagggauggcaguggcuucucuuuuucccaaugaaggaggcagcaaaaauaugauccaccaagagcagcgugaggggucuuacaagagugguaaauguuuggaacagcuguuuguuaaaauaauuaaacgggaacauagcagcaaaggaaaaggaaguuguucugguuaaauauuuaucauuagggcuccaugcagaaugaaaugguaauauagcugugauucaguuucuuaguucagcuuaaaauuagaagcugcccaucaauaauuuucccaagagagcgauuucuacuguaacagcacauagccuagagaaaaggaaacgcacaaagaacaggcuuucuuggaaugggaagagaaaccauugcagggagagaauaugagagagaaauugauuguacaucuaucccuggaaauaaaagugaguucccuuuuaucagucauucuguaaauacaucugcugcuggccuagcacuuuggcacuagguguaaucgagagaaguuuaggacuuuauucauguucucagagaauguguuguuuggucaguggggcaaaaaagcucaugccaugaguuugaggguuguuucauauaugucuuuuauugcccuaauugcuauaauuuuuggggaagaguuucauggaacagaugagauuaaaccgaggccuugaagaauagauuaaccuuggagggugucaaaggaaggaaaggagggcaccagagugaugguaucauucaagggccaauggugggagugaaaaugguuucuaggggaggcaagaaggagaguggccagaaagaagaggagaugauuagaucaagaaauuaugggacaucagguugaacugacagguugcaaccuuauuauaaggaguugguacaauauggaaggaaagcaggaauuaguuguugcaugagagaauggcauugugacaagguacacuuggucaguugggaagaacauaaugagaaggauuaguuaaaagacuucauaauaauccagguaucuucuccucaucuacuccccauacgacuugaaugacuuccuguuaccuucagaauaaagucccagucuuuaguccugcuugcccauccccauuuugaagagacuaccagauaugcaaaggguacuagaaugaggaagacucggauauguuggaaccaggagccagaccauggauguacaauuagauuccaacaaugcuaucaacaggcaacauuuaggagugcagccuagcaccuugcaagggcugugaccaagucagacauaacccugcccuaguaggauguuggagguuaggugggcuuuccaacacaggcaucaaaggagaaaccucuuuauuauuuuuuuaaacagcuuuauugaguuauaguucacauaccacacaacucacccacuuaagguauacacuuccauguuuuuuaauaaaugcacagaguugugcauucaucaccauaaucaauuuuagaaucaauuucaugacccaaaaaagaaacccugcacucccuauccauaccuccuuccuugcccauuccacugccccagcucucagcccuagguaaccaacccucuauuuuucaucucuauagauuugccuauucugggcauuucauacaaauggaaucauacaauauaugguccuuguggcugauuucuuucacuuauuuuucacugguuuuaaagguuuauccauguuguaguauaugucaguacuucaucucuuuacauugccucauaauauuacauuacauugauacaccacauuuuguuuauccauucauuaauugauagacauugggauuguugcuacuuuuuggcugugaugaaaaaugcuguuacaaacauucauguguaaguuuuuuguggauauguuuucauuucucuuagacauauacacaucuuauaguggaacugcagagucacuaucauuuaaccauuugaguaauugccagaccauuugcuacagugcccgcauuuuacauuuccaucagcaguguaugaguguucuaguuucuccauauccuugcuaacacuuguugucuuuuuuuuuuuauuauagccauuauucuagugggugugaaguuguaucucauugugguuuuagucugcauuuccaugaucagaaguuguauuuucaaaacuaaggcauaagugaaagcauguuugagggcuuugacagaagacugagaaauaaauauuaagagauugauauggauaggaggauuucaagcaguuaaaggcuaagaaggaauuggacgcagccuuuuauaguaugcccaguccgugguguugccauguuccauggaaaugaauaaccagagguugcuauucucauucuaaccauucucaguccuuggcaacacgaaguuagguucaccugaaaaauaauuuuaaauauaccagcguucaggcccuauccuuggccaacugaauaagaauguuuggggauauagcccagguaucuguaguuuuuaaaaucuccucacaugauucugaugcacagugaggguugaaagacaccauuguaaauaauucagcaggauuaaauaauagaaugaauguauugauugcaugcacugaucagauaaccaucugccuuuauuuugaccuguaagcuuuucugagacaccugcuaacugaauuugaucaaacagauguaagacauaauugcagugugcagucuucuccaacuaaugauagaggaaaaccuagcgugugguucauaaaaucaauuaacuauuucuccccaauuaaaccccgaauuuaaaaguuuugucacagaguugaguuccuucauuuuuuucccauuuauauuggcuacacaugaggcauuuguuuauuucaaugauuucaaucucuuugaguucaacauacagugaugcuuuucaagguaaugaauuaguucauugauuaguuuaucuauuauaagacaguaaauugauguaaugagucacugauagauauccuagugguuggcucauagauacaagcauuuuuuaugguuguguugauuugaacacgugccauuucuaugcaaaccuugaccuuuguaauugaccugauguguacagaugacagcaaauagaucaaucagggugaugucucauuaccauauggccagugauuucucuaggacuaaaguauguuuuuucucuuuagggauugagggccauuuuugucuucuguuaaaauucuaggucuagucacaaaacuggaaaggaugggaacuaaagugcaauacucuucugcuaguuuggcaccaaguuuccaaugcugaaaagaaugauuuuccauuguccagacucuucuuuagagggguccuauguccccaacuuaaaauuugagcuacacaguuucagaaaaugaaaacugauauuccagaaagaagagguagauaaugcagaaaugucaguaauucaacauguucugaugccaaccuggccagagauggcuuugguuucauuguagauugagauuucuuauagaagguuuaaaaugcagggaaggucaaguugaguuuuguagaggaagauauccuaguacuuuuuuagggaacccguauuuuugucuuaauggaacugcuaaaaagaugugcaguaauccaggccuucucuuccucucaaaaacaaacuaggcacugguuguauuuagucucacauucguuuaaucuagaguaaauggaagccuggcauauagaucauugauguaaagaguaucauggaagaaauugaaauggaaacaaacaguagggggaagaccugucugguagcacauccucuccaucuggcuagccgucagauuuccuggccauuucucauuguacacuucaucuuugcuugcuucuuacuuccuuucuuucuuuuuuuuuuuuuuaaaauacaaguauuuuaaacugcaaccuggaaagaaaacgagagguauauaacacauccuuaaaaacaaagaggaaaaaaaaaucaacccuguuaauaacuuccacuuugagaguuugggcugguugcaaggcccaggggacuaaucugcugaaugugggaggauauggagccauuuguccuaggagaagcacuacauuaaaaagaagaggaagaagucaugggggaagggcgagggucugcugaugaaaguagcugucaaauuagcaggucuggaaguuguagugcauauuguuaugagcugcucaaguucacaccagagcaaccagcuccauccaucuuucucaguuuacauuuuaauuggcuuguaguuaaguuuuuuaaacacugcgagauugcugacauacacugcaauaucacgugaauaauuuauggagguugcucaagacaagcuuuuuuuuuuuuuuaugugagaaaccaggggggagugggggaagaaggaugagagggucugugggaggggccaggacagaagagcagacacaacugcaugugcugugcuggauguuaaauguuucugcugguguaggcagcagcauuugggauuucagggagguuuguacaauacgaucuuauuaauaacaauucugucaagagagcacccgauuaaauugaauuggguuuaugacucccucuugguuucugaaaauguguggauauaaaaccucugcgaugugaauauuggauaacaaggguagguuucuuuauuuauuuauuuuuuugguugguuuuaaucauuccuccuacuacugagaauuugcuuguuuauaaaugcagggguaggcauuuuucccaaacuaucuuucuguuuucugcucucaaaauaaucuagagaagauggaacuggcaucagugggcaguuauccuaagaacgugacugcuucuaggcaugguuugcuggacaacucugagucuagaauaucaucuaauuaacaccugugggacaauccucuucaucugcuaaaauauacuuuuuuucucauuacaaaaugaguaaauuauauaaaaugucuagaguacaaagaggagaauaaaaauaaccuguaaguccucccccugcuaauaaaauugguaugguuuuuguuuauauccuucuagucuuuuuucuguucauauuuagugaacauaauuuagugaaucguauauacuguuuagaagucaucuuuuuuuuuucacuaaacauuacaucacaagcauauucccaugaauggucuauacggaaugucauuucuaaugauuguaguguguaugugugaauuaacuauacuuuauauaaccuaucuccugcaacuaaaaugcaguguuaguuuauaauuuuuauccauuuuagacaggcaaguuauaaauauauuuuuuggucaaauuucaguauacauucuugaucauuucuuuaggaaagcucugagaaguagaauuucuacaagaagcagagugagucugagggaaaaaaucauuaaugucucaagaauuuugucucgaaaagagggauaaagcacauuuuaaauuaaugaaauuaacaguuuauucuauuuaaaaagaaaaaugaugauaacauucaacaugagguucuuuuaaauuauugaauuuuuugccuugugggguuucuuaaccacaaaaccuaucuauuaggauuaauggaggcuauuuuuucuuuaccaauugcuauauaacuacuuaagacuucauguaaucagcugagaugcuacaaauguauugccugucaacuccaguaaaaaagcgggcaguuaauuaaagggaugucuugcuguuaaacaaacuugcagucaauugcuuguaaguaacauuuaguuugauauguagucaaagggcaggaaaauaaguguuuaggcaggacuggcuuuuugcaacguaaaaagagaagugauuauauuggggucaagaugaguaaccuuucaacuggcauauuuuccuucuaaaaaguauauucacauaucagaagaaaggugaaagacauauaaggccuuaagguuggucaguuugagaucuuuuccacuuacaguaacuaaguccucaucuucuugcaucccuugaagacacuguuuuacccuaauauaaagccuggcuuugaggucaguguguguguguuuggacaugugcgugcacacagaccguaaguagaugaggcaagaacucccuaaaccaagugccauacucugcagaugggaaacugccauccauagacccaguagaaaggcugcaguagcacagcagcacuugggacagcugcuccaacucaggcccauuaccugcuccuccuaggagugccccgaugcucccugcaccuuuguucagcucuuccuugauaauccaggauaggaucgcacaguuucugguuggugagcuuguagucagaagcccuuuucaagcuuaacacuuucagagggaggguuuauccaaaagacaccauacugauucaauauguuaaauguugaaaugcuugugaaacaacgcauauaugauagagauuuuuuucuaucucaaaaucacuuggauaugagagaccagagcuauuagaagccccauugacuuugcuuugagauuccauuggaggucauugaacuuuggagccucacucugaagccaagaaauuucaacuuugccaguaaccacauuaaaauguguguaccuggcaauggugaaccagccucauuuacugguuuccauucuuuguauuggcuauucauuauuucaucaacaagaauuuauuuuuuuacugccaauuuuacguccaacuagguaguauggaaugcaagagaagguguaaguuauggccauuccccucaugggccuuuuaauaaagcaaaguaaauauguaauccacuuacagucagucaagagcaauauuuuuauuuguaaugauuccacauuuuagcuuaagaaaguauuuauuauucugggaagaaaaacauuggcugaauuaauggcagauucugaaugggcuuugagcaacauuuggaauacaaguguguaaggugggguuggugagauuugcuuuauuuccugaacugcuaugaauuagcaaauucuaaaccagcuguuuuccaauuacauacaauaacuugugccuaccuaagucugucuuucugccaagcuucuacuugcaacucauuuuaaaacuuauuccuaaauacccccaaaccaguggaauaauaguaggcaucaccuuaaaucauaauauuuucacaagaacauguucaaucuugaaauaauggccagguuuuagaaagugggaggugagaacggaggaguaguuuguuuuuugucguuaaaaaaaaaaaaaagaagaagaagugcuugaaugagcaaguugcucagauuucucugcugcuuucuucccagauggccaaagggagagaacacuuucacugaagaaagggauaaaugaaaaggacaccucuguauccaguuauuuauaggaugauaauugaugauaggguuggaguuuuaaaauguuuccgugugaacaucuugcaguucgcuuuaccugccuuuucugugguauuaaacacauugcuuaauuccuauuuucauuuuggauuggcaaauuucuuuauaaaaggucagauagcacauauuuuagccuuuuugaccacacaggucucugacauauauucuuuguuucucuuuuuuuuuaaacaacacuuuaaaaaugcaaaaacucauuuuaauuuacagguuguauaaaaauggacugugggugagauguggccggcacaccguaguuggccagcucaugccuuagagaaacauggggggauauccugggugggcaugaguaucaguuaggucagcaagauuucccucuuacugcugcuugcuuuguucucuucuggucacuggccgucucaggagcuagucccuggagcccugcucuccugugugauguaauggugugaaaugguguuuccaguggaaggccugcagggguaaaugcugucucuaauuaaccuguucauuuagugcuauuauccuuuaucucgaaugcaguucugcucugggaggauaaggaaagugcuuaauuauaguaacaguuucacauugucuuuguuugcaugaugaaguacaaaaagcccaggagaugaagcugucagucacuaagugucuuugggagccucuugguuuuuugcauuuaauaaucaugcucuguuauugcguguuguugaaugaaaccucaggucacagucuuugucaaugaucugacccaagacaucuggccuauguaaguuauggcuaauguccacgaacuggauaauaucauuggcaaauuguggcuucauugaugccuguuuauuugcuuuuugccucaauuagaauacuuuggauuguuauuugucuuuuuacuguguuuucuaacucccuaauugcauguuaaguaccuguaguccagggaaugugccccaugcuucuuugaagccuaaagucuuuuggaauaccaucacaauauuuuuauaggacuuuuuuauuaaccacaauaaaaaauguccuauaaaaacauugcagagauccucauacucaaacucugaggagccaaagucagcugaaugguguuugggucucaaacaaacaaauauaaauauauauauauauauauauauauauauauauauauauauauauauauagugauauauauaucgcaauaaaaauguuguauaaaauauuguaaugguuaaaaugguaaaccauuuauauauauuuaaauaguuuauauuuaaacuauuuaaagccauaaaauggcuuaccauuuuaacaauuuuuaaauguauaguuuaauggcauuaaauacauucgcauugucguacagccaucaccacuguucaucuccggaacauuuuucgucuucccaaacugaaacuccauguucauuaaacaauaacucuccauucuuccuuccccaacccugccaaccagcauucuacggucugccucuaugaauuugacuacucuagguaucucauaaaaguagaaacaaauaguauuuauccuuuugucuggcuuauuucgcuuaggauaaugucuucuuuuuuuuuuuuuuuugugacagagucucacuugucgcccaggcuggagugcaguggcgcaaucucggcucacugcaagcuccgccucccggguucaugccauucuccugccucagccucccaaguagcugggacuacaagcgcccgccaccacggcuggcuaauuuuuuuuuuuuuuguauuuuuaguagagacgggguuucaccguguuagccaauggucuugaucuccugaccuugugauccgcccaucucagccucccaaagugcugguauuacaggcgugagccaccgcgcccggccagcauaaugucuuuaaaguucauccauguuggcagcaugugucagaauugccuuccuuuuuaaggcugaauaauauuccauuguauggauaugccacauuuuaucuauucacuuaugaauggacacuugguugcuuucacauuuucucuauugugaauaaugcugcuaugaacaugucuaaguccugcuuuaauuucuuuuaugcauacucagaaguggcuauugaaauauuuuugcaucugccaauguaacaacuuuuaagcucuguggaacuuuaaauauucuuacgguucuuuccuauguuaucugccuauaguaaaauaaauuuuauaauaaagaauucaguuauuagcuaugaugcacaaaaagaucuaugagaacaagcauguauucaugcuauguaccaggcacugagauuagcucuuaugugaauuaauuuacuuaaggcccacagaauauguuaucugugugcuacagaaaaggaaauaaaggcuuagagagguugagaaacuugcuuaaguucacacagcuaguauguggcagacaggguucuacuucagagaccauguuuguagauaccaugaagccauucagaaaaguggauugcaucuauauuccucauuauauucccagcaugguuagcagaaggcuuaucauuuuccauugcaugaugucacuuuuaaauuucaaaaucaaacuacauaaaauaacauguaaaauuacuugaaagcuuuaaaagugcuauacauaugcagaguauuaacaguaaauccuagugauggacagauguuaaaagcuauaaguauaugauucagaaaccaucuaagaauuuuaaacuguggucuaauuauuauggaagcuuacuggagccuauccuugugauuuguuagaacauuguuucauaugccauuuuauucguaucucuuccaauucuuauuaagacuagcacugcuguuaugaauuucauggcuuuuuuuuuaaguugcuggauauaagccagguuaucauauaaugcccuuuacuaccuguagucacuuugggauagguacugugccuucaaccaucuuugaaauccuacaacucguaggcuagguuuagaugccaaauagcuaaagagcuaucauguugaaaaacuauuauuagggcgggcacgguggcucacgucuguaaucccagcacuuugggggagccgaggcagguggaucacuugcaguuaggaguucgagaccggccuggccaacauggugaaaccccuucucuauuaaaagacacaaaaauuagcagggcgugguggugugcaccugugaucccagugacucagaaggcugaggugggagaaucacuugaaucugggaagcagagguugcagugagcugagauugcacaacugcacuccacccugggugacagagcgagcauccgucucaaaaaaaaaaaaagaaagaaagaaaaacuaucauuagacuuaauuugugucauuucagaggacagaauugaggccauucuguguguguagguucuggaaggacacauuucagugcagaauaaaagauguaguuguagcuugguagacuggcugccuugaaaauuaguaaacugucaacagaaauauucaaauacaggcuagaaaauccucucaacaaggaaguaaaggggauuccuacacuaagagacugaauuuauuaaucuucagacuuggucuauuaugacauuuacuugaaguguucuaagaacuucaccuuuaccauugucuuaugugguauuguuuucuucagcaaaagacaggagcuaagaauuuuugguuggcuuauuugcuguaccagaggcaaauaacugugcuguguuggaaugacuuagaaguagaaaauauuucgaucaggugcaaaucauggucaggaagacaacaaggucaacuuuuuaaacccagauucuccagggugaggaugcaucauguacaaaacaugacugacacuaagcaaagagucugaagugguuugaucaguauauauugauuauuugauuuauugacuuugcugcagucuucuuggagcucuucagcauccaguacuauaaaacucacuuuuucauuguaacauuugacuugagcaaggacuuagguauuuggcacaaaugacauucucuccucuuuucugauuaauguggcucugggaucaaacaaaguuagugcaaauacuggaauauuugcucaaauagagaccaaaagggcuuaaaauucagugcagguagaauuguuuaaguaucagaagggcagacuuugguaauuucagcugcauauguugguucuuauuucauuuugguagaaauugaguacuggagacugccuggaagccagccuccagcauugacgucugacaguaaccgcaaaagcagucccccuuuccgcuggcagagccaggaccacguccguggcugugaucucaggggagggcucccaguccacagccugggcuuaugacugggaagccugcuucuuguaagguggggaaaacagagccaaacugaccccacagaauuugaacuuggagaaacugucgaauccaaaggauccaucaaggccagggacaacgccuagucugaacuggcgaccaugggcuuuuucagagccaggugucagaaauggguaaauaucaaauugugucugauuaaaaacaggagggagcagagcuccccuuacucacugaggagccaaagucagcugaaugguguuuggcuccaaauaauucaaaagccacagucucaugacccaaccaaagaaauauucaaaacuagccugaaauagaacagccuguuuucagaaauaugcuaucaaacacauuuaucuuuggcuaaaaaacgaauuaaguaguuuucucuuaaaauggccagauauccauuaacauagaagaguauaggauaaauaccucuuauggagauggucagauucaugauuucauuuaaguuaaaaauauuggcaaugauaccguauaaauaauauuugcucucauccaacacuuuugguugaauuagucuauuaccuggggaaaacacugaaauaggaugaaauaauacuaagaauaacauuagaauuauauauuugaaaauuacugauuauauagcuauuucaccaaugagauauucacaagauaaagaagagggauaaugauagcccaaguggacuucccaauaaugcaauagugaagaaaucaaaauccagccaacauggacaugucuuauaucuugauuggaagguagauaacacaguacauacauuugucaaaacucaaccaacuguacacuuuacagcuguguguuuuccuguguacaaacuauacuucaaggaaaaagucaaaucaacuuauuuauggagcuacaauuuaugagaaaguacaacauuaagcaagccuugggagaaaaauuucccagcauucaggaaacuugcaaaucauucguuagcccuagacacaaauguaagaaaauuuuaauaauaaaaauuaagucaaugaugagggauuugaagauucuuaauauuguggaccuaaauggagccucuaugaucauuaacccuccaguuacaaauaugguaaaacagacauuaagaaaauuuuagaaaauuuuccaaagaaaaucagagucagaauuugacuagauggcagaacgauaagcuuaaagcuccuucuccuuucuccuuugucacauugacuuccuccugcuccuaccugcuaaauauucucaagggucuguuuucagcucucuuuaccuuuauuuuuauauugcacucccguugauccuuuaauuucaaaguuguuauuucuuuauucagucaguaaacacuuuuugaguguauaccguauaccaagcacuguuuuauaggugggugauacacaguuaaaccagaaagacuaaaagucuucacucacagagcuuacuuucuacuaaugucuguguaccuggaagccagauacugauuucuggaacaaguauucucagcaguccagacaccauugcccuacaacuucccuugcauaucacgacagugucucaagcucaacgugucuguaaucuccucuucucuccaaaucaucuccuccuauuucccccagccugaagaucgucauuggcuguccuuguugaaucucuaggucaaccaauuugaaaaacucuaaacucuuccaaauugacuuuuucuuagaucaguucagaaucuccauguuuccucacuucuuuguaauguccaguagcuuucuaacucaucucucuacuacaauccccaacucugauguguccuacacaucacugccuggcuaauuuuccuaaagcacaccuccuauaccaacuuuuucccaaacacacacacacacucucucuugcuuuuccuuugauuucaucugccuuucaaauuaaauggaaauuccucuaucuggcaguaaagacuauugaaagcauggcgccacccucccuuucaaaucugacuucuccacuacagguaccuguaccuacuccagcugaaguggauuuuuggcugcuccuuuggcaggcccuaguucucuaccacucugccuuugcccauuguguuucuaucuggacucauuaugcagcuuugccccacuccguacucaucaucauccucuguguacaacucacucacugucuuuucuaagacuccuuucucauucugaucagcaugauuuuuccuucauuugaguguagucaucacucacugcauugcauuauggucauucucuuccuuuuuuauuaaaacaacacgauggauuuucauaaaaugacacauccuuauugaaaaaaaguauacagaagaguaaugaaaguaaaaaccaccugaagcuguaucacccagagauaucugguuuugaacaucccucuagauguuucuuuguguguauacacaauuuaugaagucuauauauuuuuccagaacugagaucaaauucuaccuuuuuucauguugauauauucugaugcucuuuuaauguugaucaauagaaaacuaagcuauaauuugcaguggcugcaagguaucucaucauuuggcuuuaccauaauuuuuugcuuuuuguuguugauuuuuuuuuuuagcuuguguuccucccaguagaagaugagaggaggaggugcuuagcauguguucugcccaugugcuuagcacagucuuguaaaaugcaagugagcagucugucaugguccuugacagggacuguuugugacuuaucacuccaugcgguuugggaccugggaaaauguuuagagaucuugagaacagguuagagaggauugaccuaaagucccauaguaaaauuuuagccuuuaaaaaaaacaauuauuacugcuuugaacagccuuaugcccccauugccuguaagaaagccauucauuauuucuuguuacauaaucugcagagagcuuauucacuuagaaagcagugcauucaucauagcuucuaucuuaugaguagcuaaaagcagaaucuguucugcaucuuugaggcauucuucgcagcacagaccucaugcuaucacuaauuagccagagcauucccagccaaaaaucccagugccuguccuugacaaaaaagucuguuuuuuccacaguaagggugaaaagccugccucucugucuagggacaucuccauaagacaagcaaaaauagggugguggugagcucucagaucagccagcgcaaugaaacagacugcagccucuuaggagacuuacuguuugcugccucccuuucucugcaaagugggaucuccauuagacgaugccuuuguacucugacaaaauaccuaaccaccaugagacaagccacuucugcauuauucuguacauuguuccuauccauuccccauuuuuggcuucagaagucauccccuagccaacuuccagccacuugcauuaaugaugaaugcgauuagcagccuaugcuaguccauuagggaaaagaaagaaagaaagaaagaaaaaccaugagauuguuugcuugucacugggaagugaagcuugacgggaacauccucacugucccuccccaccgccccuccugccaugugccugugaucugugcgcaugugcucaugguugcccguguuccauggcucugccauuugcucaguggggggacguuuucuuagcugagcagugcaccacucugccugagggauugagaacauauugcuuggcaggugggccuacucagacgcacugacuguuguuucagcacugacagggaacauacaucaugcaggcccauuaugccagcauaaauccaugguaaccuguucaaagggcugcaaccagcaaacaacguguuugggucuuaauaggugauauuuuugaaacauauaauugggaucugagaaguaauucuggaugacaagccacuccuucugccauccuaacagaagcugggccuacagcaaaauaccacuccugucaugcugcacaaagaugacugccauuccagcucagcuccaggcugcugugcacggcgccaacggugccaagagcuugucugugcagggaaaagagcccucagguuugagggcuuuccuuugugccuuguugcucuggacugcuggcaaaaggagcuccuaggauuguugauagacaaugucagagccucuuucuucagccuacuauuacaaguuugaaagggaucuagaguuuguuuggcguuggguaguggacagauaauccucaaagcagaggguucugaucaaagcuaucuuucauaucccccacuggccuccaguaggagaaugagauauuaauaaaguccuugaaccgagugugaaggggcuugguaucacuagccuugcuggcugcuucccuacacagaagccagacauguggugccagcaccuuggagauauaguggguaaagucuggcacagcccuggucacaaaaaacacuuuuucccugcguuucuaggaugaggaggugaaugauuaguuuacacgaguuuccauccauuggagucaugauacaguuuccuuacaacacacuugcuccaugacucauguucugcauuccuguugugcagacucucacaagaugcaccucaccgcacauaaucaucuguugcuuucugcuuauccacuaaacuguucucccuaaagacaaguaccauacuuuauuuguacauagccaagugcuaguuucaugggagacacagaaggacugaagaaaggaagauguucauucauaaaaagaaaagccacaaggaggucauuguggaguuguugacuuuuuuaucuucuugauuucuaagaaucauaacauggguauuucaguaugacuugccaauuaaauuacaacuggguggcaauaauauauuauuuaacucucauucugccacacaauuaaacaaguaucaacacaacccaauaugcaugcuacacagcaucugcacuuuucucuugcuacaacagaaguaguuuccuuaaagcaaauuagaaaauagucucaugagaccaaggacuuuauaaaguauaaggaccaaggagggccaggugugcaccugcagucccagcuacuuugggggcuaaggugggaagaucgcuugagcccaggaguuggaggcugcagugagcaaugcuggcaccacugcacuccagccugggcaacacugucucuaaaaauagaaaauaaaauaaaauuuuccggaccaaagagaagacuguuaugaugugaacaguagcagucaauauuuagaaaaguuguguuccugguagucuggcacagaauggugauuaugagagauaugggcuguaucacaccgcagcaguggcccagcuaccacuccaccaguuucaccacuuucuuguuucuacucaacaguaugguuacuuacaacacagagauuugccagcccagguuucauagaaacauagacguugguccucuguccccagauauucuaguuauaaggccuauacgggagccugggauuauacuuugaaaaugcuuuucagguggcuuagaugcagccagucuguggacucugguuugggaagcacugauuagaagcauacaauacugagaagcccaguaguucccucagucuuuccacugccaugugcccucuauaugucuucccugggccaucugucuaaaaaugccugaugucuuagacagaggcucugaggagccuuaagagcuccuugcaagacauaaaaccaagacgcuuuuugguauggaagggaaauaucauuuagcacaucuccauguccaucaucaguucuacuucugaaauauuauuuaaaaacacauuuauugaaauacgauucacuuaugaaguucauccucauaaaguauacaauuuauugauuuuugguauauugacagccauuuaguaaauuguacaaccaucaccacuaucuaauucuagaacauuuucaucaacuaaaaagaauccccaggcucauucccuccuacccagacccuggcaaucacuaaucuacuaucucuguggauuugccuauucugaacauuucaucucugaaauauccuaaagugacugaacguaaguccaguuauaucugcaagugucucuaaaaauguuuuuuucuaauauuccauuggggguugcugguucuuacaucuuuuauagucagaaaggcuucacuuaucucuaacuuuuaccuacauuacccuucuauaacauuaacucauauucccuugucuucucugccucucucucaucauuucaccaacacucaaauucuuuauaaauucaaacaucauuaucaagucaccucccgacuuuucuguaggaugaaugaucugaacaguccuaugccccuucccagauuuacccaauauuuccuccuauuucuucuuauuuaaauaaccaaguguucacccuuuucucuaagguggaugccuucauuugugcccucuuuuuuauucucuuucuccuguucuagaaccuggcuuuggacugcaucuucauuuucuuucuucaaccuacaguaauacuccacguucacacuuuuuaaaaaauaccucuauccugcugccuccucaagcuaccauucucuuuuucucauucucuucacugccaaaccuuuugaaagcacaguuugcucucucuguuggugcuucuuuuccacucacucccacuucacuucuugcagccaugacucugcucccguuacuuuacagaaaugucucuccuuguaguucauggcaucaagcccaguacccuucccugaccccauucccugagaccucuagguaaccuggagcucaguugacuauuccuccaucgugaagcacucuuuuuccuuuggcuucucuggcacuccacauuauccggcuacuuuuggcuccaguguuuagugccuucccaaauaugggugcccacucuuuuaucugucuauuuucucccuuuccagccucauaacaccaucuggcuccuaacuauguggauaacuuccaaaacuaucuucaccacuuggauguccugccagcucuuuagacucauugcucaaaacagaacucaaacccugacaggcuuuccgucuuuccuaauguuggccauaaugugacccaagguugcaaauuugacuuuuuucuuucugucucuaucaccuccuugguugccaagaugacaagccaucauguauauaauagcuuuuuuauucuauugaagcuguauuucuucauccaucgucucuacuucucaaugucauugcccagguccaggcuuucauuggcucucauuuggacuaucaccagaccauucgaucucugcucauuccaucuucuacguuacggccagauagcaguccuccuucaacacauaugucauaucccuaggcagcaaucuuucaaauucuucuaagccuacugaauacauccuaaacgccuuauccuaaauuacaaggccuucuauauuauuuuccauuccuucauauucuguauguucuguccuaagcaaagcacugaucauucuuucaccuccacaauuucucauuuacaggaccuuucuuguccuguauucuuuuaucuaaaaugauguccuuuauuucugccaacaugauucuauguguugaaauccucucauccuucaaauucuuucucuuccaugaaaucuuagaacaguauuucucucuccuuugauuuuccaaaauuguaugagguggcggggguguggaggguaggaaaggacauuuagcacuuugucuuguauuuccauuauuuaugugcuugucuuauccagucccgccuuggauuuucauuguuauaacuccugugacugcugauaaaguaucuuaaauauaguauauccugaauaaauguuucuucagugaaugaauuuuuuaacuucuauaaaauauagaagauguaaaaaacuaaacuuguagaugacaggcuuuaugucagugucaagagaguucucaguaguuuccacacuauuauuauuuucagucaaucuagguacaaggcugaggugaaagaagcuugagagaauuguagcaaaccugccaucaucuucauauuguaaugccuuugcauuugcauaauauuuuauaccauuauaagauacuuucacaucuuaucugacccucucuauacuuauuuuagguuagaaagagauaguuauccuaauauccauuucauaaugaggaaaguguauucugggcaguuuuaaugacuuaauuaacuaacgucagguuauugauuaggggcagaccuggacaaggggaccuguuggcugucuuuaaauauuugaagaacuaucaugucaaagaaaauuaaaucuuuuuuuuuauucuuuauuuccucagaggacuagaacaaacacaagugaauucaaacucaaugaggagauaaauaguuuaacuaucagauccacuucaagaugauauuggcugccucuguuguucaagaggagcucagggagagcaagcuggccaaccagguagaggacaguuuguuggaaagagccucccaaaaaguauagguuaaccaagcucccuucuaauuuugcaauuuugacuuucuuuuuaggucagcacuguguuacuacccugcauaaucuaaguuuugauuucugucuuuuuuuuagaacucaaccuuaagcaaauuuagccacagugugguccagguccuagauuuuuuaugagauggccacuccaccuuauccuaccuacuccuugcaacugauauuggaccaccuacaggugggaaucuaaaagaauguauuuccacccaauccuucagugccuagagcugccagcccaauggggaaaaaaaacacgaaguuuucagaaaaucucacaggugccaucaucacauguagccggcccaaucuggcaacuccagaaaccugucugguauuauggccaugguaggcaagccuaguguucucucagaaugccacucucucauucuguuggaaggaggugggugacucuaaugagcuccaaacuuuuccuugaaauggggaguugccuaaaaaggcaacugccuccaaacagccaaauggaaauuaugauauuucacugaacucagaaccaaaucugccuuuuuuuuuucuuuauagaaacauuuuaugugccaugugccuugggagccaaaaagaaaucauacuuuggcucccuguuccacuuugcuaagcucagauacuguaaauacccuccucuccucucauaacguuaaauuuuucaugaauucaucauaaaggagccacuuuguagauuuggcugguaccagugaaagacuucauuuucuauuucacaggaacuuuucagugcaaaaaaaauuacgggugcaauguugaaagacuagaauuauucaucaagucuucacugccugcaaaugaagagaauuuuucuaaagccuaucugggagaaugcagacacagacaugcauauuuuagauggugcuucaucuucaccguagccaccuuaucuuucucagaagagucaggaguaagagaggauaugugcuuucuuauuguuuuguggauucauucaagaguucacaacagcucacacauuucccccuuaccuuccaguguaccuggaacucaccaaugcaccgaagaagagaauauuuccuugaauuacgcauugauagaaguaccaauagcuuuguaugauaaaaugcagugguucucagacuuugacaugcauccgaauccucuggugggcuuauucaaacacaugcaaggccucaugccaagauuuucugauucaguagauguggguugaggcccgggaaugugucuuuuuagaaaggugauggugcuaaugcugccuguacaaggacaacacucugaggaacacuaacauaaugaaaagaauuuagaaaucaggaaaccuugguuuuaguccugagucaucuaccaaugauggaucuguggccaagucccugggccucaagaguagugacuccugcacuaugugaacuaguguuacuuugagaauaaaaccugagggugugcaaaagaacacucagcacucagggcucuagagggacuugaaauguuauaauuacaggcaugaggagaguugaaggaaaacaaauggaagaaguuuuaagaugcauucauucugucaaguccaagcagagaauggccggcacucaacugcuaugcuaagaaggggccagcgaagaugggaagaguuagguaguucccccauucugugaccuggcucugaaaaagucagauacucugcuuuauucauguucuauaugauauagccaggccguguuagagcagugguccucaaacuuuccugugauucagaauuaaccugggacauuagguaaauacacaaaggcccaagcucuuuccuacuucaaggagccugggccuuggggugauucugauacacuccaaaguuugagaaugaccgaaucugugcugauaacuguaaaaccauauccugauaaccugugaaggaacugaaugcccuagacaguuuucucagccuugucugcacauuggaauccccugcagagcuuuuaaaucccacacguacaggccaccauccaguccuguuguaucugaaucucugggggugaggcccugguaucaguaccuucuuacagcgccucaguaauucacauuugcagccaaggcugagaagcaagcacugauuuagaaagaguccccugucacuguccucagcaaauauguuuuguuuguguuuuguuggcuugucucuuucccauaucauguggugagaauauugaggccauuucuuugugcccagaaaccaacacagugccucacucuguguuuuagaugcucagaacauguugguuauuugaaugaauauuucaagguauuugaauguugaauuaaugaauaugcaaauaaaauacaacaaaacucaccgcagaaguccccuacauugaacuguuuuguguaagcacaacccguuguggaguucaggcccucacaauaagagaguauuuauugaauaauuugcagaaucacaaucacggaguaucuguugaauaaucuguaaaacuguuaucaaccccaacuauaacuuacucuuccaggugagaugaggagucggggaaacauuugccuggcagaguguuaagaaugcuaaaaaauaauaacaauaaaaauaaaaaaauaaaaagcagcaaauuaagacauauuugacaccuacuacguggcauacauuuucauuuguucucacugaaucuucacagcaaacuugcauucucucuguuuuuuucugagggaagaaauggcaaaagcaaaucgccuguguugggaagcacaggggaguuuguuggaccccagagcuugaguucuuuuccaguauuuauuuugcugccauucagagcuucccuagccaccccugcugcuucccugaccugcuccugcauggcucaccaauggauccuagucacaccagcccccacagagugcuuccugacuucuccagugaaguuucccccgggaaauucucacuggcccaugauuugauugccugaccaccuucaaaacggguuagauaacucauaguaugcuaugcuaaccauguuaaaaagcuuauucucauagcuuugcaauggcuucuuuguaugacuguuccucgcccuagacagaaggcuucuugagggcaagaaugguuucuugccuaucuuuauauucccuuugccuaguguacuuccuagcccauuggagagacucaguuuuuucuaaggaaugaaugacagcagaaacucauccaugaugagcaaggaccuccugaaacauuucagcaugugugcauguguugugcuucagaauauuuuagaaacauuuuccagauuuaauugaggcuucugggaagccuugcuguguucuuccuugcaaaaaauagaaggucguuaccaggaagucucaguguaccauauuuaucuggugaguuuugaaaauacugaguaaugggacuaaugacucaacauaguauuuuccaaacugugagguaaucuuuggacuuugcaagauuauuauauuaaguguacuuuuuagucugucaguaaaaaauaaaaagccuguauuuucacauuagaauucaaagaacaucugcugcguauuguaaauaacauauuuugaaaaccaacugaugcauacucagccugccuccgcuugcuaacuauagcagguccuuaagauaagauucaguuugccauugguaccgcucuugcuuugacauuccacuguuuggugaaccaccguuuuccagaaaucuuuagacaccauucaacccucuaaacaaacugaguacagugagguuuucagcuuccuguuuucuagugggauuagaaagggacccuauuccuagaugaugauguguuuuucaaggaguuaaacuuagagagguuuucuacuggggccauuucuuacccccaaggacaugcauccucuggcuggaagcucagcucuuacugccuugcagagagccaccaguugccacaggcaaccgacugcucccgacaggaaggguaguauugauuuugcuggucugccuguaggggagcgggccaaagaggaaugcucagaggggcuccucugucuggggugugcauuugcacagcagccccauucauguccuccagccuguaucucaccuccucgggagacugaaaaacucaaucagcuuuucccuuguuccuucucaguuugucuuguuagcacucuuucuuagcaaguaagcaccauaugucuucuaugggaacuuguuuucaggagauucccagcgcaugugugcuggcugggaagagaggaauugguguuuuacuaaccagcagcgcuugccagagugcccgcuuuugaguccugcccuuccugcucaucugccccauggucuaguuuguccuggacacaguauuucacuggaucuuacuggggucgcagaaaauugccuggcuugugagggauuuuucugaaccaaagagagagccuguguggaugccucucugugguuccucauuauccuggguagucugugucucacaagcaccuguucauugaucugguccucuguccuugcgaagacgauagcacauacugauuauaggggcucuaugugauguuauugggcuuccuugcucuuagccagccacccaugccaaagcaugcagcugauauguucugcuuuugaaauaauuugguuucuguaacacgaagcccaccaccccccuuucaaccuuuaauaccugucuucuuugaaagccagcuuguugagcauccaauuugucucuuuucuucuucacuuucccccaguuuccuugcacucaggcugucuuuuaucaaaaacagagagugagccaaugacaccucauggcaagcagcagcaugaagcauuuucuucuuucaccuugacaucuuuucggcaaagaaaaagcaaggguugggaaccugcucuauucacuuuggcuucuacagcuaccucuuuuaaaacugcugguuguuauugccugguagcugucucccugaagguuuuaccaguuguuuuggaaggcuggcuauuuucuauucccuugggaauucaccuuacacagucauagaugcauguguuauguguauuuguguucauaugcuaucaauuaguaaugaaaaaucaggccaagccucuuugguacuuuuuuuuccccuacagaugaguagucaguguucauaauaacugccaaaacuuaucuugaguuuccugagugccauggucucaugucauucuuacaacaacuuuuugaaguaguccccauuuuacagaugagaacacugaugcuugacagguuaugcaccauaguggagcuaagacuugaaugcaaagauucugccuugaaagcccaggcuauucaaagauuaacuggauugccugggccugauacgguaucucucagucacucauuugaacuuugccaaccauaguccuaaaugcccaaugcuuauccuuggaaaggcuagauaucagcaaacaugagaugaguugaaaauaaucuuuguucugaaguucuaagggauaagacgcauugcuaccaacauauguggccuauuaaaugaugauucucaguggcacagaggagauugaccacugugguggggaagguggggcaaggacugagagagagugggggacaguucuguuauagcccaaggugauaaaggaguugugauaaucacuggauugauaaucacuauucuagaaccauaguguuccccuaaucauaaaagcuacuauuagccacguguuguggcucacgccuguaaucccaaugcuuugggaggccaaagugagaggaucgccugcagccaggaguuugagaccaaccuggacaauauaacaagacccugucucuuaaaaaauguaaauaaauaaauaaauguuuaaaagccacuaguaagugaacacauacuauauuucuggcauugaacuauaugcuuucauuuaaucauucucauuacccuauaagaagauacuguuaucucauuuuuucucuguaaaaugagauuucucuguaaaaugauucuuaguggcauagaggagauugaccacugugguggggaagguggggcaaggacugagagagagugggggacaguucuguuauagccuaaggugacaaaggaguugugauaaucacuggauugauaaucacuauucuagaaccauaguguuccccuaaucauaaaagcuacuauuagccagguguuguggcucacaccuguaaucccaaugcuuugggaggacaaggugagaggaucgccucucaccaaguuucagagagguuauccuggcucaaacuugccacaucuuaagugaaaaaaaacuuagacuugaacccaaauguguuugucuucaaagccuaugcucuauucuuuccuaauuaucagcgucuuuuugcccauugugauauuuaaucagaaucauuaucauuaauagcucauccaacugauaaaggaaggaaauaaaugaauuuuguauuuguggaccagaguaugugauugagcugaguaugcaaagauuugguccccuggucuacuggaugaucuuuucacaagugaucucaguuagcugccaugugcuuaacauagguugaaaguuaguugacagcuuugcuucacugaggauuguuuccagaauuaucagugcuuagugacuuugaagauaaacauggauuacagguucaaggagccuacgagagucagaagaguugggaauguguucccaacucuuuaacuagcuguacagaucugggaacugcacuuaacucuauucaaccucagcuuuucuaucugaacaucauguuagguaauuccaagauauguuuuagcucugaaugauaauugcuguuuaccgucaagccuguuuguuuuacacauacagaaaaacacucuuaacccaugaaguauguaguuaauugagaaaguuaaaggaaaaagucauaaagaagaaaauaugcuaucuacacuuaauuuuuaaaagcagcuuuauugugguguaauugacauaugauaagcuauguauauuuaaaguguacaauuuaauaaguuuugaucaaaguacccacucaugacaccaucaccacagucaagauaaugagcaucuucauucauuacuccacagguccccaucuccuuuguggucccuuccuccugcccauucacccagccccugccacauauacaaaaaaacaacugcuaagcuaccugauauaccuucugucacuauggauuacuauucauguuuagaguauuauauaacuguaaucuuauagcguguauacuuuuuugugcucucacauucuguauaauuauuuugagauuuuuuuuuuuuuuuggaaacaaagucucuuucugucacccaggcuggaguacaguggcacgaucucagcucacugcaaccucuaccucccggguucaagccaucccccugccucagucuucagaguagcugggauuacagguguauaccaccacacccggcuaauguuuguaucuuuaguagagaugggguuuugccauguuggccaggcuguucucgaauuccugacuucaagugauccacccaccucagaugcccaaaguguugggacuacaggugugagccacugcaccuggccuauuuugagauucaucuauauggcugcaugcauugaggccauuucuuucuuucgcugaguaguguauggauauaccauaauuauuuaccuuuucaccuacugauggacgucuggguuguuuacaauuuuugguuauuacaaauaaagcugcugugaacauucacauacaagucuuuguauggacauauauguauuugaaucuuaaggaaguaucuaggaguagaauggcuggaacugguagguauauguuuaauguuuuacaaaaaugucaaacuguuuuccagagugguuguaccgucuuacauuuccaccaaccguguauaagaguuccaccuccucacaucuucaccaacacuuuguaugucuuuucauuuuagccauucuuuuauuauuuuuuuuuuuuugagauggaauuuugcuauuguugcccaagcuggagcucaauggcacgaucucggcucacugcaaccuucaccucccagguucaagcgauucuucugccucagccucccgaguagcugggauuacagaggugugccaccaugucuggcuaauuuuuuguauuuuuaguagaaacaggguuucaccauguuagccagacuggucucgaacuccugaccucaggugauccaccugccucggccucccaaagugcugggauuacaggcaugagccaccgagcccagccucauuuuagccauucuaauacacaugcacuagugucuacuugugguuuuaauuuuuguuuuucuaaugacuacugauauugagcauauuuucauguguuuguuuuccauauguauaucuuuuuggguaaacuuucuauauaaaucuuuugcccauuuuuaacuuaaauucuuuguuuucuuauugugaguuugagauuauauaugaaaaaauauuguuuaagaaauaaucuaaaauaaaaauaaauauauucuuuuauuuauuuacauauguauacaacuccuuacauguauguacacacacacacacacacacacauucugcaaagauuugcuccuaguuuguggguucuuuucauuuacuuaacaguaucuuucaaggaguagaaauuuuuaauuuugaugaagcccaauuaauuaauuuauucuuuuauguguuguguuuuugguauuauaguuuugccuaacucaagguuaaaagauuuucuccuauguuuucuuauagaaguugcacaauuuuaguguuuaaauuucagucuccaauuucugaguucauuuuuguauaugaugugaguucauuuuuguauaugaugugacuucaauuuuguauaugguaugagguauagauucaaguuuguuuguuuguuugcuuauggauauuaaaguguucccgcacugcuuauugaaaagguuaugcauucucuacugcauugccuuugcacuuuuguucaaauucuguuguucacauguauguguuuauuuccucacccuuuacucaguuccacugauguaauuuucugucuuuaugccaauaccacaucauuugguuacuacagcuuuaugauaugcuugaaaucagggaauguuagccuuccaacuucuuuuccaaauuguuuugguuauuguagguuuauauauuuccauaugaauuuuagaaucagcuugucaacuuguauggaaucuauagcucacucugaggagaauuaauaccuuauugagucaaaccaugaacaaaguauuuuuucauuuauuuagaucuucuuucauuucucuuagcaauauuuuguauuuuuuaaugcacaggucuuucacauauuuuuugugugaucccuaguuuuuuauauuuuuugauguuauuguaaaugauaacauuuuuaaaauuuaaauuuuugauuguugcuaguacaguuuauuuuuguauauugauguuauauuaaauuaugauaaaugcacauacuauuauaguucuaguagcuuuuuuauagauucucuuugaucuuucuacauagauaguuauuaugccugcaaauaaagacaguuuaacucuuccuuuucaaucuggauuacuaucucuuuuccuuguugauucacuuuuagaaccuccaaaacaauauuuaauagaggugagaguggauauuucuguucuuagggcaaaagcauucaguuguucaccauaaguaugauguuuccuuugggauuuucauauauagccauuuuccguuugaaaaaguucuuuucuaauccugguuuucugauuuuaucaggaaugaauguuugauuuuuguguguguuuuuugaugcuuuuucugcaacuaugaagaaaaucauauggucuuucuuuuuuuuuuuuuuuuuucuuuuugagacagggucuugcucugccacccaggcuggaaugcaguggugcgaucauagcucacugccuccuugaacuccugggcucaagugauucuccuaccucagccucucaaauaguugggaccacaggcaugcaccacuaugccuggcugauuuuuuuuucuuuuuuuguaggaacagguucucccuagguugcccaggcuggucucaaaccccuggauucaagcgauccuccuaccuuagcuucucaaagugcugggauuauaggcaugagccaccacacccagccaggucuuccuuuuuuagugugugacuauggugaauuauauucauagauuuccaauauuacgccauucuauguacauuguacauacauugcuaaggucuuuuuuuuugcuuauggguuugcuuuuuagagcucuguaucaucuuucuuauauaaauucucauccauaaugcauucucuacauucucaguuucaguuuaaguggaggcagaucuuggacacuugucaaguuuucaaguccucuagguuuaagauuuguuuuguuuugccagucuuuuauaauuuccuuguccacaccuaaguggauagcaguuuaucuuuaaguuucucaccuuuagugagugucuaaaacacucuuguuugguuugagagaagcaacaauuauauguccauauucauaguucagcaaugaagguaauuauuaauuaaacgauauaauuguaauacccagcacaacuggguaaaaaaauaaaauaaaauaaaauaaaauaaaaauaaauaaaaacuugggauggauuacagcugaguguugguaagcauacagcccaguggaggagagcagaaguguguagacuagagaauagccaacuagacucagauuuagugugcggugguaagcuauucagagaguggaaacaauuaguuacuccagggaauuacagaaauggaaacuaauagagcuucuguaauucucuuucauuccuauaaacaguauucccuuccuucagcaaccagugggcaaagguccagaggucaccuucuauacgaggaacacaaacuagucagcacugaauuauccucacaauuagaaaaacaccugugaccaaguguggauccuugcaaugggcuuuaacuauaccuguagcaaauauauggaagaacccuggauuuagagucaagugagccuggguuugaauagcaaugacugucucuguguuguugagcagccuugggaaaauuaguaccucagagggucaucucaaggaauaagugauagaacauguaugagacagacacagaguuguagguaugccuugugugugguuuggauccuuguugcaagauguuuacacuaucuagagugguguguucuacccaaccauaugauccuccugcccaaaaaguucccuagcucuagccugucgcaacauuugaugcaaauggagaaggaaggacauugaaggcagagaaaacaguuugaccgagguuagguggcaaggaaggagaaagcauacaugggaagaugugagcagucaggauugggcacaagguucaugcugagguaggggggcagacaagcugaaaagucgccugaugugcgaccaugccaagccgugaagauuggcuggauucucucaccucuccccucacaccuuauauaggagguugguaagcaaggagagucacugaaacuuuucuuuuuaagggaacgccauggugagagcugugccagggauucucaaaccuugacuguaucagaaucaccugggagcuuguuaaaaaauacauauaccuugggccccacccagacuuacucaauccuaaucuauagguuugggucaaggcaucuguauuuuuaacaagcucccuaggcaauucuaaugcacgccaaaguugagaaaccacugcuuuagaagguuaaucuggcagcagcguacaagauggauuggagcugagagagccuggagguucagagaccugcuugcaacaacaaucccggcaggagauaaugagguuaggggcugugggaauggaaaggaagaaucagauaugggagguauuuuugagaggcagucagcaaggacugggcaacgaauuugauggggaaugugagggagaaaugggacuuaacaaauaaugucaagguuuagagaagcugcucuccauggcaugaagggagagguaacagaauccccuggggaccuuagucaaauugcacacaccugcuccccuuucugugcucauccuccacaucuuccuccuucccugcaaguucccugagaugugugccaggauggggcauaucagcuccuccuggggaagccugcauguguaguuugagggggaaacuuuuccaggugacacuucuguugcaagccacuuguuaggcaucuuugagccugugagaauagugguguggugagauuaggaggaaggagggaccaagcuggagcugaccacaggacaugaaauaaccuuuggaggcuguggaaaugugaguucagagcuguggagcaagaagugggcugugauauaaauucaaaaggccacugcauggaggucauggugaagacagaugagaccguggagaguagagaggaaaggauccagaaugaagcuugaagaaggccuacgguuaggagucauaugcagaugaagggucaaagaagagcaggcugcagaggugggaggagacugcuucugcuucaaggccaaggcaugaggcagacaucuagaaagaucugcaaacaggagggcagaacucuagcuccucugccauccuuccaccagcgugauuuugugcaggaagcaguccagucccccaggaguauguggcacagucauguaaagggguuaacgcuguauaggaccacacauuugaaaauuuucuuuacaaaauccagugucuuuugagcugauguaccagagacugacaggcuguaacuucuuacacuauuccccccagguuucugaucaacucauaaccuucuauacacauuuuuggcccagcacagccaaauguaagguauuaaaaaucauuauagugcuuugggguccuugcuccccgcaaaguuccagacaugcugccuguauuuugugaugucacacugugaaaauaggauguuguguuuuggaggcaccuccagggugcccagcaauuggcacaucuuaagugaaagaaaacaaauugagugagcaacaguagaaaagaaggacauuuguaucaacccaggaaauaaagaauuacgcagagaugcuauuuaugcugcuaugaagcugugacuugauagggacagcauaaagguugcccacuccugacauuggcaagacuucaggcugaccagagccacuccacugaaguggggucagcugucucagaaggugcucugugaagcugacgcagaaucacaguuugcuguaaaaagggcuuacacauguaaaaccuuguauuuugucuuagaaguauccuggaagcuaucgcauuuucuuaguagagacacagaggcaucaaguaauaaagaaacgauuccaagguuccagacuccuggguaguugggcaggagacucaaccuagaguucugguuuguaggguacagagagaaaggcuugcaugcgggaagagcacauuuaagaaucacuuggggaugggcguggguuagauuccagucuguugcuucuuaacugugugaccuggggccauucauuugaccuuucugagcuucagucuccaauuguaaagggcagaaaaucauauuuaccuccugagaguaguuucaagaauuaaggaugaaggcaccauuacagcgcuuggcaugaaguugauccccccaaaucgaugcccaucaucauaauuacuggguuuuuccccagucgucugaacacucauguacuccccuggaugcacgcaaagagacacugcuguuuuccuuuggcaucccuaguuuggauuuuaaaugcuuuuuuccucauuaaaauaauguuauagcuggaaggagcuuaggugcaguugaaauaauacuguuacgaaggucuguccuucaaggcauuuauaaacugaaugggacuuuuugagugggccuggacaccaggauuuuacgggaaagguacccuagcccccuuuuuuacaagugaacuuuuauuaagccaccagcucucagaacuugcagaauugcuggaaaauugccuugggcaggguauguaaucacaaaaugaauaaaagacaacaggaugugagucuuuccaaagcaugggaauagcacacugcaacuucuugccaucccuacccugggcaaagaugcagcuaaccagcuacauugauacuuggaauuaagucaggaggcuuggccaggggcccccaccauuccacaccuugggccugacugccacucucaguacagguugcuaauuuaaaugccaucuccuggcacugcauguugaaacaaacuggaaaauagcagggccuuuccuucaucagaucaucaaugucugccuggcgucugccugccuacuguggccaacaaccugccuuccugugagcauccuccaauguacaaauaccucaaggacuccugaccucugggauuucauggcuccuguccauucuucucucauucucuuagcaaaagaaauuacuuaagaaugggugagggauggagacaucucucagcucccuauggggucuucuuuccugaacaaacugagcagagccgcaaaagaauacauaaggaaggcuuggcagaauguuuugauacaaaauucauuacagguuuguuuaugugcugggcaguuuggguccucuuacacguguguagacacugcauuccuucugguucaaguuuuguguuuagagagagguuuuggaaggagaucaaagaugucagauugcuggccuaauucuuaaaagaacugauuuggggaaaggcuugaaaacauucauacccagguuugaaaacaagaaguagcaaugaguccagaaagcuuggugacauggauaacaguauauuuuuaagaaaaagagaauuugaaugucuucugcacaccuuauccgucccuaaucuccauaucuuccauauguauuuuucuuguuuuauaacacugucuaagacucgaguguaaaauccaucauccaucacccaacccucacuuuugagugggcagaggguguuguggaggugacuggaauucauuggggucauaucuaagcaugaguuaagagaucuaucugggacuuugucuucuuucauguuuuuucuuccuucuuuacaguacaccgucaauagagauugcuggcuugucauccaguuuccuaaauuuccugacuucugccuugucuggccuuuauuccugucuauaucucucuggcuucaaggugauaaaaaugcucacauuuucuuaggaaauauucaguuguauucucuuuguugugaaggcuccuuuguccacuccgucuccuccauuuaggggagguuuucagggauaauuagugaacucagagggauaugauguaccuuuucaaaucagggucuacuuccaguuuuucagguuuguuuuaaaguguguggcucaggcauagagagcagcgguuauuuggacaccuggaguuacuuggcuuugcuacccacuaccuuuuaaugugaagauaccucauugcauugcucugcauaugugcagaggaaauuuggggggacccuguucaccuuuggcauaucuugauaguuguaugugccugcuuguuguuguuguauauugcuacagcaauauggcucaucaucuuucuaccuaagaagauacaggggaaaagaaaacacugccauaaucaaaacuacagaaauggguuucauaagcauuuucucuaacuacugcgucuacccagauccaauaggaaugggagggcauuggcaucguuagaaaccggggcaaaaguuccugcugcaauauaaaaucuauagauuacgcuuggaaucaguggaaaccauugcccuuuaugccagcugcuuccugaaggagccaagaaaaguguauaguucaggggaaaugcaaauauaagcucccuccuaccuauagcaggaaauuagaaaccucuuugguuagcacaaacagauuaugauuuuuuugcaagagagaacaggagagaggaaagauacuugagguggcauuguauaccauaaagcuauauuuaugugcuaagacaagcaauugauguuguucuauaaaauauaguaaacaccuccucccugcccuuuugaaugucagucagaauucagaaucaugaaauuuuauaguauuacugguuagaagggcuucccacugggagcagaugccaucucugucuucauagacucagagaaaguccugacauguuucauggcguucguacguggaagucugugaaauggaaaggaaaacagcuuuuucugucaaccugucacugauacaagcuuuuacauuccaucagaaugacuaaacuuuaaagcuguuuucuucagugcugaguaucucucagaacucccaaguguuaucagauugauagagucccagcauaugauagaagaccaaagcauuuuguggcaugauauuaaaaauucauucaaauacucgauaaagcgugguugacaaaagugugaaauggaauaagguagagugaauuucuucaugguuuauugcccuugauuucucuccacaaaauaaauagacagaauggacuaaaaucucuucuuuaugaaggugggauccuggcagcugaaggccugcucauaaaaauccucuccgugccacauacccuugcaauguucaaaguuggaagcaauggaaauuuauugcuguuauauguauucauguuucagacugagugaauagguaggggaugcuuuuaugagguugcugagacccugugaagaauagagaaauaaaacacacuuguuuuucccuugaagcuuguuuuuuucuaggggggauuggugauuuuaguaauuauagugguauuggcaauucaugguggugguggcggccugguggcaguccucccccugaagguauuuaaaagaaaacacucuuuucacggucuccccuuccugccugccaucuuguuuugaaagagaagcauaaaauagcaaaucuuuaaagccacugcaagccaagccuguguuuucaucugucucccucccuugccaggccucccucugccuuucugaccugccacccccuuccuuccuucugucccucccuccucucagaggacauggggagugagaggcuucccccuguuucccugcaauggugggacagaaugccucauugguuucagauauuaacuucugugcugaaaacccgguuggagcuggugugacaaauggauuguaccugcugcuggaaaacacagcccugucccacccgccugcacacacaagcccucuuccccaucuugcagagcccaaccuagggagcagggaacagagagcugccccgcggcaccaucuguuucugccagcaucuauguugggccccgccgguuacaucuguugagaagaacaguguacuugaugaguuguuggaaagaaauguuuagucucccccaucaucucuguuagccauuacgaggcugcugggcucacguggguguaucuaugugugcuuccucucaggccucaucuguaucaauuggaaaucagucacugggaguuaguugcagucagcagggacccaaggcauuucccagugacaucaauucgucuucucuugcagaaauucaggaaacaauuaaaauucugaugcguuccagggaggauuucaaauaaaucagccgauagcugauaucuuguaacucuugguagcaaagcaaaauuaacaacccagccgcaucuguguacaguaugcuaaaauaaagaaauuaaccaugcaucaccuccaauagaggaagcagcuggccuguucucaaccuucccauaaguacccaaaaccuacugauuuguuaaguugucauucuccuuauggacaucaaggacuuccugcauaugccaaaaacugagcuggccaaauaaucgguaaguugcggaaaauccaggcaccgauuaagcucaguuauaacucccauguuaugcagaggaaagcugacauuuugaggcggacccaguugauagcugcugaggagguaauacaggaugcaaguagguuuggcagcagguuuagccagaauuuugucagaauuugaagauuuuggaaucauaaucagauagccaguauuuucucucuccccucaaaccaaaugcauugugcaagaacuuguguuaauuaucccuguuaauuacagugauaccaccucagcuuuuccaggcucuuuuuugcagcugucuuuguggugauuucuugucuuaccacuugcugaccaauggaacucaccauucuugcuagguucucuuaaaaagcagcauaacaagaaccggucgggaguauguucccuugaaaaauaaaaaucucagcaucacacccaaguaaaagccaugugccuuauugaaguucuaagucuauaguguguuuguguacaugcccgucacauaaagugauuguuuauuaguuucaguggauuuuuuuccuagaaagaugcauaaaauuuuaaaguaaaaagaauauagugagccaggugggguggcccacaccuguaaucccagcacuuugggaggcuaagguaggaggauugcuugagcccaggaguucaagaccgaccugggcaacaaaaugagaccucgucucuacagaaaagucaaaaaaugggccgggcgugauggcucaugccuguaauccuagcacuuugggaggccaaggcgggcggaucauggggucaggagaucgagaccauccuggcuaacacggugaaaccccgucucuacuaaaaauacaaaaaauuagccaggcgugguggcaggcgccuguagucccagcuacucgggaggcugagauaggagaauggcgugaacccgggcggcagagcuugcagugggccgagaucgcgccacugcacuccagccugggcgacagagcgagacuccaucucaaaaaaaaaaaaaaaaaagucagaaaaugagaugggaggaucgcuugagcccaggguguugaggcuacagugaauuguaaucgcaccacugcacucccaccugggugacagagcgagacccuguggaaaaaaaaaaaaaagaauacaguggcuggaaaacaaaacaucacuugaaaauuuucccaccuuuuaaauucccagcacugggaaggaaggggucugguaugguagugaucguagggucagcucaggaaaugguucauagggugagcucagugagaaucacauuaggaugagaggaaacucuuaagcagaaccacaguggggacauucaagagugguggagaaugaaugccauuccucugccuguaagagggcacauuaugagaaaggucaaagaaguaaggaauggaggaagauagggaggucuaaucagggcagagagaacaggaaaggguccacuuaaccccuuaaaaacagcaacuguugucacccaucuagugcuuacagcaccuggugcauucugggugcucagcauacaaucccugauaaucaucacacuuuugccgacaaaguacagccauaaauuacuucccccaccaccuccccagucagcagggagcugcuugcuacaaaugagugaaaauauucagguacucuuacaccuagagaucauggagagaaguaguuaggagcuguguacuauugagauaggaagcucuuccacacaccuugcugugggcuuccuuugcacgcugcacugguuacaucagacaugcuuugugcucugcagccuuccuauuuaaacauuugcccucaaaaacuucacgacaagcauaugaauuagcaguuuuuccaaccuaaagagaauuaucuacugucucuagaugauucucaaaauaugcugauagcaauuugaagcauuauaaaucuauccagguugguucugaccauguuguagaaguaauuucaacuggcacgucacaugaaggaacagauuugaaaacagugguaugcaugccccugaagguuucaucuuggcuaauggucucaccaccuuauggcacuacuuuggauugugacaacgguaccaaagaaaaugucuauagucuggaaaagauuuaucacuaaguaugacugucuaucacucuggauguacccccuuguuauaaaucuccagcaagacugaucacuugguauacguaagcauguagguacaugcauguacaagucaggagugugcuguguacuugucuaguaucacuugguguauuaguauauauauauauauguguguguguguauuuauguauguauaauaacucauagcaaauguguggacauagaugagaauauagguuauuaguuuggagaaagacuuaccaguuuguggacauuguauauacagaaauucucaagauuucucacaugaugugugugcaugugggcuuguacauguguguaggugugcauuccgacagugucuuccaugagcgauguaggguauuauugacuugaggaagcaaucacugcuuacaugaggaggcgugucaucuugaccagcauuuaaugggaggggaaagccuaacuccguaaaaacgcaacuguuaaaucuuaacugccuuagccuuucauucugagcugagacguuauacuaaaauuucuaaagcagagacauuguuauuuuucacguauuaugcuaauaaaaauagugacuggugugacuuagugauuggagaaaaggggcuuaggacuguaaauauugguagacuuuccuuucgguacaccuuuauaaguuauccauuuaaucuuaaaggaaauucaaaugccaauucaacugggaaaucaaacucugaugcaggcaacucagggaccuguucucugacccacgcacuugaacaguguucacagugagaacaguugagugcauuuagaagcuagauccacuucaagaaguuagcaguaggaagcauuucuuuuccuguuggcugggauguagagggguguuagaacuuuuucccucuacuuuugcaaguauguuuuagggaacuuuauaauuagcuuuugugcauauuuuaauuauuuuugcccaucaucaggugggauuaauuuugacugagagcaacaguguagugguugguuugucucauguaaaaggaaggcugggccuaggcugcagcucagugaugcuacuaggaacugaagcacuuccuauuacugcucuaccucuuccccauguagaaugcagucauuacuuauguugccucacagucauaaguugaacuucagauuucauaucuuaaaucuggaaaguacaaaaggcucugucuuaggaggguuugucuuuuauuuauuuauuuauuuauuuauuuauuuauuuauuuauuuauuucaaacagagucucuaucgcccaggcuggagugcagcagugcaaucacggcucacugcacccuugaucuucugggcuugauugagccucccacaucugccuccagaguagcugaaacuauaggcaugcaccaccacacccggcuaauuuuuguaugcuuuguagagacggguuucgccaugucucucaggcuggucugaaacucaggcucaagugauccgcccuccucagccuccaaaagugccaggauuacaagcgugagccacugcgccuggcuggguuuaccuuuuuauucagguaaggacagucucuucugggauuuguagcaaucauuggccagaacuauaucaaauagucauccccuacauaugaaggaacuaaggaaauaaauuauuauuauuauuauuguuauuauuauuauuauuauuauuauguuugagauggaguuucacucuugucacccaggcuggagugcaguggugcgaucuuggcucacugcaaccucugccucccagguucaagugauuuuccugccucagccucccaaguagcugggauuauaggcacccaccaccaugccuggcuaauuuuuuguauuuuuaguagaaaugggguuucaccauguugggcaggcuggucucgaacuccugaccucaggugauccgcccgccuuggccucccagagugcugggauuacaggcacgagccaccgcacccagccagaaaucaauuauuuuuaauuaaacauaucacugcccugaaaaaaaaaugggauucuccuuaaaaaggaagaagggagacguguaccuguaaaagagcacugcuggaugauauauuccccuggccucugaaaaugcacaguggucaggccaaccggcucauuucuauugcaugauaugcacaaaucaccauugaacuucaaaaaaauccuaaaagagcaagucucaagacagguaaauccacagccacaauuacuacuaaaugagaacuuuuaguuuggaaacaagcaccuagagaaugccaaaaagucaauguuccugcagauacuagaagggcacagcauagguaaacacacuuuaucaaguacugugauacugggauguugaagcuugccuggucacauuuaaaaaaaaaagugucauuuuaaucagaaaaguuuuaacauaacauacagucaacuuauaaaauucauuacaccaaaaauaauauagauacuacauauaauuagagucagauauuuucacaguguuaauggaugauuccaauccucagucaacagacaguuauugggaaccuacuaugugcucacagaccauaggggaauauagacuaucugaacagauaacuaugacaacauggcagguacuaaacugggauaugaacgaggugguuuugggaaacaggacaaaacagccaacgcugccaaggauuguugaugaaggaguuuaaacucuuuccuuuuuuuuuuccuuuuuucuuuuuuuuuuuuuuuugagacagucuugcucugugagcgaucucagcucacugcaccuccaccucguggguucaagcaauucuucugccuuagccucccaaguagcugguaucacaggcacccacuaccaugcccagcuaauuuuuguacuuucaguggaguugagguuucaccaugguggccagacuggucuugaacuccugaccucaagugauccaccugccucggccucccaaagugcugggauuacaggugugagccaccaugccccgccaaacucuuuccuuugguguuuauauccuagaagauaaauuuggccuucaacaaacuaucccuugauaaccuuaccagaauaccugggagcagaccaggguagaaguucuuauauagucuuauguucuuauuuuuagcuuccaggaaauucaaguuugggaaaguaaagaaugccuggauugauacuaagagaauaagugaacuccaggucucaaaauuuugcuaaguaaauccuugucaaggaucuucguagagcaaggaaucuaagaugauuuaugcaucuguagaauaacaccauaaugaagcuguuaaccuagccaaaagcuuugguggacaugacaccuuaaagguggccauuauaaagugagagccucugacagcuuuuucaugguuuuagauaaguggguguuugaaaucauucuggcagcucaccaaauguuucuuugcaucuugacuacuggaugaaucuugacuacaaguacagauuuuauguauacuuauuaaaauaauauaauuuggcugggcgcaguggaucacacuuguaaucccagcacuuugggaggcugagguggguggaucauggggucaggaguucaagaccagccugaacaacauggugaaacccuaucucuacuagaaauacaaaaauuagcuggccaugcuggcgugcgccuguaaucccagcuauucgggaggcugaggcgggagaaucgcuugaacccgggggucagaggucgcaggagccgagauugcaccacugcacugcagucugggcgacagagugagacuccaucccaaaaaauuaaaaaauaauaaauaauaauauaauguaugucccagccaccccaugcccugucuggcacuacugccagcacuggggaacugggaggagagcugaggaacagcuccccuuguaggcuccuuugucuucauugauugacauauccaaggaguccuguucccagcagugguuccaauaugagcaaaagcaaaucuuugcucaucuucaaauagccuuguguauuuaaguaaccagaauguuccacauuucugaaaugacuaucucaccuaucuagaauauaaguuauucuaggcagguggcaccugugucuuauuccucuauccuaaaacagaggagggauucaguaaaugauugcugaaggggucuacauuagagccaaagguggucugagcaauccagccuguuuuagggaccugggugaaaaguccuggggagucagaagcucugugaaaacaaguagagggaaacagaaaagacaacaaaggggugacaauguuuccuacuuuccauuugacaaagaaccuggguguauuguaguuaauaucccugggggguuauccugagagaugacauagaagcuuguuguuuuugguauaaacccgcaaugucuucuuaucuucauuccccuuucucauuccuccuuagaguuaccuaagcacaauuucuuuucuuguuuuguuuuguuuuguuuuguuuuuuugagacagggucucacuuugucacccaggcuggagggcaguggcgugaucucaguuuacugcagccucuaccuccugagcucaagcaauccuccuacucagccucaaguagcugggacuacagguauauaccaccaugcccagcuaauuuuuguguuuuuuguagagacgggauuucaccauguugcccaggcuggucuugaacuccuaggcucaagcaauaugcccgccucggccucccaaagcgcugggauuacaggcaugagccaccaugccuggccucucuuuaaacacuuuuugcuuacacacugcuuuuggaaugaaaagaacaaggagacuucagucauauccuccuggauuugaaugcuaaggagcugcguaacauuucugaaaucuucccauguuuauuaauaagagaauaauucuaccuaccuuguaggguuaaagguugaguacgauagcauggaagaauuugcccagcaccuaguaggcugucagcgccuguuaccuuuccuuuccccaaugcucccuaaagcuaaguucauuggcccaucauguagaguaauggguccacaggcggugaauuacuugugaugcucuuccaaggacugaaugaggagagacauuuuaaucaaagcaccagcaaagcuuuuguagcgaugaacauacaauuagugaccuucuccuaucagggauaaucagcagugggacuggcagaauuggaauuuuuuuacaugggugaucugggcacagauacucagucagcucugugucgcuuagaacugggaggcaggaggcauuugcagguuggucacaaacuggguaucagacauauuaagccugcauucaucugacaggccuccagaacgugaugucaggagagacguuuagcaguggggagacaauuaugagacucucagaggugagaaagaggauucugcucacugccuagaaagagagaauauggcauuggaaagggggugguaaaauauguugccugacacacaccgaaaaggccugucaguuacugaggucccaucgccgucucaggcuuagacugcaugagaggaucuauuuaggggaaaaaauguauagcuuagccccaguggcugcuggggugaaucuccagggcucaaagcacgaguuacaguuugucuuuaguuuacuuaauaagcuuccuggacugucugauuucuuuacagccuggaacagaggguaacaagucucccagugcaguggauccaaaguuggugggcuucaguuugggagcaaagagcucacuguuugggacuggguugaugucaucauuuuaugacagcauauuaacacagaguaaauaguuuauuccccaggguacucacccauucccucagaggugagugucaacuccuucgagagaggucugcucaccuaaccugccaauucucaaagagccccaccucaggcauucucauagccuuucucuggccuucguaggucuuugucccauuccccgaugauaaugccuucaugacaaagaugaaaugaagguugggggcagccuaggcuguaguccuggugcugcaccacuagccguagagccuuggccaagucaugccccucucugauuuuuucauuaugucaacuggaaaauauagucagacugccugcccugcuugccuaacagcacagucugaagcaugagcugauggaauacauguguaagcauauugcauaguuugaggaaguauucauguauacaguggugauauuagacuuaagauuuucauuuuuucaugaaauugaaacuagaccaucugaagucauugaaauaggaaaaacacauacaguauuuuaaauuaguucuacucaugcagacaaaaaaaaaguguccugguacaucguuguuuaagaucuggugaucuguaguguuugucuaccaaguggcuaccguaaguggccuccacuugauaaguuguaacaagaucacagcaaccccaacaucucugccacuuucucuuucucucuucuguuuuggguggagagacaucuauauuguggcugucucagaguuacggggagagcaagucaacgguaacagggaaaaacaagccuuguguggguuggaccagaccauuuguaaggcucuuggggcauuugugugcacgcacacacagacguuaaccaguccagaaaugagugucauucuccucacacagcgccgacagcugaguucuucccugauauuugcagaccucucugaagcuugacuuugaaauccucuuuuccuugaacccuacgugugagagagaagcccuucuuugccacucaagagugguucugugguaacaguggcucuguggaucuuuugucccuggcuggcuccuucauauguuauuguaagguuuuaguuugugcuggcaugcagguguguuuuuuucucacucagauuuucucuuagaugcuguaauacaaucuauaauuuuugguacaggagcaaguuuuuacaaaggaagauaugugcaauuugucauuuuccagccugaugacauauaauuaaaccuucaauagucuaugccuucaauagcauaacuacaacaacccaucacacuuuggaaauaaauuuguuucauauuuuauauuaucuggacucucuuuguccaguguguaacaggcccccaggaaacaggaagucccccacuagugagcaccccuaaugugaaugacugcacacucagccuauuuuggugagaacaggcagcuugcuuucggugggcucuuuugaaugggccuugcccaagcucaaugcucucucucuccucuuggcuuguggcaccuggccacaguagcaggcauugccugcuugaaaagaggcuguccuuggauuuuccugccucuuggaacacagagcuuaauucaguucccuaacuccgggaagaagcaaugaucuucagcccuaugaaccuguccggcaacccacagcggcccacaaaauauguucucucgccuacaaccucaucccagcugcuaccacagcccugccgacgcagcgccugcugcggucacgguccacucccaagggacacugccuuaugucagcaggcccugucuugauucccaggugcugggaagacaugauugcagccuccugcaccccugcuccccuccucugacacacacacucugagccugcaagguacagcagcccacuaaagcucuaguuaaaaguaccaaguugcuggaaugcccagggaagugagaaugagcgggucucacacagggaugauuugaaacaagccuuguggcuuuuuaauaaugugccaaagcggucucaguggugggccagcagggcccccagucuaucuucugugaaaggagaaagcccagcaggcccugccgaaugcagacagccccuccacucugcuggaggagacagacuccgagauggcaaucaaggcuugauuugccaacacauuuccaaugauuaaaauguaauuagcacaacugagugccuccuccccagcuaauuuuaauacaugcugugacaggcaggcagccggcugugccuuuagcccagcagcagauggaggcagaggcagcgggagaggaaaaccauuuugcaaugugacuauucgcaucacaaaaccaucagggcgcucagcucuuagaaggcccuugauggcagcacaucaaauuggcgcugucauagcugaccguggcaauggcagucauccuucauacugucccagaagcacagcgaggcaauuuccaggcguaacccuuuaagaucuagaaggggagagagagacuuggagagcacacuugucgucuugcagugacaggcgagagcuuugcaaugugcgcugugaaacccacgcucuuggcagcuugcaaaccguuacuuacauguuccuuuuccaaggcacaguggagugugguucagaagcuuuggaaauagcuguuucuccaaaugggagacaggcgugagcugccuucugugugcauuaucugaacugggaaggaugagcuuuucagccugagaugguauggcagguuggagguuuccucuucuauuccauucaucccauagaagccuuugagccuggggccucucaucaugaccaucugcuuuucuccuauccugaagggcaugucagacaagcugcaaaguccagaagaccguuugccuaugcuccuguucucucaccuccuggcagaaacacugggcccucaccacuguuguuuggccugcccucuccuuccaaggcaccaccugaaaaggaggcaagcuccuuggaggcuaaggaucauuuggaccucccugggauuggggugcacaggauaaucacagggggcacuugugaucuuugggaucugucacccaggcuugguggcuaacuuucugugugugugugugugugugugugugugugugugugucuguguguguagacggggucuuaccauguugccccagcugaucuugaacuccagggcuuaagggauccucccaccucggccucucaaagugcugggauuacaggcaugagccacuaugcauggccugguggcugacugucauagaacaccaaagcuagacaagccuaaauaauaacagugacgaugcuaagcauguauugggcauuuaccauggcugagaacuauguuaaaucucuuaaaugcauuaauuuucucacuucauacccacacaaaccuaggggcuccauauuauuauucccauuuuacggaugaggaagcaaagucacaguaaggugcagccacuuucccagcuucugcuguuaaguggcagaacccaaauccaaauacguaucuuucuaacuugugagugggacaaaaaagucauagcugagacaugcugcaccacagagaugcuucaccaguggaagccucugagcagagaaauccgaucugaaaacaaugggauuauucuuugccaucuaauggccucugaagaucagcagccaugggaaccuccagaacuccaucacacgggugacguuuacaugccguugugcauguguaucuuuuucuccucuaaccgaaaaauaauauguaaucguuaaagaucaaaaacgacaguaaauguaaagaugaaaauaaaagugacccaaacucuuuaucacucagaaauaaacaguguuuggugcauuuuuuuccaguguuuuuuuuuucuuucuguguguaugcuuagcaauuuuaaaguaauauuguauauauaacucuauguaucuuguuuccuucauuguaguaguaauaauaaaaguagcaguuuuuaauguauuuucuccuuacugcuaccuugagagguaguuacuaucacccccguuuuauugauuaaaaaaagaaauugaaccugugggaggguaugugacucacccaaggucacuucaguuagguuggugaaaaguaauuccaguuuuugccauuacuuuugcaccaaccuaauaugauuuuuuuuaaacuucccuaugacugugaucacuuuuccauuucagcaaaauucuuuaugaacuuuaauuuaaugagugaacacaacccuggcaccuugaccuguuccccaauuugguaacauuuagguuuaugaagucuguguacuagguuagugcagagaguuagaaacaccaggauucaaaugccuggaucuuccucuuauagauuuaugacucuugacaaguugcuucaugucuuuaagacuccuucuuucacuguaaaauuggaaaacuaaaaccuacacacugggggcugggggguggggggaguuugcuguaagguuaaaaacgugaauauaugaagagucuaucuuagcagauuucguggcccuugcuaugugcugacaguagccauauaaauaauguauuauugggucauuuccuaauuccauaaugaaauuuuuaaacaaauuauuauagacauuuuuguuccuuuuugagacuaguugagcuagacaguauggaaaauaugaaggcucuugaugcaugcuucucuucuucugaugcaaauugcaaaauuauuuuccaaauagaaauugacauuccuccagaaguauaugagugucugccucacgacagccuugccaacacugcauaucagcauuuacauguuuuuuucuaauuugauugaugaagagaaauauaucucuuuuuaaucugcauuucuuugauuacuagugagguggaacauuuuuuucguauguuuauuagccauuuauauuuccucuuccgugaauugaccucuuugcuuuugaaaggaaggaugagucuccaagggcuagcuagagaaaagaugcuccagugauaauuaucucagagcccuggggugaggaguugcaggggagagaauuaaaggucuccuggggcuaugaggcggcuacuaagugagcggcuuucuacaccagagcgaggcuuucuacacagucagcuugaaaucaguauuuguucucuaccuuuguauuuguucuguuaagaaauauuuuggauuuuuuagugggacucuucacauucuacucaagccagcgcuuauaauucuuucagggcagacaacgagcaugccuguucaguuuggguuuuuugcucugaaagucccauugguuuacagugaaguugcuguaggucuugcuugagucuuuuaugaucccugccauccagccaggagcugugacugcucuguaaccuucuuagauuuaaaucuguugcuuguguucuccucauaguguuacagagcagcagaggccauccauacugaugucuuaauaucauucucuccuuagauuuauaggguaaaauaaacccucugccauagaagugcuuauugauuacugaaguacauaauaaagccuaagaauaaaguaagaccaaguaaucgguucuguuccugggggaugacaauaaacucuggccgaggcagccucugaagguugccuuuugccuuggagcuaggaggcuccuuuuuaauugguugucaaaauaguaagcagugacugauagaaaucagacaaaaagaguacauacuguaugguuccauuuauguaaaauuuuuaaaaauaccuacuaaucuguagugacagaaggcacaucagugauacgguaagggaccugagagagggauagaagcuuuggggagggauggacagguucacugucuugaucguggugauggcuucacagguguguacacauauaugaaaagcuaucaaauugugcauuucaaauacgugccuuuuaccaaugucaguuauaucucaauaaagccacaaaaaaauagugaacaguaucccauaaagagacaauccauggcucacucugugcuagaaaaauuuucucuuuucuuagaaagcuauauuuugacaaacauucagggggaauugugagacuacauuucaccuucaccuuuagcuaaauagggguuuuagaagacugaaagaugccaccggaaauuaaaaaagaaaaaggcauaagaagguaggauagcccucuuucuucauuccuuuuucuuuccuacaucugaaccuuaaaggugccuuuuaacauaauuuuuuaguaaaacaaaaaaagguauuuagaaaauauuaauucuuuucucucaucccccccaacccuucugcuauuacauuucccccacccagaaaagagauucuacagugcagaguaaaaacuacuccaaaauguuggcagucuaaaaguggacaggcauuuucaacacaaagagauguuuguuuuccuugcauuuuaacucuuaauuuuugacacaguagggaacuccagcauggcugccauuuaaaauguaacaaugccaugcagcucugauugccucugucacagggguguugugacugaaggccaggagacaaagcaaaugaggccagagacagugccugcugcugaagugcugguccauuucuccacccgcauuugaauuugucuuuucucuggcuaacugcuuuucugcccugaugaggagucacucggggagacugaagcuggaauuuguacaaccucuuucaguccccuugauuuuaaucagaaauacacaauuauucuuuuccuccaaauagagaaacucaauccccauuuuaaauucaauuauuguaauugcagcauucagaaaaauagcacauucauuuucuaauaagagauuguggauaccaaauuacugcauauaguaugucaaaacaggaaacuugagacuggcaaaccaguggguguuuuuaucuuggcaauuuguauuuucuugcagacaauuuauaguaauccuacccuuccuuguuuaugauauagaagacuagguuuuaaagccauccuaaaauaaagacuguuuuuguuggguacaguuuaauugaaaaucuguuaugaguaugaggaauucuacaaagggcaaaagugaaggcagauacccaauaaagggaagaaaaaaaaggaaucacuuuaggauccuaugugacgguagccuaagaugucuuuggaucuucuugaaccauucucauuaucucaagccauauuuauauuccuuuagccaaguuucucacuaucuugcauuuguaaaaaaacaaaaaaagaaaucugguuggugagaaguugauaauguggccauuaugucuuagcaauaugagagcaccauugucccucuuccugcucaauuccaguugcucuaguuggcuugaagugaaucaaaugugaaaagaaauacaguuuuuuuauuuugaguuuccugauuuucauaaaagaguaaccuuaagaugugauuucuucaagugcaugcuguuauuuucuuaggauuuacugucaccucaaaauuauauccaugucagccaggcauaguggcucaugccuguaaucccagcacuuugggaggcugagguggguggaucaccugaggucaggcguuugagaccagccuggccaaccuggugaaacccugucuguacuaaaaacacaaaacauuagccaggcaugguggcgcauaccuauagucccacuuaugggaagcugaggcaggugaaucgcuugaacccaggaggcggaaguugcagugagccaagaucgcgccacugugcuccagccugggcaacagagugagacucugucucaagaaaaaaaaaauuauacccaucuuuuucauagacacauucagacaccuaccacacuuucagaucuuuuaguguucaugccgccaaccacugucucucucuugaucucuucacucagacacucuccaugcuaccuucccucagguauuuugcuacuguaauuuauuaauucuuucacauauauguauugagcaccuucuagguaccagcuucaaguggagcaagauaugagcaaacucugagauacugucaaggaaacuagccaacaguguuggaggugcuagaaaccaacaguuaagguacagccagugaagucagagcccuggaaagcuuccauauggaagaaggaacagucauuuccauguguccugaaagggugguggucuguuggauccuugagugccuacuaagugccagguacuuuaguuauauucucucagcaaauccccauuuuugcaguuaccucugggaauuuuuaucucugucaagauuacucuccugguugauuuugguaaaucaguccuuaaaucaaucuugaauauaaauaaucugugaguagggcuaucaaaacuaucuccuaauucugacuggucagaaucgcuagacaaaguuuaaaauauguagcuuccuacuuguaccaguaaucaccuaguguuuuuaauauccauucuauuuaucuguguauuuauuuuuccaacuuaacuuugaacauuuuaauaaugucaaagcccauaugcacuaugcauagcauaacuuacaaauuuaaacuccaaaucuuguaccuaugcauuuuacuuuagucccugugugcagguuacugacuauuugaagaauaaguccaagcuacuuccaucccaaaaaaaaauguucaucaagaaccuaaagaaacacuucaaaauuucagcucuaaggugucuuuccuuuuugguuuuuuaucagugaaauaaaacuauuaguuaccuggaagauucuucuuguugcucacuucguugagagggaaugaugguuucugguuuuguuugucugggugguuguuucuguuuucguguagcauaguauugagucuuuaaacacguccugagcagaaauccuugcagaaugugacuuccccucuggcaauaaaacgguacaaaaauucaacccaacauuuaaauaauuaguaaguuacccuguuguugugugugauauaacauaucuuucauggaaauaacuggaaaaaugaaacuauugguaugucuuucuggcugcuuucacauaccugaacugauuuaauucucacaaaaauccggugggguguguaucaucgccauucacugguuaagaaagguagacuccaagaauuaaguuccuuuccaaacacagcaugauuauuaaguggagggggucagaauuugaaccuacgucagccucagacugaaugagcacuuccugugagccagggacugugcucagucccucuuaagggagagcugucuucuguggagcagaaauacggcuauauggcugcauucacugcugcuuguaggcgcugcaaucucuuuucgguuucagcuugccucuguacuuugccaagcaaucaaucaggaaaauauuuugaaguaguuucuuuguauagccugagagagagagugagaugguacguuauacuggcuaagaacaugaacuuugaaggacauaacuggguucaagugccaucucugucacuggaagccuuacuuaccuucucaucucuaaaauggaagggugguaguauaauacuuucuucuagagcuguugucaggauucuugguguuuuuuguuuguuuguuuguuucuuuguuuguuuguuuuggacagggucucucucugucacccaggcuagagcacaaugacaugaucagagcuaacugcagccuugaccuuccgggcucaagcaauccucucacaucagccucccagguagcugggaccacaggcaugcaugaccauaccugcuaauuuuaaaauuuuuugcagggacaggggucucgcuauguugcccaggcuggucuugaacuucugggcucaagagaucaucccgccucagucuuccaaaguucugggauuaaaggcaugaggcauugcaccuggccucaggauucuuuuuugaugaaugccagccaacagcuggcauuucuagaggaaaacaugcucugccguuguuccuguggaggaacccugcaagaugugaaaugcacuucaacaaccaggcuuuuccaaaauagagagcucagggcugcccugccaucauggacaccccaucucuccuuuagcuugagauggacauugacccuuuggcugggaauugaaucauguuggugauacuuagcauggaaagccguagcuacauucagugucucacaaccuuagugguggaaggaagaaugguugcagcagcuucauuaccuggggaaaaagaacuuggaauuccaagcacuuuaagaaagaugcuuuuacuuugaguguuggagaaaauagagcaauuaccuauugaagacaaaguggaugaaaaaacaccucuguucaugcuacccugaucauguaaucuauucauauucauucugccuuccugaaggugauucaagccagacuggcuguuccugcuggcugugccuuuccuuccccaggauacacagggcacauggugaucaccugagauucccagcuaaacucagacauuuucuacuccaagaggagauuccucaaagggcuauagcacacaggcagcaucagauaauguggaaugaguggaaggagggagggaggaggaauccauaaaucaucaaauuguuguugagcaucuuugaggguccucaagaauacacuagacccugugaugauuccagggacaaccagccugcacuuucugaggaguucacugccugccuggggagcaagacuuguauauguuaaauuagcaaagaauuuaugcaagacguaugugaaaucagugaagaauucuauucuaucuagacuagagccagggagauuuccaacaccuggcucauguaugcuuuuuaaaaaaagauauucagucuuacugaagaugaauagauggauggauggaugguuucuaacaucuauugauugcuuccuauguaucaggcaguguucuagacauuuuuauguuuauuacauauguacuuauacaaauuauauguuuauuaacucaauuaacguucuuagcaacacuaugagguacauacugucaauagccccauuuaauagaugaggaaacugaagcacagagagguuaaguuccuugcuagagguuucacagaugguguacaguacaggcaggcuuugcacccaggcagucuggcuccauaguuauauaugaaggauaacgauguggucuuuucaagagcuguuggcaucuugguucacacugaaagcuaccaggcuuuguuaucuguuccucuggcuuuggcuuccugagucuuaagcacccuucucuuuucuagaacauagaccagcuugaaccaacccucugugauuccaccccgccucuccccuggcugcaccaggccucucauuuguaguuucucuuacugagcacauuucuaaacgaggacgguugcuccacuuuaaggacauacaaauggcuugcccucaccugucaagcaugauccuuguauuuuaccaggcccauuaugaacgcaaucuuucuguugaaaauuugcauaccuccuuucuugaaaaguaaugacagcaauuucuuucccuccgcucacuuucugagugucucauuuaacggcaccugugaaaccgacaggcacagagaugagaagugaaagagagcaguugauuaaaucaucaucaagucgggccucagaaagucaauucugcuugccgucugcaaugauauccuuuuaucuuaaaguaaugagcuauggcacuuuugcaucggguaaugcgauaaguucuauuagcauguuccauuugccucacaagcaagggcaagucauuuuagcuagcucauaucacugcaaucaaagcaauuggcuucccaggcagagaagaaagggaaaaggcucagggugauuucuauggaucacaacacagcggaaaaaauagacucuuguauuauuuuaacccauaacauacuuuuccuuuuuacucaucagcaaauuuggguuuuauuagcuuacacaggacuccaaaaagaacccagcaucaguugaagcaaaccugggggugggggcucagaccccacccaaagcaccaagaaacuauauaugggaagggaaaaucgccccauuacagaggggucacaaauagaauucugccaaagcacacaggcaaagaugucuuccugauaguaacacuguggucucauaauaaacucuugcuucacaccaucuucaaagucauuuguaauagguccccaggcaaguacggauuaaugcuauugaugacuuagaaucaguaaaucaaugacagagaagcaaaggaucuguuccuuaagcuuaaaagagaucauuuacaaaucaccgggccccagacugucaguuuuaccuuuggacaagauacuuauuuuucugaguuuggcaaccacugagguuuguggacucuggguuuuaaguaaauuucaucuuugggguuuauguauauuuauacuuggcaaaaugugacuuccuuucuuagaggaaaacaagcugaacuccccaaagauuugugaaauauucacuuccaaccccacuuccaauaacucaacaauacuuuaaugaucuguggaaauuuacaacauacagauuguuuuaugaaauacacuuggauuucaaagugacaaaaaggaaaaaaaauauuagaauuuaauuuaugagcuuuaaaacuucaaguuuggacaaccugauuucugucaauauauuugcacuucuaaugggugguagaaugaaccuagcacauaguaguuaccugaacauuguugguugaaugaguguguuauuaucugagacacuggagggggaauaagaaguguucccuuagcccccucagaucacauugguuauuugagcucuggccaguucaaacugagaacuugcaaaaaugucagauucugagaacuccccauucagaaaugcuagguuaucaguaccgaauuccagaggcuucugagaguugauucucuuguaucuccugaacaauugaagauugguggaccucauauuauuuucaaaugggcucauuagugauuaccaaaagcuuuauucuuguaaacuguuguuuggaacaugaauauuuuaauuaggcuuucauuuuaucugagcuauuuuauuugaucaggcguaguuacuguuaagauagaggggaagagucgacgacauuauuucacagucaguaagaauauggucucaguaagaacauuuucagguuuaaaaauuuaaaaauuucuagggccccaguagcuuuaaauuucacuuaguccaaaaccaauaugagagcaauguaaacagugugaaauuagggcuuuguggauugaugaaaaacagacaacaucagagcugccauauguggcacaaaauggcggcccauuuuuacaugagcaaaggauugggcagcugggcaggggauggugaacguguuuuuagucaccaugcugcuaucuuacuucuuuaaauaagaaaauaagugucauguuuucugcagguggcuucuucugaaauugcuuuuaggugagggaugucuuuaaggucuuagauaaaccgccugccccaaaggagaaucgauuuguuuugucacuggcaaaguuaaauuauacuugauguuagauauuguaguuuacaaguugggguucucccucauuuuccucucauuuccuuuaggcagaaacaagaauaaaauaacuuuguucagcagugguauucagcccugacaucuuugguggcaaugauaaauggauuugagauacgaaauaacuguuccagcaagguccauugagcagaauagagagcaaugcccuccucaaugucauuguaugugauauauucaaugauugccacucugugcuuaagaaugcauuccaucacaagguaccuagaauuccaucuuguugcuacauucugaaugaaacagagagaugucacagaccuugacugauuucaauuuggaccagagucuuaaaacacagauaccgagauucccaaaugaaaaugaaaaauauuugcuuuugaauaaauauaauaaagucauaaucacaucuuuuuucugagccuuuuaauggaagauauuuucuucugggccccaacucuaggcucugcuaacgauuuuaaccucccucaguauguucacacauacaucucuuugcguuaagcagucauauuaguguuucuuguacuuucucuuuggaaucaccugccuuuuaaaucauacuuugcuuaugcugcauggaaucaaccacaguuugaacaauacucaagaagaaugagauugacuugucaguauaauugagcaucuauugugucccaaggccuagagauacaaagauaagcaaggcacuguccuuaccuacauggagcucauucucugguuggaaagacuguuguggcaaacaacggcaguacaguuuuguaagggauggagauagaagcaauuaagucuuucuggaaaaguauuggaagauucaaaaaaggaacuguguuuugaaggugaaugucaggcuuuuagguagaaacuuggaggaauagaauucccaguagagggaauuguuaagugcagauggcugguggcaugacugagcgugagugggcgugguugaagcaagguauguuaggauagugccacacaaugcgaggaugccaaccagggccggaccacaagcuguuugcaaccaaccugcugugagauuaguauggggagucaagaguaagcauugggaaacuuuuagaguaacucaguagcauaauuuuguguuucauaaaucuaauaauuuuuuaaauguauuauauauauuuguuuuucuuuuucauuuuucaagaauuugacuuuuuauuauauuuuacaaaaguaauugucguaacauauuagaaauuaaagaaagcaaaacaaaaacaaauggcucuucaccacagaaagcuuaagaagcauuguguugagagagugguugggauuugggaguugagggggauuagaaacagaaugugaagggucuucauaggccuugugaagcaucugcaucaaauagaaauuuaggaaauccacucuugucaauaaggacuuggauuagaaaaggaagagagcauagaccuuggaaagcagucauuauccucuuguaaugacaaaauaaaacccugaacuaacgcaguagccauggccacagggauggagaguuagaaagcagaaucaauaacguggggugagagaggaagauaaguccgcucaaggauggggucaaggauaaggcucuucacuuacgcaguugagugauugcuuggugaugcuauuaccaagggcaacgugggagaggggcaguuucaggugagcaaagauguugaguccagauuuagauggauacuugagucugaguguucgcugcacuucaacagggggcacauacccaacggaagcuuaauaauacuuaacauuuaucaucuguacauacuugguaccaugcacuaaguuguuuacauguauuaacucauucuccucuucuagccauauuuuacagagaaauauacuaaggcccagagaguuuaaauaacuuuuccaaaguuacacagcuggcaaaugugggcauagagauuuuugaguuucagcauauacaugguagaaaggaccaagggaaucuuuaaggucucccuugaaagucacauagaaacaauagaacuccagaugcaacucuggggagacagugacauuaaagaauaugcagaaaaggaagggccuugaaaagacagucgcagacagcaauauuggugaaugggugcaaagggaaaaauucuaaaggaugugcaauugaaacaaucuaaauaaccagcacuggggaauuuuuuaauuagauuauguuacaauccacauagcagauugcagugucgccuuuuuuuuuuuuuuuuuuuuuuuuugagacggagucucgcucugucgcccaggcuggagugcaguggcgggaucucggcucacugcaagcuccgccucccggguucgcgccauucuccugccucagccucccaaguagcugggacuacaggcgcccgccagcacgcccagcuaauuuuuuuuguauuuuuaguagagacgggguuucaccguuuuagccgggauggucucgaucuccugaccucgugauccgcccgccucggccucccaaagugcugguauuacaggcgugagccaccgcgcccggccgugucgccauuuuuuaaagugauguuacaggauaaauuuuacugauuaaacugaaauauuugacguguuaugugaaaaucaaagcagguuccaaaaugguaggaauucauuuuuauuucuuaaaauguauguuuaaaagacgagugggauuauauccuuaagacuggaaagacuuacaaaaauguauuaacaguguuuaccuaaggauuguagauuuauggguaauuuuuaaaauguauccaguaaauauguuuuuuuuguuuguuuguuuguuuuugagacgaagucucgcucuguugcccaggguggagugaucucagcucacuacaaccuccgucucccuggcucaagcgauucuccugacucagccuccugaguaucugggauuacaggcgcgugccaccacgcccggcuaauuuuugcauuuuuaguagagauggcguuucaccauguuggucaggcuggucucaaacuccugaccucaugauccacccgccuucagccucccaaagugcugggauuacaggcgugagccccgucacccggccguaaauuuguauuuucaaaaggagaaagauuggguggguugguuuguuguuuaagggguaagacuugucugggaaaggaagacugugccuccagcaguucacuuuuaauucaugaaaccaggggaagagacggugaagauggaaguugagugguuucaguauugagauggcuggaaggacucagguuuaggaacuagucccuuucuaacugugcauuugaggccuuuggccaggcgugcacacguccucuuucucuccuuuugugugugaugguuugggucaugucuuugucugaaggccgggugaccaugaauucuuaucugugauugcuguaaggccuaguuguuucuuuuugucucuuuucauuucuugcuuuuaaaauggaggauauauuuuuagcuuuucacagcgggcucugaaaucuugucauggagaguacuucgucaccucaagcugguaguuagugugcaaccuguuugcuaauaaaccaaagcaggaccccgaugucaaaaugcuuaaaauggucaaauccgcugggacgccgucucugcaucugacaugccuuuuccauuucccagccucaugcagaacauaaaccugcaucaggagguggcucaaugugaacucuuauaaauuggaguggguaucuagggauugaggagcagacacuucuucuuuuaaccuuugaagaccaagaaucacuuggccaaaaaaauccacaguguauugaacuuagggugugaaagcuauacaguguauuaaaugugaauuugagaccaugaauucuacccacacugacucuauaaaacagccucccuuuuucauaaagcaggcccauaaaccgcugccagugaagcagaaagacuccuuaggacuguggcucgcuuuccgucugggguugucaacaaacccccuuuaugaguggaauagaccucuuguaugugucgagcuucuggcuuuuuacagaguguguuaggagccaggcaaggcaaacguuaggcgcuguuugcugagugcauuuauuggcuuugcauaauuuaugagcuggagggguugaccaucauucgucucugccaggggcuggcacucgaggcuccagagaguggagcuguaaauuggauggugcgcuccugcugagcucacggcaaaguccucaggucaguaugggaauuuaauaccagaaauggaacuguuuucucagcacaccauguggaccccagugcagcagagacuguuuuggcagacuccacgacuggccuugucgaggagcugucacucacccggcauguuguguggggagccugagcauuuuuaaucggcuuggcauccgugcugcuuccauaauggauaccaguaggucucaguucuucaccauaugcuuaacucuggagacaaggugcuucuggguauaucaguaauuacuugaugcagaauuaaguggaccuugaaauuagaacuggacuguuggaaagcaggaagcuuaacacuuugauagaaauaaccauucccagggacauacugccguuaggauagggggcacaguggugguucuuucccagcuaccccacuccucguccucccugcacaccagauccuuggggaggugggcaaaugcgaugccacagccuucagcugucauugauuaccucacaaggagcgcugugaacaucugggaacaugagccugccuggcaaaauagucuucugccuuccacaccccucuugaauugagcguugucacucuugaaaaugugcccagaucuuaggaaccucacagagggcuuaauuaaaggcaauggagagaucacacaaucaggacaguauuguuccucauccaccugcgguucuaggccuucaaagucuucaucucauccaauuucuuucucaacucauuugacuuauuacaauaaagaaaccacucaucaggucaaagaauguaaauguagacaaucugagguuggaagcuggguuggaaaugaugcaccguacuugguuaaaucgcugucacugaauaucugacuacccuguggcacugaggagccaaugggagaaguagaaaauguucuaauccuccagucuauaagacugugauauaaguuccuaaaugcuuuuacuacggagugcuuagucugaaaagaauaaguaguccccagguugucucauaauagcaagaaguccauuuagauggguguucuguuacuucccauuaaaagcucucuaauaggagcuuaaacaauaagguaacuuaguguuuucugaauaaaaguccugaggcaggcugcccugagauggguucagugguccaauucugucaggcauuuuuucccuuggucccacucuguuguuuuuguacugagucuuuuugccucauuuuugcaagauggcugcuacguaucuggacaucacguucuuauacacucauguucaaaggccaaaggcaggugguuccuucuuuucuuuguuuacuggggagacaaaauuguuucuagagcccucagcagauuucagaaucucauuggccaaagaugggccuucaaauaagcgauuacaaugcccagagguuuaccucuuuucccaucuuuagccucaagaaaaauugagaaagaaaauaccuggcauuuuuaaccucaaagugucaggagaagguacagacuagggagaagggaguugugaauggcuguggggaucuagccagcaguggcugcccuacaagcaaauuuauuuccuguuucuguucaaagcuauaccaacucccauguccagguggccacacuaaaaaaccuuggcaucauccuagacacaucccuguuacuugcuucccauauccauguguuaucaaauccuguugguucuaccuucagaauugcugugccaucugcuucugccuuccuaaaccauggcaccaccuuggguuagacaguggaauggcugccaaaccacucucccugugaccugauuuuuccccacugugcacucucuccacguucccacagaaagucauccucauggaagcagcucugaucaugccacaccccugcuaguguuuguaucccagcuucaugucuuacugcuaaacggaaggcuccuuuagagccaggccuguaucucaggugaauuucagucuaguuuagcaguuccuuaucaagggcuguugacugaaugaauagauauauuuaccugcugagcuuuacucuaacaaaacacaucccccaguuuuucauugaauauugaauuaacaaaacacuucauuuuuuuuaaguuguguucuuuuuucccuugcuuaucaugaggaucccaaagacugggguuaauuauuaauuaucacucucugcuuaucccaaaccaaacucagugguuggaauuugggaucuguuugauauggucugagucuauggcccuaaagcauacuuuuuugcccauauuuuuuauuuacuacccugaccucuugucuuuggcauacuuuuuauagggaauguuccuucuauucucugggccucuaaaccggaaaaggcagccaucacaaguggugagccuuggccauuauguucuguuuccuucaaaguucaaaugagugacuacaacgcccagagguuuaccucuuuuccuguagaaaagcaccgguagagauacagccauucacauuagcugaagauagaaugucuucguuaagaaauugauuuugcucugaauuucauugaacaaucuugauucaccuuaauccuguggcugacuccuagaggggcaucgccucuacccugccauggugggagggaagcgcucacuugugugauugagcaccuugcuggacugaccugaggaagagccacagaguacaggcaucagaugaaaucaacaaaauaacuuuuuugcaucuggauagcauuuuguuucagaugcuguuuacuagcacuugaacuggagaaacucuuucuuuccaggaagacagcauuuuuuauuuccuuuacuuaucuugcacuuuuuuuguauggggguugggggaggaggcaucaaaagcaaaaacauacucaguucuugcacuaacccuuauucucuugucuucauuuucagugugacagugacagugaccaggaagagaagguaagacccccccucccccauugugggcacagcacauaacacacugaacaccagaguccucccacacacagcugcaggguaggaugccagcuucauguugacaggaccuuuucucuuuaggaaagaugggcauuauucacacagugacauuuccuaugcuaugacacguuuaauuugucagaucuaccuuuuuuucauuuaaacaagaccuuuaauauugcauauaugugacacugaguuuuuacuuuauggaagaugacucauagacucaaaaacauuuuaaaagacaaaauuauuuauuuuaauaaccaucugauuuuuaaaaauccaugaugagaacguuaaacuugcuaguuuguguuuauaaugucauuucugcauuuauuuuacugacccauaugcuuuucuguaccuauuggccuucuugauagaaauguuaauggucugugucuaggaaucucaucaugggguacgggugggcaagggaggucagaugggaacugcccucuucccauccgggcggaccgccagguaggaggacaguucuuccagcagguacaugcucuguuucgaggcucaugggcaccagccucuguguauccagaucaacauggaucaagaaaaggaacucaguuucugagguuccagaagauuggaucacaacucgguaaagugagcuuucugcugccugaagcaaagggauuauuugucuguuuggucuuucuuucuagccguuccaauccccaaccaaaguuccuuccauuuuuacugcugcuuuauguuauuuugaaaagaguuaccugaauaucacgguuucuguauugcuugguaucaaaaggauggacucggccucccuucccccguuucuggaucuguccugugcccugugcuuugacuuucaccuccuacaugcuugcggauuuuauucagaaugcugcaguuaguauuuagugggaucuuuccaacaaacccagaauuuuucucuccuucucugcugccagccuccaagagagaucuaaaggcucuuguucuguacugucguuaauuugaauucagcauauguagccuguuauaaaaugcgagacaucaucauuugagcaggucaagcauauucagaugaagacaaauggugcuuauuugauuuccuuaaaaucaggaaaugaaaaaaaugcucucuggagaaaucauguucugccugacuuggaugauagaccaaugcaugucccccagauaagaacaggcucucgccuugagguuuuuaucucugaaggacggccaggacugucagcuugcugacaugugcauuauccaugucauuuuaaacaaagugaccuauggaaggguacgcugugcugugacaugguaaugggcuguuggaugacagugaaaguacacacuggaaagggggcuguggauuauucuuuuguuuaacugacaaguaggagcugccuuucuccagcccccaggagccuuagcuccuuggaaguaggacuccuggugucucaggcagccaguguguagugggugccagggacaugugcacagcaguaaugguuaguguucaagacacggucauuggcccccaaacccccgaggccacauucccacauggugggcaucacugguacccagggagggacugguaccuucuggccauuccagaucuaucagcaaugguugaucucacuuucuaagucugugccacuuuuccaaaaggauaaaucuuauucagggucguacaaccaagcugacauucuuuccuuaaaaggaaauguggggccaggcgcaguggcucacgcuugugaucccagcacuuugggaggccgagguggguggaucacgaggucaggagauugagaccauccuggcuaacacugugaaaccccgucucaacuaaaaauacaaaaaauuagcugggcauuguggcgggcgccuguaguuccagcuacucgggaggcugaggcaggagaauagcuugaaccugggaggcggagguugcagugagcagagaucgcaccacuguacuccagccugggugacagagugagauuccaucaaaaaaaaaaaaaaaaaaaaggaaaugugaauuccaaaaccaucaccagucuucagcagugguagaaggugguaaggaugcccgguuuuguguuccuuguaaaugucuucaccaguggccucaaccuugacacccaaaucaccuagggagcugcuacaaguuccagugccugggccucaucccaggucaaugaccuuggagccuuuggggcugucuugaaccaugggucuugaugaucaccuaacucugguaauuucuaggaguaaucugccucugguugucagagggaucugggggccaauacugagagcaccccaccagguccuuucccaucaccugaauuccugaguaguuauugccuggguuuccaucucuaagugcaagaaguaaagugucggaauaauggguauugggaagguagcucccaccuaccacucugagcuugaguagauuucaggguaauaaagcggauacauaguuguuuauaggcgaguccaagaguggcaauggcaagaagggaagggguauuaggaguguuccucagauucauggcgcaccuccugcccugcacccccagccauucuuccuuucuacuguggugauccugcaggucuuaagugggagccacaccauaaccaguguugacaucaucugccucuguucugccccaugccauuucuccagggggcucccaacaggagccauugagacucuaauugcccucgcaccugcuuggcccuguugcaguuaagacuguuaggcuuccccuuuuggacugagauugucugguguuuaucgccaacuuuaacaccauccuccaagacuucugcucugucggagccugggucccugucagccuccucugugaagaaaccucuugccugugccccccucgaagccccagagcuaaccagggcugcuuucauguguugcuuggaggauucgcauucgaaucugaauugcuaaugguggaaaagaugccacucaguguccugggauaccuucagcaagccccaccagggaugcuguuggaggcaaaagugaaacuugucagggacccacugggauuucucucuggaagaccugccauucucuuacuccauagggaucugcagaaccggcaggcuaaaauuaggguacuguguuucacacagcugacugaauuaagauaaacucugcuuuccucugauaugaagcuguaauuuauaaaaugauacccuuacuaauuaacguggaagugacuccgaaaggggcuaaaaaagcagagcuuucccuaaaugcaggagacacacuugugcacaaaaaggcuuugaugagacacugagcaaaguaucucccuuauccuccccucccagccacgugaauacauugcacauuaaugucagauaaccacaaggacguucaugaagaguagaaauugggcugggugcgguggcugaugccuguaaucccaacacuuugggaggccaaggcggggagaugacaagaucaggaguuggagaccagccugaccaacauagugaaaccccgucucuacuaaaaauacaaaaaauuagccgggcgugguagcacgugccuguagucgcagcuacucgggaggcugaggcaggggaauugcuugaacccgggaggcggaaguugcagugagccgagaucgcaccauugcacuccagccugggcgacagggcgagacuccaucucaaaaaaaaaaaaaaaaaaaaaaagauagaaauuggguggggaauuacagaaggcugugaacacugcaucuuagaugugggauuguucuucacuguagugagagcuaagaaaagaggcagcacuuggcacccuuaaucacccaaauuaagcaauuauucugaucccccauucgaaaugaauugguaucaugagaacaaagaggcaacaugcaauugccaaauauuuggccuauauuuuauuguuuccuuucuuucuccaguacuggcagcagcccaugaugcuaagaaauaucccguuugguuaugaaguuaauguggagauuaaaagucauucccuguucuacccacacccuuuuucuuguguauagcaugugacugagcugauuggaaggcauauagcccaguggccaagcacuugggccucagugugauggcugacacauguuucugacucuguccauuucuauuuuguuguggacaagccuuggcuuucucagcugucaaaugggggugacaacagcucuacauauaguccuguagcaauuaaaugaaagcauuuagggccaggcaugguggcuuauggcgguaaucccagcacuuagggaggccaaggcaggacaaagugggcucuugucuuugagcccuagaguuugagaccagccugggcaacauagugaggcccugucucuaaaaaaaaaaaaaaaaaaaaaaaucuuaaaacuuaaccaggcaugguggcaugugccuauagucccagcuagucaggaggcugaggcaggaugauugcuugagccuaggaguuucaagacugcagugagcuaagaucaugccacuacacugcacuccagccugagugacagagugagacccugucucuaaaaaaauaaaaauauaugaaggcaucuggcucagugccugguccauaguaacugcucaauaaauguuagcuuuuguucauuuuacuugagauaaaaugagagaggacgcuugaaaaaagaggaagacuagcauccucuuuggaaagcugggguucuucuagagaaccugcuagaggguuuccccagaaucugaggcucagccuuuaucccaagggcccuucuccuggacacaggcugaauggaaguguuaaauuuugaaggguucugaaacagugucuuuuuaaaccccuuauccaaacaucaggccuuccucugagcagaaccuggagccaagagcacguguacuguccuggagggaucaaauggugauuaagugaauuguauagcucuugucccuucagcaacuguucccaaaugccaaacacugucgguucccagaaacccaucacaggagagauguucugggguagggccagagcaucuguauuuuuuaaaaagcuuccuagguaauuuugguacacaacugguuuugagaacuacugccuuauaguaaaugucaaagggaaacaugauuuuuccccguguuuaaugcucuugaaauuuugacugcuuaggagaaaaacuugaaaguuguggagauguugccugugugugcagacaugugccacccaugcuuaugucuguagauaccgggcauaaguauacaugcaguacacacauacacaaucucacagaaaugaauccuucuccuuuuccuaucaaucuuuuaacaugacuccugauugcaguuuuuucucucugugcuguuagcaguaggaacaaccaccuggagaagguguuugugcuccugggcuuugcuuugguacuguguccuguacccaggacagccuacuggcacaauggcuaacugcaaaugcaguacuaccgauuuuucacaccugcuuucccucuuuccacacacuuuuuggugcauucccuuuuuuguuuagagacagggucucgcucuguugcccaggcuggaguacaauggcauaaucuuagcucacuacagccucgaacuccuggacucaagcaguccucccaccucagccucccaaguagcugggacuacagguguguaccaccauacucagauaacuuaaauuuuauucuguagagauggagucucacuauguugcccacacuggucucaaacucuuggccucaagugauccuccugccuuggccucccaaagcacugauauuacaggcaugagcaaccaugccugguguucauuuuuaaauucaugcuaaaaguuguuguguuugaucauuuuauguucacuugugugggaaggggcuucuaagaaaaggagcaaagaaaaccagcaaagucuuauguuccuaacucaacacaaaccacaugccuaacuuggcucgugcaggagucagaaacugcugagaugucaaacugaagacugggcaugugguuugugcuuacaguggaagagucccaucccuugguuggccauguuucacacucgguaagguuugugcacccucagcaacauuccagaagcucagaaggcccucauuguugcuuguggaacccccagccuuaguuuucaaauaggauauauuuuggucaggagacaguuuggagguacuguccuauuuuguagcuagaaaggaauaucuccaccuuuccagauuucauagcagcaaagcagacagccaucacccagggaaagagaauggauccauguucuugucuuuauaucccuaauacuuugcacagugcuugauaugaauuaggugcucaguguuuugcaaaauuugcauuuucuuuccuggauacucaucuccaaacggaggggauaagugaaccaaguucagaagacucauacucaaaccugauugcaccucauacagucgcaaugucuacuuccuggacccccaaaaugugugaucucuuccucaggcuucuauauuucaucuacaguuuucucauacaauauaucuaagccauuuauaaguuuccuaacuuauaaauagacaauuucuuaugguucuuggcugagucucaggagauuuuuaauuuauuuuuguuuuuugaaauggagucucgcucugucacccaggcagaagugcaguggcgcagucucgguucacugaacccucccacuccuugauucaagugauucuccugccucagccucccgaguagcugggauuacaggcacccaccaugccuggcuaauuuuuguauuuuuaguagagacaggguuucaccauguuggccaggcugaucuugaacuccugaccucaggugaccggcccauauuggccucccaaaguguugggaugacagucaugagccaccgcaccuggccuaagagcuuuuuauuuuggaugcgugauuuccgugaugcccaucuacucaaccucuucuuaccccuucaggauuuugucuggguuaaaaugacauuuuauuguucuuccaaaaucaucauauuuccaauuggcuuaauuacauugcauacaucccaaauacacauugauacuauccuuggauuaaauuucuaugguaaauuauuuuaaauucagaaucucauuaucuuuuucauaugauaacauuuucaggcaaaaccaaaaauuacuucacuuauacugaacauguauguacaauaaucuguucauuacuaccaugucaugcaccugaaaaagaaguuauaaauguacagauuuucaauuaaauauagguaagucaacagaauaaauacuuguuauuggaaauaugucaggcauuuucagcuaagguuuuguuucuugaaauaaacagugagaagaaagaacagguucuagauguucuauugcucgcaauaggugggugguggagaagggcacucagaagacccaauuccugauuucucacucaccagcuguauggccuugggcaaguuaccuaauggugccuagcauuaguuuugucaucuggaaaaugaggcaguauucaaugauccaacauugacuauccagauuuuccaaauagcuauuuaccuaggccccaacagcauggcagaacccagagggaaauuaauaugugauuguaucuucccuuugccaauguggaaagaggauuauauaagaauugucuccauucuuucgucucucucagucuuccaagagagaauaaacauauaggggacauacucggguauauguguguguacucucaagcaacugaaggaaacuuacauacagaccugaugucuaaacaggguccuuaucuguuuguugguucagucuuucagucauacauauccacucauuuuuucacaagugucuacugaugaacugacaugagaauuauaguugcuuaacucugauggaacugucaccauguaccugugaguaaguagcagagcaguucauuuaaucuguguuccucaacuacuguaaguauuuaggaaagcauggggacuagguggagagcuagcuuacggaauguguuucaagaacucacuuguuugguaaugaccauuacuugaucuauaaaaggaauuguuccagaaacaucaagguugagugcaugauucuguguucccacagaaaaguuccugcugcuuccccuugggugaaugagccaucgccuugggugucauggcuuaccugaagggaaaguuguaaagccaaggaggaggcugggggaggugauggcuaucagccccaugaaauugaccaugagcccugagccaccugaauaccaggagggucaugagcagaggcauuuguacaggugaugucuugaacaacaugcuucauguuaguggccucugauagaguguaaccugggaggcucuuugguugucagagaauuugucuuauacuguauuaggguugcagaguguucugucuucaaugaagauagaacuuuuuggucauguacgugugugugugugugugugugugugugugugagagagagagagagagagaaagaguuaaucccccuugacaacuccuggauggcaagauaguuacagauaaaugcuccucagaacugugccauucuagugugacaaauauaaucaaauaucuauauuaggauguguuaauaauuaucuaaacuuuauacuuuaagaaguccccagauucaacaaaugaauggacuucuguuuucuuuuuuaauuaaaguuacagcugggaaggucaaauugguucucuuuuauacagguuagagauuuucccuaucaguuuccaugaggagcauguugagaaguucuagcuguagaccugcaugaccucuucagguacccgaagaauaacccaaagaaagcuggaagcagcuuucucccuuguuguucuaaaccaggcuugacucauauacuuacggagacagccgaauggggucuuugaaauaaggaaagaccaguaagcccuguggugggugguuguaguacucaaggagcccaguuugggcuucaucuuuucuuucuagugcucuuagugguuuuugaaguuccuaauuuccuggucuaaaaauauagaugcuacuaaugucuucggucagugaaaaacuaagauuagggucaauaauagcaacuaaauaguaauaauaagcaccacuucacaugaaagagaacauugcauuauucaaaacacuuuuaaaaacaucauuuuauaagaucuguuuaaguauuuauuguagggaucuauauauucucacauacaccaucguugaccaugugccaaacucucuguuagggcuuuucaaggcuuuaucuucucaagcaggugucauuguuuuacaaauaagaaaaaugaggcauaagugauggagcugagauauaaguugugucuuaggauuccagaaucugggcccucuucccaugccgugcugcuuccccguacgucagugugaguugggauaagccuagcagugccauucaggagcucaugcugucauccccucugugucucaccuacuugugcugcaagagaccuggauccuguuuaucuauccacccucacccccacccaaacaauugcacuaacuccuaaaaauucaaacauggcgguuucucaagaaacauggaacgaauaaaauuugggucuacuaacaacuuagauuguacaggcucuucugaagugggacuuuuuucuuauuuuagccuggaaugcaguuauccaaggugagaagggaagggcuauauacaagguauauauuuuaacucuuacagauggguagcaaagucagcccaugauuaauuagggauguaggcuacaccagucgguggacuuagcaugaaccauauuuggacacagaacucagucuuccuuuaagugucuguauauguguaaacauuuaauauuuuauuaaaucauagacucccugaaagcaucccaugccuagcauguacuugacacauacggcccuguaaauauuaguguuauacccagaaguugcuuuauugguuauccaagucucauaaaggagaagggccuugccucugucacucagaaagcacaggaagagcagggcuggagcagaggaauuucuucugagcuuccaguccagagccucaugaaccccauauggucccugcagaccauuuucuuccuacgaccccacacaggagaaggggccaugguuccaugguggcuccugcacugcacccucuaagguaguuuuguucugaguuauaauucgcccccucaagaacccucuuguccauccccagacacugauucucacccugacagaggucuggguccaucagggccacagggccuuuucuuuuuuaacagcaaaugcugcgugggcuguuccugcagcccaaaugauaguaaauaccugaagcagccauguccauguuaaagauuauguauuugccacuaaggggagaauauaguguuuaucggccggagugcgugccggcugagcugauuacggcacaacacucugucagccaaugauuuguccuguccuuuaucaucugugucacucagcagugugcuggcgaagggaacggaucacccccuucccuuuuuuuguacccauuuuguguagaaaauuuguauuuacuuugggaguguaauuuguuccucauggauaaugugacccugagcggagcuggaucauggguuaguugaagugauauuuuccgcuaaugguagucguacaucauugcugucagcucggguuaggaggcaagcacauuacagcuccauuuuaccucugcaggcaucugggauuauuugccauaaccgaguaugacaugaccgcacuacagagugcauuaaaauuuuacuggcuucucaggcaaguuccccagcuccagugugugcuucaggcaggcggucugauggggaguccaagggcccugacuuccugcucagaggugcugcgggcaguggccuaagcaggggcuacucucuccuugcccugagaaagaagcagggaaagacucuguggggagccacccaggggauguuuaugucucuauacgucccggacuggcaagugacuagcugccuuguguacauaaccaggugccgcccacaguggcugcugccaucugcucucucuccuugaugacuucagcccccaggguggauuaggcaaaaacuccuucucuaaggagagcccaggguaagugcaagucucugccaagccuugggcugauuuguauuguucuugucugccuacguucagacugaagaaaggaggcguaaguccucauuauggcagaacccacguccagccauguagcuggacugagccugauagagucucaucaacccaguuagaaauguuugccaagguguuuuacacauuaucuuauacaguccucacaccaacccaauggaguguaggcgugauuaccuccauucuacuuauaaggaaacugagguucaaagguucuguaacuuacauuauacagcuaaugguagcagaaauagccuucugacuucaaauucuauaugguuucuaguguucagugcuacagagagauaaagaaguaacuauuguuuaaauagugcuuagaugugcuauacauauguugacuuguuuagucuucaguacaauccuaauagguaggugcuaauauuaucccccauuuacagaggugggaacugaaucacagagguauuaccgaacaugcccagucuugcuccugguuaauggcagaggcagguuucaaacccaggucaguguggcagugcucuuagccgcuaagcuggacucucccacaugccacauuccaauaagccugagagcugauaggaaaagaccagugaaaacuguaauacguuggaauacaaggaaauguucaaagaguauuuuaucacuuucuguuguaacucuaacauccaacaaaauaucacucaaagaagauguuuugugaugagcuuuaauuaauuaauaagucccauuugcaguuagcacauuacuugcaugcaaaugaugcuucuaaggugcuugaaagguauuuauuuugauagguuaagacuaagcagucacucuggcaaaugcuuuauucuuuuauauucuuauuggaaaggcuguaauaaacuuauguugaaucauguucuuuaaaaggacaauuuaagguugucucccaguaauuagugggauauggaugagggcccauaggcugccauauagaauaaaaugacugcagauuccauauugguggauuccgaaugcuggacacuugaauguacucucgugccuacaguguggacaugacuuuuuguucugacacggaaauaccccuuuuuaccucucuagccgccucaucgcuuucuauuccaagcuugaaauguuaccccuccuggacagaauggacaagccauucuuaccaucaccuguguacaugauaggguuguaauucaugaauuuauucaauaagccagacauaaagugaguuguaccuucagggcaguuuuuuaaaugcugcaacagaagagccauagauaagcauggcuuuucucacugagaaauuuaaaauuaaguuagcacacuaagaauuguccucccugcccccgcuccccuccuugggcucacaagcacacacauugaucuucccugcuagauuaccauagguccaggggauugaccuuaguuucuccucuagccuuagauccaaucacucaaguaguaaagaauaagaacaaaaguauugauccagucauggaacaguaauuauuucucucagauggucguuuagaaugcagcaauaauuuuaaauaauguauuccucagagacagcaugacaacauauguggauuauuuaguuggugcguuuaaguaaguuacacuugcacccucaccccuuuacuggacguccaaugcugugcaaggaggccuacuuuaagaagaguagacauugagaaaaaucagaguuuacccaacaaaucaauuaccaagcaauuguucauuauaaaggggcuuauccauuuucuguagcuggacaaaauaauggaccuccacaugcucacaugcuuacagugcaacuccacccuuccguaugaagagacuucaugaagucauuggauccuuuugaaacucuuaaguuguaacagcuuugacuguguuuauguuaauagaguuaccuuuuaaagacucuuuuuguuucaaauaacauacauuaaacuaacaaauaaugaaauguuuaggcuuuuggaauuuaaauguguuaaaauaaccaaaccaucagaagggcagagccaggcaacuggauaucagaaacagugagcagagggcuaaaugcccuccuugcuuugucucuacuuauuuuugcccguccacuugaaucuugauaauuucggagacuucguuucuccuuuugguagaaaucaugacccauccacuuuucaguuuuagcuacaggcagagagacugucucuccuuuuccacugccauugcuaagauccaagggagagauucugacuggcugagauuagcucaggaaaggauuguggguugguguaacuuaagccaggugcuuacaccuggauuggucaguuauggguagagagacgggaccauguuguccaaaugugcuucucuagaggugccucuguacauggugcuggagucaguagagaacccagaaaguuaggaguugggccugcagcaguggguucuaggaagcaaaaccuaaucuuccugccauuuggaugaggcacuacuuacaggcauaaauucuugacagccauagaagcugccugggucauccaaaguugacacuuuauagugaucacaaaaucucaaauauggauacguauuuacaauuauguauaauaauugccuaaauauucauagagucauuuuaagugcuauucacagauuaguucuaucuugcuuaagcuauuaaaagccauagaaauacacaggauuuuguagagugagaguucauguguacaugcacuuagaaaaguccagaauuuauuaauauuuuaaguacaccuauaguagcuaaugaauuacuccccugccccacccaaguauaagacagccaccuugagagacacaaagaucucaaggaaugucaauuaguaaauuacauaucuaggguacaaaaugaaacuucuuuguccaaagggauuguggucaaccuggagaauccaauuugcaugccaugcaguacuacuuaaacuucagcaggcagccuuccugaagugauguuccuaagacuagaaaauaguaacucacucauagcuucuuucacucauguuucauucaacaaauuuaauccucacuuguaugcuaagccaagcacugucaugggaacuagggaugggaagaagacaaagacauagaaaaccuucagggaaauauggccuaauugaagggaaagcugagguaccuagaugaauuacaagaccccguagcguaugcuguuucugaggaauggcaugaugucugaaugcaaaaaacugagccauacucuguaagggaggaagcaauugaguuagaucuugcugcagcacauggaauagauguuacuagguagcaagaaugggguagaucacaggcaaaggggauaucauuugcaaauaacagaguuaggaaaggcuuagcauguggagagaagcaugaaaacuucuguuuguuuggucaggguccauggcaguguuggggggaagaugagacuguaaacauauguugguauacacaguuccauaaaaacaggccuugcacggcaagaugagaguuuggacuugauccagauggaagccacuggguaccuuauguaggugaaugacacaucagaauugacauuuuggaggaggauucaggcaguggcaugaaggauggagugaaagggggugaaaguugucauaaugggggauuugagaggugauagagaucucaaccaaacuaauguggaaagaaggagucugauuuuagaggcauuucugaagugaugauuuugugaccacugggaaggggggucaagggaggaaucguggaugacucagguuucaagucaggcugacugggucaguauugaugaugccaucaaucacacagcgaaaguggggggauggagaaaauaggagcucagggaggggcuuucaggaccuucagcuggaugaggucagaagagaguacauauugaugaugcaggagugaucccaauuuuaguucagugucugggagacaaaacuaccuuaguagcagagauggagcuauaggggaaugagugggaggccagccagaacacugggauuuugucugugucuacaggaauaaauauacguggugaugauaaccauuaaaaacaaaauaaauacuggggacuaguagagagggaagguagggaggaaggcaagaguugaauaacuauuggguaccaugcucacuaccuggguaaugggaucauuagaagcccaaaccucaguaucacucaauauacccauguaacaaacauacacauguacccccgaaucuaaaauaaaaauugaaauuauuuuuuaaacuacaaaauaacuguauauuaaucguagcacuugauauuuguauagcuuuuuuuuuuacuguacauaucuuuauuuuuucauuuguggcaaaauacacauaacauaaaauuuaccauccuaaccauuuuuaaauguacauuucaguaguaaugguaagcacacucacaugguugugcaaccuauguaguuuuuuuaugccacauguguuaaaguaccauauauaguucauuuaaaccucauaagaaacacccuggaugaaaggauguuaaauauuuauuuuagaaaugaggaacuuugaaacgggaugaacugaaacaaagucguaaugcuuuggugauaauauccccaugccuucuagggucaguauugggguuauaccacaguauccuuagugaugauauuuuaacaucuaacuuccaguggaccaaacaguaacucacuuauagccugagauccuauugcuuuccuuaaggaaacuggaauggaaucagccccacagcaugaacugggccacccagcagcagccaggucgccgcucugagaggucugguucugaggggcucugugggaguaagacagcaugaggccauauagcuuuggauauaggaaacgccuagaaagguagagagauaugauaccacacuuccagcucuagcaacauagugcugugugacugcggccuugggcaguuuacuaaugcuucuaagcuucugcuuuuguguuuuuuuguuuuuguuguuguuguuguuuuuccuuuuaaaaaucuagauauaaaauaccuagaauuauauggcccauaauaguaacuacucaggucaggcacugugacucacaccuguaaucccagcacuuugggaggccaagguguagaccaaccugaguaacauggugaaaccccaucucuacaaaaaaaauaaaaauuagucagaugugguggcaagugccuguagucccagcuaauugggaggcugagggaggaggauugcgugagcccgggaggcggagguugcagugagcugagauugcaccacugcacuccagucugggcgacagagcaagauccugucucaauaauacuacuauuaauaauaauaaggauucaguaaauuuuacauuucagucccuuccacccuguuuccuccugcuggucccccaccauugaccgacuuacccugcaaaaaaccauaacacacauuagcaagauucauuuauuacagccaaaucagcaccccaggaucaggccuuuuaggaaaugggauccaaaacauaagugucuuaaagagguagaagaucagagggcuuugaaacauggccaugucaucagucugaaauuuagaaagaaguucccuguggcaagagaauccgcaggaaaucacuaagcuuuggaggcccaggauauacccaguaaagcacaggcggugggcccccaagggaagauggacagcaaagacagccuuuauaaucugaguagauuucacccaugucccccuccaccuaagcucugguuuuccuuuagaggaggcuuuuaacuuaauuccuguugaauuuacuaauguuguguggugugagauuuuaaguaucuucuccagccuccugggccccucucuccuccccugucccuuccccaccucccuauccugucuugaacuuccaaccccaagagcucuucuuuacacuguuugcuaaaauggagccucuugugugaugcauacccaggaggugaagcuuucagggguccuaaugugugcuucaggauaagggcaccauggguccccugccugccagugugccccucaaagaaugugggcuuuggcaacauggcauuaauucacugccaaugaaacaaugaugggaauuuuaaugauagcguugcugucuaaaagaugacgggggagacuucucagcgucugugauccagaaaacacacuuucuaguaaguaucucuuauggucagaagugagagugaaaucucugucaguccuuccuaagcauuaccuuggcaagcgcuacagagcaauguaacauaggauguguucaguuuaaguaacagaaugccugauaguggcuuuguccguguauuaguuuccuguggcuguucuaaugaauuaucacaaacuuggcggcuuaaaacaguagaaauguaucuucuuggcaugcuggaugcuagaaguuaagcaucaguuucacugggccaaaaucaaggcaucagcagggccacauuccucccagacgcucuaaaggagaauuguuccuugccuuguccagcuucugguugccaccagcauuccuuggcucuggcagcaucauucucaucucugccucugucuucauguggccuuuuccucuuucgugugucucaucuccgccugccucucuccuauaaggacacucgugguggcauuuagggccuauccagauaauccaagaaaaucucacuucgggauucuuaauuaguccuaucugcaaagauacuuuuuccuuguaagguaacauuugcgggccuuacaaaacacauucaaggcagacaaggagacaggcggucauguguccuguauguccccuuggcuagaagaguccauuccuaagugugagagagaaaggaaaagcaaagaucuggcaaagaggggcaaggauuuccaugacccaucaugauuguccccuguggguuggcguugugcugucuucuguuagcaagaaagaggcggaggacauaguuuguggguggucgaagaacuaugacugccaccaaggaugcgggcuuccacacccccagugugucagacaaaaagaucugaaugggggucucucuuuuuuuggggaagguaacgcuguuuuuuaacgcuauuaaaaaucuagauauaaaggccagguguggugucucacgccuguaaucccaacacuuugggaggccgaggcggguggaucaccugaggucaggaguucgagaccagccuggccaacauggugaaaccccgucucuacuaaaaauacaaaaaaauuagcuggacgugguggcaggcaccuguaaucccagcuacucuggaggcucaggcaggagaaucgcuugaacccaggaggcagagguugcaguaagccgagaucacgccauugcacuccacccuggguaacaagagugaaacaaaaaacuccaucucaaaaacaaaaaauaaaaauuuauauauaaaauaccuagaaugauguggcccguaauaguaacuacucgggccgggcacggugacucacaccuguaaucccagcacuuugcgacugagcguuucccugcucagucacacugauaaaccaccaucgccuuugaguuucuaacucugccuaucucuggaauccacugaggaggaaagugggcuuaagguuuggucuuggauucugaaggugcagaccucaucaccaccugcugcugugcaaagcacacuacuggaccucucuagaaccucagcaagaauucauaccucccaaggcuguggcaaagaugaaaugcaggccucgggagugcuuugagcucuagaccauuccacgagcugcuguuccuguugucacuggacaguagggcccacugcugcuucauagccuaaagccagguggagggaguccaguacccuuguugauucuuugcuucccuuucccuugucagccacacccaccacacagacuuccacauacccauguguuguuguuguuuguuuguuuauguucguuugccaguucugacuuaggagcaagccuuuggugcugaaguugguacuguucucacuccugaauguaaugcccauaauggauggagaaugucaggggaauuguggguaauaguaagauuacugucauauucccaaacccuggggugggugggaagaagccccuaaccaugcagcuuuauuuccacugugcuugugguggggccuggaccaccuuauuccugguggccuucaucuugggugcuacagguggcaauggcaaggacugaaguggggagagugaagaugcccgcagcaucugugccuggcccuggcucauucgucugauuggauuguuagcaagccaaauaugaccuggccugcaggguacaagaagacauggaauaccugguaggcagcuagauaggaacgcgggacuucccagcagcugagcguggagaggugguucccuaccuggcuacacaucacagucacucagagugcugugcucagagaggcacuuuggcaauacccuggacauuccgauucagaaguuucuuaggcaggugugguggcucaugccuguaguuucagcuacuucaagaggccaaggugggaggaucacuugaggccaggaguucaaggcugcagugagcugugaucaugccacugcacuucagccugggugacagagugagacucugucgcuacaauuaaaaaaaagaaguuuccaggugagguacaggaaucuauauuucuaaaagcaacccugggacuacugaugcauagccugccuggcaaauacacaguuuuuaggagaaaaccaugagcuuuggggucagggaaaccuguuuuugguaacagcugugcuacuuacuagccaugugagcuuugucagucaccuaccggccucuaaacuucaguauccucagcuuuaaagcuagugugguacuaauaccugccucacaggauugcugugaggauguaauaagauguuuaugcacagguuauauguaugcacaucauggugcuuuaaaaacccucaacuucccccuaacccagcacggaaguucaagggcagacuggcccacuggcuuuggcucuggugcccccagccacuucccaccaacuccauccauguaagauuuacauagccauggccaaauuguuacugcaauuaacaaucacaccuaaaagcuuuuacuuuuacuuuuacuuuacuuaaagggaacucuuaaagaguguuuacuucauaucauuagcaaaucauuguuaauucuugugauacucaccguaauaacaucuauccaaaugaacauguuugcucuuaaugcgagugucaugugcaauuugggagaaauucuguugucauuuagcauuaauuaaugcccacuuacuguaaaguguucagagacaccaauaucagcgagauuuccagaccacauagacaggacagaagagcugggaaggggccagaagccacuagcagggcugcacugugacugaaggcaguggcccugggcacacuucucugcugagggcaggcaggccagccuucuggcuggaggaucuagguguccacccauagguguucagagcacacaacugggccaucccagccuggcuccacucacuguggcuggaagggguucugccucuccauccccagcccuucaaucccacacaaccaccucugaugaccucuccucccagcugcagccaccuuggauguugauuuuuaaccugauuucaccuggcugcacaugucagcuggugggcccuggagugugaagugugacuugcuugggccccugcagccuugccucccugcagcgacuuccugcaguuugacuuuggggcagcggcugccggagaagccugaaaguugagcucaggaagucaucuucaucuccacccccaagcaggugcuugaucaggacuguuuauuaauguguucuauuuucucaaaugcguccuccaaaacagagugugugugagauacuacuccugugccugggacagucagugugacagugaacagugcugcucuagguguggggacacagccuuacguucccuuucuuccaggcagcucaguguaguggaaacuacaauaacugaccggggcugugcccaccagcugugugagggggccucaguuuucccaccuguaaacggggcucacuuuacccaccccguggaaugguuuaauuaggugugaugaaguccugcaugccacagguggugcuuaguagccaucgccuuauuaaaaaugccagugaucaccgaggaucaugauuucccuccccuuguguccacaccucagacacguccucucuccuucuggagggguaggaacagaggaacagugccucucaccugaggagggaacuucucugaauccaccaggaaacccagucacaaaucacacagaagcaguguucauuuuuucuguccacaaccaauaugacuaaaguacgguggaaagacaaguauuuuuuguccuggugaggaaaggugccuugauauguacuuuuuuucugccuuguggauggacugcauuggacagaggugggggugguggagggaguggaauuuaccauggugguacaaaugagucagucugcucaauagggaugugucccauacagagccgcagaugccugguuuaaaagacucaggcugcaguuaacuaugcuaaacucaaauuuuacugaguggaauuuagucuuucucugaugauuaaaaggcccuucagaaucuucugagccguuuuguugaacagugcuuuuuuguuacuuccuggguguaggaaaugguggggaacagaggguuuugcuggaacacccacuggacuuguguguccuccucucgguuucuaagggccccucaggccacacgccucccauuuccaagagagugagaggggccuagaaaaggcugaacacaaagccccacaaccgccaaauucccuuucaaggguguuacuuaguaaacaugagcccuugagcccacauucuuccagacugugucugccucaggccaccccuccuucuagaaggagcagugggggcccuggcaggaggcugccggcucagccuggaguggcccacagcaaugcuccaauucacagugaaaugauuuccucugccucguauaauuuaaccugcccacauugcuaaacuucuauauuacacauuucugucaggaugucagaagaaaugauaagccuccuugaaacagcaaccucuauuacaugcuaagagcauugcgccuggcuccccccagcucugguccuucugguauguuucugagauuuuuagcauggucucucaaguauaaagaauacccuacuucaugaccccagccucuuguuagcugauagaugaaaucuuuucuaaagcugacucucuugucuauuauguuuucaaaauucaagguuuuagauucuuggauggcugccaaguggccgggcuuucuuaguaggugaauugcuccucucuuuuuuugauccuuaaacaggaaguaguuguuuuuuaggguggagggaagcgggaggcauguuccaccucccuucucccuuuguugauguuuccaggcaauugguggggaauuuuuucaggaauuucuccucggggaccauacuuuaggaauaaacccaaacacggaaaagccauuuccuugucuggugggagcuuguguuuucucgcuagauugugucacccagaauuuguuguggagcuucuugacaauugugcugugcacgugacugcagcauggaccacugagggggaauagcaccaagcugcuccauccacacgggagacacuugcgagaucucagggccauggacagugcagcugccugucgcucccugcaacuuacucccgacccgggccuccucagagacagccacaaugcagacaguccacacauaggauggcucaggacucucuucauuauuagcugugguugugugguuuccccgggagagagaacuaagacugaguuucauuuaaaccuaaaagugaggaagaacagaugccauauuccuacccuuaguuguuaauuuggauuacaaacacccaugcuuuucuucaggucauuagucauguggcuuuuuucuucuuugucucacuagauucugugggaacagauuucuuucugcauagcauuuaguggugggaaaaugauguuugcugaccauccuugaaauugaggcacaauguaguucuugauuaggaagacucuggaauaagcgcccaggagaaauggaagguguuugguuuccaaaagugguaccuucaacucuuuuuguaagcugaguguguuucucuccaaaguuccuagcccauuagugaacugucauacacuucaaggccagcucaccacuccgauagcuaagcugucauacauaguccaggguccgugugagccccagcucuuuuaaaacuccuggcuggcuguguccagagaagacauucuuaucaguuuucucaguuacuuuugggaaaccaucucagaguguaaccuaagucuaaacucagacaaggcacuguguguuuuacaaaauacacaucccacucaccugggcuuaauuaccuguaaaacugaaguaaugaaagcagugccucaggcuucuuugcagcucaaaggggaugggccagggauuggaauguagaccugggagcuuccuuugggugccuccuggaugaacugcacuguagguucagugagacuccuuccgggauaagccaaggacaacagagccagacuguggggcagagggucucaugguccucauggcaaagccagccccagcccucagugugcccucaugacuaugaguccagucuuuacaacaggaacauaacaauucuacagaaggguggaggaucuaacacugaacaagcaaggccccauggaccaggcccccaauagacguuacuucauucagucauccccacagccccgggagguggaggcaucacuuuccauaccguauagaggagggaacuccccaccaacuagugaaguuuaaaaccagcauuccaagcagggcugcccagcuacccugccuacuuuguccuguugcugcaucuucucucugauuccccugaagucugugcgaagugccacaggaggucgaaggagggaccagaaaggugaggguuucccggaaguaguggaagcggaccguguccugagagguccccagcccgagaaggaggcagccaaccucagcaaggacagccuggucuuuuuuuuuuuuuuuuuuuuuuuuuuuuugagauggaguuucgcuugugucacccaggcuggagugcaauggcacgaucuuggcucacugcaagcuccacuucccagguucaagugauucuccggccucagccuccugaguagcugggauuacaggcaugugccaccaugccuggcuaauuuuuauacuuuuaguagagaugggguuucaccauguuggccaggcuggucucgaacuccugaccucaggugauccacccgcuucaaccucccaaagugcugggauuacaagccugagccaccccacccgcugagccuggucuuagaguggggucagcuucggcuuccuauugugagaaucaggccucuggcacuuaucagcccugaggccuggcuuaauuuacuucgaaugucucugucuccauuuccuggucuguaagguaucacuggaaguguucucaacccuuuaguaugcuuuagugugagaaagcuuguaaaaaugccugcauggugccuugcuggugcccagucaguccugcauuucucggcucugcaaaaucacagacacauggaaugggaugguaugccccagaagaacugggggauugggagaccuggcaggugugagcccuggguuugggaagggcagaagguaaguggugacagauaagucuaggaaggcauuugggugucaggucauaaaggaccuugaaaaaccaaccccuggguuaguugaagcuuugguuuaguuugguuucacggaggaacaggaugaugagauuuuucuuuaggggaagaugacggcagcaauaagaguguuggaaaagucacccugaacaacuuuuguagguaacuuaagggcagaaaaaaggaacucuuuauuuuucaaguggcaucauggcuaucacagcucaucagugccuggaacaacaccuuuaauaaugucaauaggaacgcuucgaacugcugcagaaauucugcuuccugaauguuugaacuuacccucccauuuaaucuuuaaaccaucccuucaagagagggaggacacaaggguuuuucucaauuauguaccacugugagcuuggcuuaguuaccaaaggcugaugaugggcucagcagugggauccgagucccugcguucccacccaggcuucccaccauuuuccucuuaggugcgcauccgcuuugaagcugcauucucucugagacauguggugguaaugauaauguuaauacuaguaaugaucauaguaaucgcuaacauugagaaagcauuuacuuauuauaugccaggaauacguugcuaguuuugaauuguuuuguguaauuaucaucuccucuuuccaacuaagaaaacugaacgguaaugagauaaauuacccuaggacacauaacaagggugugguaggauagaaccacacccuucccaggugaggaguugccugucauuucucaggguccuccguggcaccuggggacagguggaggugggcguggguugucaggacaucaggggccuaacucugacucugcgucaaucagagaagcuugauuuuuaucuguuucauuggccuuucucaaaagaguugauuugagaaaguguuuuuuaaauagcuuuuuaaagcggaaaggggccgugugcgcuggcuaaugccuguaaucccagcauauugggaggcugagguaggcagaucaccugaggucaggaguuugagaccagccuggccaacauggugaaaccccaucucuaugagaaauacaaaaauuauccaggugugguggcaugcgucuguagucccagcuacucaggaggcugaggcgggagaaucacuugaaccuggauggcggagguugcagugagccgagauugagucacugcacuccagccugggugauagagcaagacuccgugucgaaaaaacaaaaacaaaauaaaaauaauaaaauaaaguggauagggguugauugggguuuuucuuuuuuggaaaaaagcaauuaaaaagaagauggauugauagauacauaaugagcuggguagauggggagacacaugauaaagcaaguguaguacaguguuaauaaagucagugguggguauauagguauucacucuaaaauaccacuuuucucuauguuugaaaauuuucauaauaaaauguuggaggagaaacuagccaaguaaauaauuucuaagggcccuuccaauuuuuuaaaaaauuuuauuuccugcacuucucucuacauccuauaguugugaucauguacaaccaugacgugaucauuaaucuagauagaucuccuagucaccacuggauguugccacuaaaaaaaaaucuaggcugggugcaguggcucacaccuguaaucccagcacugugagaggccaaggugaguggaucaucugaggucaggaguucgagacuaggcagaacaauauggugaaacccccucucugcuaaaaauauaaaaauuagccaggugugguggcaggugccuguagucacagcuacucgggaggcugaggcagggagaauugcuugaacccgggaagcggagauugcagugacccgagauugcgccacugcacuccagccugggugacagagcgagacuccgucucaaaaaaaaaaaaaaucugcuggggagaacaaagucaaucaucacucauuugguucuccaacuaccugagccuaaauuuugauuggcaaguuugguuggguucagauacuuucacuagaaagccguaggccugugagucuccagaugaaagguggguuuagaucuacacaucuccuguuucagggcagugagcuguuuuggacccaucucuaguagaaguuucuuggagcucuccagccacaauaaagguacaguguuccuguucacucacuuuggcagagccuugaaaaggagcacagagacggucaaauaguaaaaucuaaaaacccguagaaaacccuagcagaaaguauucuuaaagacccagcuguauuuuucuguucauaagacccagauaagcauagucuucccauuugacauucugacuuuaacaugagagggaguuucaugcccccuugguaggacauuggaguacuuguugcagcgugcaagaaguggacuuuguccagcuuauauuuagaauaaccuugccagcacauuccagggaguugaucaaggaguuuugccaaacugugauaaaucagcacauugagcagccucugauggcugauaagcuugggagugccaguuaauugacaagaaccgcacuugucaaucuuuugaggucauggaaauggaucucuugucuuucugcccuuccccaagucuucacccgcuugcucuuugguagauugagcauggccuugcacugcauggagcacaccucccaccuuuguucuuguguguuugcugaguaauuaaucucauugugcuaguauggaaauagucuauuaaaacauuccggaggacaccauggagagggaggaaggaggaugaagacuggcggagggaguaguuugcucuguuuaauugguucuuucaccuaaugguaguuugucaauuaaggggauacuuagagaaagugaaauuaauccaugugggucaaaugcagcuauuaauuuuuaaucaaaacacaauguucaacaaaucuguagcugugcuuaguacaaauguaagcaugccaccagccucuucccaaaggaugugggagcaggcacaggaaaggggggccuguuaaucuagcaaauguuugccuccucccacacucccugugacccugagguaagcuccgcagagcuucguucuugucucuucaccaucuauugcauugccuaacacaugguagaugcucagugauauugcucuucuggaacucuuuccaucccuauuaugugcacagcuuuggaguaccucaaauagguuuuaggcauaacagcuauucucuaagagcuccuagccugcuugagaaagcagaggaggcaguuaugaaugcauccccaagucacucagagcaacguacaaucaaguacaagaaugugugauaaaccguggcauuuguugagcacuugcuauaugccagauacuuuuaagcacuucacauaaaccaaguuuuuuaaucuuugcaacaacacaauaaaauaaguaccauuuuuaucauccuauucauaaauaaggucacugaggcccagaacauuuagguaacuugccuagggucucacggcuaguacaauuagucugcuagaggguugcauucauuaccuaauauuauaagacccagaguugucccaagagagcuggcauugaucagggguuaagguaugaguuuauuuuggaaagugccagaauaagaugcuccagguaguuggaaugguaaucagcacgguuuuguggaaaaggagugcauuucugguuaacuggaauaugagguuggugagguugagguaggucuagguuaauacacuuucagggucuuggauaccaggaugagaaauuuucaugucgguuauucugggauuucuuuauuguuuauggguuguuucacuuuggaggagcaagucccguuccucuauuucugcacuugggcauugugcccucaucauuaucucucuuaccuccucugccucccuccaucuggcaucuuucuucucauuuauggcauccuuagcuccuccugcuucccauuuuuagagagagggagagagaagagaaaaucaagaaaguacaccagccggccuacuucuacugacuuucagagguugaaugaagcuuuucucagcccucugcccucaccucaguuugguccuggaacuuugagaggaaaaacaccagaaggacuuggccucaggaaguuuucuucugccuccccuuacugagcagaaagcagguuggaggaaccacuuggcucugugacauuuauagugacaugguuuggagaggucaggaaggacugucccaguggugucucuucaggcugcucacaacugccugaaaccucucaguaggagagguuucucaugauccagugaaaaaucaggcuucagguguacauaguuuaggauaggcuacaggguauguuaaauuccuucacauuggccagaagcuggagaaaugugaggacagguaaaauccuuggauauuuucuucuuuacuuccaagguagcuuacaaccuggccucuugaagucauugggcugaugauaacugguggaaauuugcagguaauugccaaugacaaugagggagagaauuggggaauagaggggcccuaugaagaggauccucugccucguauuccaugcaguccuaugggcugcugcaguaaaccugggaggucaucaggauuaccacaaagacucgugauugggugggugucccucugggcagccuaguuucccuagacauacaacacguguucuucuccagcagugcaaagcugagaaggggccugaguaaucguucuggucuugcuccaggaggcaaagccacagcugucuguguacccccaugcaagugggcaggagggguuccagcaaggcugcuugcugggggagacaggguggagggaggaacagcgacucuggaucauagagcagaggucagggaagcacaguuaggauggaaagucucgggcagaagguggguagagguggauaggcaguguacaugguguuucaccaugucaucuugaccaggaacacgguggagagaacagauauagcugacucugugugaucagugauuuuaaaaugacacuagugucagacucuuaaccagcaagggaacacaucuuguaaaucugggaaaacuagguagcccaaagggacacccacccaaacaagaguccuucauguugaagaagaagaagcacuucuugauaaacaaugaaacaagcugauauggaagaaauuguuaugucaugggaaggaggacauuuuugguaccuaaugauuaauaugaaauaauaauuauguagugauuauauccuugccucucaaucuaagaauacucagaacauugucauagugaauuucaguaucuucuaugugaaaagcagcuuagcuagugauaucuguuauucaugcauucauuuuuucuuuccuuugccauauauuuaccaaaaccuaaucucugcuagguagugaauaaggcuuuugggaugcggcaacaaacaaaaugggcauguucacugcccuuaaaauguaaggugaaauacaaccuuuauaguguccacuuuccugcgaugguuaagguuuucuucguggacaaauacaugaucaauucuauagcuauuccaugcacauauaaagaaaagugaauaauaccuguucacaaucucaaaauaccuguuaaauaaaauguaucaauuuuaaacauuagugugagacaaaaacauuaaguaacagauugugugcgugugugcaggcauguacaguuagucuugaaaagaucaauugggagucaguggagcauuuaaagcagggauagacaugaucagauuugucauuuaaacgguaacuuuggcagcuguguggaggacggauugagggaggccagagugaagaucagcagugaggagagacuguuacccaggugagagaggauggugacucagaguaggcaaugugggggcugagagaagaaaaggagcuaaauucuucuuggagaucaaauaagcaagauuuggcaacugauggaagagaauguaaaacaauuaucuacuuccuagguugguugugggaacuaaaugagacauuauucgcuucauuuuacaaacaaggaaauagagacuccaaagugauugagauaaacgucugacuuccacacagccuuugaucucucuacugcacaaggcauaaaaaggguguaaacagagguagauucacccaggcuaauggcugaaagccucaaggcccuucacuugcugggaucucauccaaggccucauaccuaauuuuauauucauaacuuuguauucauuuucuuaaaaagcacccuccacaaggguuuaagcuucagacuccaggaaaccucuaucuaccucuggccaaguaaguaaccucauuggguaggacugaaacuugaugggaugagaccuaggaucaaaaucugacccagcaggcagagaaaguaguguguuuagguugggaucaacugggagagaaacagaugccauauuggaggcauaacaaaaauauaacuguuaguguuuauugaauacuucuugugucaaacaguguauuuauugacuuugauuuuuugggggaaguuucuuguauuauaucacuuaauucuuauacaacccaacagggugguugcuuucauuauccccauuuuauaugugaggaaaguaagcccugguaagaguaaguaaauuaacaaaguaucacaauacuaagcaggugagcagcacuggcaucuuacaggccugacuuugauguuugaggcuguccuuaaccuccacugcuagagggacugugguccgaagccagcaccucugauagauucuugacaugugcugggcauuuccucuccuagagguuggaggaagcaaggucuaauucuguccugcuccuuuccaaaaaggaauugcuuggugaaaugucagugggagaaaguaaucaccccaccuucagauacagaguugaggacuuaucugacaugugccggagaagacaagaagauucugaggcuugaggccgaaggagggcaucaagagacuccagcagccuuauuuuguuauuaugcgguuguuauuuugacucaacaguuggcucuggugaaggggagagauggggcuuauaugcaacaacaagugagggcgauuugagggaaaacaugugacccagacuaggagcauuguguccacauuaacugaagcucacagaaauccuaaggauaaguaggguuuucagcguaauuuuguuuuuuauguucugaucaagauuaagaaaaggaggcuuuguccuuugauggaaggugugguguugauggaugacccagagaaagcagagagguucaccuccugcucuaccuuccuguccagaacaugaucuuuagaaggaaagguauagaauuuucuuggcuuaaagggacuuuagauccaagaucaguaaagagauugccuugaagauuuaaaugagcucacguuuuccugaccuggacaaguuaccuccccacaugcugagagaucuuguaaaugaaaucacugaccccucccugccagagauguuggagaaaggugggacaucaggagagaggcugggagacuagaggggggcaaauacauugcgaaauuuuuaaagagaaaggaguguucuguagccacaggucagugagcaucaggugcucuacaggauccuagacccggucagcauggagcaggcuggugaagaggaagcaggaaucaaagagucgggucacuaagacuggucacuggagcuuagcaccuuuuuuuuuuuaacaagcuuacuaggcaguuaccaaaaguggaaagggcagucuuacucccucuucucaaggucuucgacaaggucuuuuaugaagccuuuguggauucggugggaaacuguggaguggcugcagcaaauuggugaauuuguugaacugaccaaguugauggucgcucuacaguuucgucacgggacucugcccuauauaaaauaaucgucaguaguuggguaauaauuauucugcaccaaaguugcagaagacagaaaguugugaggaaaacagauagcuucagauggccaagucagaauuugaaaaagaaaacucauucauacagucaacaaguauuugagugucuguuacaugccagucauauauccaucacggagcagcuacuucuggguugauucuccuaguauggaugguaagcaaugaagaaauguguguggugucugcaugcaaugucagaugaugguaaagaauauggaggaaaaauuuaaagucuuaggagauaagagcaaggugugaggggggugcuauuaugauacagugaucaggggcagcuucucuaaggaagggcccaaauaaagagaagcugguagauacccacaaaucugggggaaaacuauaccugguauaggcaacagcaagagcaaaggcccugaggcuggaacauguuuggcaucucuagaaagccugaguagcuggauaucagugagagcaagcaugagaggucagagcacagcuuguccuugcaggcuaugggggauaucagauguccugagggagagggaagccacuggaagcuuuuuugauauauaauugauaagauccgacucgugguuuguuuuuguuuuguuuuguuuucuuuuuaauugagucagagucuugcucuguugccccgccugcagugcagaaauguggucuaggcucacugcaaccuccaccuccuggguucaagcgauucuccugccucagccucuugaguagcuaggaauacaggcacccgccaccacgcccggcuaauuuuuuauuuuuaguagagaugggguuuugccagguuggccaggcuggucuggaacuccugaccucaggugauccgccugccuuggccucccaaaguacugggauuacaggcaugagccaccgcgcccagccagguucaugguuuuagagacucagucuggagauaagcuuagcacagugugaugggcuggcucuucaaggauagcaugacacacauggcuuagcaaugguagaugcgagaaaggccuagaaauuuuaguaaaaauucacccuaauauuagcaacaguguuauuugccugaggaaaaaacuaacaguauuaaaugguauuugguauuuacagugacugguagggauugguuuuuacccucccuccccugcccaaucucugaagucuuuuaggauaagaaccgauugguuaacaaagcuuccuggaugaacucagcaccuuauucagcuggccacugccagccccaaccaacagagaaaggagcaucagugaaccaguucuggugaaccaguucaccccacugugaaaacucaaaacccaggagaugugguagauggaaauaaggauguuuaagguaaagagagccucauggucaaggugaaucacuggauucagauguuuggaagucugcucaauagagagaggagauuaaauuuggccacagcaguuaguacugugacagauuucuuuuccauauauaaaauaugcuuccuagagucaacgcuaucuaaacauggacugggcccacgcagcaucuggcucaucccuggacguguauguaaacugaggcuggauaagcuuugggugcaguuauguagagacuuaagucaguaaauggacacaaugcagucugauaaaggaaagaggguggaggcggggagacaaucaggaggagaaaagaggcagagaaguagaagccugugguuguggagauggucuguaaccccaccgggagcagcagcaucugaacugguucuccccuugcuccccuuucuuuugcccuccagccaaaccaguaacaaagggcauugucuaguagucugugucagcaauaaaagccauggggaucugacccgcggcaguguguuucagccugcgaacuuccuggauaucuuuacggggaaucauucccggggaaggaagggcaggcuggaaauaauauaaggagaucaagaaggaagucgagcaagugacaccuuuaaacaggccaagcgagccgggcucuucccccugggacaguuagaguuaugcagagcuguaauuaacccagcagcccacuggauaugucuauuucaccgcacaaaggcuguugaaagaaggauucuugaagaaagagguuccaauucaaaugguauuugaguaagucccuugucggauauacuguuucuagaguuuauggcuauaaucaacaaaacauggccauucuuucaugcagguuucucaugacuuucugaauaccaaucuuuagaaagaaaaggggaaaaaaaaggcauccagaauugucuagggguagaaugggggaaagggaaggagggggaaauauggcucgaaucaaauuaaggacuugguuuucuuuucagaggauguugaaaacauuuaaaaagcagguguguccuucuuucauaaaugaagacucugagauauguaagaaaauuuucaguuguguauucaagucccucaaaaucauuuuaucaaccucccuaauuucaauuaauuuuuuaacaaauauuuuuuguaugccuacccuauauuaggcacuauuauaggcgcuggggauauuaauaucucucuccugccuuccuggagcuaauaguggggagagauagacaaaaacguuuaaguauguagacuaauuggugugugagaugaugugcuauagagagaaaaauagcagggagggaaauacaguggggagggaugcaaggaaggccuugcugagaagguggcauuuaagcgaagaucugaaggaggugagauguggauccgguggguguaugcgugguggggucagcggguggggagagacagcagugcaggcagugugcacagggauucguaagguagcaguguccaugguagugugugugaggaauagcaagcaggcugaccgggccagaguggagagggggagagccagagcacugggagaugagggcagagaggucaguuauggcuggagucugccuuugcccucaauaaggcacccauucaguuacucaagugggccagcacacagugguguguccucccacaugcucugaguacuggccauucagaaugguucccaucacacuuaaaaccguagagaauaaaauuacauugucacugugcuacucuucacccuuggauaguccuagaguccuuuggcguagcuuuuacauagugugccacaucccacuguacucccuuuccugagaacagacugauggaccgaguuacgauuuauaugagagaaccccaaaucagaauuccuagccaugucuaauuuauauaucagcaggcaaguuguuuuguuucuuguuuggguuuuggggcuucuguuuuggggugggguuuuuuuuuuuuucccaguaccguaacuuauaaucucagaucauggaagagcauucucuaaugagcuuucuaaagccaagagcucuacccaguugcuggguaaaggggggaacauggagaauuagaauguuuacauuguaacugauuuauguacacuauauuugcauguaaguguacuaaaauauuuuuuaaaauuaccagccauuaaaaauguguuugcuaauggggauaagaaugcuggauacaaugagguaagcuuuguuuaaaaggauuuaggagacucacaauucauaaucaauauuucaacacacucgucugcauuuuuagggcaauagaucuguaaguagaaacaggcguauuugaagaaaaacauuaguuucugagaucuggccagcuccuguucuuaccacucugucaucucugauuggauuagacgucacagaaagggccucagauccuuguuucacguuaaguuuaaccacuccaguugaauaccauccuuguggagcucaguggagagaaauuaaauuucuaucaccagaaguauggcacugaaucagguaucaagggggcuacaucaguaaacuucguuggcuacaagauguauguccuuccugaggcucuguagcuguuaaguuggcucuuuccaaucacagucugaucuuucauuuucccguaaugcaguuagacaaccuaguuauucaggcauagacuucucuguuuuucauuaucccugaauaacauuugaugcugaaauagggaagacgggaaggacgggggaggggagccaagcauuuuucacagcuugugugaaaugcuuaauauuugaacgucuuuaaaauauacuguacacauacauuccaauuuuauaagacuaacauaacauguucaaaaguuuuaugaauuucagcauguaaccagaguaaacguuagccuguuuuaaauaagccauaauggccuggcaacaaaccugcauaguuagcaaaucccuccucuguuuaugggcagccauuccucaccaggucacuacaaaauacaaguuuuaucaguuucuguggacuccguaaguuggucuguguacugaguucagcaugaaucugguuuuaagagcacaaaaccaagggcaucaugaugaggugauauuucguuuugauuuuaaugaaauggcaugaaucugacuugcuuaagaauauguccaggccucucguauccugugggggcaacuugguuccuaaaugccuuccguaagcacagggccacacagacguagcaggcuuaccccuuccucacuggagucaagagagugcuuugugccuagaaaauguuuguuuuuuugguggggcuuuuuuuuuuuuuuuuacuuagguuggaagcgccccccagaugaugcuuuuuaagguaggaucuccucuuaacaagugagagcaucaaacaugcugggucaugcccaguuccaucccaucguguguccugggucuaagguauuagacacagucaugccucucaauggugaagguucuauguuaccagaucauauauuucauggaaaucugcuagcucaccagauaaaauccucccagcuucuucaagcguggcagaggagagagacuucccauguguuaaaaaucugcuaaacuuugcagccccaacucuuuugcccguagacucacccuggccucagccaucccucaggaaucaucuaccguagaccaaacuggcuucaggggauauuccaaccccugauguacucuggcaucaaaagcuccuuuaauuacaaauaggacaccagagaacagguuggagcauuuaaauaagacugaucuaaaggcugugggccaaagauuucucacagagggcaacacguaauuagguaaucugacucacaagaugaaguuuacucgcuuucauuguggugccccccagggcagccuuccccaccugcccucuaggccuguguccuuguagcacuuaccacuuguaagcccagccuucugggagacccucagucagguccagaugcuuccagaggccgacuccagacucauccaguuucuucucucuuugucuuauaacagucaugguccucauugcucccuaaaacauccuacuuaguauuuagagcucacuauacaucuguucaaagcuuggcuuuuggaagucuuuauuguaccagucuucuuaccuccugaaauaaggaaaauauaaguauaacugcccacagaggcauauaaaacuccuuuccauuuaccucauuuauucgucuuauuuaggggaagcgcaguucagggugggcagucuaguuuaagccauugagucuaguuuaagccguuguucaccaucaugauuuuauagccuuuaguuuuauucccugucagccauagacauccccagagaugcaagaacucaugcaggaaaacccauuuaauuaggacccacugugaaggaccaggaaacagacccuaaagcacuuuaugacggaagcuguugaucaggaaacaggauguuuuccuuucccuggguuuaggucuggcucauacuccuuuggggagaucugggggccugucuccaucuccacggaaacagaaccuguaaccuucccagaaucagguuacccuagagggcagugacauuuauaucugcuuuuuuguuuguucguuguucucuuuccuaagacauguaaguggcagguuuugaacuccuggaucucugcccaggggccuggcauguuguauaucugccauucugauguguggagggccuccugucuacacucucucugccccauggcuagagacagcucauucugagagauucuuuuuuuauaggaaggcaaagcucaccuaucccuaacaugcaaaaauuuucacuugaggaggcggggaacugguuuaguaaagaucuuugcgugaaauugaauccaguccuugccauccuucauguucaacucaaguccuccuucuauaaugaagucuuccccagccagaagugaucuuucucuuuccauuacaucagggccuuuuccacauucccaccuuuccccccucauacuguugacuaguuuuauuucccauuagugcuuugcacccuagugcuccuagguccauuuaaagaccuaaauggcugggaucacaucuucuacuugguuauuucccccacagcauucgaucacuuauaaacuguguuaauuuuccccacagugccucacauagaguggugcucaauuacaacuuacuaaguccauuugaaaagaaauacacuguuggucaagaaaucugugugcugagugcuucaagggacacaggcaguauaaaugagacauccugcccucagggaauguauagucugaguggggauaagacgaggccacaugaaaagucuacuaauagcggccagggaccauggcuuccuacaauacaagcacuuugggaggccaaggugagaggaucacuugaggccaggaauuugagaccagccugggcaacauagugagacccugucucuacaaaaaacuuucccagguaugguggugggugccuguagucccagcuacuccagaggcucaggugggaagacuguuagagcccaggaggugaaggcugcagugagccaagaucacaccacugcaauccagccugggugacagagugagacugugucucuuugaaagaaaaaaagauaaaaaaagcaaccaguaauacaauuccauauaggaucugggccagaaaaaaauaaguacugauugucaugaucauggugauacguuaguuaucuuggguauauacacuguuuuuacccauccccauaacaacucuacaaaguagauggugcuagacauucuuagucucagcucucuugucuuuagagugaggacaaaugauucguccagugaguacagagugcugggauucagacagcucugugagcccucacgugaggcucacccuggguuccaauggcucagagcuucuccucuugcuucucucucauuacccuugugcccugcccacucccaaccuuucaaauauauuaaggaggauuaaccauauuguucacugcuauuaaacaagaccagagacagagucuuuccagcagaggugacaccuuggugucugaaugagaaaggaguuguccaaagacaucugccccacacagaagaaaauuagacauaucacaugccugcuuuguuauaauggcauaaaaguauguguauguuuuaauaagucauguacugaguguacucagacuauagcauauccauguguauuacggugguuaagagcucaucucuuuaguaacaaacagggguucaaauucugacuuuaccacuuacaagcucuauagccuucagcaagcuaguuaacuucucaggaccuguuuuuucauugauaaaaugagugggguaauaccuagcucaaaaauuuguuguaauauuuaaauaugaauguaaagcacagugccugaggucacucagugaacugugauuguggugagcauacuguuauaucccuuccugagccacagaacuugaauuuguguucagagcuggagacuccagaacaucucccaaagggaagcaauuuaaaguugaaguagccucucccuucugucagugaggaugccaggucuuuucugaguuuccuguaaguccucuaggauauguuacuuuggauaaagucucacuacuuugaccuguggaaagaaauuacuguccaaguacacaauuuauuuugaccucccaacaccuuuggacaauuccaggcuggcuccaggcuucaucagaacaauuauguccucucuguggaaaacauuccuuucaaaugaaucaguaguuacucaccuuuucuuuucccagccauauuuuucaguugccaacagugggaucagugagggguagugguguagcuaacauuagcccaauauagauaagcuccagauuauccgucaucuuguuugaaaaaaggcaggccugccaaauuugccuacaguucccagugagggaaagaaacaacagguucuaugaagaggaaggcacagaacuagucguggaagucacuuuuccagacucccuccguuacucaggaggaaacaaacccagagugucuucuucaagguuaaacucccuagaagcugauggaaccuggccagaggcugugaacuuugcacagagggcaucaucagaaucacccucugcucaguggaucgcugcccucccauuacucugcuggcacguaccugauuugguugacauuuccauaauuaauuuauaacagcaauaacccugagaugagccuauuuauagguuugugcaagcuagguaagaauauagauuaaaucucagaucauuaacauacuuaaaggacuugggagaguuuugugauugucaaaugaugugauuaaaaggccuccaagcuugauguguacugggaauccacaaguuuacuuuccuugccaagcucagaaacaacaaaauagcaaaagauaagcuuacauuccacccauucaccaaagauguugggucauccggggaacuggaccagggucaucacugauggucuacagcugcugccccacagaugaggaucugugagcgugguucugacccuugauaugccagcaaguguggcaccaagagucccaugggaagaauugcugugacuguccacagcaauagagaugagugugagaagcacaccuauuaguugaaaggaugcuauuaugaccuggacugcugugcagacccaaucuuacuuucuuuccuccuuuuuauguucuguuguucugguuguuaaccuucugaaaaguaacauggauugcuuuucuauuauaaaaguaagacguguucaauaucaaaaauaaagguaaguacagagaagaaaauaaagaucacucauaauuccaccacccagaaauacccacugcugaauuucagugugcauccuucuaauagagucuucauucugacaucaugcuaguagaacuguucucuggacacagaggccucccauucaggugcuugcuuugacagauguguuuccuacugaggaaagcaucuuauacucagggggugagaauccauccaucaagaagaaggaaugacuaagggacucccugccuugccugcaggaggcucuucaaaaaacuaccacccagaaguaguucccucucucucuucuuuuuacauuuacccagaccacucaacccuauuuauccuuuucuuaccuguauaugcaaauaugauggcaccaccaacgucauccaccucuuucguucaagaccauaacuucuuuuaaggcucucaugaguccuucacaccacccuccagcauagagaagggcucuucacccauuauucccauuacuaguguucaagacuuguuuuuuuuuuuuugcuccaguuuuuuauuagcaaacuagcuacaaaaugcugaaaaucaaguuaaaguuaauacauauaagaucaucauaaaugauugcacauguacacagauaauuauuacuuucauuuguuuuauuauuuuaaucuacaaacuuugagcucuuuaaaaguggagauuagauguuaugucgccagacccuuaacuucgcacuuggcauaauauaaauacuugauuaauauuuauugaauuaagaugaaaaugaagagaaaauuuaauuacccagucuacuuuuuuuuuuucuaucucaguaguuaagugcagagaaaaaggaggucauauaaaaaugaugaaaaaauaguaccuuagaaccauuuuuaugguguaucagugcauuuuuugugcuaagguaucacuguuaacccuaguguggacccuuuuuaaugacuuuuuaaaaucuugacgauguccuuuucacuucuuuccuaaaugaacauuaauauaaagccauaaaauguuccuuggaggguuuuaugaguuacuguguuguaagguuggggaaaggacacuuggagccauuuguuuuauggagcuugauucugaaguccagcaccgccccugacccuucagaggcacgcucugaggcaugaagccuuucuugaggacagugagcacugccacuucuccccgaaauacaccagccacacuccuacacuugccacuuccccggaguccacagugucaaccucaagcccugcccuccacgaguagccuagacaccguggagcagacguuacugaugaugcauugaacagcucuucuuccacagugcagauggauuuuccguucaccagcaugaaucgcuuuugccauauauaauaucauguaguaccugaaaaaaaaaaaugaugccaaagacuagagauuuggucgaggacauugguuuuucuggcucuuuuugccuccggaacucuucuucaguuuauaucagauguggaagggaagccuaaucuauaaaacaaagauggggguuugaguccccgggguuuccccucaccacugugcuaacccuaaaucagcuuucaccacuuacuugaaaaacccagggcccagagaaaccaaggugugagagugugaaagguaagugcaggacagauagacgauaacgagggugauauaaauaauaauagcuuacauuuuuuuaggucuucuuguguuccaagcacugugcuaaacacagacuguccccccaaaauauggcaaauugugaugccugaggcagaguaugguauggcugucugggaacucuugaaaaggauauuggauugcuugcaggcaagaaacaggccagauuaucuuggcagaucucgcucucacugugguucuuagccuuuauuacacuguuggaauggguuucucacaagugauaucaagggaaaaaacuagacggauauguccaguguauguguacgugugugugcacaugcacuuaggacaacuuugagccaggagugugagccggauuagcacacugaguuguacuuuauucuaacacaugcagcucaguagaagucucaucuuaagggacauauagaauguugagguagaaauagcucagaagaaaguugauaaaguaauaggauacgugcuuuugccaaucuacauggccauauccuugcaugcuuauuuugacagaagagucacagaacagagcaaguucuuaaggcucauucauucccauuucccucuugacauuuugagcaaaggacuggagggaccaauccauaaggggaaugcaccuggucaucuuuuccugagcaucuugggaucaggugcucuugggaauaagaugauacguauacccaagagcacuugaucagucaggcagugaguccaucaauccacagcccuguucugugcuggaucccauaccuuuguaccuguguggcaggagacaggaaggaugugugguggaaacuccaggaacuuaguccagcugaggagaugauacagacauuggaaaacauaauggaccaccaggaaaugauaagcuuaggaacucagagaacaucauuucuaggaugaccagagaaggcuucaaggaagaagagaaauuuaagcagugccucaaagguugggugggaugugaguuacucagcuggggcagggaguagucuuugcagggagggaaacugcugaggaaagauacggaggugagccgugcacauuguuccuguuggaaccacacauguguaaaggcucugagaugaguuuagugagaguugaaggcucauguugaaaaacacugugagaggcacacccaguacagacuguggcaaguguugaaugccuggcggagaaaccuagagccuuuuaaauaguucugagcagggaagggaggcaaggaaagcaguuaaacugguucagcucucaggacaaauguaaaaugaagggcucaugcuugugugucagauugcagguuugcuuagaaagcacagugcagggagaaacccgaaggagcaggauucugucuucuggagcccuaaccaagggaggccgaaguuggugcuuucauugaacguccauguucugacaugaauaaaugccacgucaugaguuuguggucaacuccuguggucaacuuuuaagcaagcuuuaaaacaacagcaaauugcuucuauggaauuucucuuacagcaucuugacauucuggaaaagccagugcagcagucaagggaguagguccuguccugucauuuacccaggcuuccuagauucaacacaucccugugggucccgucacacaucucacccuggcccauuuaacugagcugggccuacugcagaccuucagauauuuaauuuguaaacacuuaauaaagcacugucaguaggucggcuugucuucucugucggccacaucaaaaucaauacguccccuguguauucugccaugauugucugggcuggggaaucuaauaggauuaaguguuugggguccuaucugacgccacaguccacaguccuaguuagaugagguuaaagacuggcuugccauuguggaggcacgauugcuuaggggucugaaaaaucauuaaagcuuguccucuuaaacguugauuguucccuggugauuuauugacaaaacacaaaaaagugcucuauacugcacucuaauuauauguaugaggccauaagaucucaugggaaauuaaauaaaauuuacagcuugaugguuuuaugcuccugggagacauaccuucuuaauaagaucuuauagcugggaauauuuaugagguuaaaguccguaggcuugagcaaaagaccuaaccuuuccaugggagguggggauggggugcguuuugauuucuuugaagauaaaugaucguaaugaaauuuucagggguuuaggaaaaaguguucaguaagacacaucaagcauuucuccuuaaaaccucuggaggacaaagcuguaagggcacggggauuuacugcgaccauuugucucacauaaggcccccauaguccuacuccccaccucuggggcacuucguccuccuccuguacucucuguggcuuccucgucuuauuagcccccaucacacuuugaaaagguggggaggauccuaauuaagggcaaugauguaagaggucaaggaagggaaaggaauuugaguaaggaaaagggagaaagacugagagaaucaauacauguuaagacagcccccagaggagucacuggacauuuaguauuuuaacgggucaccuucucuuuauguuaagggauggcugaggaccaggcucagauuccacaaggauuauccugugcuguucuagacaaagaaucagagcauaucugggauaagagggauuuggggggagggccucugcaggugucaugaagaugaagaugauauuuauuuguuaccuuucuugacucugaauagagugcuuaucccaacgucuccgugaauccuaaacgaagcuucaugcuugaaagugggcuguuucaauaagagugaggagcaucguuuaugcagccccauuccugcugcuuucucuaauaguucugaaauggcaagaaggagguagguagguagauagagagcugucauauauauauguguacacacacacacacauaauuccuauguauugaauuauauuuuuaucuacucaaaggaggauaauuguguggaacucaaagcgguugggacaugucauaugugaucuauuuuucuguuuauuuuuucuauugaguuuuuuauaugaaaucugcauggccccuucuuugugugggggguuggagauggggagggcauugacagaaggguuggagaucaagcuuuagagggacuuggaacagaugggcacaucaccucucuggggccccugaauuugagagcucugcucccagccuuuucccaccaggggagcucaugacuggcugucuucuacugugugcuccaguuuaucuccaagggucaagcaaccccaccuugagagcucccuaccuaggcucaugugaaaagcaaaggacuaugugaugaggaugaauggauacagcguuugaccugcuagggugaggcaagugaauugagaaguuccugacuuuccucauugccaacuagucauguuccucggcuucccucuuccagaauaaaccaaaauaaaauaaaagggacugcaaaugcccaugacuuagauguguuagaguccagcuucuguuucccccauuugguccugauuuucgaagugaaggggagacaggacugaguggcaugguggugagcaacccgugugcuuagcccagcggcucucugguuugucauugugguaucccucucuggaccacaguuuccucaucuggaaaaugaagaucuaaggcuaggugauuuuaaagucccuuucagcucuaaaauauuauuuuacaguuguaggauuuauggaggagaacggcauuccgcucuaucccuugcuuuagccuuuugaaugaaagugagaugucucaucagcucagauagagccagcucaagcccagugucucagauaaaaggagaaagaaaaaaaaaacuuauuaaagauagcuaaguucccuugauaagcagcaagugagaaauccugauuuaauuuaaauaugauauuucugucuucauuaauuuaaagcauguauaugauaauguauccuuuuuuauuuaguggucugcccugaagggaaagaaaggcuugauugugaagcagaggggcaaaagcuuggguauauuuuaauaaagaugaauaucccuaaaaaugcuugaauuauuauggaaguaagauuuguugcaaguuacaaaucaaagccugaauugucacuuaucuccuaaugauacuucuacacagauuauuaauuucauuuuagaagcccaaugaauguuauauuuuaugacauugauuaaacaucuugcugccaucuaaccauccauccuuuucauuuucaaaaauccauaucggaauuuaacaaaaacagcucauaaauuuguauuuuacagccuagcaaaguugacugguucucuacucuacuuacccucgggcccauucugaacucugggcuugggccauuuccacucuuagaagucagcuuuuccaaacugacaucauguuuuguggucagaguaguacuuggggauuuguuuggaagagcacguguggcuucuggagcugcaaagccaccaggggaguucugaggugguugggguuagccccugacgggaacucagggucucagcuuucauucucauucuuagacaagcuaguuaccucccuccucaguauccuagggauaauuaugcccuccccagggggcucccagugccacuguggggaugaaugagacaguagaugugaaaggucuucuugcucuuuagaggcaagcagugugguaauggauuuaagagccaauaaagaacagugagauuguagguuuaggaucaaccuuaggcauuauaggaaagguguaggaugacuugaaagcagggauaaaagccuuuugaaaauaucuccaccauguuauuauuuaucaaacguuugucaaaagaaguaccucuggacauagacaguucucaaaaaagauauacaaacagccaauaaacauaugaaaaaaugcucaacaucacuaauuaucagggaaaugcaaaguaaaaccacaauaaaauaccaccuuacuccugcaagaauggccauaauucaaaagucaaaaaauaauagauguugccgugguugugguaaaaagggaacacuucuacacugcugaugggaauguaaacugguacaaccacuauggaaaacaguauggagauuccuuaaagaacuaaaaguagaacuaccauucaauccagcaaucccacugcuugguaucuauccaaaggaaaagaagucauaugaaaaagacauggcgcacacauauguuuacaguagcacaguucacaauugcaaaaauauggaaucaaacuaaaugcccaucaaucaacaaguggauaaagaaaaugugguauauauacaccauggaauacuacucagccaugaaacaauggccuuugcagcaccauggauggagcuggaggccauuauucuaagugaaguaauucaagaauggaaaaccaaaugccguauguucuuaccuauaagugggagcuaagcuaugaggaugcaaaggccuaagaaugauauauuggacuuuggggacucgggggaaagggagggaggugagugagggauaaaaggcuacauauuggauauaguguacacugcucaggugacggcugcaccaaaaucucagaaaucaccacuaaaguacuuauccauguaacuaaaaaccaccuguaccccaaaaaacuauugcauuuguaaaaauaaauuucugaacccuucaaaaaaaaaguaucucugguuucacgagacucauauguguguuuccucaaaaccacugugggcucauccuuucccuggauuggcucccauuaggggaccccguguguuccugucacauuuccuucuuuauaauugugaucuuuaugauugcuguucauuuccauccagcgagggugcuggcaccuggaucgccaugcagggugcagcuguggccagcucuuccuccaggaaggagaccugaagagacguauucugagaagccugaauucgacucuacauugaaaaauuaaggacuggcaaccaaaggcugucacuuguugaagaaaaaaaccuuaauuaaaaaauaaauaaauaauaaauaaauaaauaaauaaauaaauaaaccuaaugaagcugagggucaaggggcaucgggauaaacuguuuugcaaggguugaugacauuaggaaaaauaacucuauuaaaucagaagucugccucugccagguaauccuuaccaaaaguaugcaagaagcuugagagaucagcccuagaaggaaaggugccaccccaguccuccaagggcacagggcacagggguuagcauguaagcuugcuagucaggcugcugaggcucacaucuugucucucgcuguacccuuggggaaguuaucaaaccuugcugaucuuugguuucuucaucagcaauagcccugucaccuagggacauugugaagauuaaaugaaguaauaguaguauaugucaagugcuuauuagugcagugucaggccaaaguuagugcuuaauaaauguuaguuguuguuuggccaggcacgguggcucacgccuguaaucccaacacuuugggggcugaggcgggaggaucacuugaggucaggaguucgagaccagccugaccaauauggcaaaagcccgucucuacuaaaaaacaaaaaacaaaaacaaaacaaaacaaaaaauuagccgggcaugguggcacaugccuguaaucccagcuacuugggaggcugaggugggaggauugcuugaaccuaauaggcagagguugcagugagccaagaucacgccacugcacucccgccugugugacagagugagauuccaucucaauuaaaaaauaaguaaaaauaaauguuaguuauuguugucacgcguuggcugguagucuguggugguggugcugguggugguggugguaguggugguagugguccuuuugguuucguuuguuuuguuguuuuuguauucccccccccccaaaaaaaaagaagaaaagguugcauaucaucacuuuaaaagcugaagcagagcuuuucuaggccccacagggccuuucccuguaggcauggugguaaacugguguuuagggacagagcauccuugagugagguuggcugcugaggacagccccucccuauuugggaggcaagggaguugguaugauaggagcguuacugggagaggacgguagccgcuuagugugaagacuucuccagcauguugugaaauguucuugagugacacauuuugcccuccuuuuucugacucaucuaccucauccuucuccuuuccucccccgcgccccccucccagccaacccuccauagugugcuccaacacuggcgauguugcauaaagggaaaauauggcguguuuacagagagaauuuucaagaaguguuaauuuaauaugcuaaaguguucccuucagcauuuuaccuuucuuguuguuuucacaaaacagccaagacuaaauaaugagcccagggcugugcccuuugguagcgugauagcucauuacccacuagcggccuccaucugcccucauggcugcauagggagccauuacgauuaugauggaaaucucagaagccauuaccaagaugcaacagagggccuacugcagacagccuaauggacuaauuuguaauugggagagggaaaugaguuagcgagcuggggccgguuuugaugagaguggaagugcgcaugcuaaaugugauaaaugaauaggaauguguguuugcacagugggcucuacaagcuuuccaucucuccuggggacuggaggcgugcugacaagccgugaggagcgaggaggaaaggcucaggggaggcaagcaagauucaaggagaguagcuaaggauaaaucggugaggaaaacuaauggcaguaaaaauccaaggaaaugacugcaucugccaugaaaguaguaauuaggaagcauucggugugcaugucuuuaaccguuaaaauagggggaugaguagauggaaggcuggggcgguggugggccaagagagaagccccucguagagggcuccgaagggagagcauccucagaccugguggucugggcaaaugcugccugcucagaacggagccgaguccagaaacaccacgggcaccgcccuucgaggggcuucuggaacccagcaaugggaaggccuagcaagcucacaggcagccauugugcaaggcaaggaggccaggcugcagugccagaccugcagaacaucuguccuuggagggcuggagagucgcuucauaagcccucgugcccggcgcucuaagcugaggagugcugggcaccaguguggcuauggacagauuucugaaagcuggccuuuccuucuguuugucauuuggcucccagcauuucaucugcccagccuggagagugcgccaggugcccucauggaggccggggcuuuuguuuccacucacacugauggaccuggugaaggguaauccccccagucggucugaggccaaguccugcuuggagcuguccucauuuucuguuucuuuuuggcauuuucuguuucuuuuugguguaucuucucaguucuguccccuaaccuccaagcccugguguucuuucuccucagucagaccuucuuagcccugaaagcugcaggccaagccuuaaugggccucuuuuucccagcaaccugccguccucaacccuuucucuggaucucacuuuuccucaugggccagccugaauugagccucaggaucguccuagcucucaggauuccuccugcucccaaacauucucaucucuuuuccugggaggaccuuucagccuuccuaaauagccuaagggaagacgcguaucccuucagggaagaaggaagcacuggaaccaauuaacugaaccccagcccagggcucuuagaacccuuucccaaggugagacagccacguagcugacucugccugcagucccaccucugucccacgggcucacuuuucccaucacauucccuaguacacaggaaaaguucccauuuucuucaccaagcacuagaagagguuucuaauuagcucccuaaugggaugaugacaguccuguucagcaaaauuuuauugucagccuauuugauugauuaugugagugauugaucccaccuacuuugaaaaugaauuugaggaaaccaacaaaaaacacagauacauugagaccccaaagcaacucauucugggagaaggcaaucaauaaauacaaaaggcagaaaaacauucucaaaacauaguacaaauuaaagaaaguuauugaaaaaacacaaaugcgguucugcugugacaagcagucauagaaaaggaacaacuggaugaaugucauggauuaacaauggaagcauauuauuuaaucaggggcaacugacuuuuucccauccaguguccgcuguuaaguauagcauugguuaugucaucaauaucccuaaaccaagagccucaucauacagucccaucaauguuguauaaaagaccuagauuuucuguguaaagguauugcuuagauauccuucaguaaacccccccagaaugugucaaccuaggacaaagccguagagagacgacaaaaaucagguuccugcugugcccaaguucccacuuuagugacguagagauuuauacuuggguaacucuaauucaguuacacagacaguaacaaagcauuuagaaaaugcacaggaggacaucaucaacacauuugacaaauguuucuugaguacauccugugggcaggcacugagcuaaucacuggagacacagcauuaaauaagugggagaacauggcccauauccucaugaagcuuaugaugaucgaauucugacccaaagaagguauggugugaggggaguauuugagcugagcugugaagcuagaaguucauuagaaaucaacaacaaugagauacccagcaaaaccccaaauauuuagaaauuaaacaacauauuucuaaaaaauccaugggucaaagaggaaaucacaagagagauuagauacuauuuuaaacuaaaugaaaaugaaaaugcaacacaucaaaaucuguggcaugcagccaaagcaauuccucagagaggaaugguuguguuagauuacauuaauagaggaaugcuuguauuagaauagaggaaaggucuaaaauaaaucaaaauuccaccaugaggagguaggaaccgaagaacacagauaaacccaaugugagaaggaaggaaauaauaaagaaaauagcagaaauuauugaauagaaaacaacaguagagaaaccaaagccaaaacaugguucuuugaaaagauuaacaaaauugagaaaccuguagcuagaaugaacgagaaacaaauaauaaaaaaaagaacacaaauaccaauucaccaagaaugaagaagauguuaucagugcagaucuuacagacauuagaaggaucaucaggacaggagcucgacaagcagaggggagguaacgaguugcuaguucuguguggguuugugggguggagagaaggaguugccauagcaggcaggagcugaaaagaugugaaccagaauuguugguuucuacagugacccaggaccuguguacacagcccaguugacugcacccuauaccagcagaguucccaccguugagugguggucuaaugugcauguuagaccauagaugccgagacugacaggucaccaauggaccauaaugcuuggcuuucagggcaccuggacuugcucaaaacaucguugagcauuggccaguaagucaaucugauagaucuggguccacagccccuagaacauaggggacuuuauuucucccugccaacuucuggcuucugaucauucagucucauggauaucaaaacugaccugaugccauccugaggccaugauaucauccuuuccacaguuuauaugcuucugaaaauggagcuuucuuuuuaaaagauuaagucugaauauucauggcagaagaagcuugccaaagcuggcugcucaccuccagcucccaagucaguaucagccugccauggcuuauuccagacccagacaacaucaagagagaaggcggguguggcaugggccaguuucauccacuggucacaggaccggcaccugucagccaugaggcuguagacaggguccuaaagugcaaagaaaaagcugucaaagcuuaguuuucucccccugcucagauguuuaccuggcaggagugccugccgugucuuugugucauuguugcucuuugugcaacuggccuuccuuauucucucauuaucacacacucucucucucuaucucugucuuucaucuguccuauuauucaucugaguguggacucaaaagaaccagauucugauccugggcaggcucccuuuccuuuacauaucuuaaugugaccauccauaaaaugagggaaaugagagugccaucucauaggcucauggcaaguuaaaugacuuggugugugugcguguguguauacacacacacacacacacauauauacacauaauauauauguuauauauacacauaauauauauguuauauauacacauaauauauauguuauauauauacacacaauauauuauauauacacauauauguuauauauaauauauuauguguauauauaauguauauauauuguguguguguguguguguguguguguguguguguauuuuuuugagacagagucucacucuguuguccaggcuagagugcaguggcgcaaucucagcucacugcaaccucugccucccagguucaagcgauucuccugccucagccuccugaguagcugggauuacaggugcccagcaccaugcccagcuaauuuuuguauuuuuaguagagaugcgguuucgccauguuggccagacuggucccuacguccugaccucagguaauccgcccgccucggccucccagagugcugggauuacaagugugagccaccgcacccggccaaaugaguuaguauauuuuaaaagcacucagaccagaacuugacaccuaggaagcacuagauguuuuaccaaaucacaggccuaggugugguguucuucagccuuccuggcgccuguguuccucaggcugaccacgcuggauuccucuucuguuggaagcuccuccaccccaccccucccaguggagaccugccugccucacugccugcaggcagccuggcccaacagcugcaguauaggcacagggggcauugcucaggggugcagguguucccuaacccuaaguugagaccugagggucucauuagguccuccaaacuuccaagauuguauacuuaaugaauuggaggguuucaccuucccccaaauagccauugagcgaauccagccaccacucccgucagguccuggcuguucauguugacacugaugcuggcgagaggggaguaucuugaaagggcagaacaauuggggugaggauggggaagaaaagggagaaagagaugcccucagguggggaauuuaauuuagucacaugauaguagcaucaggcacuuguguuuuacuuuucucagaacauucucacaugcauucucuuacuguauccuuaccacaagucugggagcuagcuguggccgaaguggguauuuucucuagaaacaaaagagcugaagccuaggaaggcugaaggacuugcucaaggucaugcagcuaccuagagacaaagcggagaccauaagcccagaagugcugauucccagggcucccugcaggggaucauguauagagagucacugugaacugcugucugagcaaacuacgugacccccucuuggcaagacgaaaggccuuggcuuggagcaagauggauggagaacacuccgggcccacacuaugcuguuuugaaacugugccagagaagaggaguggccuggaagugcagcccccucuguuggguguuucugagaaaguguuuuucuccuuugcuggauuuaaugaauaaauuauaauaacuuuugcguuuuuauccacauuaugcauguuuaucugcccuucccccguaaacccccuuucccacuuccacguaguacuauauuucuuuucauguuuuaucuuugggaacuugccacugauaauuauuuuuuuaaaaagcucauuccuagugauugcugguaaagaugcacaccucuucauuuucuaaaaauguauaugcucaggaccaaaaauucagggaggcaugugugggaaaagguauauuuccacuuccaaagagaggguacuuuuucagaagcucagaaaaggaaaggggaaaauguuauaugagcccuggugguaugugagcuccuugggggaauacaugguugucuuaucugucuccagcucuuugaauagaucuugcaugcaguagcaugugaguacauugauggaaugcauguaccaaggagcagcuggauggcugaugggcuggauggcuaagugagugcauggauagauggaugcccaagcaacaaagugaaaccucauuuggcuuguugugucagagagccuucuuaauuacuacucuggauuucacugcuauauucuauucuggccaagucuuggaauuucuuuauguucuaggugggaaaagauuacuucuauaauucaucaaggaaaauacuaacuugcucccccagagagcugggggaaaacacauuaauauaaauauaauugaggaguggaaacaaagucuaggaggaguuaaagcauaaguaucagccuggaugugaauucuaauauaggaauuagaauuccuauauuaaaaauuguauuagaaaccuuuacuuucuugugauuucuguuaguucaguaaguaaccuuucuuggaaggucuacuaauuccuuucaaaaaagauauuuauuuuauaucuuacuauaauauacuaagcacuguuauugcuaggguguuuugaaggggcaggagaugguauuuaaaacugaguugcaguucuaggcaguuaaauaaaauccacugaccagaaaaaaauauguaaaaugauaaggcaggauaaguauucacugccaaaaagucaacaaagaaaauaguaaggauuuauguucagcaaucccugagauuaaaauuuaaaauaaauaaauagggauaguacgauuugaaaucggcguccucuuugaacuaggaauucaagacucagaauaaaaugguccuuuucauugcagagcugaucuuugugaccaacaucuugucuccaccaggaacauuuuaguugagaagcaggagaagucauugcuaagaagcuuggauuuucaaagaaacagauaucaaauugagaaaucucuacuaaucuuucccuucagagucuaggcuuggguauuuuuuuuuucaaaacuacauuuauuuuacagauaaucaagacucugacagaguuuuaugucuuuuuaucacucuuuaucuugaaaagcauuguuggccuaagguugaaucagccaaacacucagccucaugaagagcuugucuggggcccauggcgaggaaaaugccagaauguaagugcuuuagagacgggagccauaauugcaaugagaaggggagcuguggcuggcucugacugcccugcuucccacauuuucuuuuaacgaguguccccacguccccaccgccccucccccccgacacucagaucccuucaguucccacuggcugccauuuucccuugcucugcagccuccaacuccacuccacuuaagagaacagacuggagacugcuggaggcccugaagugauuuauugcuuagcaggaacuucacuaaacuucccaaguugauuuuuuuuaguuuugaaaaucaaacaaaguucaaaaaguaaacaucacagguugacaucccagcccaaagcugaggaaaaaugucucuuguuacauuuuuuggcacauaauagaauuuaugagcauuuucaguguuuugauuuuuuuccccagucacuguuauuccuuacccuccagaguuagguguggagagauuauguuggccuguuuccauggugacacugaagaaaaguaauuuuuuaaaggagguuucuacuguguuauuucacaugcaugaaacaucaacaucuaugcuguguggcuauuaccccuaaacauaaagacacagaaaugguuggaguauuuuauauaaauagacaaguagggugauauuuuccuuggucucgugccgacccuaguaacaaaagucucucaguuacccagggcaccugggagagagugagggaacaguucuguucaguguuaagcaagcuccucuccugugaauaaccuuuucuuuaaaaaaaaaaaaaaaaaaaaaaaagcucaaguugaaaguccaccccccuucuacuuaaacuagggaccagaugaaaaguuccuuuuggggcucacuguucaaagaaccaggauuaaucucuguuuucgauguagcuuacuuggucaaccacugcaaguauuccccuuaucuguccaaggcguugucuagaaucuucuugccccaguaaacaguugcuuacagucuccuagagugagguugguuaggguaaguauauaccuuuagcagcagaaauuuggugaaacucuuuccgccacccuacacauagacacacaccccccgcacaugcacacgucacaucagcaucaaucacacaccccacucacacacaccacguacacagucgcacacacacaccccacacaugcacacgucacaucagcaucgaucacacaccccacucacacacaccacguacacagucacacacacacacaccccacacaugcacacgucacaucagcaucgaucacacaccccacucacacacaccacguacacagucacacacacacacaccccacacaugcacacgucacaucagcaucgaucacacaccccacucacaccacguacacaaacacacacacgccccacacaugcacaugucacaucagcgucgaucacacaucccacucacacacaccacguacacagucacacacacacaccccacacaugcacacgucacaucagcaucgaucacacacaccacucauaccacauacacagucacacacacacaccccccccacacacaugcacacgucacaucagcaucuaucacacaccccacucacagacaccacauacacagucagacacacaccccacacaugcacacgucacaucagcaucgaucacacaccccacucacacacaccacguacacagucacacacacacacaccccacacaugcacacgucacaucagcaucgaucacacacaccacguacacagucacacacacacacacaccccacacaugcacacgucacaucagcgucgaucacacaccccacucacacacaccacguacacagucacacacacgcacaccccacacaugcacaugucacaucagcgucgaucacacaccccacucacacacaccacguacacagucacacacacaccccacacaugcacaugucacaucagcaucgaucacacacaccacguacacagucacacacacacacaccccacacacaugcacacgucacaucagcgucgaucacacaccccacucacacacaccacguacacagucagacacacacacacaccccacacaugcacacgucacaucagcaucaaucacacaccccacucacaccacguacacaggcacacacacacaccccacacaugcacacgucacaucagcaucgaucacacaccccacucacaccacguacacagucacacacgcacacaccccacacaugcacacgucacaucagcgucgaucacacaccccacucacaccacguacacagucagacacacacacacaccccacacaugcacacgucacaucagcaucgaucacacacuccacguacacagucacacacacacacaccccacacacaugcacacgucacaucagcgucgaucacacaccccucacacacaccacguacacagucacacacacgcacaccccacacaugcacacgucacaucagcgucgaucacacaucccacucacacacaccacguacacagucagacacacacacacaccccacacaugcacacaucacaucagcgucgaucacacaucccacucacacacaccacguacacagucagacacacacacacaccccacacaugcacacgucacaucagcaucaaucacacaccccacucacacacaccacguacacaggcacacacacacaccucacacacaugcacaugucacaucagcgucgaucacacaccccacucacacacaccacguacacagucacacacacacacaccccccacacacaugcacacgucacaucagcgucgaucacacaccccacucacacacaucacguacacagucgcacagacacacaaucacuucuugaggcuucagacagguugcuuuaucuagggcaagucaaaguuuggaaacagaagaggucaugauggauuguugugcuguuucccuuacguguaaccaugguuagacuuucuuguuauguaacugagaauacuugguuuuuggaaaauaaaauggagagcacugcuuuaucuuggagaauaauauccucaugcauguggagaaugccuuuaacuuuuccaagguucuuccuacauguuauuugaauuuccuaauaauucugaaagguagauuuucuuggcauuccccuuauuuuaaagcugcagggacagaaguuugcguuaccuguucauuaggggcauagcugagucagggauucuggacccucgguuuucgcugagguccuguguuauuaauccuauacuuggcaucuuccacacagccagucugagaaagcacagggccugcagcuuccugggacagggucucagacacgcagagaccaucaggaggaguucacucugcuauuaacaaauguuuacugagcaccugcuacacaucagacacuacuccagccgcaauaguccaaacagucaagaaucccuacauucuaugaguacaagggaauggugagugaaugaguaaaacacauaaugcaugugucagauggugauuagugccaaggagagaaagaaagcaggaagagggguagacagaaugcugggagugaaaagaagugggaagagguguuauugaggggugacauuggaacaaagauuugaaggugcuaagggagcaaguuuugaggaugucuggggaagagaaguccaggccaacagaaagaucaaggaguguggaaaccggcaugcguugccuuccugaaauccacagagccgcauacucauugcauguguguguguauuugaaaacuucuuaaauucugagguugguacauggcuuuaauuuuugccuuaauggcuuccugcacuuggggagcucuuuaauaggugcauucugguaguaguaaucaucaguccugggcugguaucacauuaccuauguggaaaaaagcagaauugcuuuggcacugauugggucuugggguggugacuauguuuuccugguuuuuaaugcagaucauugaaaacaugucagggccuggucucaaguguuucucuuaaaugggauagaaucauguucuuauaagcagaggguguaggaagggacuaggugggggguuggugggcagaaggguucuuauauuuuaaaugccagucagcugcaaccacuaguuaacuggagccuguucaaacucauuuggagaacaguugaauuuuuaaagugccuuuugauucucucuuucauuuauuuuaacugaucugcugggauuaggagcuugguaggggaacaccagaaugcuugccaaaaugugugaauaauuagagcugcgaugaugugugccagauagaaggggaguauucacacuucugauuagauucagcuaaaugcaguuguaaaucacugcugccacaguaacagcgcccugucaggacugagcacaagaggaggcucagggcagugaagagacgcagggcagccccaaggcauggggcuggaccgaaccuuuguggaagaggagggcaaggagaauggcuccagucaccagcagccccugggacauugguuuuggcaucucucuuucagcucacuucuaccguguugagucuugcugggcacugagguggccaccaucucagcaaaugcgaguaagacgggucccugcucucgggaugcuuacagucucacggaaggugaaugcacaacugugguucagugugaugcauguguccgcaggacagacauugugcuaaagggucccagaggaggaauugggccugcugaagggaaaggagaagggauagguggaaaggcaguuauuuccuucagagauaaaaguugacauuucagagugcucagcaagauaaguuaguggcuggaggaguuccaggcagagggaacagcacaugcaaaggcacagacaggcaaagccccacccagucuaagagugcaguccuccaggauggccggggaacugggaacaacauggaagaggcuggcggugcaacuuggaaacacugcaaauagguugggucagaaugugaagggucucaagugcucauaggaggaagcucuucuuccaauuacguaccacucccaagaucccagcuaccccuuggagaggguggguuucccaccucagccagagaacccugccuuagccacagucaucgaugggaauguguuaguauucuuuggacaggagaaauaaauguugagaaccauugcucucaccaguggagagucuuaggagguuaagaaggugaagaggaacuauaagaugguuaaguuaaaaagaaaacuggcagaagcuuugguguagaauuguuaguuuacagcaagguaagucugcaggcucccagauguagauaggagguuacagucaaggucugaccaaaugauagaauccauuucaagagagauuucagaguggaauccagucagacuuguugaggaagacuccagcugugugcuggguuucuugcuccuuucugaaccauccuugccugauccugacuuuucuguacguguggagugccauagcucaagacacgauguccuucggaaaauagacagugaguguauauguuuuacaguauugcccaagagguggaauccugucauuuccuaaucacaacuacacguuuccucccucuccagcacugcucugcucccuuuaccuaagguugcuaaagguacugguggucuucaaaaaaaaaaaaaaacaaaacaaaaagcaaauacccaccucuuacucaggacaccccagucaguggaugccuucucuggccccucucccguccuguucuuggaaaagcagccuacuuucucuguccugaucaugcaacaaguugcucugaaaugaaccagcagcuuguggugggaauaaaagcccaggaaaaggaaugcagaaggaaagugauggaacggcaugaaacccaaagcaauugauaaaaaugagcaccacauggagaauguggaaaggagaggcaagcauaaaaaucacaaccacaucugacaucucuagaaauggagagagacaaaugaaaucucacauguggcuuuccucaagucagaaagauuccgcuucuccauucaggggcgggaugaaggagccucuuuggaagccgugggccuuucucaaguuguucuaccacgccuuucauuucucccgcuucagccaguaaguucaagugcuuagagaaaugcuuagccucuagcaccuucuccaggcacaaaauaauggguugaccaaauugauaauuuuuuuuuuuuuugagauggagucccucuuuguugcucaggcuggagugcagcagcaugaucucggcucacugcaacuucagccucccagguucaagcgauucucccgccucagccuccucgaguagcugggauuucaggcauccgccaccacgcccaguugauuuuuguauuuuuaguagagaugggguuucaccauguuggccaggcuggucucgaacuccugaccucaggugauccgcccgccucagucucccaaagugcuggaauuacaggcaugagccacugugccuggcccgaauugauaccucccaaaguaugcaugaaggacaauaauuugagauaugaggaaaaaaucuaaaaugacuuuuucuacuuauuuuuaucucaccuauucagauuuauuucgugaauguguauuuuagaaauacauuaguauacugguauaucauuaagcauaucaauaaguaaaaauaucucgggcaaguuaaaugaguuauuugucuguuuuuacucuggggggcacaugaucagaaugugugaggacugggagaguaguuagcagugucacuagcugaauguggggccaggaagaaugcucuagaacugugaguccuuguggaaacaggggcauuaacuggaucggcugccuccuucuagccuaugagauagccuguuagcuucccuuguagcucaaagagccccuggaaaucaguagucagaacccagagaaagggaaguucuacccguaaaagagaugcccauguuuucuuagcugauagucacuuugcagagccacacccacaggugacaaaagcacaguggaacuuacccucaggcccuuucaccaucacaggccucucuucuuuccugguuuugucguuggguagggguggugguguugccucccggaacccucauccaggcuacaugagacaugcagacaugcuccagugucaugaaccucccccucaacagcuccuuccccccuuucuccacaacacaaacaaaaccaucaaacuccauaugauuguuauaaucuaacuguggagucaggaauacugugcugcccuacgugaugcucuuuucauuuuugcagccaucuagcuuucuuuucccccuaccccagcaacccacaaacuuaaacuccaaccuaguucaaccucagaaaucccauuaaugucuuagaggcagguggccugaggagcccuucacuucugcugucagcugugucuccauggcucaggaacuuacccucccacccagccaggcugcuuucccugucaauagcauucucauucccuccaugucuguuagaacuugaccauuagucaagcuguuccugagaugugucucuuguagagauguacacugguuagaaauggaagcaccuccgugacuuuccucucccugucauggugacagcagugugacagguuugacaguuccaguuucuaggaccuccagcugcaagugcugcuucgaccaugugcuuacgaauugcuucagguccaccucguacccuuucccucuccagccauguuuaucuuggcuccguauuaauggcacaccuucugaauguuggacaaagauaguagcucuuguguaagaacacacuaucgacagcaaauggaagauguuacacuuuaaggcugccaguuguccccacuugugccauacugaaauaggagauggccugcaucuguuugaaagaaauugagugaaauaauaguuggugaguauaguccugaaggcagugaacugugauggaaucaaggaucucuuccuguuagagugacuuuugcccaccgcuuccaguggugcuuguagaacuuaggaucucaagaauauuuuguguccccugcagaaaaguagcaaugcagguuguucacauccagaggucaugacucccaacagacuuuguuuauagcagcccaggcucagugagguguauagugggaagggcccaguaccacaugggcagagaagcacucauuaacuuccuaccugguuguaaacauuagaaaguucccauucagaaaaguacuuaacagcaaauaucacagcuaugguauaguccuguucugaagcggauguguuuuacaggugaagacuucaggaaaacagccaaagaagaugugaucuuccaagauaucauguacccuccauuguuugucaguagaggaguuuugggcauuuaggguagacuccucccacacaucacaaaacacuuagcaacacugcuuugcccauuaaauaccaguaucuaucaccaucaccuugacuccugaaaaacagucccacacaguugcaagugcuccccaggguggggaggaaaggagcacuucuccagagggagaaccaggggaaacgagguagcagcacccauaggugugccugugcacugggugcagcuagucgguuauuucacucagacucuugaugauucaacacauuuuggaaagagaaaguuuguccccaaaagaggcaccugacuggcccaauccauugucacauguuaauggcugucacaugacagccaguugcuggaucuguuuaugucaccaaauagucacugucuaauuagacuuacaaauucuaaguguagcauuagauuuacaaagucaguaaacugugaugugugccuguguuaucuuucaugaucugacagaucauguuugaaaauuggcccaagcuaggcccagugguuuguaccuguaaucccagcuacuugagagguugaggugggaggaucacaacauccugggaacagagcaagacucccgucucauuuuuuuuuuuuuuuuuuuugagauagauucucucucuguuguccaggcuggagugcaguggcuugaucauagcucguugcagccuugaacucccagcccaaguaguccucccaccucagccucccaagcagcugggacuacaggugugcaccaccaugcccugcuaauguuuuaaauuuuuuguagaggugaggucuucuuauguuccccaggcuggucucaaacuccuaggaucaagugauccucccaccuuggccucccaaaaugcugagauuacaggcgugagccuacugcacccagcccaaaauuguuuuuaaaaauaaggaaaaaaaaaaaaagaagaaagaaaaccggccaaaaugcagagaaaaguuugacuaucaaugcagcauuacuuugguuuuauuuuacaucagccaucuccccuccgcucaagauuugagguugcuuguuaguugaacuacuuggcaaugaauuugucauugaaacaaaaauuuugaauuuuugaauaugagaauuucauuaauaagucaugaauuguaagcuugggugugaaaaucuuuauaauacuuuauagugagacauuucucaucugucgucuugcaggcuacugcacaggagcucgaguacauagauuuguugucaauuaaauauuaaagcuuuauaggcuauuuuuauuuccuucugcuugcauuccuuccuccagcuccuaauagccacauguccagucuuuaaauggagccagguuuagagaggucuaaugaagaggguuuacugaauggggaaagggcagccaccgugaccccauaucacaccuuugccacacaaucagagaccucuguugaagcuauucuggaaaagaucuauucuuaccagaagcuguccugcgcugucagugaaaagacauuaggugcaggugucaaacaugacuaaugaggcaugaggagucgacagcaaaauaacagagauuaugggcagagaggacuugcagaugaaaugugaauagcaguguagaugugugagugaugcaggaaggaaggggaccggcaccgaggagcaguagcugucccacuugcgggaagguuggacaauaucaguuacuugauugguaucuucuccuuugauauauuaaguggacaaacaucuaauguuuuccucucgaaaucaugaguuuccugcaaguguuuggggcuugguauccacguuucuguaaucuucuaagacaagccagaaucuuuuucuguuuuuauauuuacacagguuuuauugugaaauugucaggaaggaugaggcauguuucacucauuaauuuucauugucaucaaaacaucagaguuacagugcaguauccugcuauuccagggcccacaggagcucugauugauaacauucuaccuucacaaagguuguaaucuaaauggaagaggcuggaaaaagaaaaaaguaugauuaguuguaguugugucaaaagcugccucugaacagaccaauacacuaagcaaucagagauuucaagagagguagcagggccugagacucuaacucagugaaucuugcuucaccagauguggagucugucuuuggugguuucgcagagccuggcccugagccuccauccacucagcgcucaauagaugacuguaagcauauuucuaugcguucauuagccucagggagguugauuuuuaccuccuagaggugaauuuuaaagacuuccuuuuuggaugagaaagagaaggcugguagagaaggaggagcagaagcaccaugaaaucaggugggugaugguuuccuuuccuggugcuuuuaaccaguucucccagaguggagauaaacaugaaguuaauauggggaauguugaucuuccuaaaugcagcuccaaaugauagacccaggacagguuuccaaacagcuguuauucagauuagaggcaaggacuugauguauugcucccauuagaaaguguccuaauggaaagggccugcacuuucuccuggccccaucugaauuaaacaauuggaguauuuuaaaucaagggucauaagugucaacaagauggagagcuuugccucucgauuaaaagaggcuuauaaguuacuuaggaaguuccugccgacacagauugcacguggcuccugugaaccgugguuauacccaggcuaaguccagccguuguccuaaggagggagcaggccaccucagacagaaaaugcagcuggagaauuuaagucucacaugccaagauccugcuaaccagaggguuugggggagguaggaccuuucauguuucucugccaacuuguccccaagguagggaccacaauccuggcaggccgggauggggaccaaaguggcacuugccuuucauaacauguuugugcuuguuuccguaucaguaaugucuuagcuccuuaucagguuaauuacccaccccuucuuuccaggcuccgaguagaagucaugcuccaagaccaggcgcuggccuugaacgugaugccuccuccugguuuguaccuuguuugagaucaucucaggcacagagcacuggaacacggggagccacgugaucccaggugcaggcugagccaagcaugaucccuggggugucuuuuucuccccugggacugacauuaaaggugcaggagccaaucaggaucauaacagaagguagaagauuuccccagauugagaggagaggagagaaagagcagggcaaggggguggugaggagcgagagagcagagcccgaacagcaguagcgagggcaaugcaucuggagcuacaaggacagacgucucuagguagaugcccuuauggcagcgcuucuggagagagaagaaaaucccaguaauauuaacagggcuacaacaaaugaaaauuggaaaauaaacagauggaacaugccucauaguuuagcuuuuaucaucaauaauucuaaaucugcaagugaauauggcuaacuguaguucaaaccaucugccuauuacugccucucacuugaagagacuguguugcaucccacucuccaccaagacugagaggaagggagggagggagagggagagagaauaauuauucucagcuguucugucaaaacagacacgugcuccgcgcccagcguaaaggucaacugcagauacaccaucuaucucuggagagggcagccagcagucccacgcugcucuccugggcuuguggggaccccuucuggcugcccuucugaguucaaauguaagcgucuaacaggcaggcucuguuguuuauuucggggcugagauucagcaguuucuuaucuauaugggggaaauuaaugcagguacauguauggugugucccaaccuacucugggccauguggaguccccucugugccuuucaagucuucuggaggcucaucugggguccagaacagugcugugagagaugaaaggacacgagugcugucccagcgcagagagcucagaaucuggggaagccuggcucuccaagacagggaccacugaugcugagugagcaccaacccaaauuaggccuggucuucaccacccucuuuuggaaaaugaacauuuuauucagaaggcaauaugguaagaaccuugaggaaauaaguguaaauuguaaaucagccacaaacucaguuuuagccuaccuugccuugcguauucccucuugcaagacuaaccagagaaacacagaaucaagccuuuaucauuugguaaauuguuucaucaagaauacuggcccaagcaugguggcucacaacuguaauaccacugcuuugggaggcugaggcgggaggaucgcuugagccugggaguuugaggccagccuaggcaagaccacaucucuacaaaaauuuuuaaaauuagaaaaaaaagaaagaauaccauaucugaggugcagaugagugugcaaguaauucuuuuuguuguuguuuuaacaugacaacagcuggcuuuuuuauggagcuucccugaacauuaaaaaaaaguaacuaaggccgggcgcaguggcucacaccuauaaucccagcacuuugggagacugagguggguggaucaccugaggucaggaguucaagaccagccugaccaacauggugaaacccugucucuacuaaaaauacaaaaauuagccagguauggugacgggcaccuguaaucccagcuacuugggaggcugaggcaggagaaucgcuugaacccaggaggcagagguugcacugagccaagaucgcaccauuguacuccagccuaggugauggagcaagacucugucucaaaaaaauaaaaauaaagaaaaaguaacuaagacauaaaaaccaacccaaaauaagauggggcaccugaaaaguguauguguacacaugugugugugcauguaccucauaugggcaaugcauguguggacacaaauaccaaaaauauuccaaagacuuaauuuuuuagguguugacuacuguuuguucauagcccaaugguguuaacaagcaguagauuguuagugacaaucacacucucuccagcacuuacagcagaaggcuugauuuaaucgaagagcugucauuuauuauucuguugugcaauuccauggggguagcuaacugaucaagcucgggcuacggggagcagagggcuuuuuuuuguuguuguuaugucuaaauccucaauacaaauuacaguauuucuggacucccagugggacccauuagagccuguggggcauuaacgaucauuaauagugcugucaaaaaggagggggguagggagagaaggaaagaaagggagggaagugaagaaagggagggugcagaauaguagccagggagaaguguggcuuuuuuucagaaauggaaaauuaauacaucugcuuuguucacagugccgagcauuugauguuuauuaacaggcaucuuaauuuugcagauuaguaccagucggguucuuacuuccgcauauugaaauccuuccauugccucagauccuucuucucuuuuccucauccuuccuccgccuucccaaaaucuuucucuccccaguagucaguccugaaucuccaacuccaacaaugaagacagaaagggacugagaaaauaugaguggggagagugucuucauucagaacagagugugugcgcguacauacauacaccacgguuacagccauaauuggcaaucuugccugugauaucccauuaacugugguuccuuguaagcauuuaacuguauaguuaguaaucagguagaaauguuuuaaucacuuacuaacuagcaugcuuaucagugugauggagaaagggcaagguauuaauuaguuaggauaacaugcuaauguuugcauuguaacacuucugcuauuuaaagcaaggaagacccugaguuugagucuuauucagaacugaagccuuuuucuagaauuuuuguucucuccaaauuccauaucuaugcuaagcugacuugccuuuugccucccuaugguugcauacuuuucuccuuucauuauauuuuuccuuucagucucggacucuugagaucuagucuucuacauccaugacauucucaaaccacagaaaggaauuuucccacaauaauaauaggugugcauuacacuuucuuucuucgcagcaauaagugccauuacuucauucaaguguugaguaccugugaugugcugggcacugugcuugacacagggaauacagcagagggaagaaagaaccaaggcaccauuccugcccucauggagcuucugcuauggugggagagagacuugggaaucccauaaguccauuuagaaucacagccaugguguaugggagaggcauugggacuaugagagauuauaagguauucugacuugggaggaagguugggaaaguacccuacggaagguacaguugagcagauagaaaagaaaaauagauugcugauuacuuuguuccaggaaccauguuaaguauuuuuccauggauuauuucauuuaauccuuauaacaguucuagaauauagggaggauucuuuaguuuacagauuaaacuaagguuuaaaagagaaugagcugcugccugucuggcccacgguauaagccuacugcauagcucauugaugaaugaaccccagguauggagaauuugacccuuggauaguaacucuuccaucuucucuuuuucgugucuuuugacauuuuugagcauagauaaaccaggcugaccaaugcagccauuuuacucucaucaaggacucagaaugguguggguacugugcacuuguuugagacaaugcccuuccuugcugauagcuucccgaauugagcaaagcagauacaaaaaaagugagcaagacucucagccuacaaucucuaguguggaagaaacacccuauuucuuugcuuucuuacaucaacuucauuuucuacuugaaacuguacccccuaaagggaccuugcacuuaagucguucccagugcauccuacaucccuagaguugugucuguguucugugucuuuuugccaagggauguugaaggcuggaaguccucuaggucuuaggucccccagaucacugugggaagaccccacauccccaucccugugagccaccaggagccugguguggccauuucuccuggggccuugcuuccuccugugagccauuccagaauaggguguggggcccuggugcucugacagccacagcuuccucugcuucuccauucugggugaaucuuuuccuuagcgaagcccuuccccauaucuuaggcacuacaauucuuuacuuaagcucucuuaaacuuuaucuuucucauuccauuagauuuucauggccauugaacuuagcaacugaagaaaacuaguuucccuuuccuauagggcagagagagcuuuaguaaccaaauguuccuaggaggaguggggaaacauuuuuauuuucauuccaguaacacagugguucucaaagaguggcccagguacccaagggggauccccaagacccugucaggaguucuccaaggccaaaacuauuuucccaauaauaagacauuauuugccuuucucacuuacuaucauucucucacaaauacauggugggguuugccagaggcuacaugacaugugauuuaaaauauugaaugcaaaagcaaauaugagaauccagacaucuucuauaccagacauuaaagaaaauugaaaaaaauguaaaacucacuaauuuuuuuguuuugaaaaaguuauuuuuauaaaaauguauuuaacagguaauagguuuauuguuauuuuuaaaugaauaaacauuuuacaguuuucucaguuuuaauuuauuuauuuuuauuuauuuauuuauuuauuuuuguugagacggaaucuugcucugucacccaggcuggagugcgauggcgcgaucuuggcucacugcaaccuccaccucccggguucaagugauuguccugccucagccuccugaguaguugggauuacaggcacccaccaccaugcccggcuaauuuuuguauuuuuuguagagacgagguuucgccauguuggucaggcuagucuggaacuccugaccuuaguuuaucugcccgccucagccucccaaagugcugggauuacaggcgugaaccacugcgcucggccuuuaauuuuuaauuagcauagcaaaagccuuuuggaaguucucaaaaaaaaauuuaagaguauaaagggguccugaggucaaagcauuugcaaacugccacagcagagcaaaggaagaaaagaaaaaccaaacaucagauuuccagacgaaauccaccaugccacaccggcaauuuccaaaugcggaaacuggauugugucauccagugagagaaacuguuacuuggauacuuuggcccuaccucucuuauuuuuuuuuucucaaauuugaagagaucauaauaaaacaaccuccuaaaucuagguaaucacacaucccaguuucccugggacagccccaacuucuauaugcccuuuguccugucauaauuuuuuauuuuuauuuuuuucauuuuaaacuuuuuuucauuuucuuuuuuuuuuuuuuuuuuuuuuuuuuuuuauugagacagagucucacucuguuguccaggcuggagugcaguggcacgaucugggcucacugcaaucucugccucccagguucaagcgauucuccugccucagccucccaaauagcugggauuacaagcaugcgccaccaugcucagcuaauuuuuguauuuuuaauagagaccagguuucaccacguuggccaggcuggucuugaacuccugaccucaagugauccgccuugccuuggucucccaaagugcugggauuacaggcaugaaccaucacauccggccuguccugucauaauuuuuaaguguucccacuuucacucuucaaaguguccugguuugauugauaaauuaaaggucagccuaccugaaccccacccaacuucaugagcuuauaaaugacaaaguaaauacaaaauuucuauaguccagagagucaagaaagcaucccauuuggauugacuggcugggauguggcagagagcaugcauuuauuugucugugaccuuuuccuguuucagcugugaauauggguccccacguugaucucagcuagggagcuggguauuaaccaucaaggcaguggugaaccgggugggccucccacacaaaaagcucacuggcaacuagcaaauccagauggcgcacauauccaugugauauuagccacauagaggccuuugcggggcuuuuuuuggacauugcuaagccugcugagucuaagauuucaaaugcuguuuugagcuacuugauuuagaggugaagccagaccacuuggagggaagugugaaauucuuuggaguucuucaacucacuugugacucuauaaaaauuacccgggggccagaagcaaggaaggagguaacgcuucaaguggcccuucugccuccacagcacuuuucagauuagggagugacaggggcuguggaaccguuuuucccucccgcuccucaguaggaaaacaucgaaacauccauacugucagcugacaugauuuggggugagcuuuaaaggacuaaaggacuccccccagaaggcugaaauccuuguuaagcaaggaacuuucaucucagguucuaggcucaggagcauggaaauuggaauucuuuuuaauugaccauaugguuaguuuugcagcuuugugaagcuauaaaucuuugguggaguuguaacccagcagaagugucaccagaggaaauuuuuuuuuaacuuuuuccucuuguuucuucccaaaacucacuuaaagaaaaaaaaaaaaccaugcagcuuuugauauauacacacuggugagugaagugugggggggcaguaggucuuggacaagugagcguggcagggaucugucaggcagauccagcaguuccagccccauucugagagcucgcaauuuagcuuuugcuggugccagcaauuauaaaaggggccuacucagcuuuaagcacucaaguguugauggacaaagugcuaguuuaacagaucugcguaauggggaacagguggauaaauacaggauuagggagcccuuuacaguaacagccuuauuaucacauguuaugugggguuuuugccuucauuugacaacuuggguuguguaaaaaaauuuuaaguaacacaacauagaggaaacccuucauaacaaagcacugaaacaauuaaucaagauuuaugaaaccucuggguaguagugguguaucaaccaaaguggcuauuucugaucagacccacagccuccuaaaugaauaaauggagagcacagcaccagaagccacagccuccauaagugguacaauuguuuuccauaauugaagauagcaaaagccuguguacgaucaaagaccauuccauuaggagagugaggauguaauaaggggacagauuugagucugcccagccuggaaggcauauaaucuaucccccugucuccaccacagcaaaccccacuggugaagcuuacuccaucucaaaugguggcuguaauccaccuuuugcccuuaggaaauuguauuaguccagaccuaacccccuuauuaagaggaagcacuuuugccauagaaaucaucuacuuuucuguuuccuuuuuuuuuuuuuuuugagauggagucacuguugcucaggcuggaguguaguggugcaaucucggcucacugcaaccucugcuccuggauucaagugauucgcaugucucagccucccagguagcuggaauuacaggugugcgccaccaugcccagcuaauuuuuguauuuuuaguagaaaugagguuucaccauguugcccaggcuggucucgaacuccugaccucaggugauuugcccaccuuggccucccaaagugcugggauuauaggugugagccacugugccuggccccuuucuuuuaaaucaccauaggauuuauuaaaugagcacuguauagauuuguuuuacaauuuuuaaccuuuauguaaauaauguccucucuuuuaccccuuuaaaagcuguuucuuggcuacauaauauguuuuggcuguuuaucuauaugagauagagcucuaguuuauuuuaacugcuguauauuauuuuauuaugugaauaaaccauacuuuauuaauccuccuauuggauauuuagauuguuuuucauuuuuaauauaaugacgaaguccacagucaaccauuguuucuuuaugccaaggauuagguuugcuggguguguuagucuguuuugcauugcuauaaaggaauaccugagacuggguacuaucuaaagaaaagagguuuauucggcuuaugguucuacuggcuguacaagcauggcaccagcauaugcuuggcuucuggugaggccucaggcagcuuccaaucauggaagaaagcaaagagggagccaauguaucacaggggaagagagggagcaaaagagaugccagguucuuuggaacagccagcuccugugugaacuaagagcgagaacucauucaucaccaagggaaagccauucaugagaguuccgucccuaugacccagcaccucccacuaggccccgccuccaacacuggggaucacauuucaacaugagauuuggaggggacagaacauccaaagcguaucauggggucauaaggugugagcaucuucaccccaacugcuuauugccaguugcucugcggugguugaauucaugcgugugccugggaagugucugagaguucccuuucaccauaucuugcugaacauugacugucaacagacauuuuaauauucuccugugugauaaauauaaaauaccaucucacuauuccgaucauuuggauuuucccaauuacuagugaaauugagcaucuuuuuacacauuuauaggcuauucaacauaauauccuuuguccauauuuuuauugaguuguuuaucuuuuuuguauuuaccuguaaagcucuuuauauacucuggauacuaauuuuuuuugguuguauguuuuguaaccauucauuauuuccuugauucccuuuauuaaguaacagaagauauaaccaaauagguuggaagcuauagcauauagagucaugcaggugaugcucaggaguuaagagucucuccugcaggcaguggggagccguugaggguuauuaaaaugaggaauaacaugaucagauuugcuauagaaagaaaaggaaagcagcagaacagaggaggauggauugcagagaggagaggcuagacgguggugccaauuaagaggcuuuugcaagaauccaggagagaaauaaugaggaccugaaccuaaaccaugacagugacuccuaggaggauuuccaaggauuuccgggaacuauuugagaaugggaugggcaaugcuagugagaauucaguggagcauuuuaaucagcccuuuccuauugauucacagaguuccuuucccaucuugccucggugaggauuguuuccaucaucccuuggccacucaagucuacuuaccggguuagagacuuguugggucuaugauguccaguuagauuucccuucaacgagacccagggggacauucugccagccauugacagaucuuaauucucccuuuggcucucacuuguucccuucaugccaccuuguuugccucucccugacucucccucucucucucuuuucucuuuuuuuuuaaauuuuauuucccauuuuuaaaucaugcacaguauaauacaauaagcauuaaaucaugcaaauuggucuagguuacauuuugaaaaauguuaagaggaaacuguuaagagaccaguuucugacaggcaaugcauuuuaaaguugagggauuugaaauauuucagcaguggaccuaaaacagcauuauaaauuaguucaacuuaucagcccuaaacagaauuauucaucuuccaaaaggguauuucauggccgcugggcccaaacgaucguucaccuucauuucugcccugcucuaaggguaggucucacuuuacugaauucuccugauucauuacuguguguuacuuuaugaauuuuuuaucagcauuuuaauagcucuuucagaugauugaauguaacugauucuuguagcagaacacugauugaacagagagacaguaauguaugucguagggguuagcuucaagccaagcaacagaguuuuuuaccuauaaagaugugcuuuuucuccccucacuaagagucucugcagauagaagcugccccccuccuccuuccacacacccgcaccuuacccaccaggauuuaggcaggaaucugccauuuucaguuuccggcaugguacugccagcaaagagagggaaaaaucagcccaagccugaagcacccucuuuuugcucaucaaaaguaugaaaugauuaagauuucggagguucuugggauaagagaaagacauuagacuaccucagaccagcaggaggauggucugugggaagagcauuggagucugagccaagcaugaaucucagcugucccuuccuugcuguaucaccuuggguucuucgucucauuguccugagcuuuuucacuuuccuguagaucagaauaacccaccuuuccugguuauugugaggauuaaaugagaaauuguauuagaaacuccaggcacaucagaggccccucaggaaauguuugcuacauaugaauaacguacacgaaagcacuuguguggcacuguacaaauauaacuuauuaauauaagccacagugaugcuugaccaagaaaagacuuuuuauaauacuguaugcuagguugaaccauaugagauucuauuuuaauagacccaaaauggcaacuucauaugguucaacccaauauuuuacauuguuugaucaucuguuuccugguuacaaugaaaaaaaaaugugagggauuuguguuuggguagugggggaauuauauagcuauaaggaauauuagagauaauuaggugcaauuuucucuccugaugagaaacccaagguccagaccacacugguaguaagaaguagagauaugagaacacacucaguucuucccaaaucccaggacuuaugcagcauaucacacagccuuccugaauaagggauuuguuuucuuauaacaaguauauaaccggacuugaaagagaauccagauccucuucagccuugaccaggauucuuucuucuguauaugcucaccuguguacagcacccaacacuggggagguucucaagaggguuucuuagacaacugauugacuucaaauggcaacuagagagaaaucaaaaugaguuguagacauugguacauggguuuggugguaucagauaagugaacugacaccugaaucuuagcugcaaaucccagccaucauuugauucuuggugugucuucuaccucaaaaugauacaaauuggaguugacaugaguuuuuagggaaucuacagaaccaacuagaguucaguguuuuggggcaaauuguauauacacauauauacaaauugcauauacacauauauacaaauugcauauacacauauauacaaauugcauauauaauauauauuauaauuaaauaaaauauauauaauguauuauuacauauaaauuauacauguauaauuugcccagaaacaauuuguguccaguuaaugauagaaauuguucacuuaauauacacauacauaguuugcauauguauacauaugaauacacacacacacgauuuguguccaguuaaugauagaaauugcucacuuaaucauuuguauguauacauauauacauacauaauuuguauauacccacacacacauacaugauuuguauccaguuacauuaaugauggaaauugcucacuuaagcucugaaagucaucaaccaauccagaaaaauacauaaauggaagaaugggcuggcaagaaaugaguggaagugaaaugucuuauuuggcaaaugaaaauauagccauuugggcagauacuuacucaugaaaugcugauaaaauacuugaaucaccaauauccuuguuugcuucccuguuuaugucaacaucuuaaugugaaauauaauuacaaugaacauucagaaacagaauggcaaagccuggcuaaauuuauucuaauguccauucuuaugcugaaagcuaggucuccaaauguacuucuaaaauuauuuuuuacaauauguacuuuaauaggauugcaggauugaaauauagcuuuuguggggcaaucaggacgcaggggagaaguuauaugaaaguuggguaaagauugggggauuuuauggcugauuuucaugauccugcuaaaucauguggucacagugggaugaaugaagaaugaacacuagaaaaacgugucuuuuugggcugggugcgguggcucaugccuguaaucccagcacuuugggagaccaaggcgggcggaucacgaggucaggagaucaagaccauccuggcuaacacggugaaaccccgucucuacuaaaaaaauacaaaaaauuagccaggcgugguggcgggugccuguagucccagcuacuugggaggcuaaggcaggagaauggcgugaaccaggagccggagcuugcagugagccgagaucgcgccacugcacuccagccugggcgacagagugagacuccgucucaaaaaaaaaaaaaaaaugugucguuuuguuuguuuguuugagacagagucucacuccaugacccaggcuggaguacagugaugcuaucucaguucacugcaacuuccgccucccggauucaagcgauucuugugccucagccuccugaguagcuggcauuacaggugcacaccaccacacccagcuaauuuuugcauuuuuaguagagacgggguuuuaccauguuggccaggcuggucuugaacucuuggccucaagugaucugcccaccucagcuucccaaagugccgggauuacaggcaugagccaccacaccccgccaauaauauguaccucuuuucacccauguaguuacugcuuauggacuuuucuccauuaaaaaaaaaucaaaacacuaaaagccuuuauuuacacuguuugcucuuucuuuuacaucuacucuguaucuucuuccuaauuaagaauaguugggaaccuccagggucaaauagaaaugguggcaucaacacggucauagagaacucugauguucaaaggacauggccauggaaaaucaaagggaagacuaauaaaguuaaaggaaaguuucagguuuguugggcccaaggacuccugaaaggauaggauuaauguguuuuuugagccaaaguucugcccuugaaagggaaaucuccucugagcuuugaguagcuggugcugcauccuuuaaaaauguauuggauggaauuaauagugagcguugccacaucccuucuucccagcccaaccaagaaccagggaaccagucauucugucacaaaaugaauagaaguuauauccaaaugccaauaaaacccaguuagaauuuaauguaggacauaacuagaguguuaaauaugacaaacuaacuuugagauaagucugagagcucaaguuccaacagaaacaaaaccuuuuauggacaaauagcuucguaucucauaugcuacucccaacagcucauuuagaugaauaauacagauucugcauuggaucuguauuggauggaggaaauugagacauagagcaguugugacuugccugaggacacacaaaguuagugacacuggcaggguucuaccauaucacuuuacuuaauaugagcagcuucuacuugauuggguguucugucagcuggccaugaggaggggcaaaggaagccauucaaggaaucugaauugccaaugaggcuguuagcugagucuacuuuuugaaauaacuucaucaugauauaauuuauguaucauaaaguugacccauuuuuaagugugcaauucaauuaguucuuuauauauuauaaauacaaauccuuuaucagauaugugauuuccagauguuuucuuucagucuauggcuugucuuuucauuuucuuaauggugccuucugaagcaugaaaguuuucuauuucaaugagguccucuuuaucucuuuuuuuaugguucaugcuuuugcuguuauguccaaauucaaaggaauguuuuuuaaaaauaaguauuaucaagucuuguucucucucuuucucucugacacacaugcauacacacacacaugagcaagcuuaaaguccugcaugaccccagauuucaucuggaauaaaacccaagucuguugcuguggcccacaaggucuucccugaucuggcaccugugccuggucucuccucagccacauguuccagccucacuggccucauuuuuuuccuggaaaacgcuaaauauguuccuuucucugggccucugcuuuugcuguuuucucugccuagaauguugucuccagcaauucuuguagcuggcuuccuccuuucauccaggucccaccuuuagauaucacgugcaucaugaucacgccuuagauuauucaggagauauuuauucuacuaaaagagccuucuuccagccaauaaaaaauacccuuuuaaaaauuuccuucgcaguacuuucugagauuauuuugacuuuuuaaaaauuuacaugugagcaccguggagaccuugucugggugcucacugccccuuucuuggcaccuugagcagugccugguacaaaugagcggcugaguaaguauuuguggaaugcucaaugaauguuaaacugagaagcaguucagagaucagagucacuguuuaaacaaaucaggaucuucaacaauucuuuccuaaugagccuuucuuugucaaacucauuucauuccaaucacuccuguguuucccccacgcuuggagaaacaaucuuucuggugcuuccuuucauuuuuuuugcagauguccuugcauugguucauauucuuuucuuccuuggaaguuucccaccccaccccgaauuaggaaguuccucagggacagaauccaugucaacuacuuuaucuucugucucuccaugccuagcaaaugcuagguguuuggucacugaguagaugaaugaauguacaucccugaccuucacccuuguuccuugaguggagaaaaaagaccccaggcuguguguacucuucauuucuggaaugaggguucuuguacaucccaucaucagcucuccugggcuuuuauucugaaggcuaguggaggcacaacugcaaaagacuuugcagauacgacgugugaaaugccaagaggaagaaaaauugaaagcaggaguugcaucuugccaugugaugugaauaccuuucuggcacuaugacagucuccucauggugggcagugggauaccaugugagaccaagcaagggcccaagucaccugcagcucugagaugccugcagaauucuguggaaaacuucccaaaugcacuuagaccccaggguuuugaugauguugaugguucucuguucaguuuuuuaguuucugucaaaauguauuaucuaaacucuuuacucaguccuaccuacaaaauacacuuucauauuucuuacuaaucacuuuacuacugaaguaaauuuuacuaguucacuuuuccaguggacuuugauuaggacaugagaaguauuuguuggcaccuauaggcagacuuagaugcaauguuuuacuuugaugccaaaagugggggaaggccuuagaccaauagcauggcguuuguuauuuuaguuuaccauucucccuccaaacggcccauuucacugagacuggggcuaucuugcugcagcuuggagucaaacacacauggaugugacucugccuuugccucucagagccucaguuuccucaucuauaaaaugaggcuaauaguacccagcugauagggcuauugagaggaucacaugaaauaacauaucagauguucuuauuacagugguuagguacagaguaaauacagaauaagggguagcuuuauuaugaggauuuauaugauuauuagcauuauuauugcuauggcugcaaccaguacuaccaagaagagaaaugccacucaagcgaggacaacucaguaggugugacguuuaaaccaacagagaaaucagugcauuuuuacuuauuuauaccuuuaccugguuccauaaaaguuuuaucccuguuucuaaaaagaaugcaucaaauaaauugaagugaacacagaaagaaaaaauagcaacuaagaaaaaaacacagauaugggaaacuuuuuuuauaauuucagcuuucauuuuggauucaggggguauauguguagguuuguuacuuggguauauuuugugaugcugagauuugaggcaugaaugaucccaucaccagauacugagcagaguacccaguagguauuucuuuagcucuugccuucuucccucucuccacuccucuaguaguccccacugucuguuguugccacguuuuguccauguauacccaauauuuagcuuccacuuacaagggaaaauauacaguauuuguuuuucuguuccuguauuaauuugguuaggcuaauggccucuagcuguauccauauugcugcaaaggacaugauuuuguucuuuuguauggcugcuuaguauuccaugauguauauguaccacauuuucuuuauccaguccacuguugaugggcaccuagguugcuucugugucuuugcuauugugaauaguguugcagugaacacauuugugcaugugucuuuuugguagaacaguuuauuuuccuuugagcguaugcccaguaaugagauuacuggaucaaauggcaguucuaaguucucugaaaaaucuccagauugcuuuugcugcagaaaacuuaaagaucauguaauugccacaacugagcuucagauuuuaaacugagauuccuggcagccaaggucaacuucacuacauaauuaauuuaagaaugagaccgccauuucuucaggauucaaagcugcuucuaaaacuaauuuccaagauaacuuucuuaccugggacuuuaugcagugaacaguauuccaacaacauguucuccucaaaugcaauaacagauuuuuuauggcugcuucugguagcaccuuuuugauaauagcaaagcagcauggcauuaaaauacaauccggugacagcaguucuguguggggcuaagguaauauggcccuaguguguagcugugagguggucagacuugauccagggauagaauguagaguguuuugaagaaugguugaacugcuuguccuucaaauaaucuuuuguaaauauugcuuuucucagcuugccuuuugauaggaguugaauagcagacaguuugagauuguauucucugacaaaagccugguguguuuguauucucuguuccugguccagggcagagccuuaugccuuagaaaucagaagugcaagugguaaaguugacaucuuacuguaaaaauuggacuccugccugaacagaaggccauucucccucucccuagguggagcugcaggaauacuugcaaacaaaucuagacuccucuucaggaaucaguuugggggcgucuaggggucuaguguggcauucagacuugcugcccugggccuuauucaguaggucuaaacugcagugcagcgcacucugguuagggguagauucagaagguaagauggcgcaaggacaagcucuagccuauagcuggaaaguacaacgcaccgugccccacagcacccuuugagagacaccugcccagcaggaaggaggcugcacuggaaacaucaccugagcacuccaggcgaaaaccggugaaucagcucuagaggguggcuuagaucuuucccgccuggguuucucacugcccugccccaagcaguagaaacuguaauuccuucacacaagucuaagcaacaugauuucuucauaaaccuggcagaucaacuggcuauaaaauuuucucuuaagaaauuaaacaaauuaaccuguucagugaaguuauucgaacaaaaugguuacauuuggaggcaacgcuacuauuuuagguugcuguaguuacuguugagucauucuuucugaccauggaugccaagaccauuuaucuauugacacuaguuuaugucaaggucuauaaggaagaacuuguguuagguagagagaaaauaauaaagcagaaaggaaccaugcagaugauccaguacaaucuucacauuuuccagaggccuggaaguauuuccucaaagccugggggaaguccugacucucccacuuacaauggucauuauuccaugugaagacuguuuccaccauauaguuggucagguauguguauuagggagagauaaaauaauaaaaugaagguggcuguuggauuccuuagaauccaggggccucauccacauugauaaauauuuaucuuguucuaauuaggaccuacaugccuacauuaacugguggaagagcucucaguugcauuaagcucccuggcagaaagaaauggccuggaggcugcuuccucucaagugagaaagggucuuccaggacuguucgaacaaaaggcaucagggaaguaccucuugagucuguccugugaaagucaacccaguuucuuggcuuuccaggcagccucacauugccuugacuauuacuccaguucauuaaauguuaauggguuaucaauauaggaagaguaauccccugaagucccuuuaauauguuuuauucuuccucucaaauaaaugauugauuaacaucaauaggaauuguucaauauaugcugucugcaagacuccuugcuccuugaggcuuucuccugugguuuauagcccagugcagacgccucgaugagaucuuaaauagagagagugguaaaaguuuaugucagcucgucagugaaauggagguggggaaggaucuaauaagugcacuggcuugaggaugauggcauuuucauaaaucacacuguucuuuucccucuuggucgguccugcuuguagaaucauaguaucuuagagauggaaagggccuugagguuauuuuuuccagcuucccauucuucaaggaauuccuucuauagcuuuccugacagacagucggauagcaccugccuguaccuccagggaugggccuuaccuuccuccugaggcacgccuucagcuccucugcaguucugcuaguggaagauuuuccccauuccaucaguugucauaguuccuauuccuuuuucucacgacucagguuagaguuguaaucuuccauuuauuugauugccucuccuaaaagacuguaagcuccaggaggccagaggcccuuuccuuguuagcuggccauuccauaucaugccuugcccauugaagggacucaauguauauuuguugaaugaaugaaugaaugaaugaaugaaugcacuuaaguuuagaaauuccagaaagaacuaggaagauauuacauaacaugaaaauggaaauagaguauuuuuucccagauaccagcugaugugcucaagaugacuuuagggugaauauggaggaaggagugaggggaaguacccaggaaagagugacggguuaugacugagcaacauucagagcaugggaaaaacaaaaggaucuugacuuuuuaaugcagccugguaaauaucauugagauuuggcaggaccaaaacugagcauuggaaaagggauggaaaagucuucccuaugaggaaaggagcccacuuguggagaagaugaacacucgcauggaagcccacagaagugagagagguggccuggaggagggcacucgagugaggagaugggcaccuccagccuugggucagucacaaaggaaggacagaggcaggaaacaggagcauucuggacagggggcccuggccgcugcucacagcagcucaucuucuggcgggagaggguuagcuccugcccaguguccucacguacgagaguggugaguuucuaaugcaucaccucucaccaugcaccccaagacagcugcucuucugaauccuaccuagagaaaaaaaaauaacccacacaauucucgcugucucucaaccucccacaucuaaugagucacccaguuuugucacuucauccuugggaugucucuugacaugcuuuuucuuccuuuccacuaauguagcucagaucccaaauucucucugggaccaucacuugccauacgcagcugagucacauaaagagguugcccuuacacaacagaucucugcucacuguugccuaagacaccgcacgcucugcugacaucguuuauucuuccugaagaguccuuuaguucaucaccuggugcuugcuggccagguucuauaccaucuucaagauccugcuucugaggccgugugcgguggcuuacaccuguaaucccagcacuuugggaggccaaggcgggcagaucauuugaggccaggaguuggagaccagccuggccaacacggugaaaccccaucucuacuaaaaauacauaaauuagccaggcgugguggcacaugccuguaaucccagcuacucuggaggcugagacacgagauucacuugucugggaggcagagauugcagggagccgagaucgugccacugcacuccagccugggugacagcaagacucugugucaaaaaaauaaaaaauccugcuucuguucuucucuucaugacugcccguccaacucccucugcccccuggccugugauuguguucccaucuguaccuucuuacacuuaccuccaucugccuuaugugugccuuugaaguuccugcccuugccuccucucucccgacacccucaccagccucugaaucucugaauggucuuagucacacuugcuuccagucagccuuacaccccagcauuguguuuuacauacaggcugcacucacugaauguuuauugacuugaaugggauguuucuuccuaagacaucaauuccaugucuuaugauuuuucaugcuuuucaaaauauuuucacagagucuguuucagaucauucuuggugcugguaucacacaagcugagcugccuuccugggguucacccuuugcucuccuuugcucaucuccguuguucuggucuccuccagaaaucugcugaggugacaucgucuccagugaccucugccaauuuguuccaacaugggaaugacaugcugauuuaaaacaguugaagcauacuccagaaugacuagaaauggucucguguuugaaguuucugcucauugguggaaguuaaaauuccaguuucuccagcaacauuugguuaaaugucccuauccagcauuggaacugcucacugaucucuuuuuuuggggggguugaaccccugcccaucuucucaguauuucaagggcauagucacuuggcuguaauaacugcucaaacuauuuacucaccaguuuuaaguauagaucagccugguguuuaugugauaaaauucuagaaacuucuuccuuugcaucuuucucuaccugugcccaccaagaaaaggagccguacuucaccccauagccguagaucaaaugaaaagaaauaaauuucucacuugucucuacccuaugcuaccuuuuccuuuguuaaaaagggagauaaaagagaaaagaaaacacuggucuacauaaauagcacuaaauauaaacaguggaaaugggcuucugggcuuugaacucuacagggaaguuguuauggcaaccucaaguugaauucacugggggggaagugucaguauuaaugagauaagaucgaacuugugacuccaaugguaacuguauucuccaagguuuuucuucuuacugagacaagaagcaaagccuuuauuuuaucagugacaucuagauuuagaauugggagacaaauugugugggcauuggggccuggaguuuaguuuccaggaugagguuucuauuucucuguugagaggaauuagagccacuccuaacacaccugcuuuagcuauucuuguucaaagccuauaguuguaaauuuagaggauggguaacauagaccauuaauucccuaaagagacuugaaguucacuuaaauuuaaggauuuuuuuuuuuuuuuuuuuuuuuuuuacuggaguguuacacagauuuuucuauagggauaagguaauaagauauaauugauauuguaacuguccaguggagguuaaguucccaaaacagugauugaccaugggucaagauucccccaaugaagaagaaauucuaaaaucugaagagagagagaaauaaaaaaaaauaauaaaaaaaaaacccagguaauggaaagcccugguugagggcgagaggaaaggguugcagagcacgcugagcagguacugccuauggaaguacugacucugacuucagagguggggagacagagguaagagcaugaaguauguaaauacucaaaguguuuauacugcauuacuuuaucauggaaguaaguaauguaugaaauuugcauuauagaaauuagacugagaugcuaaucauuucuuguuccuaaagcugaagacaucuauaaaauaaguuucuaauucggagaggugagcaaggauccacagguuaagcagacuucaaaaauauaccaucuagugccgggcacaguggcacacgccucuagucccagcuacuugggaggcugaggcaaaggaucacgugagcccaggagaucgaggcuguagggugcuaguucagggcuguugugcacuaugauuaugccugcgaauagccacugcauucuagucugggcaucauagcaagaucucaucuuaaaaaaaaaaaaggaguaugcccuccaucuagaaggggaacagugagccccagggcacaaagagagggaacaaaaaaguaagggugggcaaagcaaaugaaggaggauaauagcaaccagaaaaacuucuucccaaauguuguuuauuuguugaaagaguaaacucauucauaaacuauggccauguauaaacaccacuguacuaacccaaggagacauaggagugccucagaacagcaguugguugacuaaugccaaaaagggccuggagccucucaaaaccccaccaccacaaacacaugaaagagcuacuucuucugggcagacccuuaaauggaaaagccuagaaaauaccaacacugcaaacugaacuacuuugcaauucucuccaaauucugucuucaccaugcuggaaaaauggaauaaagaaccaaaaucaacgauagcaguguagauugcauguaauaaagagcuaaaaaauuuauguauuucauagccuacaaagccccuucauaaauaaucuuugcaaagcaaucaugugagcuagacaggacagauagagugacucucguuuuacaaauggagaaagugaggcuuggagagccgaccagaccugcuaaaacuguacagcuuccaagggcuaaaccuggaacuugagcccaggcugaauucucuguauucagacccucugcucuuucuauggcaaagugccucaagaaaccaggcaaaucguaccuauaaaagaaaugucaaaucacgcagaauucacauaaaauuacuugaaaaggcuccugccuuucaucccaggcuguccuucacgcugcuggcauauccugcaaaugucauggcuucagugcccaggguuuugccagaaagaacaugcugccagccugccgaaugaaggaugcgacuugagaagcagcagaauuuggagaggaacaauggaguucuccuucuagggggugggaucagugaccauaguucucagggggcagugaugaaacagggcuuugugucuauucaggaauaguauccagaagcucacuuauuuuugcuuuccaaauaaguaaauaucagaaaggauagcugaggucagucuagaaaauuagaauuugcuugggggaaaaauauguucuggaaaagauaaacaguagcuugcaguuucacuguuggaacauuuguuacaagguccugguauugaucuuuuaucacccaauuuccacugggagccaugauguauuaccacacugggaagcucuaaugcaagugcgugaaucaagggagauucuagacaacaucuguagugaggcagcauccauuugagggagggaagauugggaaggggguguugcuagcugcaaaauuccaaggggaguuuugcguugugcugugugcaaaugcauauccgugcuggggaguguuauggguuuaugaggagagugauuaaaauuguaucaaagaggcuuaugaagcuuaugguucaaguuaacuguaugaaguaaacagccuuuaacggccuccugggagugugacagauagucuguggguguuacggcaacaugguacuggugaauguucuggccaucccaaacuaaucaccaucugugagcaugggucucuggggagcgucuggugguuggacaaucaugguaguuagcauuuuuaaucagcuucugugcggcacagauagaaaccuuaugcucaagccuuucuuuuucugucuguguagaauuacuuaugaugaugauagcagagccgacaaggguuuggguugugccucugcaggauacauucugugguucucugcccucccucuuccccagcccccagccugaccguggaaauuagccuggccacugcuuauggucacugcuuuuauuacuucucuuuaccacuagcaaaagggaugucaggggaggggggauguuucuggguuuagugggacugcugccucgggucaggaucuugaguuugagauucuucucucuccugcuuuccucuccuacugcuuccuucaucaccaccaccucuagcucugccccaacauucacucacccaucaggcaccaacuucuuuuuucuuguucuuauuaucguugggaagcauuacuugagggcaucguuggaugcccucuaagggacccaggcaaaaggggaagucaaugguaccaucccuagaaguaggcaggccucauggauguuuuugcugugcaacagacuugagcagcugugacagacuguaaggucugcaaaacuaaaaguauuugugauacagcccuuuagagaaaagguuggcugacuccuggcuuagaguauuccuuauucuugagaaauauuugaucuagcaaacuguacuaagaugagacauaaauaucuaaaucagaauauacauuucauuaggccaguauaugcacauuucaugguagguaacuaauucagugggcugauuaaaauaauuuauuguaacaaaaguauuuggaacugccuguaauuaaaacuaagauuuauuaaagaaacaaaagucgccaggccugcagacagcuagauccugugcgugaggguugucuuaguccauuuuauguugcucuaaaggaauaccugaggcuggguaauuuuuauaaagaaaagagguuuauuugacucaugguucugcaggcuuugcaagcauggugccagcaucugcucugcuucuggugaggccucaggaagcuuuuauucauggcagaaggugaagagggagcaggcaugucauauggugagagacggagcaaaagaaagggcuugggggugggguuccaggcuuuaaauaaucggcucucaugugaacugauagaaggagagcugacucaucaccaagaggauggcaccaagccauucaugagggauccacccccaugaccccaacaccucccaccaggccccaccuccaacacugaggaccacauuuuaccaugagauuuggaggggacaaauauccaaaccauaucaaggaugaaaggagagggugucaguuagcuuuuguuauauaacaaacccccccaaaacuuagcgacuuuaaacaacuauuuuaaguagcucauaauucugugggucaggcaggugauuguaccucucugggccagcucagcugaucucugcuggcuucugucagucaucuguggccagcugggguuggcuggucuagauuguuugacuuacgucuggugaauaacaggcugauuggucuggggauggugcugggacuuggcugggacaguucaucucugcuccauguggcucuuacccuucaguaggcuaacccaggcuucacugcauggcaaucucaggauuccaaggagcagcaagagagcaggccccagugaauaugcacuuugcaagcuucagcuuguaucgcguugcugaugagccacuggccaaugcaagucacaaaacuggcccagaguuaacgugggaagugaccccaaggauguggauacagggaggcaugaccaaaucagaagccauuacuucaacaaucucugcaaagaagagagguuuccuucucuucauaaucucuaccaccuuucauggugccuagaauuuacauuacagauuuauuccuuugggucuuaaagagucugcagucuucaagaggaccccuguuauaugaagguguaguuguucaaccaaggccuacccagagcuuagcugauaacugagaacagggucgauaccaggguaucagacaccaagaaagaauaugaaagggaaggugagaaggcacuagaaaaaaaugaacuauuccugcauucgcguauccagcuacccacaagaaaccccuacguggcuguucagggggcacagcaaauccauacugucucagaccaaccccaucaccuugccuucuuccuucucuccaacaugauuuuucauucucgcagcaaauacagugccucgucuugaccagugaagauggaaaugaggggagguggagguaaaggccugcagaacaaaauggaagaaagggaaugacagguaggaaaggguagaaaauuauugcugagucuaaguauugaggguucaacucaguaauugauuccauccaaguuuaagacaguggacacauuccucuguuuuuuugguuccuuauccuuugcuuccacuccugaaaggauuauaauccucauucuuguaguuguggaugguuauggccagagaaggccauagggacagucaucaaggaaagcagaggccucucacucaggagaugccucagcauuuuacugucuucaaagacaacagcccaagugcuggagcagccagaaaggaaccggccugauuuauuuauuuauuuagagacuuggucucacucugucacccaggcuggagugcaguagcaugaacacggcucacuugcagauucaaucucaagcaauccuccugccucagccucccuaguagcugggaccacaggcauggaccaccaugcccagcuacuuuuuaauuuuuuuguagaaacggucucgcuuugcugcccaggcuggucucaaacuccugggcacacgcgauccucacaccugacccucccggagugaugggauuauaggcgugaggcaccauucccagaccagccuguuuucuaauggguguccacauuaaaucugaacucugccucaaguuguagcugcugcugagagaacccuggcucuaugcuuuucucacaaaagagcuguuccagacugcccuuagaauguuuucucccguggcagaacagcuguuuucuguucagcugucccuuacauuguagcucuaugcuggaacuagcucguguuuaaugcuguguuauggguaaagcccucuugccuuguaggugacacuaauaaaaucacagaagagaucaaaccuagaaucucugccgaugcagaccucauagucagacaaagaguuggaugcuuccauugcucuccuagcuuaggcuggagcuggaauucucacagcaaccagcagggagcuggcaaguaauggcugcuguguccuccuagaccagggccagccuuuaguagcagcugagcgugggaguggcaggcaagcuuggcaccaugcagcagugggcuuccuugggugcuggaaguacagucagggaacccuuguucuguccacucugccuacacaaugguugccuucagucuggagaguagugaauggcaaugaguaaugaguaaagggggacccucuucauaauggcaggggcugggagccuucuggguugaauauuuuguagcacucaaagagauggccaacuaagaggucgcucugguauugccuuuucucugccuccacaucggcaggcuuccagcaccccacuauucuggaucucaacauuggacaaguguacuaauguucaagcaggggccugggugagauggccucauggugcccugcugguugcugccuuuugcugcucuuuuacaaucccuguacucaaggguugauuucugacgccugggaggguuggcacuuugggaaagaccaaugagauuuuuacauuugagauuuucagcaugucaaacauaggcaagacagaauaucggggaguuauugggaauaugaauuuguuuguuuguuuguuuguuuguuuguuuguuuguuuguuuguuuugagacagagucucacucugucgcccgggcuggagugcaguggcacaaucucagcucacugcaaccuccgccucccagguucaagcgauucuccugccucagccuccugagaagcugagauuacaggcaugugccacuaugcccagcuaauucuguauuuuuaguagagaagggguuucgccauguuggucagcauguucuugaacuccugaccucaggugauccgcccaccucggccucccaaagugcugggauuacaggcgugagccacugugcccagccuuuuuuuguuuuuuaaauaggcacuaggagagcaauaucuuuacauuuuguuaccugugaacacucagcacaggaccauauagguaauaguaauggugauuauggugauggcaguaaugaugaugaugauuuaguaugauucaccaacagguuauaagacuucagaaugucacgaacuggugaaaaaaaaauguauauuuuuuuguaauuguaggaggccugcauagaguugaauugcuagcuuuuuauauugccaaguaagaauuuuuuuaaaguaugaauaccauaaacuaucaccaucuauuucauaaaaaaaaaaaaaaaaagauguaauguacugguuaagaguuguacacucaaagaaauucugaugauaccugggcuaguaagcugugugaccuugggaaauuuaaguaacuucucugccucaguucccucauugugaaauggggaugauuauaacuguaacuaccuuaugggauuauuggcagaauuaagugaauuaaugaaugaaaggcacugagagccuggcacagagagcacuuggugccucuuauauuuuuauuguugucacuaauaccaaagaacaagacauauauaauauuagaauaaguaacaauucugcacaugaaaacugaaaauucacugcauuguuguguuguuuucuuuuuuauuuuuauuuauauuuauuuauauauuuauuuuuugagacggagucucacucugucgcccaggcuagagugcaguggcgugaucucggcucacugcaaccuccgccucccagguucaagugauucuccugccucagccuccugaguagcuggaauuacaggcacccgccaccccacccagcucaguuuuguauuuuuaguagagacgggguuucaccagguuagccaggcuggucucaaacuccugaccucaggugauccacccgccucagcuucccaaagugcugagauuacaggcgugagccacugcgcccagccuguuguguuguuuucaucuuacuugguuauaggccaguggugaucugggagccacugguggaccacacuggcuuaguuagucuuccuucuuuccuccaccaaaagacaugcagagcguuacugccuucccacccaauaaagaggaugguaggugagaaaauaaagagcuauacuguaagcagagcaacuggguuuccaaggagggaguguaaaacaaaggaucucagugugggagugucuaagguugaagcugucccaaggcaauaccuucuaccccuacucuaaauuaaaggagucauaacucuuugugguuccuguaaaaguaguuaagaggccggcacgguggcucaccccuguaauaccagcaauuugggaggccaagguggguggaucacuugaggucaggaguucgaaaccagccuggccaacauggcgaaacccugucucuacuaaaaauauaaaauaauuagccagguaggcacaagaaucacuugaaccagggaggcagagguugcagugagccgagauggugccacugcacuccaguaugagugacagagugagacuccaucucaaaaaauuaaaaaauaaaaguaauuaagagucaaagggcaucauuacauagagacacaaaaugaaagucaguauuguaugcgccuuugcccuguuuuagaccuucuuaacauaugggagcccaaguagcccaaccaugguggaagagaagauuucauggccuuucucauugguccucaccgugaauaugcagaguaggcacaccucucugcagagaacuccucuaagaaaccagauucaaugaucugaugaucccgcuucugcugauaugcuagaagccaaggcuuuuuuuuuuuuuuuuuuuuuuuuuucaguagaagaaucaaaaguaggccaagcgcaguggcucacgccuguaaucccaggacuuugggaggcugaggcgggcggaucaccugaggucgggaguucaagaccagccugaccaacauggagaaacuucgucucuacuaaaaauacaaaauuagccgggcgaguuggcgcaugcuuguaauccuagcuacuugggaggcugaggcaggugaaucgcuugaacccaggagguggagguugcggugagcugagauugugccauugcacuccagccugggcaacaagagugaaacucugucucaaagaaaaaagaaaaagaaaaaucaaaaguaauaacaggaaggaauguguuagcaacuguagaguauuagauguauggcugaccuuccaaccagcuagcucucugguccccagccccacuccacaacacauccucagguucccaguucaaaacuuuaaggccgcugaaacccaggcuccaugcacauucaucauuuuagccccacuuucagacauuuauauguuggugcucaugccaagccaccuuggaaaacaaggacaaguauauguuccccuccaccuccuucccaccaguacccagcgugaggucuguacauaguagauccuccauaaaucugguguaaaacaaaauaaaagcaggugaccuucuguaaccaagauguguguagcuacauccauccacucccaguacuacaacauuggauuuuuguugcuguuaaaucaaaauuuuagucuuucagaauuaauucucuuugcuuaaaauuaauuaugacagguuguguuuuuuacacacugcugaaauguguaaagcaguuugggagaagagggccuccuuuccugaguugauuuauguuauauaugcaaacucuauuaauguuaaaccaugcuuuucaaugaaauuaagacuuuccagcaagcagcucucuccauuuuauuuaaagauccuagugacugaugcacauugugccccuguugcuacgauaggagcggaggauguuggaucugagagaucucaugcuuaacccuuaagugagaaguagcguguggugugggaagguaacacagcucucuccuguaagcagaaaucaagcgguggucuacugagagccauuuuauuacuuccagagaacccugaaggugaaaugaaggaggaaaugaaggcaggugggaaauuaaagaaagaggagcagaaauggaaguaagaaggacguaaaaauuucaguaucuugagaaaccugacugccgaacaaaauguuugggcugggaagauggagaaugcacggaggccugcaagaacaugggacagccaugacaugugggcuuuguucuuccaaagagauaaaugaggccaggcaugguggcucacaccugucaucccagcauuuugggaggaucacuugaggccaggaguuugagacuagccugggaaauauagugagaccccauuucuacaaaaaauuuuaaaaacuagccaggugugauggcgugcaccuauagucccagcuccuccagaggcugaggcuggaggaucacuugagcucagggcaucaagucuguaaugagucaugauugcaccacuguacuucagccugggugacagagugagacccuguguaagagagagaguccaggcgugguggcucaugccuauaaucccagcacuuugagaggucaaggcaggagaaucaccugaggucaggaguucaagaccagccuggccaauauggugaaaccccgucucuacuaaaaauacaaaaauuggucgggugugguggcaggcggcugucugccaccugcuacuugggaggcugaggcaggagcaucgcuugaacccaggaggcagagguugcagugauccgagauggcacugcugcacucuagccugggcaacagagcaagacuccgucucaaaaaaagaaagagagagagagauaaaugaaacaucugcuccuuaaagcaguaauagcauagucuuuaauaucaggaggaagcguuauauguuuuauuuaaagguuguugauuuaugaacuuuguaccugucuauuaagagucugguucuugcaugguuaaugugugaaguuuuaaaauuugugcuucucauguuuaaagcaugauacccagcaaggcuucugacaccagaccuuucccauauuccauuucauagagcauuucauagaaaauguuucauagaacaugucauagauauguucuuuucguagaacaguuauauauucuuuccuucaucaaacauggauugaacaccuauugugugccagguauagugauggguucuggaugaacaaaacggguuuucuuuaguucuuuguaagucuuugaccccauggaauuaaccgcauaguuaauuccacaggcauccuugguaacauagcccccucugguaacguagcagaccacagagugacagguggaggggaccgaauagugagacagucaccugggauucuaugauuccacgccccugaugcuuugggcugggggaguuggcugcugucauuugugagguagagucgcaaccugguacagcacuaagaauccauuuccuucuucucagugacucacuucccaccaucuccaauugcucucuggucauaguuacuauguuguuguuugccagcagaaacagccauguuguuguuugccaguuuggggcuuucugucaaccugaaagacuuccuucucuccagccaguuuggucuugcagauuuuguugugaggccaacaaccaggcugugaacugccuaagcccagccagcccuucuuugaaaagcccuguggaacuaggucaucagguuguuggaugguucuuacacagacugugcugugcugcaacuuuuaaugugcacugucuauggaauaccaaacuuguuuccaaacuaaauaguuuccaaugaggauuuaaugggaguuuuucauuugaaauggauugaaaacaagccauuuccuacucccauuucaagcaaauuuugguccaauuauuuuccuuuuuuuaacauaaaguuaaauggacuauucugcccaucccugacugagcugaaccgugauuucucuugauuaugcuuuuacacugcgaaucgcgaggcuccagagacauaaugggcgucugugggagaguggcagcaauuuuuaaaauccugccagugcuugucagcuuccacucuggugucugcugugcgggaagaaagcaccccaccaaaagaaaaaaagucugccaacaaaaccagcgcugcccgccuguucuguggggguuggcacagggaugggcuccucucugcaaaccuauguagggcauauucucagccacugaggaagcccgguuuccacucauccagcccuacuccucccacuguuuuccagccauuagcuuuuugugguguugaagguuucuuucucccuuuuuuuuccuugccucaauuuuucuugguuucacuuagaccauagccucagggaaaaggagcucuuggcacccugccuuccacuugguccuuuaccuucagcagcccagcaaaauggaaaauaagugucucauaguccuucuugggugguagguuauuuguuguugugauauuguugguggaggugguggucauucucuuggauuugcagaaguuuacagaaaacucgggagaagaaaaggcuucuugcuaccauccucucucuuugggaagggcagcuaccccccuagcagauauguggggagccuacugggcaaugccuuguaaugggaacagccucuuugcucucuuacccagcagugccaagaauuucacuaggcccacugaagaagaaacacccuucaccccagcuaccauuguagcugcccuaccauugugugcagcccgggggaagcacacagucgucucuggguuucuggugaaaguccauugugccugcucagggcuccuuggugcaggagcagucaagccuuccuggagguugaagaucacgugcuguguuugguggcuccccacuuggguuuccaucgauucaugguauugguuugggaggugcucacauccuccugcaaguacccuguagugaggcuuacucugaggaugcagcuacaucucaaaacaugacuccaccucuuccugcaaaauccugacugguacaacugccagcacaucccuuugaccuugagaaggguaaagcacagaggugguaggugacuucauuagcaugacagaacgucagaguugauuagcacucaggaaagguugucuaaugccagccucugccuuuguaaaugucuucagcaucaccagggagggguugaucuggucucugccugaacuugugcuggaaaacaguucugagcaggcaccccauggaaaccucuaauucaugcaaaagucccccccuaugaagugaagucuguuucuguugcuuuuucccacuggugcuaccccuuccugaguccacgaaaucuaaauccaguccccuuucuaccucuuaucccuccaggcauuugaaagcagguacuuauuccuagcuaagcuuuccuucucuaggccugcuuucaggucuuucagccaucccuccuauugcuugguuucccagcccugcauccuucuaauugccuucuucuagacauguucugauuuguuguucuguuuguucugagcucugagguacccagaaugaggugagagacugucacagcccuugacagagacccaugccaccuuuuagugaaauuggcuguuucgauagccuuaaaagggucguucauuuauuucaaguuuaaucgagucauucuucacauacauaacugcucaccuuaucugcuccacguauaugugugauuugucauuacugaaccuaugugcaaaccacauuuauuccuaaagaucaucuuaucaggauaagaaggaacauauucauuucuuuagucugcaaagauauguuggaucuguguuuuaugauccaauauacugcuauuuccagcuucacaucauaugcaaauucagcucaaccacugugugccagacauugugcugaaccuggggauacagcaggaaaucagacagcacaguugcuucccucacaauuuauugggagggacagacaauugacugugcuuuuccaauccagggugacagcacaaaagaggggaacugcagaagcguagaggaaaggugcuucacagacucaggcuuucuaggaaaugugauauugugagaaguuggccaaggaaagagcuagggauuaaaguuugagguaggcagaacuacauaugcaguguuugaaaggugacaaaaagcacggugucuucaacagcuuaucaccagguaaugcuccugauccucaucaguggcugaugugaauguggaaccuaauaggaugaaagaaauuaccauuagaggccuucaucaucugccuucgggcacaucaaacauuuaugaacucaccuaauuguauuuuugucacagccacguuucucugccuugaccacuugaauugcaugugaaauguauuuaugucucacugaauacagaccuguucugucuaugucauugcucaaguuuaccaaucuaaaaaaaaaagacuuguucuuaugacuuguucuucauaacccagguuggcuuugagugauccuaaaagcuuccuuccuuccugagaguucacuagcucucuuccuaauaaucuguuuuauuuuccaagucauugguuaacguaguagguuaguggcagaguugcaccuagaccccaaguaucugaacuccuagucuagacaucuuuccuuucuauugcucugcucccccuuggcucaucuuuccagagcagagacacuacacaagguuuuuuuaagagcagcuggucagucccugcauccaauguaggaggcagcaagcaaggcuagcaguuacgccagggagaaugcaaagugggguguccucuuuccaggcacuggcgcaggccagcuacauggcauuucaucuccuuagcaggccucugggguaaacuuuauguguuaaacuuuaugguuaacagagcccccugcuauucauugucuccuuuauuuaucaaccagccccaugaagucaguggggaaauauucuuguucccauuuagcagauggggcucaaagaguagaagagacgugcccagaggcacacaguuauacugaguagcugagccaggugucuuaaauccagguugucugacuucuggugccccaagcugacuucagauuucuuuucuucuuauaucaaugauggcaucaacucccugaccucccccuucuccagaauguugccugggugauuggguaagaggauauaaauaguaagugaaaaaaauagauucaguuccaagcacuaaggggcugagacaacuagacacuguggcagugcuacagaccuuuagaucauuuuucugacacucucuagcuaaaaaggaacauggacaagugacacccaaaagucccuaggcuuaaaccaacugucuuguggaaauauaauauaaguaugagcuauucugagcaggaugacaggauuggaauucaguaaaguuuuagauggacuuugagauccaaauaagggaggaguauuauaaagagcucuauaaaaaugguuuaaggaagggugugguggcuaaugcuuguaaccccagcacuuugggaggcugagguggguggaucauuugaggucaggaguuugagaccagccugaccaagauggugaaaccucgucucuacuaaaaauacaaaaauuagccaggcaccuauaaucccagcuacucgggaggggugguggcgggcaccuguaaucccagcuacucgggaggcugaggcacgagaaucgcuugaacccgggaggcagagguugugcugagcugagaucgcaccacugcacuugagccuaggcgacagagugagacuccaucuugggaaaaaaaaaaaaaaaagguuaaaaaugccaagcuagcagagagagggacucagacacacacaccuaaguuguugcuccagccuaagcuggcccaccacuaccugacugcaguuuguugccugucccgucaugcuugccuucaaaaugccuuuggauuguucacaagcucaggagccaugggccuccuccuguugagggguguuuauugucuaaaucccuuacaugugaauuaaaaauaggcaaagguaaaaaggcaggaguuuucuaacagguaugggagugcuguaguaggccaguggcaaagacuaucgccauuuucuuugccugggacuuguugagucuuugaagucuaccugaauuccagagucuagggcuucuugauuccuuagcaagagcaaagggauguguacccucucuuucaggcuuuggugaauuagaccuugagacuucauaauuaaaauggauuuaauagaggcagggaagcugggaugucugccccaguaagcaggcaucuucugucagaaggagaauguguccuuuguauuuaaacgguuucuccaaaaggcucuaaaugagauuugggacuuaaacaagauuuggugugauuugcuaauuacccaaguuacuauuaccugauuaacacaggaauccucauagucuguugcagugccuuucuuccgggugccaggaggcuugacaucugucaccuguucacuuggaggcauuuuaaguaacccaaauuauguaugucuuuucugcuuuaggauuuggugccugauuuuuacauuuaaaaguuaauaacuaccuaaaggagguuugcugccaaaauacaagagugaaaacugacaaaucuguuuguugcugacagugagguggagaucuugguuuauucauuccaacuaguuaggccgagaaaugauacacaggacaguacagagcucuuccuggugaccaucacaggcaucaggaauaaauccccucaaaucucacuuugccccaccaaccuuaauugaggccuccgcuugagcagugacagaacuggaaggguuggaaccagaaaagcuaagugucuuucucaaaaucacacaggccugcaguuaggauuugucuuucguuguuuuuuauuuucaagauaauaaaagguuuccacuuugaccaccaggagaccaugcugacuuucauuucagagauggggcuucagugugauaaagugaucuagguuagagucuuagcagguuucccuugagaucugaauggcugcggggugugcugggggcucuguacagcagcuguuaacaguuuucuccuucccaugaagacggcuuauuuaccugggucucaguucugaagauuguuuccagguaugcuguguacugaagggacugagcgugauccaaggagccugggaccuauguacuuggugaccagacucuccucuccaaaagcagggacccaggggaccucauccagcauccugagaagccucgcuuuggacaggccugaaauuucccuuccuucauccuagcucuuucauccaagacagugauucgggaaacaguauuucaaaauugaaauucaggccuugaauuucaagucuagaagaacuguccaaaucaucgguaggaagagcuuggaagaaagggaaagucccacuguaaugcuaaaagagagccacccagccagggauggucugcauccagaccagagcacaggucaaagggaaagccgagagcaguucccuaaguucuggcauggcuuuuggacgcaaagcagcugggcugcgggcaugcuguaaggacagaggacccuuuaggguuccaucucuucggagagaaagucccugcuguuccaguucacugaguguuuaagaggaaauaacggccugaggcauaagccacucacccauauaaagugaauacuuccucaagggcacaaagagaccacuugguaaaugacuucacccaccugcuuuagauggugcuccagugcacugagaauguuaaccucauucacccuucuguggaugagcagauuauuccuagaaaaugguccguucauguuugaccaggcauagccccacugugaaugacaaagucuuuuuugaccucccacgaucuuucucccuuucugucucagccaagccuuuucuucuggaaggagcuacucucuuuuggcuagacgaucauucagaggagucaccucugucccucccccuacugauacaucucagggucucagagccguuuauguucccauuuuugcaucuugacauagggaugcaaagaugggaacaucaagcaucaguucuuccgagccuucauagaaggaguggggggaguggguagacauggagaugaaacaagacuggccauggacugaucauuguguaagucuggaaaugguugcacaggaguuaauuuaacuacuuuguuuacuuucauauugguuugaaauuucccauaacaauaagcuaaaaacagauaguaagggaucucaagugucuugggcagugguuuucccauugccacaauauauguggugaaugggcauuaucugcuuggaaaauuaacaaaauuaaaauuuacauauagaucagugaaaacacugcuacagaguuaacuuaaaauuuuagcugggugugguggcucaugccuguaaucccagcacuuugggaggcugaggaauguggauuacuugaggucaggauuuccagaccaagcuggccaacaugguaaaaccccaucucuacuaaaaguacaaaaauuagccagacacaguggcucacgccuguaaucccagcuacuugggaaguugaggcaggagaaucgcuugaacccgggagguggagguugcagugagccgagauugcaccacugcacuccagccuaggcaacagagugagacucugucucaaaacaaaucaaaaaauuuaauauaauauguguucauuauaaaaaucauucagggccaggcgugguagcucaugccuguaaucccagcacuuugggaggccaagaugggcggaucacgaggucaggagauugagaccauccuggcuaacacagugaaaccccgucucuacuaaaaauacaaaaaaauuagccgggcaugguggcgggcaccuguagucccagcugcuggggaggcugaggcaggagaauggcaugaacccgggagguggagcuuucagugagcugagaucaugccacugcacuccagccugggcgacagagcgagacucugucucaaaaaaaaagaaaaaaaaaaaaucauucagguacagccagagagagccacuguagauaguuugaaauccaaagacgucuuaugugggcauuacccacagaugugcaugccugugcagcuuaauuuuagauuuuguuuucuuuugcuuuguuguuuuguguguuugauuucuuuucaaaucagauuuauguuucuuaccagcucguuuuaacaacuuuauucaaauauaaucuacaugccguaauauucacccguacuaaguguauaauucagugauuuuuuaguaaauuuauagcguuguguaacuauugccacaauucaauuuuagaacauuuucaucauuccaguaaaaucccucaugcccauuugcaguuaguccccauuaccacucccaggucaaggcagccacgaaccuauuuuccaucucucuagaugugcuuuuucuggacauuucauauaauggaacaauacaauguugguggguuuuuguuuugggagacugagucuugcucagucgcccaggcuggagugcaguggcgcaaucucggcucacugcaaccuccgccucccggggucaagcgauucuccuguuucagccuuccaaguagcugggauuacaggcgcccgccaccacacccagcuaauuuuuguguuuguaauagagacaggguuucaccauguuggccaggauggucucgaucucuccaccucgugaucugccugccucagccucccaaagugcugggauuacaggcgugagccaccgugcccggccguaauguguggucuuuugcauguggcuucuuucacucguccuaauguuuugagguucaucuacauuguagcauuuauccauaauuuguuuccguuaauugcugaauaguauuccauuguauggauauaccacguuuuguuuaucuguucaucagcuuauggacauuuggauuauuucuacuuuuuuggcuauuauuaauaaugcuacugugaacacucacauacagcugaguggacauguguuuucauuucuccugguagauaccuaggaaugaaacugcuaugucaugcaauaaguuucuguuuaacuuucuuaagauacugccacacuguuuuccaaauggcagcuucauuuuacauuuccccaguaauuuaggugcuucugaucuccacauccucaccaacauuugcuguugucugaccuccugaacgugaagugguaucucauuaugguuguaguuuguauuucucuaaggauguuuugaaauggggaacugugcgucuuccaacuuuguucuuuuucaagauuguuuuggcuuuguuuccuuugcauuuccguauacauuuucauaucaccuugucgauuucuacccgcaccccaucccuccccgaaagucugcugaauaaggguguugagcaucuuuucauuuguaauuagccauauucuuggaugaaauacuauuaaaaucuucuucccacuuuuuaaguggguuguuuaucuucuaauagacuuguaagaauucuguauauauucuguauauaaguccauuauccuggguauaugauuugcaaauauuuucucccagucaguggcuugacuuuucauauccguaaugcugacuuuugaagcacaaaagguuuuaauuuuguugaaguccaguuuaucaguuuuuuuuuuauggaucauacuuuuguuguuauaucuaagaacucuuugccuaaccuaaggucacagagacuuucuucuaagaaguuuuauaauuuuaacucuuacauucaucuauguggcugagguacuuuuuuguguaugguaugaaauaagggucuaguucuguguuccugcauguggauauccaguuaccccaucacuguuuaucgaaaagacuauucuuuccccuugaaaugcauugccacuuuugucaaaaaucauagacaauaaauacacaggcuuauuucuggacuuucauuucuauuccuuugaucuauaugucuauccuuaugucaguaccaggcugucuugauuacuauagcuuuguaggauguuuugaaauagggaacugugcgucucccaauuuuguucuuuuucaagauuguuuuggcuuuguguccuuugcauuuccauauacauuuuaggaucaucuugucaauuucuaccccccccccaaaaaaaaaaaagucugcugagauuuucauagggauuacauuuaacccacaggucaauuugggcagaauugccuuuuuaacaauauugagucuucucacccuugaagacagaauaucucuucguuuauuuagaucuuuaauuucucucaacaauguauuauaguuuuuggugugcaaguguugcacuucuuuuguguuauugugaauaaaauuuuuaaaauuucuuuuuccaauuguuuauugcuaguauauaaaaacauugauuuucauauuggucuucuaucguaugacagcccaauuuuuuuauuaguuuuaauagcuguuuuguaaauuccuuuaucagauuuuuccguguacaggaucauggcaucuuggaauagagacaguuuugcuucuuucuuguccauaugggaugacuuuucuuuuucuugccugauacagaauuuuaggaauuaaaacucauccaaagucaugccaaagaucagugauuauacuuaugauaucaaugaggagacaaaagaggcaacuuuuggaauuuuaaaugagccuuacagaggcaaagggaagaaugggugacugcauuagcaaggaaguaaaaauaccacucuacagccagacaugguggcucucaccuguaaucccaaagcuuuggggcaccaaagcaggagaaucacuugaaaccaggaguucaagguuacagugagcuaugaucaugccauugcauuucagccugggcaacagaguaagauccuaucucuuaaaaaauuuuuuaaaaagccacuucgcauugacucagguuucacagugcuccucuuagugggugguuauuucagcaaccugaccagaacagacaagauaagcccugaaacaacacgaaggagcccugaguaggaaaagguagacaccacacacucuccaggcucauuuauguaacccacuggaagaucucuggucuauacagaaccucaucuucaugucuaccuauuguuuuaaaaagcauuggcacuugguuuucuagcuuguugaugguuuuguuuuguuuuugcagcuauacuuuaggaaagguguuagagaagagacgaaguaggacuugaacauaaaggaugccaaaaagugaaaggacaguagcugauagugagggggcauauuggaaaugcauuuaaauaucccauguauauuuccuggacaccuacagggacaaaucuuaugcucaagaauuuaaaagcaccacugguaggucaguggaaggcaacuccccagacuugauaaggucugaggacauuggcugagcaagccaagacuccagugacgccauccauuucuuuuguggcugaugaaucagauucaaguacaaugcuuuauaauuaucccuaugaaauucuagcauguuagugucgacccauuauucuaguccuucggcaccucuuuggauucugauucugguuuuaugaguugaagauuaauaacuaagcuuugaaggauggggggauugccaaaaaaaauaagcugaacagugcuuuuuuugugauaauccuguguccucaaagaaguuaagccccauuugcugcagaaagaacucauuagcuccuguagcuucuaaggaggauccucaucaaagaaucuuuuuuaaaauaaguauguaauaauaaaauaaaacccaccaucuagccaggcuucuugcuauuggagugggaauuuacagauaaacuagggaggaggcuacacugaugcaugugguaauggguuagaguuaaaaauaucaguaugagcucauguuuagcuuaacauagauacaaauagucacauauagaaaucuuuacagaucugugcauauaaaaggguuaguacccauauguauuucugugcccugacaacugagauggccugaaagaaacggacaccccagugucaacaagcacaccuucaucuagaucuugguuccuauuaccauucuccaauaaaaagaacuaggacuccugagugaaaugguugcuucuggaacucaggcaggaauauacaagaugaaccuggaguauguuauggugccagaaaguaaggaaguccuaaaacaaaaaacaaaacucacacugauaggggcacaucaaagaaacacagaggccaacugaaagagcuaauggccacuccuggauaauuagagcaaaacaauaaggaagcaucggauuauaacccaaaguauaaaauaaauauccaugacuccauacugauagaaauaaauaaauggaggagaaggaacaaaccucccacacagaagaauuccaaguaauuuacacagauaccucacccucaagcaggggaagcauaaugccccacucccucaaugugaguuccagguaguggcuccuucccaaagaguaguaggggagggggaggggaguccauugacaguggagagaccuucaaccuggugaccaaggacaauaucaguagucacaaaucacauuaauagaacagaccauugauacaaugugaaaacaauggcauuucaccucuguagucuuccucccaaaaaccucucaacccagucuuaaucaugagaaaagcaucagacaaguuucaguaggggggcauuccuauagaauagcucaauauuccuaaaaaaugucaaggucaccaaaaacaaggaaauuugaagaaacugccaaaagaacccuaggaaacaugacaacuaaauguaaugggccacccuagaugggauccugggacagagcaaagauacuaaguacaaauuaaggaaaucuaaauaaacuauggacugaaguuaguagugcuauguuaguauugguucauuacuucuaacacacaugacauacuaauguaagauuuaguaauaggggacacuggauaugaaguauaugggaaugcucuuugcuaucuucucaauuucucuggaagucuaaaauuguucuuaaaaagaaagccuauuuaaagggaaaaccaccaucacuaccaauuuugauaaacuugaaggguuagcaucaauuaucuggaaaauuuauuugugagaaaaccuuauuccuuuaugaucauugauaagugaagcauugcugaauuaucucugccucucugagcaaguuaauacuauauuuuuaagagaagaggagaagagaggggagggaguagggaaaagaguauguguaucuuuguguguguaugugcgugugcaugugcguguguguuuaaacaagagaaaaagugaauucuaaauuguuaaaaccuuggaguggaacuuaaucuaauuuauacgcaguuccacuagagaugugcaaggauuuuuuuguuguuguuaaagagaaaaacuaguuucaagcauuauuaagcuuuuuucccucccagaagcuaagaaaaccaucugugagaaccuguuugcauguuuguuuucuacaauaaaaugcaaaauacuucuuccuguuagcggauuauaccauaugucucucccuguaacaaaaucagcauguuuauuaaugaacccaaucagaggcaaagauuuagaaagauuuaaggaacugaauuuuccauucaauauuucagcaaaagaaacuucugguuagacaucguuguugugcuuggaaaauagaagguuuguuuuugcuuugaacucaauuuacuuggcaggggacagagagcaggaagagaggccuuugaaaauuuucguaaaaaaggucugcauuuagaaauggcccuuccugccuaaugauuccccuacggauuuagaccuacaguuuauaugugacuaauauuuaauuugaucaguuacauuuuuccagacagacuaauuaaagugcuugauggcccagaucccccaaaucugaagcaguaacaggccugugggcuuccuggaguaacaggaagugaaugaaguaguuucagccauauugucaaagcaacccccaugguacucauaauggaaacaugugaauuuuccagcacaaacacuuuccucacagcccuguugaccaucugaauaaucaaauagauugguagcacuagguauagcauaguguauuagaaagaaauauguccagccagacccagcacugcaguuaaaguacuggugcugucacgagccagcagaaggccuggagcaaaugacguacucucucuagaccccagcuuacuccucugacaaaugaggauaucagcucugcuguucucuuguuucugacuuguagaagaauggacuugucagcagagaccguaagcaguggaaaucccaaaagccagacagacccugugcguauuuuaggggauacauucuguucuggucauucagccuucacccaagccaucuuuuuuucuauuugguggcauagacacagcccagccaaccuaauucucauuuuauugcauucauuguucaugugccacaguuuuuuagaaaucuuacaagaaaaugaagcaccuauuaccaggacaccacugcaagggggaaaaugacacuugggcaccuggaaggacaaagacaggcaguggaggcaucaugggguuggauucgaguaacccucugccuucuuccuggggucuguuggcaguguuuuugugcuguggucaugauacacacaggucucacaaggcaggcagccaaguguugacucugucuuuguaggcaauacagaaaacugucuacuuguuccagugagcuaaaucaagugagaacaggaaagagguuugugcaacuuuggcaacuauagcaggaaccacuuuaaaugggacagggcaaguaaugcuaaauauuugcaaggugauuuuuuuuuuuuuaagacuuuaaagguuguauugggagaccuugagaaagaggccuuucuuucuuuuuuuuuuuuuuuuuuuuuuuugagacggagucuugcucugucgcccaggcuggagugcaguggugcgauuucggcucacugcaaccuccgccucccggguugaagcaauucuccugccucaacccucccaaguagcugggauuacaggcacgcgccaccacacccaacucauuuuuuuuuguauuuuuaguagagacgguguuucaccacauuggucaggcuggucucaaacuccugaccucaugauccacccaccucggccucccaaagugcugagauuacaggcaugagccacugcaccuggccuuuuuuuuuuuuuuuugagacggaguuucgcucuugucgcccaggcuggagugcaauggcgcgaucuccacucaaugcaaccuccgccuccuggguucaagugauucuccugccucagccucccaaguagcugggauuacaggcguguaccaccacgccuggcuaauuuuuguauuuuuaguacagaugggguuucaccauguuggccaggcuggucucgaacuccugaccucaggugaucugcccaccucagccucccaaagugcugggauuacaagcgugagccacugugcccggccucuuuuuuuucuuuucuuuucuuucuuuuuuuuuuuuuuuuuuuugaaacgaggucaugcaugcaggcuggucacaaaccaaaaaggccuuuugacaauucaacuaccucaacucugggaugggcauuuauuaauaacccccaacccacccaaguccuccaaauacccugccauccaggggaaaacacauaaacaucaauaaacugcauguccccaagggaugcucuuugccccaggauagucuggccucucgggagauuucucuuaccuccagggcuuuguuucaccagagaagccagccuggagguagaaggggaagauacuuagcagcaaaaucugcugcccugugcagccaggccaggggggcagucaggggcuauacaggcugaaaagcuguccaggacccagagcuaugugacucauaaaggcaggcugcccacccacugaaggucuccaaguggcaguccagauggacagugaucagcugucacauuggacgguuggccuccugugaugacaacacugugccaaggaggccuggguugaagcuuugagcacauguuaauuggcuuagcucuauuccaccacuguagaauuuuuuaguucaauucagcaaauauucccuggguuccuguucuuugccagguaauagagcuggacacugugaaugcagagauggauaaaauauguccuuuagcugauggagagaaaaacaugagcaaauaaaugucauuuacuaugaaagauacuagaguaucuggaaagaacaguggagacagagaagggauggauggcugaaagugugugguuaaaacagugcccacccaucuugcccagacacaaaccacucaaaaccaagacccuguuggaggaagcauuccugugaguuuauuagagcaggauuuccugaauucuuccuaggaauguuaaaagauaaaauuugaaaaaaggauuccaagagcaaauaaguuugggaaauagugaguuaaaguuagacagguugcuuucauugguagcucaugcuuaagugcagaacuucucaaagccuugaguaugcugagcacauugugugauuaccccaggggaggagaugguauugagaauuuugacuugggagccuuuuuccagaguuaccuccuuggaccugggacccucauauucuuggacccuggcacaguguccugucuggagcugagaguuugcagaguggccuucuagucccagcacucccacugugacugaaacuguuuggcuuugggaagucuaaccuucucugauguuguuuccucauuguguuaggcaauuuuugcaucucuauaaagaaauacuugaggcuggguaauuuauaaagaaaagagguuucauuggcuccugguucugcaagccauaaaagcauggcacugguaucugcuuggcuucuggggaggccucaggaagcuuuuuuuuuuuuuugagacagagucucgucgcucugucgcccagcuggagugcaguagugcgaucucggcucacugcaaccucugccucccggguucaugccauucuccugccucagccuccugaguagcugggacuacaggugcccaccaccaugcccggcuaauuuuuuuguauuuuuuaauagagacaggguuucaccuuguuagccaggauggucuugaucuccugaccuuguaauccgccugccuuggccucccaaagugcugggauuacaggcaugagccaccacgccuggccaagaagcuucuaaucauggcagaaggcaaagcggggguaggcacaucagauggugauagcaggagcaagggagagagagaggggcgaugccacacaccuucaaacaaccagagcucaugugaccucacucacuguuaugaggacagcaccaaaccaugagaggucugcccucaugacacagauaccucccaucaggucccaccuccagcauuggcaauuacauuuuuaaccugagauuuaggcagggacaaauacccaaacuauaucacucaucuagaaaagaagggaagagugacaucugccuaucuugcaguauuguugugaaauaauagaugugaaagcacuucauacucauaaggacugggauugucauugcuggguugugacaaucgcagcugugaucaagucuucgaggcuuuaguuacuugacugccuugagguuguggccucuuguuaugccuggaauucucccuuccuucacuucuuuacccaccccuugagauacuucuuauaaccauccccuaaguucaauguugguagcccugagacuucuguccuuggaucccuucucuugagaccauuuaucucagagcuccaugugucaacauuaccugucuucugauaaccacccaguuuucugucucuagccuuugcuucucccuuaaguucuggauccaaauguccaacuucuccccagauaccuugauguaauuaucucaagcugcauacuagugccucaaacugcuugcccuuccccacacacuguguuccuucauaacugggugucaucuuaaaaguacuucugguaaacuccugcucauccuucagaacccaacuuuagucuagucuccucuuggcugacuuccuccugugcgcucccagagaacuuuguaccuacaccuaacaugccacuucucacacugccacuguggccauugguguaguuuucauuaagucaaggacugugcuuuauuugccuuuaaauucucauccuugagcagagugcagggcgggcaguaagucuaauuggaugcauauaccucauucuagucaugcccaugcagcagaggggaguuucaucuuuaaugccacaucuggcuuuacacuagaggccugaaccugccggaugcacaauuuuguucuuuucccugcuggcuaggauuugcaggcacccagaagcugaagacccucggggucuccagaggaggucacaugugccucuggccacagccaccccuggacuuucagcuggccagugcucccagcucccagcccuuggcuggcagaggugagcaggagucccacccacuccuccccagcuuagccgagucauguugauauucuggcggcauagucaggcuuguuauugagcacaugcuuugcagauuagccuguuuguauagccaaucgaacaugugcuccauuaaaaauuaaagcauccuguuuuaaggauggagcaggagacaucagcugccacuguguagcagacaugcaaagccccagagcccauuaccauagguuacagcaaauguuaaucagugccagugcaguuaaauaaugcaguuugugcagauggcagcuacuacaucuccucacagauguguccucaagucccggaggcugcuguaucacaggaguugucgggagcagucagaucugaugcugacugucaauaucaccuuuuguguuugugugcauccuccagccagcugagaggcaacgauaggaugacuccaggcccuacuuccagcagcccuuccagagcuggagcagggggucugugcagggcucacaggagagcagaaauauuucacuaaaucgccaagaacacucagaguaaagcucugcagucugcuccaugaaacuguacccagcugcauccugcaagaggcuucccagccagguggaguggggauggcguucccaccuucacucuucacugcuuucugcuugcugaugggcaagaauuccacaaguauucuuccuggcuuccauaagcacagggacaccucacuguaucagaaguuggaguucugacagcaccuacugugcacagggccugauucugaauggcaaagugcuguucccgaagcccaggcacuuggcucucugguccaggugucccuacccuccagccccugaacagauacucugcguaaaauuuaggaacaaaucgccacucaugcugccagcaguaagcagcaacuguuguggcaagaaaagaccaaacuguuucaacugucccagcucuucucucucucuguguacuuccuuacuagcagcugugggggacccuuccaugaaggggcaccuagagcacugacauccacaugugggcaccugggggcauuccaucucagccacugucaggagcaggcacagugacugguccccaugaagguggccuguuaucaagagaagaugaaauaaagcucgagguaaccaagugugggaaacuuguauggaagcaggggagauugcucuugauauaguuaaguguuuuacuuaaagguguaagccucagcuuucugaaaaauaugcuacuguagaacaacucauuucugaauagcaucaaauaugugaggugaaaauguacuuaugagaaaaauaguuaaaaguuuauucauccuauuuccuuucuagguugucagacuaugugcuauucuucauuccuagaugggaaacauugcaucuuaugaauguaacguguugcuguagacaaauauucuuguggagugaagcccagggacaagggucuuuugcuuuccuugcaaaauguagagacauuauuccuguuucaccuuugaaggccaugccaucugauaggccaugccaucugauaugguuuggcucucaccuugaaucgcaccuugaauuguaauaauccccauacguugugggagggaccuggugggagguaauugaaucacaggggugggucuuuccugugcuguucucgugauagugaauaagucucacgagaucugaugguuuuauagaagggagucucccugcacaugcucccucuuugccugccgccauguaagaugugccuuugcucuucccucaucuucuaccaugauugugaggccuccccagccauguggaacugugaguccguuaaaucucuuuuucuuuauaaauuacccaaucuugaguguaucuuuauuagcagcgugagaacagacuaacacaccaucugaucugauggcuucuacccuuccuuucuuucuuuuuuuuuuuuucugaggcggagucuugcucugucacccaggcuggagugcaguggugugaccucagcucacugcaacuucugccucccggguucaagcaauucuccugucucagccucccaaguagcugggacuacaggcacacaccaccacacccagcuaauuuuuguauuuuuaguagauaugggguuucaccauauggucagccuggugucaaacuccugaccucaagugauccaccugccuuggccuuucaaagugcugggauuacaggugugagccaccacucccagccagcuucuacucuuucuuuacuucccagucucaacaucauuuguggaagauuuuagcaccgacucacuccuuuccuuccauuaaacucagcaaugacaugagcagcucaucugagccccaggccucuggauuccuaaccuccuuaccuccaguggucuuuccuuuauccaccucugccccccauucccauuguuaugcccuacgucuugucacuaccuauaaugaugucaguuucaaaauugugauuuccaaaccauuagcugcaaagaguucaaggaacugagaggccaggaugcucaaaacccaccacuggcuucacaccacacuuagaacaaaggucuuuccccugcugugagccugccuacugcucugacuucgucucccacuacucugcuccagucacgcuggccuuuggucuggccuuccaacaagcugagcuaauuugcaccacagagauugguuccauugccugaaugcucuaucccguuauauagauggucgcuuggcuuguucucucacuucauucaaaugucaucuccuuggagagacuucccugacuacccuauuaaaacaacaacaguacaucccccaccccaaaucacucuaucuacuuauccagcuuugcucuucuucacagcacugagccaacauuuagacagacacacccacacauccauauacaucuauauucacuuacuuacugccugucugcuccauugaaguguuggugccacaaggacagggguuuugucugucauauucgcugcuauaucugaugugccuccaauggucuuccauuggaaaaucaauugaaugaaugaaggaauauguuugggcuggaagcaaauguuggaaauggaguuuuaaaacaacaggguuauuuuuuaagcuuucuaauaaacuuucuaucaaaagcauuuuucaauuauuaacacuucauaaaugaacaaauuucaucuucucaaaguuacacuuaggugccaacuagagaaagcagaagaauucauuuucuuaauauuuugugaaauccaggauagauuauuauuucaagcuauaaggcuuccagcauuagccuugaaaccucaucuuuauuuugcuucacugcuaggugucuccuuuuuuguuuuuccuagaacuuuuguuugacuucuaauuuuguccucugauugaggacugaaacaacguguaauaaucucacaccaggcaaauauaguugaaauuuuuaguggauuugauuacauucuugaaaguggcaaaaucaaguaaaagcagauagaucagaagauugaaagcuuuggcuuacaaucauucuuuuuacuuuuuaggauguaaaucaucguauugguccuuuuuacuuuagacaaauaugaccccauaaaguuuuaaaaguuugugucugugaaaaaaagcaagaugaauugucucucacuucccugguuuggaagagaaguuccaaagcagggcugaacugucaucaucaucuaauaauuuuccuuuaguuuucauuuuuccuuucuaaaucuuagcaugugagaucacaggcucccucuccaaacucaucaguugucucuuguuuuaccaguaagaacugaaccccucaucucaaccagucugucaccaaggcacuugcuccaaagacucuguaccagucgagaugcuuuuagcugcaaguaauagaaugccucauccaaaguagccauaggguagccauagggccaagcacagggacucacacuuguaaucccagcacuuugggaggcuguggugggauugcuugaggccaagagcuugaggccagucugggcagcauagcaagauccugucucuacaaaaauuuuuuuuaauuagccuggcauaguggcacgcaccuguagucccagcuacucaggaagcugagguggaaggauugcuugagcccaggaguuugaggcugcagugaacuauaauccacugcauuccagccugagcaacagugaugagauagucagagguaaccagauguguauuaggcugacuccuaggaagcuuuacguuagguugauaagauggcuacaagcaugguaucuccacaccauauacccaaggagggaaggaaaagggcagaccuacuccuuaauugugucuuucuuuuuagcaggaaggaaaauccuuuccggggguccugcagcagauugccccuuacagauaauagccagaacuaggucacguguugauaagguuuagauacuuguucccuucaaaucuuuuguugacauugcaucuccaguguucgaggugggcgcugggagguguuugggucacgggguggaucccucaugaacggcuugguguccucccugugguaaugaaugaguucucacucuacuaguucacacaaaagcugcuuguuuaaaaaagccuggcacuucuuccccucucaccacgugcccuguugacuacccuugccuucugccucgaguaaaacucccugaagcccucaccagaagcagaugcuggcaccauaauucuuguacaagcugcagagccaugagccaaauaaaccucuucucuauaaauuauccacccucagguauuccuuuauagcagcacaaaauggacaaauacacaugggugccacaaaccagucacuagcaaauauagauuagaccacuugguuaucuccuggccuggacacaugucacuuuccuaccugaacaaaguugauguuuucuaauaacagagaaugaaggaugacaagcugccagggucgacaacuaacaaugucugcuacagcaguacaacccguuacuccuacugaaaaaacucacuccagguggaauaguagcuuaugucagggucuguauugauaggccaguagauuauaaaguauuuggaagugaucuuagaaucucugcucauuuaugucaccacuguuucauuuacauaccucuaggauagcacuuaccacguggcaucaugauuccauguccacaggucugacuguuccuaccagauugucaccaggaaccccuuauuucuuuguguccagaguacccaggauaauacuuggaacuuaauagagguagaggcucagucgguguuugcugaacaaaugaaugaauaaacuaacaacaaauaaugaauaacauauuccugaagccaugcguuaugaagaacaguuggaauaacuauagguguuuaccuggggaaugaaugaaugaauggacaaaugaauaagcaaaugacaacuaagagauuuuuggagcgguguccaaugaacuguugaaaugacgagaaauguugacauggagaagagauuugaggaauacagugacuuuuugcaacgcaggauuuaaaagccuuuuaagugaaagagagaugagacuuacuuugugggaucuuuaaggguagagcuaggaaaagugggcugaaacuacaaggagacagaauuguaaaacuaaaaucuaaaaguggagcuauguaaagauggaauagacugccucuggaaagaaugagcucacugucaccaagcagagaguggcuaggcauacucucaggcagugguaggauuuuaucauugaagauuggacuuagauaagaaugauacuuauucccugguauaacuggggguccucccucguagugaggguauucucugaaaguaugaaaaauuaaacuuuuaccacuuaauguuaacaugaaggagguaugugguagcccuuuccaaaguaccaagagacuuuaugaugcuaugagacaucuuggaguaaucccaucugucuuuauuauucccaauuacaugugccauuucccuguugagcucauuucugauagaagaaauguuuuuuaaaagaaaacgauguuaauagaugucacugguuuugucugucuuaacggauucuguuucucacuucaggacauuauccaguuuauacuuuauuaaaauuggccucaugcacccuugaggugaguggguagagaaugaggagaagagccucacuucccggagauggcggagagggauugggcccaccagguauucuuucaaaugggcugccuuacugcccaccugcaggacugaaaaucagagaaaagcgguggaaauugagaaacuguaggacaucauucacucucguaauuacagugaggaagugugcugcauauguauguucccucaguaaaacagguguucugcccuuaaaaugcuaauuauagacuauugcagaucaaugaucuucacuuauuucauauugcugcuccauuuuuuccacauuuaacuacccugugauauagaaagcuugcucacccuugaaaaaaucaaaaugcauauggauuuucugaaauaagccccuuuucuggaaguauuuugugguuaguuucaaaaugcaauauccugagaaagguuuaagucggcuuuuuauuuuaauauauaauaaaaaaguaaaaucacuaggcaaugagcaauuuuacuuccauuagccuaaugucuuugugguuucaucugaggucacuaguagauuauuuuucuugcauuauuucaucagcugucaguucuauuacaaucauguaauucauucagugcugugauuuuucaaagacauaacuguaagcuuagaagacaguuuuuuggaaguuuauuuagaugauuguagggugucagacugccucaaucuucuccaugcucagugucugaagggucaccaacagauuguacaugaccuuagaugcucgaguaauuaucaccacuauguuuuuauacccagcacauaaaaauauaucugcacuuucuuuaucaucaucuuuugaaagacuguggccugccuaugggcugggcaauuagguuuacuacuuagauuacaggauacaugauacagcucuuauuuaacaccaacaauaacucuuuuuaaggugguuucauuucaagcuuagucuauuaauauauucaccauugggcuuugauuacaauaaugcaguuuauuuauguuugcauauaguggguaucagucaagaaaucauuugaaaaucauucacugaacaccagcuacucacagcuuguuaguuucuggugguuauaaaggaauuagaaauucucugcucuugaacauauuauugugauccaucaaagccucuagcaaaguagucauuuaguuugguuuuugugagguuuuuuuaguacgaggauaauuuuuaaauauuaaaaaaauuaggccaggcacgguagcucacgccuguaaucccagcacuuugggaggccgaggcggauggaucacaaggucaggaguucaagaccagccuggucaauauggugaaacccugucucuacuaaaaauacaaaaauuagccgggggugguggugcucgccuguagucccagcuacucaggaggcugaggcagaagaaucgcuugaacccgggagggagagguugcagugagccgaggucgugccaguguacuccagccugggcgauagagugagacucugucucaaaaaauaaauaaauaaauaaaaauuagaacucuacauaguaauaguuuaccuuuauuaucuuguaauuuuaaaaguacaaaaugcacauuuaagauacaugugcauaaaaugauaugucugggauuuguuuuaaaauuaucuggaaaggugggaguagugggaauggguagaugaaauaagacuggccaugaguugauaauuguugaagcugagugcugguagguagcaguuuauuauacaguucucucuacuuuuauggaaauuguucauuuaaaaaaaggaauagaagguuacuaugcacagggagcaguggcucaggccuguaauuucauacuuugggaggccaaggugagaggauugcuugagccuaggaauucaagaccagccugggcaacauagggaaacccugucucuacaaaaaaauacaaaaauuagcccaguguggcagugcaugccuguacucccagcugcucaggaagcuaaggcagcaggauugccugagcacaggagguugaggcugcagugagccaggguuguaccacuguacuccauccugggugauagagcgagacacugucaauccaucaaacaaucaauaacuaugaauucagcuuugcuuuuaaaaagaaaauauauuuuaaugaucauugaagcauuuccauauacuugaaaaauauuaauaauuguaugagaauagcauauaauuuccugagacuauagacagagcuuugugcucauggacucugaacccuuuguuguaacuauuagaauacaauagacaagcaaguucaagguagcuugauacauacuguacacaaacacugagcacauuccaagggaugugaaccuuaacuacagaagcguguauggagcugcuuuaauuuacugugacuguguugcauagaaaaggaagacgaccgugcugccacuuaaguacugauaacauuuaacacugugugcauaagauugaggcagcuuggaagguccagaauaugaagcaaagaauccgauccauucagaaaccaagaaaccuccaaauaauagcacuuucacucuaauucagccucugccaaauuugccuuuggccaauugucaccagugccaaauuaccaacagacuuccuuuucuggucuuagucauguugaccucuuccuucugucuccuagucaagcagaauuuaaaacauuuacauuguauuucaauuucuaugaagaugggagaggaaagguguauuucuugucuuuugucccuggccagcuucuacugggaacuuauuuccuugaaauuccuguccuguaaaagcaugcagaugaaaguaucuuuaauguauaauuacauuuuuauauguguauaaucuuagauuacaugggaauugaguaucuggaauggaucggccuuaggaaaauguuucuuuuuaaaaacuauuaaauauuggaacauuauacaaaaaaauagcauugaaauauuuaaucugugguucaggucuguuguucauuuaaagguuuaacuguuucccacuguuuaaauaucucuaucugaucuuucaugcuaaguuagcauguccaaaauauugaaaaacagaugaaugaucaaggaacuuaaggaauacuccuccagugaagccagaaggauauucuugaggagaaaaaaagaaugcaugaaacuuauuuaacaagaaagauuugagucagguaaucuacauaauauauccacuggcauuaaggcugucaucuugguauugcauuucugguacgaauuucgcaauagcugucuuucacugucgguucuaauaaagaguguuggucagcuuaaauucccugggagcucagaguuauguuuugugaacugcaugugccugaggccucucaugcaugauuuaaacugcuuuguaaaugucaauagguggaaaagcauuggaucccuuguagauuucuccaaauccucaaagauguguaugccauguauaaaccaugcugcacucucaaggccauugccguuuuuuauacuugccuaacuggggguuuaagguauugcuagaagcaaaauaucaguguguucaugucucgauccaacuggccaaugaaacccuuuauuaggaaaaccuuugcaccagagaaaugucuccagugaccugaaaugggcacaccucaugaauguugaauguucuucaaacucuauuucuucauucuugacuuuuuucaaaacauacauuugacuugauugaauuuacugauuucagaguacugcauccauuccauggacagcaguauggggucaucaaaaaaaauuuccauugagagugcccagaccuggguccuauccugguucugccacucucuggcucuuuguccuugggcaagccacuuaaccuuuugggggcccugcuuuucugauccauuaaauaaaggagguugaauuaaaugaucucuaguuaucccucacagcuccagcaucagugauuccaagagauagugacagaaaaccagugugucacuuuuaaagccagggaacacaugugacuuuuuaauugggcucauuccacucucugggcaguacacagugccggcagaagccccaaaauggccagcagcaauggcguagggaggccugaguguuagcuugaggguucaucaacucauuuucguucaaagcacuuccuggugauuguuuuccauggaccugggaacugcacuaagggcgcuccucccacagugugcccugaccccccagguguguucuuuagguaaagcuguuuuuuaaugucugaagaggccaaagcaaaugccagugaggguauagcucucuaggaucuccagaauagaggcaccauaugagcaacaacacuagacuggguuucucagagucuguuucucacacacuuuaguaccucucagcuuaacaugguaccuggagauagaggugcuuaggaaauguaugcuuagcaaauguugcagaaagaguuuauucggagucauagagccaucggagcagauggucuuuuuuguuuucuucuucauguuuugacuccuacauaguucagaauaagucacuuuggucuuuucuuugcacauguucacuuucuaauauagugucuucuuggggagacuguuuuauggggaauaugugaguucauguguuagcuguggagccagccugccugaauuugaauccugacuuuuccucuaacugugugaccuugagcaguuuccuuaaccauucuguaucucagguuuuaaucuguaaaauaaggauaacgggaguaccuagcucuucagauugugaggauugaaugggauauacacauaaagcucucaaugccugguguguuaaaguguucgcaguuguuacuuuuuuaaauguuuuuacuacuuuugaaauuuaguguucaaggugaacuuuuuacagaagagccagggcaauuggaugcacuuugggggaaaaaaaaaucacuugccucauccccaucuucuccaucgcagugaggacuguucucaagugggcacacaggacaccugucuccuucaucugcaaggccccaguggcugugcugggguuugaggucucucguucagaccagguaugugagggcuugguuaucaugcacugcuccugaauccaccaucuccauguccacauccuuggcagggagaccagagccaacugggaacucugccaccuggagagaccuuugaaacacugucgccaccaguguuccauuuguguguuugcagaaugccaaguaagcacauucuuuuucacccucugacaugaccucaggguuacuuucuguggcuguugacaaauuuuuagacaucccaguuuuaucagcggaaaccuugaagagugacaaaugguucuuggaagaguugguacauacuauaaaaaugucagcuggcucauuuauaacccagugauguccagugucugagccgugcuaucagcauggucuauagauaacucacccucacgaugcuccgcucuccccaaguacuuugugcagcuguucugguugaagacccaguugacaucuauaauagauaucaaauggagagccucuuauuuuaucacucucuguguuucagcacuggcgguccccauggacugucagaaacaggcagccagcacguuaugggaaaggugacuugcugagucccugugcccugaggacauuauuaagugcuagggaaccuuguuagcucauaaaguugguucaaaccaauuauuguucugcgaccauuaccauugccaagaauguaacucuuuuaaauucuugcccauaaagccgaucuuuccauuacauuauaucauagagcaagacuucugaucuggccgcacuuguaucccaccggcugcaaagacuaaacauugcauuugcugcucaauauugguuacccuucagugcuucauggaggcagcaagacugcuauuuauagauuuacuuucugucucccuaguucagcacagucaguuuugacacacugucccaguaaucugaucagccaugcugcuuuuaaaugaaggucuaggccuuggccucugcagagagggugacagcugucagauacagauaguaggcuacagauccuggcugcuaaaacccucucauucauuccuguuacagaucauugaccacagcuugaagccaugcuuuacaguuggccgauuaguuggcaagagaucuacauacuguauuagcaaggucaaccacugagauaaaggcaaaaacguaaaccccugcacuauuuuuaaaccaguagccauuuguuaaagcugguuauuuugguacuugucuccguuccccucuuuuuuuuuucucccaaaacaaaacucaagaaacuuguuaaaacucuucggcagcuaacgaagaugccucagauaaugagaugguucaaaccugagaaggaaagaugaggucuuucucagaaacucauuuaggaaccucggauaggaagccguguuagcugugcuuauaccuuguuuuaaucagaacgugucuggaaaucuuaguccagggagaccuggaugaaagugcagccaguuugagugcucuggccaugacaguagguuaggcaggucuggccuagaaagagguaaguuaugauucauacaaguuuaaauccucgcucacuccugaaugaggugguugggcuugguugucagcucagaugauuggacccauuuuguagguguuuccuucuccagaguccuuccuucccccagcaucuugucuguagguauucuaaagccaggcauuauucaacacacuauauuggacuuguguaaagagaacuugcacccugggaaaccuuguguuaaagugauuaauugacuucuucauauucagugaagauccuugcuguuucagaaucgacacaaacgaccaaaccuucaaucucaucuuuacucagaaagggguccaccuauaagauuuugaacucuccuucaccaucugaccagccuccucucugcuuucaccucuccuaugccuucacucccacugaacguuccuuuaacuucaugacagccaccuuccccuuuacccuucucuguguccugcuaagacuauguggacccagcugggguucccauucuuuuuccagguuauacucucuauggucucuauuuuguguccuccucccucucuucugugaccuuacugcaucuuccuguugcauucccaucucccaucugaucucuugucuuucacucucuaccucuuguugacuuaugaccaagcacaguuuccuuaguguacaggggcacccaaggcccuugacaauaugucuguccaccaucuuguagucuugccuccugcuuuguuucuucuccaccucucuaaggccccaugcacacauuugcugaacacacccugcccugucaagcuucuuuggcugccuuugcuauuccuccaccacguagguccuuuagaauggcaagccuuacaauguauaguauauuuaguauacauacccaguaaauauuuguaggacgagugcaugaauaaaagcacaauguuugacauuguuaucagcauugacccaaacccuuugagcuagaugagcaauaaagauuagaagaaagagguuagguauaaccacaaacaaacuugagauugaaggcucgcuagaaguagaacuuuggguggauuucucucugugacuugauuuucuugccuauaaagugagguaagugauaucugcuuuauagguuguugggaggaucaaagaagaaaaaagggaaguaaagugccuaacacagugucuggcaaauggaaggaacuugauagauguuaauuaccuagcugugccauauaacucccaccccaucuucaguguucugugaaauguauuuucauuuuacccuuggaaagguacaggacaggauggaagaccaguuugaugggagagaaggcugggaguuacauaaacccccaugguuuucugacuuuucacuagagucaauaaggagauguuuaaacagacuuuggcccacaaaaggugacucacucucacauucucagcuuccugcucagggaaucaguguggaaacugggcuuccacuucucagcuucaaacuggagcugggaaacuuucgccucuguggaggagccuuggggaaaucucagcccagcugccaugaggugugcaaggggaggacgugucagcccuggaaacuccacaggccucuguuccagaugcacagggcagucacgucuuugcaggggugaagcaggaggacacccucccuccuguucuguucuagcagccaucaugaggugggacuuggagggaaucugauccuguuaggggaacgauccaguccggugcagagcagcuuugggguauuaaugacuguguguuccacagggggaacuuguccauuucauuuauuugcaauaaaauauaugagaggaacaucugcaggcagcuuauauauuugucaaauuuagaaguaauucaggcauaugauggggagccauggcgauuuuaugaauuuucuauuguuaugcauucgaguucccauggcaucguuuggccuagcuauggcagcccagagaacagaggcggugcuagcagacccacgugacacaugccgcgggcuugggcggaugccuggcaugugaagugauccagggugcuggcagaugcagacgaggugggagggagguggaggaggggcauacucauguuuuaggaggggaaauacagggucaccuuuguggacggcaaauagccagguccugaaacuugcuucuaaugaauuccuuacaugcuguugaaauggcaggaaucauaauagcuuauuucaugugccuuugaaggguuccagcaaauggagucuaagagaaggcagggaugggggguggggguggggaggcaggaaaagggggggcgagagugaaauauuacuacuuaaaacauauucuuagacauaauaaagcauuaaaguuaaaauauuguugagacagcuuucauuaugcauguuccaggccucauuauggaauaagcagaagugacugugcagccgagaccuaacaauaucugcacugaauuccuauuauguaagaaaggcuuucuagucccugccagugucgggauguggugguugguuuucaauaaaggucagaaucggugccacacugaauagagcuaaaaguguguuucauucuuuuguaggccacgggcacuguuggggauugaucugaaaaucuggucuguugcgggccuuugcucucaagggagauuaauauuuuagcuauuccuuuuuguucagugcuucuaaauguauuuggaaugaaaagaaagguuaaagaggggcucugggacggcuagcuucagagacuagaucauuucaugaagggaaaucaauuaaaaaagguugacugugaacauuuauccauuuagcuuagccgcuauugaauuuucaugauggacuucgacucuucggagagaacggaguuaauggcaauuguuccuuucuccucaaaauuuauuaucugguuuauucauggaaaacacuccaucaaacuagauagaggccuuaggccuauugauagauuugccugugugggguuggaauggggagguuugucacagauguccagccuuugaaggaaaauuaaacaaguaucucauuacagaaugcuucacugguccccggagguggccacagacgcaguggauuuaaugagcugggaacgucaaugcugccaaaguuuaccucgaccugucuuucugaagaacuccucuauuuaggcccacucaagcaaaggagaaaggcaccacgcuguuuucucccuuucaacuccaaagaaggggauaaugcacuuuuugugccaugcauccagaggaauuaugugugcuaauuugauuaggggagauuugauuaacuggaaaaugagggcuuugcuaagacuuucacacgcuuaauuuaucccuugcaaagcagacgcaacauugugucaugaaacucagaaggcauaugggaacaguauucagugguuagacggccuuucagacccaacaauaucaaggauugccacgguucauauugggauaaucauuuuagagcauucgcuuugcugcagaauacaaauuggguuuggcauugccaguuaaacgguucaaaggauaaugagauuaauauaguaggaaacuuagcugagcaaaaagcuuuuuuuuuuuuuuaacaccauugcauaacuaguuuuaaggggaacuuaguugaaaaaugcuugguuuucuccaaagaaugcauuaauuauguuuugugguuccauacacuccuggucuuucuugcuaaauaaacauaucgugcaucauccagaucuugcugaaauuugggggauaugcauugaagcagccccuguuucuccaugaagguguaugucugugagccuggcugugcaguugggaggccugggggagaggucaugcuucuaccauggcguuuuccauuuuccuuaaaaugugccucagcaacaggcugccaagaucuaauccuguuccccuacccccauagcaguuggggaauuaccaacaaagucuuuaccaucugacauuccccaagggcuguguaagggggcaucuuaccccugcuuucuugggaguauauauuuuuaaaaaguugaaaggagaccagcaaugccaaucucuacuaacaucugaaaaaaggucuuuuuuaaaaaaagcauuucacauucagaagacaccuggaaggucccugcagagagagcucugggcuccaugugccaacgaucuuugaauagaaucccuuggaguuucuacccguaugucuuuuuucuaaagauccccuugcccuugaugauugcaaacuuccacauagcuucagaagccaucuucauugugccaaguuuauuuacaagcagauuuggcccucucuguacuuuggccuacauaguacaagcaacguuugaacuccuguuuugcucuuagcaccagaaguuugggcuuuuccauuaaaaucagucaaucaggaaagagugcaugcaugcuggguuuuaacuuuaacacaggcuggguuucaacuuucauggugaauuaggacugucuccugccauucucccuuggcuugcugcacuguagaaaacugugaaaggagccacuaacuagggcagaccacuggcccaauuugaacaggacugcuuuguuuuagcuggaccuagagguuuaaaucacaagacggcuacuggauucccuucuccccgacccccucauggccaccaccacuagcccucuguaggaggagaacuucacugagcaccugauuaccuguucucgcuuuaggauuagaucaagauaggacagagagguuguucauuuguaggcuuguugccuuacuguaggaguaguuggauugagucaagccauccuuuuccuugggaaacaggccccugccgcuuuaaguggaguugcuggguaaucguuccgcucgguugcauaaccagaaagggaugugucaggacugggaccugcagacagcgaaggcuuuauuaaaacgcucgcagagaccuagacagaugaguggucuccaguuggaguucuuuccaucuuccccaucuguucacugcaguuuuaauuaaaucuacugagauuauuuuuggccuucuccaggaacagaaagccagccugugccaauguccacucguuucugugcuuuacugccagccacuaaugagcaggcacauggggcaccccugccugugugcacccccuuccuuugccagccaucaugaguugcuaauaggguaggaacuaaaagugccaagcccaggccucuccaccuucucccaccuccacccccacccucagccccaccuuggugcuaaagaaagccagcuaacgaaugauuccacuugugguuagcuagcuaaugggaaugacaggcuucaaauaaccuuaaagcaugcagccccaaugcuugucugucugaucagggcccuucugcuggcaccugacacuuucaauaccauaauggcauucacaugcauucuuuuugaaugcugucauauagcaagaccuuucuucucuucguuugcugggaggaugccuggcaaagcuauuaagucugugaugggaaugacaguuaacugcgggccugucagucccacuuuggaagucagcacauccuuauacccauuaggagcauaucauaggaacuucagaaauaaccugcugcaagauaccaucagguuguugcgcugccugcaaacauaccacccaacgagcuuugcacaucauucugcccugccucucauuaagggucugguuuguugauauuugguagauauuugauuucugaauuucagauugggacauaguaauuacuucuggaagguagcauggcuguccccagguaguuggcagguggugguucuuccuauuuauggucagugcuucauggauuugaggacuucuguuaguuggguuuccaagagaaguugugucuuggaauccauuucccuaauugacccccuagguuuccaaagcagacucuaggcagauguacauuuuuuauugcacuugagucccaaauucuggccuaaucaccaacaccagugcacugggcaggacugugagugagccucaguuuccccucuugccccaaguucaaggccuacaagagacccaucugaguggcccacccuccucugcgcucccuaagaaggaaaggggucaaagagagggauccgagugguccagagcaacugcugccccugcugagcuguguuuauaacuucucauuccucccacugauagucucaccccuccacagugaucccuugcucuguucuugaagacuccauuuucauugacccauaucagcacuugcauuuugggguugauguuguggaaccuaaacaauuagaagguuggacuuagagcuuuuagagucuugauuuguccauacauacagcuugacuuucugcuaagacacacgcuuccacuccuaaccagcaaccgagaaucaacaucuucuguguaauuuccaggaaaugccuuucaaacucacugccauuagguagcucuccaaacuucacuuagaggaacaauguuuuagaaggauuccaaaaauaggaauaagugcaguccuuuuucucuagauuggcauuuucugaaauguuuccuggaauagucuuuucguaauauauuaauagacgccacuaggauaaaggauuuuguuugaaaaguguuggauuagaucaaauuaagcaaagcaguggagagggcaauauuaugcuguguuuaccaaacagcuuugaccacagaacaccuaggaacauuucauagaucccuuggaacacaguuugggaaaugcuacuccagaggaucuggaguaagacaaaccagcagagaaccagaguuagccuuucugguauuccaguuuagaacagcaccauaugcucugcagauagaggcucuaauaacccuaugacaccaaugccaggacuuuugaaugaaugaguagaaaaaaauauuauuuagugugcuauguguuguuuugcuuauguagauccuugggagaaauaacacucugauugcagaguuacgaauaauugagccuuuuuugaagaguugguuuuccuuuuaucuugcaacccccaugaacugugcaacugcuuagcuucccaucaucaccguggcugcuggaagccuagagccagcuuccuggcccaucuguuauaaauaagugguuaagugaugggcagacuucauuuccaucuccacugugcauacccacaugguuuauuuuuccuucuuuucuaccaauaauuuuaaaaauccuccccccucccuguuaucuuuuaaagguacccuaaauccuuuugguccuuuaagguacuuuaaauccuuuauccuuuugguccuuuaagguaacuuaaauccuucgguguagggaauauguaagugauacauaacauuaccuguuaccagucuuagcuacuuaauugauaaauugacauuggcuugucugagauuauugucauuuuggguugaucaacaagguugaugagcaguugauguauagccacagcuacggcaacaguuucuuaguuucagaacauaccauguguuuugucuggagacucucuaaucacugaaacaugaaaacaauuuacuaagcuauguuuuuuuccccaacuguggcaacaucauaaagcauuuuuguucauauguguuuuauuggguuuuuuuuuaauuuuuuucuuuauuuuuuuuuuauuuuuugagauggagucuugcucugucgcccaggcuggagugcaguggcgugaucucagcucacugcaagcuccgccucccagguucacgccauucuccugccucagccuccugaguagcugggacuacaggcgcccgccaccacgcccggcuaauuuuuuguauuuuuaguagagacgggguuucaccaugcuagcuaggauggucucagucuccugaacuugugaucugcccgccucggccucucaaagugcugggauuacaggcgugagccaccgcaccuggccuuuuguccauauguguuuuguccucaguagauuccuaguagaauaugaaaauaauuugcagaagauauccuagaaaguuagagcuaaaagggaccuuaaagaucaucuagucuagagauggcaaauaaguuucgauuguccugcuaucuaugguuuguuaguuggcugccuggaggcuuguauugaagauucugggccaugaaggcaucaaaggcuaaaucgauuagugaugucugccaugagcauggcaugaaggcaaggaagugugcaugcugcacauuuucugucccuaguuucucccuuuugaccaaugaaaucaccugagacagagguggcacuagaaaucacgucuuuauucuaaguccaggacucuuuguaaccccaucuugcugaaguaauuauuuuucuuccaacuauaaacguuaguaaacuagagcaccaaaacaauaugcuucuucuagauuugccauugaguucacuguaaagugaaauacaaaaccaagaaucagucccccucuucauuauuuuucccaacuucugauauaguugaggaacgaggccuauucuauacugggaccuacccaaauuuuucuuguuuauacuuagccauauuaucaugauuugguuuuuuuuaauuaagacuguuuugguaagacauauucuccagcaaauucauuuucccuggguccuucuuugguuaagcauguugcuagcuauagccaaaccaacaggucuaagaugccuaaguuauauuaucuuuucuuuucuucuuuccuuucuuucuuuuuuuuucuuucuuuuuuuuuuuuugagaaacagagucucccuccuuugcccagguuggaguggugcaguggugcgaucauggcucacugcagccucaaccuccccaggguucaggugauccucccaccucagccucucgaauaguugggauuacaggcacaugccaccacaccuggcuaauuuuuguuuuuuuaguagaaacaggguuucaccauguuggccaggcuggucucaaacuccugagcuaaagcaauccacccaucucggccuccacaaguguugagguugcaggcaugagccaucaugcccagccuuauauucucuuuucuaaaaaaaaaaaaaaaaaagaugaagggaggaacauuuuagaaaaaucaaguuaggcagcuuugcuaucucaguaugcaaugcugagaagugucacuuuaacagacuuaauccuuucaaauaauaauucaaaugaaauugagaugaacaguuuggcucuuaaggacuuuuuuucuugagacaaugggauucuuuuuucuaagcaauuaauuugcuaauaaaaaaaauggugcugcccuguuccuuauuugcuuuauuucaugagaaaucagguuggcaaucuuguucacauauuuacccauggaacauuccauuccaucuccuucaaugcugaagacauggguuucaagccuacccugcccagggauaagacagagcaggugcaauuaauaaaccaucuuuucaagcuuuccuuccagugguuuguagacugcuuucuccugacaugagucaagcuauuuaaugugauggaauucaucuuguaaggcucucuccauucaggcuaagugauugaauucacaauuccucugauuuagugccucguuugucacuuucuugaggagagguuuuuggacccauuuaguugggagauuggcuggagcaggaagucggggagaaucugccccuaagccaccauuuccuuccacuucaaacaugauucauaaucagucuggaagaagcaggaagauagaggaugaccaacugcucugagaagcaggcugcugugaaguugauuacguuugcaggacagccucuaagaugucuucgaggccaggacacagacccucuagaagccagccauuuuagccacuuggggcuccacaacacagugccuucgaacguaaccagcacugacucgguggugugcacugggccucaaagcacauucccgucucuuaucauucaguagcccagugccaauuagaguggacguacuagacgguuucacucuugcaacccugaaacaguggaguuucagggcugaaagccagucugacuucauccugaccuucagcuaugcacaugugcccugcgcuguagcguggcugccugcugaaugggaaugggguaggugugcuugucccagcaucauugacauuccaggaggcugcuuccugccgguccucccccucaccagguaccauguuuccuauuaguucuucaggaaggaaggcaggucaaaaggguggaugaaguaggucagaaagagggcagucucuaguaggaggggacacagacuuauuuacugguaggaauucucuccuguggaaaaacaguuccgaauucagccucaggauacaagccccaccucuggaggugcucaggccaugagggcugcagcugcaggucuucuguucgucaaccuuuuucucuugagcugaacacaccagacucccugcagaauugcuugggugugcagggagagucagguuauuuuuuaauugaaaaagacauuuuuucuugagaacaugggaacacuacaaaccuucaaggcaaauggaagaacaaauagauguuccagugucuaggcccagaacaggaaguuuuacguuguguuuaacagauacgacaggauuugcagaggaacuuuaaaggagcccaggaguccgcugaaaauguauuuaaaguuuuguuugugugcuugugcauuugccucagaagaugguucuuggcuuucaucagauuuucaaauagaaucuguaaccaaaaaaauaguugaggcugggugugguggcccauaccuguaaucccagcacuuugggaggccaagacaggaggaucacuugaggccaggaguuugaagcuagccuggacaacccagugagacuccuuugcuucaaaaaaaauuuuaaaauaaggccgggcguaguggcucacgcuuguaauaccaguacuuugggaggccgaggcgggcagaucaccugaggucgggaguucgagaccagccugaccaacguggugaaacccccaucucuacuaaaaauacaaaaaaauuugccgggcaugguggcucaugccuguaaucccagcuacucgggaggcugaggcaggaaaauugcuugaaacugggaggcggagguuguggugagccgagauugcgccauugcauuccagccugggcaagaagagcgaaacuccgucucaauaaauaaauaaauaaauaaauuagccgggugcgauggcaugugccuauagucccggcuacucaggaggcugaggugggaggaucgcuuaagccagugaguucuaggcuaugauugcaccacugcauuccaaccugagcaaccuccaaccuguuucaaagaaaaaaaaauguugagauucauugggcucuuaaccagagacuaacuaugcacacgccacuuuggaaauguaugcuguuuguuacccaccacaguacucucacccaccugaccccuucucccuauccaaccuuagccuuaaccaagaacagaccugguuccuaguaagccauguuuccauucaccaagguuuggggagccuucccugacuauaaaagagacucugcuaucacuuuuauuucaucuuaauucaggcauuuuuuuaaugugguguaguugacuuguuucuaaauuccuuuacauuuuguauuguucacacaguaaaaaugucuauuuuaccauuccccauucuaauuuuucaucauuuagucaaagguggggccaaaauugagcuuuagucuauguauaguaagguuuuguuucauuuuguuuuguuuucuuucaaccagaagaauaaaaucagaauuuuagagcuugucuuacccaacccacuuuuuuuuuuuuuuuuuuaaccagagauguuaagucguuuuucaaggucaaacaucuaguugguaguagagguaaugaguuguuuuauucuuugcucuuaucgaagaaaggaaauuauagaauuaauggaauuuuaugaaguuggggguuuucuuuaucguuaucauuaaaagaacgcagugugguuuuaugaaagccucacacaggcugucuucucagcccuuuucagacccgcacucuuuccuccauccacauccucucccuucuccccagccccaacccuuccuuccacgucaagcugaguauacaaagcaucccauauuucaggcugaggccuacggaguggguucccacuggacccucuagcagccugcauucuccgacuugaauggcugcauguggagaguauguauauuuguucagagcucuugcuuuaaguuaccccuucccaccacguugcccaaagaaauaggaaugugaggggaaaaggaaaggaaaaauaccacagguauuuuccccucuggggaagcuugggacucaccacuucacagaauucaagguacagaagcaucuuuucauuuagcagaaggcugcaaaguguggguagaaugcugaguuuuguuaaugaauugcuguucauuucccucuucaucguucuuaguagcuuuuagaaaaugugucugcuuuugacuugagccuucuacaaggccagagauguuucuacagagagcccuuuucuugcaaauaagaacuccuuucacuuuuguucauauugucccaccauguugcugccuuuaaaaaaaauguguuguauauauaaccuagauuaugucccuauaaagugaguuuguaacgacucccucaugagcuuagcaaaaguaugucuagacaauuuuuuuuggcuuuuccccccaaacuucuuuggguuaaaaauagggaaggacuuguuuuaauacaguguaguacuguaucuuuaaccuuuuguccaaacgcauauugccuguuuaaguuuuauuuagagaaaguguguaacuuauaaaccagcucgcucagaccuuggggccgccccuggcuggucuuccugcugcccguggauuagccuagucuccagaaguguuuuacaggaagcuuaggcggagggaagcacuuaauuauuauccaaauuuuucccuuuaguuaagucuuacgguaagauaucccagagauuauauuuuuagcaaccacuuuaaagagacuggggagauuaauuuaaaauugauaaucgcauggcagcaccacagccuaacaagcucaaggucugccuuguggagcuggcugcucucuggggaccccaguucaauucucuuugcugccaguugaaaucagaaaucacaaccgcagugauuagcagugaauucccugaucucccugcucgaggcagagggagagggggccuguuuucuaaguagccagucguuaacucuuucaugggaggggcggaggcagagguagugauucaugggugugagguggggccuaguaaucuacaccuucacagaaacuucccagguaaugcuuagaguccccagcucugggagcuucuguuuuuaggggagugguggacagugagugaagaaagagccuuuugggcccauccaaggcugcccuccaggcaccaugaccgcugaaacccgcaccgcacggcucaggccucugccgagcaacucuguccuucugggcgagccuuucuuuguggaagaaagcaaaaaaaacugccuucugucccucuuccagcauucuucuuuuaaaaauggccucuggcuaccaaguggacaauuauggauagcucuguagagcagcgguaagcaguguuaauuagcugcaggauaucagaaacaaaaaugaaaauauuuucccugugggccaaacaaaauuaauuuuaaaaauuaauguaaaccacuaaugcugcaagugccuccauuaaauuacaggacugugacauguacaaugcuauauuuuugccguugaauuuguuaucuaagagguguucauuguuuguuacggugugaaaagcuguuuuccuccagauaagcuuguucauuaggaaacuggaucucugccaccacccuguuucuucgcacugaaguaaugcccuguagcauaaauguagacagccgcacugcauuuaauaucagaaauguaaaucaaaagcguccagucugguuuuaaauggcuucagucuuucccagggugaaaucuggggaaaaauuucuucucugugcagcuucugacaccacugcuuuagcagacaggcccugaaagcaggcugauaauuauuaaacaaaguaucuuguuucccacugaggucuccggaucgcucugucauuagacuggauuuauuucuaggguuucauucacgcugugacagcuugggauuuauaaguucuguguuuuaauuucaggcagaaaugaaacuggucaauugcaauuugggagggggaagaacccuugauaaaagggcugugcauccuaaugccuaaauacagagccagaauaaagaaggcaucuuggguggcaugcugcgacuucagccacagcugccagcgaacuugagccagcccugggggcaguacagagacaggccgagaacgccaugcuuagugcagccccagagcaccccuucacaccacaggccccuguuccagggaggcgagugcuggccuugcucugaagaaggaagggggagcaaccaggaggaaucccucguccugccagccacgaagggcgugugcuggggcagugacugaaaacuucaguguuucucuggcucugucuucauuccagaagcucuggcacacagguggaagccuggccucacccagccaggagcauguagguucuccuugaaccucugcacccugcuuuucaagguguugaguaagcucagugucugauuucuuuuuuucaaagggaaaccaaaauuauuaacuccucugauauccuuucuggcuccuauuuacuuacuuagcaagcaucuaauucagcacuauuucaaaucugagggguguguugguaaccaguugggagcugagagaaaaccugauuagcaguaagcuuauuuccauagaaacaggccaauuaagaugcugugugaaaaagcaguggagagcccugaccagucaacuuuuggggguccugcagggggcaaacugucccugcccugcuguggaaacagcuggacugacacacagagaggagacucuaguccucuggggggugcuguggcuuucugcggggcugcugguguuuucuugcgcucagagcacuuuacaacacaggccugaaacagagcagcaucaggagggucgcuagagcuacacucccgcuucucuuccagaauccccuauuugacugaccaggaaacugagguucucauuaaugacuuuucugccaaaagaggcacaaacaaaugaacuccuuccgagagcccuaucagauguugcaacguaagaggcuucuagucggucauacagaucgcguauauuaacauaggaacugaucugccaucaccaaggugaccauagguccugguuugccucaaacagccccaauuuaugccugcuguacuuguuaacaguggauaucuucacucuuaaaaguauccgaguuugaauucuacgggaugaucacccucgcuauuacccacaaucuagccaguugguucaaggcgaauaaccccuaaugggaccagugaauuagaaucucuuguuuaaaaguuguggaaggcuacaugugggacaaaaccaaugaaauaaagauuuauuuauuuauuuauuuauuuauguauguauauauguauguuuugagacagugucuugcucugucgcccagacuggagugcaacggcgcgaucucggcucacugcaaccucuaccucccggguucaagcuauucuccugccucagcccccuaaguagcugggauuacaagcaugcgccaccaugucuggcugauuuuuguauuuuuaguacagacagaguuucaccuuguuggccaggcuggucucgaacuucugaccucaagugauccuccugccucagccucccaaagugcugggauuacaggcaugagcgaucgcgcccagccgaaauaaaguuuuaaaacacucgaaacaaugcuacauggcauuuguaucuauguacaaauauagcaaaaguauaaaugccauaccgugcaugauaaauaucaaauuggugaguguguacccugcgggaagauaucugaaauauauauuucuccagcuauaugguggcucuacagguuuuccuuacauguauucuuauguuauccuauacuuuuccuguaguccaaaaauauuucauaauuuaaaaagaagcaagcaggccuucagccaacagagaaugguuucauuaaaguaggggaguguauuuguuggggugcauguaaggaagggaaggauucuauuuaggguuaaacaucucaagaauugcuccaggaaaugaugcgauugggagcaugacugaagcguugcauuguacucugggauagcacugguagacaggcacuccagaaagcacaggaugccugcccauugcauugauguuucucgaguucucagcacuaaggcuugcauccuaaacucuggugugggaaagcuagcugcauauuuacguucuggguggauuugccuccggagacccugcuguucaaucccauucaguuugcagguuaacauuuacuguuccuguccuugaggucagcacuugcccacagauuuuccuaauuucuuuauuuuacucuuccuccaacaauugcaauaacuuggauacuuucucuucacuacuugcaggaaacaggaaggaggcacacagugugauacacagucuuggguugaugucuguuuucaaacauguuuuuggaaucuccauuugaguaguuuaggucuaauuccagucauaccaacuggcuuauaaaagccaccaggaauggguaaaauugcuccagaaugggaagggagcagcauuccauauggcaagggauuuuucuuuuuucuuuuuugagacagagucucacucuguuaccaggcuggagugcagugaugccaucacggcucacugcagcaucaaccccccuggacuugagcaacccucccaccucugccuccugaguagcuggaacaagaggaacauaccaccaugcgggcuaauuuuuuaacuuuuuguagagauagggucucacucugcugcucaggcuguuccugaauccuugggcucaggagauucucccaucccagccucccggaguauugggauuacaggcaugagccaccacaccugcccaggaagggauuuuucaagaggaaaugagacagaaagaguuuggacugagugcacaucuuucucuacccucaaugauguuuguuagcacugcaucaccuggccuagaugguccuuggcaacuaggugacugaucugaguauuuuacauugcagcaucuguacacaggugaucuguauacagcaagugauuccuguaagcuccuugacaauaacagcaauaauaaccuuuacucagcacaugcugcaucccaggcacuuuggugcagcacuuuacaugacuuucugucuuccauccucacagucacccuuugagguggguauuaggaugaaccaugugaaacugccauuuuuguaggucaaaaacagucaaauauuggcaauuguaugugguccaaucuaauaaucuuuuuguaaucaaaaacagucaaauauuagcaguccuaugugguucaaucugaucaucuuacuguauuugcuuugcaaauagagaaauucagacauugaaacuugcucaaaguccacccaucuaccaggugccagaacuggaauuugaacaagguacuccccuccacacccucacacugaacugccgccgcacagugcugucuccuuggguggaagaaaaaggcauauuuuuguggccuagguguuaaauagguucuucaacaacaccucggccaacuuugagaucaaagaugguuggucagaugaaucaaauguuuccuggagucuuggguuacacucguaaugcucuguuuaaaaggaaugauauguagugagcacaucagaaaucuggaagauggaaaaucucucuuuaggaucucugcuccucucucgagcaaagaaagaaaucgguguggugccagcagagguguucucagcaggaccuggcccauuaaaugaaagacuuccaugcugagccaaucaagagagaccuggacaaaaaucagacucuuuccugcccuggaaacccaugccuugaaucuguaauucaucuguuaaaucaagugugcagccggugguuuagcacagagggggacgacggggaagagagaggggcaggagcugcagcacuugaauuuccagcaucagaguccaguuagggaaaagaaacagagcugugauagcuucuuggaccuuauguuuccagcaaagagaaagcagcaggaaagauuuuugaaaacagaugagcugguggaagguauuagaacaauggcggaagaggcagggaccccaggggcugaacaaaacacaguuccgcuguugccuuucaacaagacugaauaaaguuuaggauuuuuuuuuuaugggacuuguagccguuuuuaaacuuucauuuuucauaaugucacagauaaucuuuuuaucuauuauccacuggcucuuuucugagaggcauuugcaucaaauagugcuguacagaucaugacugucucuaguggggaaagcagcuugaaaugaaagguuauucacucccucugcuuucgcuggcuuuguucuugauucucacacauuuuuuuacaucugaauucggguauuucuggaguuuuucuuuagaaacccuuccauucugagaucuaagcauauucagacuccgaucuauauaucagggguuacaaagcuuaugccuacugaaagugaagcauguacuuugaaacauuuguuggauaccccaugguuuccaaaaucccuucagagcauuuccuacagaggcagcaaccguaaaaagcggccagucacacagugggggcccuuucccuagcacuggccuccugguggcaguggagcaguggccuuccaagcaugcacugcgagacaugaguggggcaauccgcuccuuccaacugcagggagaacgggucugcagaaugaauucucuuucuccacuccucccauguggggaacaaacgagagcccucccagggggcgaaguggagcugcaggagagcaugguggaaaacccaggagccaccugggcuaacagggaaucaaaaaugaccuuuuugugcacaaaacccccugggaaaaaaaaugaccuagaaagaagugggguuauggccaggugcgguggcuuacgccuauaauccuagcauuuugggaggcugaggugggcagaucacuugaggucaggaguuugagaccagccuagccaacauggcgaaaccccaucucuacuaaauauucaaaaauuagcgggaugcgguggcagacgccuguaaucccagcuacucagaaggcugaggcaggagaauagcuugaaccugggaggcggagguugcagugagccgagauuaugccacugcacucuagccugggugauagaaugaaacucugucucaaaaaaagaaaagaaaagaaagaaagucguggggauaugacugauaguuucuguucagcuucuauuauaguuucuuaacucaucaccccaagcuccagggggacucugggggaagguugagaccagguuuguucucaggccugccugacagagccccucaggaaagcaucauccacuccagcuuucuccucugcuguuccccacucaaacacuccugccauucccucucagaaagcccagaaaccuuucuuccccuccccaggaggagggagagcagucugcagaggcaaggccugaguggccacaaugacuuagguauuccagcugugcccagaacuuggucucagacaagugcacccagguuaguagugaccucagagaacaguggccaggaacuuguuuuugcauuuguguguguguguguguguguguguguguauguauguauauauauauauauauguauaaaauaagggggcacuggcccccagagaaguacugacaacaaccucugguuagagggcaguucuuugcagcuuuugaugacaaccugcgaggagagaauguugcucucaauuguucaagaaacugaaagcuuagagagguugaagcgauuugccaaguucacgggcuggugacggagugggccucagaacucagaucuuucugacucaaacugccuuguucuuaccauccccuaucucccuagagguuguuagaacuuuugggggcauacuguuccuuuauuuuagaaacucuuuggauauaggguagugguugaagcagcucugaggaucuguuuugaagagaaggguagcauuguuagacuaguaggguaauuuccuuuucccaagcucgucccuccagaccuuugagccggucaucauaguuuuauauuuuaugaccgaaaagaaacuucuguuaaaucguaaauacacuaaaagcccuggugccuaaacacaugaacguauuaucuccuugagccuggaaaucucccagcaauguggcaggaauguagaaacagucugaguugucaacaaaacauaacagauuucccaguuguaacaaacauacguguaguugugaauggaaaacucucccaauaagcaaaauaauggccuuuuucguguuguuuuccucauuuaccauagcuguccuuucagagugccaucgguuucaaauguuucauuguauugauauuuauaacacuucuaguaagcagagugcccacuacauuauuuuuauuuaacucucuccagaguuaaaggaacuuguaguuaaggugucaucuuucagauuuacaauuuuaccuagauuggcaacauggguggcaaagugcuuggaacuaagacagaaaaguugguuccaguccuggccugccuuugugugugacuugaguaaggcucaggaagagaggcugcugauacccaccccaccuguccccaccccaccugcccccaccccagaugggucccaaggcaaaugugaaagauuaggugcuccugaaugugacaccagacguggugugacagagcccauuugugggugucuguuucaaagcuuuugguucauaggccaugcugcccgcuuugcuggaggaaaguuccaagacccacaccaggcuacuccuugacaggaagcuuuuguuccuagcaacggguuuacccagucuuuguuuguuuguuuguuuguuuguuuguuuugagacagggucucacucugucccccaggcuggagugcaguggugcuaucucagcucaccgcaaccuccaccuccagguucaagcgguucuucugccucagccacccagguagcugggauuacaggcacuggccaucacgccugacuaacuuuauauauuuuuaguagagacaggguuucaccauguuggcuaggcuggucucaaacuccugaccucaagugauucucccgccucagccuccgaaagugcugggguuacaggcaugagccaccccgccugccccgacucucuucuuaauaugcuccaugcguuuguuuaugcuccccccaccugcaacauacuuuguagucuacgcaugugucagggcuauuugcuggucucuuuucucucacccugaucuggcugugagcagauaaucccccauuccucaauuuggcugguacugcaguuggcacggcucuccaaacucugcagccaccagacauguagaaacaaaccucuaggcuucccaggaggcucacggacugccucauggcugagccuucaauagagaugaucaucuaugaaaauaauaacaaaaaauguugcugguuauaaaugcaauauaugcucaauagaaauaguagucuauaaaauuagaaaguuaugcuguuauaaauagaauauaugcucauuguaaaaauguagaaaauguaauacauauuaagaaaaaauauucauauuugccaucgauauauauuuuacauauuuguauguuuuuucaguaugacacaucaaagaaagggcagaaucuucuuucuucucuuaacuuuuugucgugagcaauacaguguuaaguucagggaaggaauugaguucggagccaaacugcccagguuugaauucagcucugccacuugcuaguuguguaauacugcuuuuuuguuugguuugguguauuuuauuuuauuuauuuuauuuuuuuuugagauggagucuugcccuguugacaggcuggaguacaguugcacaaucucagcucacugcaaccuccgccucuggguucaaacagcucuccugccucagccucccgaguagcuggauuacaagugugugccaccauacccaguuaauuuuuguauuuuuaguagauaugagguaucaccauguuggccaagcuggucucgaacuccugaccucaaaugaucccacccgcccuguccucccgaagugcugggauuacaggcaugagcuaccacguccacugccugccugucuuuuacugaaguuguagauguccucuuugccuauucucugaauucuaccccuacccuacccauggugacccacagagugcuuuguauacaauaggggugucauuaauguuuguugaacauaaaugaauuaaaauauaacauccuaaaagugauuucaaacuuuggaauuuagguuuuguuguuuuuguuuuuuauuagagacggucuugcucuguugcccaggcugcagugcggugccaccaucuugacucacugcaaccucaaacuucugggcccaagugauccucucaccucagucuccugaguagcugggacuacgggcacaauccaccaugcuagcuacuuuuuuuuuuuuucuuguagagaugguguuucacuauguugcacaggcuggucuugaacuccuggccucaagcgauucuccugccucugccuccuaaagugcugggauuaacaggcaugaaccaccaugccugaccugacuuuggacaaguuauuuggcauuuauaauuccacuuucucaucuacaaaauagagacaauaauaguaccuaccucauggggcuguuuugaggaauuaacacaaauaaagcacuuagaauaaugcuucgugcugugcaguaagcacucaauaaucuaaguugguaauauuccuguuuuuauaucguguuuuaauaaaugagaacauaacauuuuaaaaucaaggagcugugauuucaugcucugcacacugccucagugacauaaagacugggacugaagcuggggcaucacucccuuugguuuccccucuccuaggcccuuagucacauacaccuuggagaacaggcacaaccgagaggaccugcauuucagugauguccgaggccaagggacaaggccagauucuagucaggugauaauggaaugagaguguucacugcacaugucuuaaugaauggagaugauaaggggucaccaagcccuauauauuuauagugcuuuauuuuucauccaaaaacacaaagugcuguuuaguccccacaacaaucaggaaagcgaggaacuauucuucccacugaggggaugggaaagcugaguccccuuggugggaccgggcugcaggcgcagggacuugcuccccucaaacuguuguggucucaccacagucaggaccagucacuugaacagcucccauuuccccagaaugauucuauagagaggcaggagaacccuggacccugagcaggagacuucaguccaggggccagcagcgcaagcacagcgucauagaacaucauagaacauagaacauuauucugcucagggcaaaauaaugugggcugcacagucuggcccaggcagcccucaguguugugcccucaaguguugagaugacaggaggauggggucaggccagugauccucaaagucagaagaagaauacuaugccucaauccuacucauuuccuuuccaaacucucccuagagggccucuaacuguggcugaggggaggggcggcacuuuuugauacacggugcaacuugcccacuuugacccugaccuuugcucuguccccuucaggugacccuggcaaguagcuuuuuagagcagugguucucaaacuugagugugugcagaauccccugggguuggggggcagggcuuugaaaauacagauugcugggccccaccccuagaguuucugauacaguggcucagggaugggcccaauaauuuacauuucugacaucuggguuccuggaugcugcuaguggagagaaccggugauuugauagcauuggugagcuggcucaacucucugcucaggaaagugacaggaugccucaaaugcugagugcugcguauucaaauuccaaacacaaggcaacuaggaugggagcccuucuagacucuguguauucaaggaccagggagaggcuuagcagcucucagcucuccuggcacagagagaguucucugaagcuugcuguuuuucucucuccuacuuugauaguuuccuccauuuguaugggcggagguugcaaaggccagaauagacucagcgagagugggagaugggggugagugaguguguucacuuuugaugaggagcagaugugacaagcacuaaaauggagugggcaauaagaauuauuacuagcugaggccgggcacagucgcucacaccuguaaucccagcacuuuggaaggccgaggcggguggaucaccugaggucaggaguucaagaccagccugaccaacauggagaaacccugccucuacuaaaaauacaaaauuagucgggcgugguggcacaugccuguaaucgcagcuacuugggaagcuaaggcagaagaauugcuugaaccugggaggcggaggcugcagugagccgagauugcaccauugcacuccagccugaacaagagugaaacugucucaagaaaaaaaaaaaagaauuauuaccagcugcuuuguggucaggaugucccaagcuggcacugcagcaaccgcuguuagggggcuuggugccauuugcaaggaugucauccucagccacugguuucuaggcagccccuccaggaauuccucuuccaugcaccuccuugggcagagcguugaggugugguggcugaaauucaggaauuauuguggaagcuugaguuugcaugcccacuccguuuccuacuaacuagcucaggggcgggggaguuucugaacuauguuggcauaguucagaaacuuaauguuuaagugucuuaauguauacgauggagauaaugcucucugauuuacugaccucucggguugugggcuagacaccagaguuucagaguucucggugcacugcuguguauuccugggaaugccccugaggguggagcucucuguaaggaaggcagccccaagggcagggcuggucucuuuagaaagacuaggaaugaggacacccggcguccaggccuagcuuuuccacccacucaccuucacagcuccuucauccuuucugcuucaguucccuccucuguaacaugaaguuggaguagauacuucauucagagcaucuuccggcuguaaauggcuugagcccauugucaacuggaagacagagugugacgucuaaaaacccaaacagcaaagagcaucucuuccaaaccacccaaucuggagagguggggcaguuuugugguuccggcaccgacaccgucccuuucacacgguacugagccgcgggcugcuucggggcggcccuccccgccccgugccuugccgggauggcagagcggaucagaagcugcgcgcgcucugccugcgcgcuuugccugcgcgcuuugccgccgcaacccgcgcagcagccaauccgcuggugcacugcaggugaccucccccgggcccgggaauaaauugucaaguuuccccaccgugggugucuuugcuagccggcgaguugcagucuucugagcuaauuaggagacggucaugaggagcgaggcgggccggggcgcuccgcgggccggggcggggcuggggcgggcggcgcgcagcuccugggccgaggcauccgcgagccgcggguagaucgcucgcgucugaucgccgcccgggagcucccgcggagccggcugccaggacucguuccagcuccagugcggggcugcccgggcguccagaggcggcggacggcgugccggcaaguuuccccggcaccugccagugcccgcgaacccaccucggaagccagacccggggaggcagaggcagaggccggcuggcuccagccgugguaccgcacggcugccacccucggacuuccgucuugagucuccugaggcugagaagcagcagaugccgaaccugcccccugacguggacguacaccucaagaccuaaaaugcgcccugccuggagacuuugaacuuagucuucuggaaaugcggagaccgcuucgggugguuuuguuuuugcauccucuucggcuagguuuggcuuugggauucucuggcuaccuggauacgccuuuccuuugugggcaagucucccgcggaucgcagcaccagcagccaacccuggggcacaccagccuuuaaaacccccgagccuggagacgcauggagcuagagaagaggacccaacuccugaccacguaaggacucugauuccaccuuucccgugauggagagaaauauaauuucauggcagaauuuucuuuaagcacauugucugauaggauuggcaauuacuaaccaggaaaaugaguagcaauuaggaguucaguaauaaauggaagucuauuguccuaauugaguggaauuacugacugguaauggcaacacugaauucuucaguuuaauuaagaguuuauauaauuauagugcacuuuuuauuucuugggggagccaugggguaggaauuaaauaaccagugugaugguuaagaaacccauuuaauggguaaguaaccaaugaguugaaaugaaugugagugccuugcucaagcaaugcaaacuuagaugaauuccugauaaagagauguaacagcuugggccaagcaagacuuucagcugcuaauuccugucugauaaaaaucugaacggcuuagaaaugauuggguaaucucuaaaacuggcacacugaaacuguuuuagagauaccagagcucccucucuccugccgggguauuaaccccgauuugugcucucugucgcuguguuuuccacauucuucaagagugaaacgagugggucauuugagagugcuuuugcagccugggguuucuguauggaaaaucuugugauugagcuguugagcuguaaauguugauagcugaaggggauagacaagcuucaucgaaguuacucaaauucaaagcagagugaguauguaggugugcaauuugggaacuaaucuguaauuauaaagauguuauuuuccucuuuggugguguauuguuuccuuuacuauuauguucucaagaaauuguuccccuugugggaagcagugaaauuggagagaaaucccugcucagaggauaauuacuuauauuuuugguguagguuucugggaauccuuuuaacccuacauugggaugcacauauuuauuuccauaagaagcuccagcagguuuggaaaucacuagguuuugaauacacugguagauaauuagcacuucaaguaacaauauuuaugccacucuguaccuugacuucuuuuucuugcuuacacgaggucuagauuuucaacaggaugaucagggacuaccuucucuagagagcuugcauauugcaaguggguucagggagcaccauuauaguugcauuucacuccagaagagacagugaguggcauggaaggggcauugcaucuugaauacugcaugcguuuuaaaguuugcagagcuuauucauaaauccgcuugguuaaugagaaaaaagcagguaucgaaagacguuugcuguaugugugccucccagucucagcccuuccaggugcuuugcaggucccuaaguacagagugucacuguccagaauuuuaagggcuuaccuacccugguuuuuccccucuccccuaguccuguuuugucauugcuaccaugaaaaucuagcaaaaguguagaaaguuguguccuuccagaaccacgguuucucagugcagguuuacuguauugagcgcccacuccuuuucuguuuguauucugcccaaggcacagcagacauucacuccuuuuauuucccaugaaauuguacaacaggcagaagcuugaagauacaacacggauggaaauuugagccuuguaacguucaaaaaugacacaauugccaaguuuccuaacuuuuccuaagaguugauuaaagaucacaacuucauaucgcuccuuuuucccuaugcauuugccguccaucacacaccugacugugagcuguuguaauagcuagaugagguuuaaaaaaagagggaguaggggcucaaggauugcuguccucucagaaauguugcccaaggcuacccuaaggcucagccuacccccagauucucuuucugacaaguggguguuugguaggauggugugaaaguuuccuucuaugauaacaucuuuaagauuuguuuccaaauucccuuuuuuuucuuuuuguaaccugcugagaauaugagucuguaaccuauguauuuaucugaagucagccugaacagauagaaaaacugaguuacaagguaugggacucccaguaaauuaggaacagaugugggucaaaaacagauuuccaaacucuuuaucaaaugaucccacuuggaaacaagacaugaacaggccuaacuacucuuaaaaugcaagguuugucugagggcaaacaugcuggaaaagaugguggccaccacccugccucuacuuuucuuuuccuuucaucuuucuucccaccgucuuugguucccugcauaggcuguguaguggguaucagucagcacuugucugcugguugcacaaugcagauuacucacuucugcccaaguaacucccugaagccguacuguaacaauagagcauauaaaaaagaaacucagguugaucuuggccccuguccaaggggauuagcuagggagcaccugaaaggccuguguugaacacacucaccuguaacccaguuccauggccuggaucucaaggacaggguaaucucaguaccuuuuaaugaccuaguaaaugugguaucuuucugucuuuacacucgaccugauggcucauagagucuccucauuauggagcuggaggaguacuuugaggucaucuaggcccucacuacucaaaguguggaccaugggucagcagcauugguaucaccaaggagccuguuagaaaugcugaaccucagguccaucccuggauuuauagaaucagaaucugcgacagguuccccagauuucucauaugcauuaugacaggugggguugucccaugauccaacucugagauggaguuuagccaguggcguauuuauuaaggagugcccuuuggaucaauaccuaugggaaggaggaggaaggaacaggaauagguagguagagcaagaagucaagcagcaauacaggcccagugacagucaucacucacaacacgggaagcuacacagcuaggucagccuucuaaguugucuguggugggcagggauggccaggccuuucaacucacugcagacagcacucccagcagucagcagcaagucugucauuagacagggaucuggguagcucaucacaguguccaccacaugcacugaaguugggagaagcucuauucugggucacugguucucaaaauguggcugcauaccaacaggaccuucagcaccccggggacucauuagagaugcacauuccugagccccacccacagcuacugaaucagaaacuaggguggggcucagcaaccuguguuuucacacguucuccaagugagugcugcaugcccaaguuucagaaccacugcuccaaggcagccuuuuuucuguuuguuuuguuuucuaauuguuauugaaaugauucacaguccaucuuaauaauaaaauucaccacuuuaaaguguacaauucaguaauuuugugggguuuuuagguuuuuuguuuuguuuuguuuuguuuuguuuuugagacgaagucuugcucuguugcccaggcuggagugcgguggugccaucuuggcuuacugcaaccucuuaucuccugggucaagggauucucucgccucagccucccgaguagcugggacuacaggcgcccgccaccacuccuggcuaauuuuuguauuuuuaguagagacgggguuuugccauguuggccagacuggucucaaacuccugaccugaagugaucugcccaccucagccucccaaagugcugggauuacaggcacgggccaccgcgcccggcccaauucaguaauuuuuaguauauuuauaaccuguuuaguauauuugcaacccucgccuuuacuuccagaacauuuucauuauccccaaaagagaucccacacccauuagcaaucacucucugcacccccucccaaagucuggcagccacucaucugcuuucugucacugugaauuugccuguucuugauacuuuauuuaacuugaguaaugcaguauguggcuuuugucuuguuucuuaacguuuugagagucagccaagcuguaacauguaucaguacuccauuuccuucaugggacaaaucauauuccauuauuuagacaguaccacauuuuguuucuuuauucauccauugauggucauggguucuuucuacuguuugguuauugugaauaaugcugcugugaacauugguguacaaguuucuguauggacauauuucuucaauucucuugggucaauaccuaggaguugcucagucauauguuaacucuauguuucacuuuuugaggaacucccagacuguuuuccaaagugacuguaccauuugacauucuuacaagcaguuuaugagaguuccaguuucuccguauuaucuccaacacuuguuaauaucuguccuuuuuauuauagccauucuagugaaugugaagugguaucucaguguaguuuuaguuugcauuucccuaaugacuaaugauguugaacauaguuuucauguuuucauuggcuauuuguacaucugcuauggagaaaugucuauucagauccuucuuagggcagcucuuuuuguuccuuaaggaaucccucaguaugucagcuuuguguccaguccugugcagguguuuuaggauuuaugaaacaaagccuacaaccuguggccauuacccacuggaaaguucuaaucagaugugaaacugucuaaaaaggggaaaggaggacaggagagcccacugucgaggguuagcaugaagagauucacauucuauuacaauucgugcuucagaaagacacggugugacuugcuaggauagaguggugugugucagggauguggcggcugcagacugcuggagaagacugggaauguugagaggaagaggaacaaguagagaagcggggacaggaaguugugggcagaccuucuaguauucuuuuauggguuacacacaccuguaagaggggaucucaggagcccaagauuucuuucaagaucaugaccuucaccagccucagcaaggugaagcaguucaccuuuuucuucauuugggcaaaaaugaccugccuccaccauuucucagaguguuuguaaagacugauuauaauacucuaaacaagugcuugaagagugugauuuauucuacauuacaggugagaaaaaaguuuguagguguccuuaaauagucucugauucccuauuagcagauccucaugguggcagugccauguccaucccaaccccccagggcaggugccucucucaagauaccugagacuaccaggcacauccucagggcucccaggcagcuucucuuuaugguugcaacacaccuugaaaaugacauauuggggcaaaagaauuucaaaacagcaaaaccuuugccaucauccucucacauagcuagggccucugcacguaugauaacaagacagcuaccuuagacuuaugucaugccaucuaacuuacaaagugcucucucaaccuugcaccagaggaaaccaaagcuccaggaagugacuuggcuaaugucaccgguuggacuguagcaugaucaggaccugaccccugguacauugacaccugacccaguguuuucaucgggcacuuuuaccuuacagguugcuaaggauuaaugaugggauguuuugauucuuagucuauaaguggauccucucccaggaggcuccaggucuccggaugccaggcacucauguuuuauuugguguugcagcuguguuucauuguaguaacauauuccaaaugcuaugagaucacccugagucucauugaagaaaaguguuucaaaaguaugcagagaggucaaaguauuaggaaaguucuagaauguacuuaaauucucaguuucuuccaggagccccucuguaacaggcugggucguaauuagaguauuuggaucacuguuucuugaacacauucaacacaaaacuguggcaaugcagaauucaaagaguggaucaggacauuuguguacuaaguagcccuguacauacuggauaaugauuuucuuucgucuguucgcccugaguucucuagcguauacccugucuuggguaagaauauauccugaaaagucaugugucagguugauguccuuugaguccuauuuuaaauucacaagugguaugugcugagaaaaagcagauccucugauaaagcaaagaacuguguugugaaaaaaguuauucuaucccuacucauucauuucuucuguaaaucaggauuuuagguauuuuuuuccuuaaagcuaguuauaucuacguagaagauuucugcauacuucucuuuuuuguuuguuuuguuuuugaagaacaaaguauauaaaugcccucuagagucauagacacagauugaagguggcaaggugagcaaaauuggcauuuugucccauuaccccauuuuccuuuucuuuucuuuuuuuuauccuaagcaggagagaagugaucugcaaguuucucaggaugcuuuuggguaagaguuucaccauaaaaaugucuucacccacacuccucccagugucagugugccagguacccugucaccuuugguugauguccugauggauuaagcucuggacagagccacaccuuugaagaggcuucuuggccagauuaacacaccaaggaaagugcuucagucuagaacaugccccgucgcuggggucuggcacccuggccucugugcugugcccuccugcagccugugcugugcucuccuacuccagugcuuagaaaugccaagucaaggaugugggggcaggugcuugagagagggucaaagugcugucauuguaagaaauuauucaucaaccucagauaguaucuuccaguaacaaaccauacaagacccuggcccucgaggaggagccugcaaauguuagcuccccugccagccaaagaaaaucaggaaaagagcaacagggaaaauacuuuauuuuuaaggagauauuuugccaauaauuuaaauugcagcuuucuucucuuaaugaagaaauaugcauuucgugauacccagccucccccaguuccucugaagcagagauaauaauaacuacuauuuauugaggacuagcagccaggugcuucagcacuuuaguauuuucugccacucaaaaaaucaaugggauuggcauauaaugaugccaaagcuuggcaaggugauuuugucuggguuuaaacccgggucccucuagcacagugcuuuaaaacgugccuggcccacaauacaaacacaccgugacccgguguaagguguuuuguggaacucaccaaaccacucaauaaauaucgacugcaugaaaugaauggcugaacuucuuaggacaauuuuauucuuuuugauggucauuucaggugucauuccucuccacagaaugguaguuaucacuuaccuuuuuauauccgcacagauuaaaagcuuuggugacugucgcuugguuccauuuugugcucuccuccaggcuggugaugggcuggggugggccgagagcaaagugucagugcccacagcaugcaugagcuacugcuuucaggccuggagaugcagaaggugggccuuaccuagcugcucuuuuacuugcugugauuguguaaggcagaaguucacccuugcucugcagcaaccaucacagagaguugcaccagccagauuugcguucagcaugcccaaugaucaacaugcuguugaaaauggaaguuugaaaggaauugaaaguagaaauauucaccuuacaggacagguaacacuugccccuaggcccuacuuuaaggauuuggcuguuccccaguauagaauuagagaacgucagagcuugaagggaauuagagagcaucuagcccacuccacuaucccugcucaccucugccucugcugacagagaagcuauggacaagaaaggagaaccgaaccacucagaccaccacaguccuugguggcaggccuuacacuggaggccacagcucugccuucugguaccuuccaccauguggcaucuagcugcaagggaggcugggaauuuagguucuguccuuacaguggggaaagagacuuaacccaggaguuuccccaaauaugggaaaucugauauaaaugggcuugcuuaauaauuauugccauucuuacaggcuaaaauaaaaaucagauuucuucacugugggaauagauuuuccugagauguuaagggagcuccugcuuuguaugcccuuaaucuuuucuugugguaauguuuuagggcgguuccauuaagcacgcaaauggucaugauaucuuuuaaggguuccuccugcucuaugagucuucauuuucaacacgugaagaauucaguauaacauuuuccauuuuucacuaaggcuaaacuuauacacacugacauauccacuuuaaagcaucauaaaacagcauuugcccuugcucugugcucaauuuuucuuuccuuggaaaugcugagaagucguugccuguuccugguuuuugacguuggcuaaccaccuacugcuaaaugagacgaauugaaauaauggucugaaaacugaaucguauggcauucauguucacaggcugaccaagccaggagggacuggaauugauaucuuccauggaaaagaugucuaacaacacaaccguuugaaucaacucacguuuacuaccagguacuccugguacuaaauacuauaaguagcaguucauuuguuuuugucuuucuuuuuuuuuucuuucuuucuuuccuucuuucucuuuuuuuuuuuuuuuuuuuuggucuuuucuuucucuuguguaaauauaaagcucccacugaaaucuacuuaaguaucauaucuggaacuuuucuaguaaguaguggaaaaucaguuugucugaggucaucuuucccauaaaagguguugaagucaaaauacaacauagcgaugaauuucucaauuaaacauuguauuagcgaaucacagaauuacaauuugaggaauacacacagaccagaguagucuuugguauguucaaaggacaaagagaagauuggggauuuuauuagaaagagaaauguuauguauuguuuugaaagaaggcucauuggcacuacagaagcuuuugggagcuggcaaggucugaugagugaggcagcagguaaaacucuagacaagaagcaagacaacucacagcaggucauuucagcagcucuguguaaaacaaccuuagggucauagcaagccuuuucagcagcugggcuugcagaaaauucacuucuuggagcuggugcuauauguccagagugccccagcaccucgacucugauuuaguugaauauuucaagaaugacucaauucguauaaucaacuuucacacacgcuuuuugggcgcuggauaagauuaucagaggagauaauuacgcuaccuccagaccuuuaaaagugagccucgucuagaucugauaguuaugaggaauucuacuugaagccuaugagauuaacuagacgauuuaggacuuaggacugagucccuaacacucuaguaaucuaugauucuuaaaaguuaauauuuguauuuauauuuauauuugcagcccaucaauaauuacauuaaugaugaacuugguucuuaguuuugaagcaucauucaugcauuuggucaauagcauuuacugugcaggcacuuuguuagcagccggggauacaguggugaaaaaaguagacaugaagcuucaugaagcuuauauuauagugcagcgcccauaagcuuuucaaaaucuucaauuacuguaauaguguuucuuggggccagacgugguggcucacgccuguaaucucagcacuuugggaggcugaggcaggcagaucgccugaggucggaaguucgagaccagccucaucaaaaguggugaaaccccaucucuacugaaaauuccaaaauucgccaggcguggugaugcacacuuguaaucccagauacuagggagacugaggcaggagaaucgcuuguaccugggagguggagguugcagugagucgagauugugccacuguacuccagccugggcgacaagcgagacucugucucaagaaaaaaaaaaaaaaaaaagucuuucauggaggacuucucauacacgugcgcacacacacaacacauugaacacuuuauuguuucuguagugauggggagacagcuagguguggagaccuguaauaaguccuagugauagcgagccccaguucccaccugggcagaguuagauuuauccuguguaacugaccaauucggagugauuuggaguguuucucuucuugaugaggcccaggggccccacugcacuuggccuacuucugaaaggagggaaaugcugcucucaguaauccucugcuggggggcgaaggugggagugauuggauuacaguuccuuuaguagcugcguggagcuugccaugugucagaaaaccuuagaguguagucauggaauccucagugcugacaggaaugcacucuuuuuaaaauaaguaugccucucuguguugggauauaugaucaauugaagccucugggcagaauccauugauggaaagccuauauuuaaaaacgaaccuaguggagguguaugauacagaggauaugguacagagaagaagaaagcagugaggucucagguguuggaaaagucaagucuagacaagaagcaagacaacucacgaugcagacgagaugacuggaagagucuggggaacuuugggagauuaaaggauagagaugguggaugcugggugauuucuaccugugagcacgauuaccagauguccuugauagugugcaaugcccaugccauuuccuucaggcgacgcugcaguucagcgugcaagauacugccacacaguugagaugcagaugaauuuggcacauguucauguugauguugcccaugugauuaagcuuauaugaagugguacacacaaaaaaagaaccauuuccuuccacagauauuuauauuuagggaaaaaugagaauauuuaaagaaaagcuguuaugcauuguagaaguaaaauuguagaaggucuucuacuaucugcauuuacuuaaaguuaaaaguuaaucacuuccagcaaggaacugcacauguggaauguugguggucaauguguuauguuaagaaacuuaaaacccucauuucuacaaauagucauaugauacgacucuuccugaaaacuagaguugggacacugguacccuaagcacagcacagaguaccaggaugccuaucugacuggaccuuugccagcucugggcauuugcucuuuuguuagucuuuggcauuuauuuuauuuuauuuuuagagguagggucucauucuguugcccaggauggacagcaauggcacagucauaguucacggcagccucaaccucccaggcucaagagauccuccucccucagccucccaaguagcugagacuacaggcauacaccaccauacccagcuaauuuuuaauuuuuuuuguauagauggggucucacuauguugcccagccuguccucaaacuccugggcucaagcaauccucccacccuggacucccaaagugcugggauuacaggugugagucacugcauccagcccaaucuuugacgguuugacagacaaaaaacuggcauccugugguuuuguccgggagguuuuuaaaugccucugcccauaguguagcagugacuauuugagacuaaaaugcuuuuuuuaggggaacaguuuauuugcuauuuucuuauugggauaacuuuuucagagcagccuccccccauaguaagaaaauuaaagguauucacgaugaaccacccugaugaaaggaagaagugcuuagagcuuccgugucccacauucugugugggauugggaaccucuggcaugggucccagugaugauauuggacaauccccugguguacugcucagugggaaaguagauauggcagagaauguuacuugacuucuaauaaucauuuuccccaucuuccuuguuaauagaaccacugcauuuuuaauuuggugacuugcccgauuaaaugcaauaaagacuacaugucuuagccaccauugcagcaaggugcugucauaucacuaaguucuggccaaugguuauuuuuaaaauuuaaauacauucauuuauuuauuuuaauugauguauaaaaauggcauauguuuauuguguacaacaugauguucuaaaaugugcauacauugugggaugaugaaauugagcuaauuaacauacguaugaccuuacauacuuguuuuuugugaugagaacacuuaaaauccagugauuucuaagaauacaauguuauuaucuauagucaccauguuguacaauagaucuucuaaacacauuccuucugucuagcugaaauuuuacauccuuugaccaacacuucccaaccccuccgcccagccccugguaaccaccauucgacuuuuugcuucuauagcucaacuuuuuuagauucugcauauaaaugagaucauguaguauuuaucuuucugugccuggcuuauuucacuugguauaauguucuccaaguucauccauguugucccagaggacaggauugucuuuuuuuuuuuuuuuuuuccgagacagagucucacucugucucccaggcuggagugcaguggugugaucucggcuuacugcaaacucugccucccagguucgugcuauucuccugccucagccucccaaguagcugggacuacaggcgcccaccaccacgccaagcuaauuuuguuuuuuuuguuuuguuuuuuuuuuuuguuguuuuguuuuuuuaguagagacaggguuucaccauguuagccaggauggucuccaucuccugaccucaugaucugcccaccucugccucccaaagugcugggauuacaggcgugagccaccacgcccggccaggauuguccucuuuuuuaagacugaauaggauccauuguguaugugucuuuaccacauuuucuuuaucuauucaucugucagcggacacuuaggugaauuccaugucuuggcuaauaugaauaaugcuacagugaauaugagaguacagguaucucuucaacauauugaucuuauuuccuuuggauacauacccuaaaguggaauugcugaaucauauggaaguucuguuuuuuguuguuguuguuguuguuguuguuguuguuguuguuguuguuuugagacagaaucucacucugucgcuuacuuaaguuggagugcaguggugcgaucuuggcaucuuggcucacugcaaucuccaccuccuggguuaaagcgaugcucuugccuuagccucugaguagcuaggauuacaggcaugugccacugugcccagguaauuuuuguauuuuaaguagagacaggguuuugccauguaggcugggcuggucucgaacuccuggcaucaagugauccaacugccuugaccucucaaaguucugggauuauaagcaugagccaccacacccaacccauauuuuuaauguuuugaggaaccucccuguuguuuuccauaauggcuguaccaaguuaaauucccaccaacagcauguaagcuuucuuuuucuccacauucucaccaaaacuuagcgcucaucuuuuuuuuuuuuuuuuuuuuuuuuuuuuuccugacagagucucauucuguugcccaggcuagaaggcagugguguggucauggcucacugcagccucaaccuccugggcucaggcuuuccccccacuucagccacccaaguagcugggaugaccacaggugcacgccacuacaccuggcuaauuuuuaauuuuuauauagagaccaggucucacuauguugcccagguuggucucucaucuuuuugauaguggccguccuaacaaguaugaggugauauucauuguaguuuuaauuugaauuucccugauuauuagugccguugagcaguuuuuaaauauaucuguuggccauuuguaguucuucuuuugaaaaaugccuauucaggucauuuguccauuuuuuauuugcaugauuuucuugcuguagaguuguuugaauuccuaaucuauuuuggauauuaaccccuuaucagauacaugauuugcaaauauuuucagccauuucauaaguucucuucacucuguugauuguuuccuuugccaugccaaagauuuuuuaguuugaugcaauccuauuugucuauuuuugccuuuaggaucauauacgaaacaucuuugugaaugucaugggguauuuccccuauguuuucuuccaggaguuuuacagcuucaggucuuguauuacauguaagucuuuaauccauuuugaguugauucuuucacacggugugagauaagggucucauuucauuccucugcacguagguaugcaguuuucccaauacuauguauugaggagacugucccuuccccauuagccaguggguauuaacgaaagagugaaguguuacuuguagaguguacccuuaaagagucaagggcaugcccccuucacccuugcuccuucugcggucuagaauguggacauaaugguuggggcugcaguuaucaucuugcaccaugauguagcuuugggaaugaaaggcaguaaggcagaaacagcaacauaucuagagaaacccuaugucccugacauuauagagugccaugccagcccuaggcugccuaccguggggcuuugaugugagaaagagaacucuuacuugagccacuguuauuuuagguugccugucacuugcagucaaacauaauccuaacuaauccaguggggaaauggcucuaaaaggagcuaucauccaccuuccuaaauuucuaacauuuggaagccgcuucuuauagcaagucuuuuuguuacaauuacgcagucacaauggauaacuaucugcacuuuacuguggacuguggaaagguaugaagcacagaggaaugaaaaucucacacucacucacuagaauguacuuauacucacauuuaccaaaaugccacuuacagccuugugcauaauaaaauaaaguaauuacuaauuaguccgucacgugggcauccaaaccauacuugaauagugacuucagugaugugcugagagucguacucauuagaguagucauaguuucuacaaagggggccuuagaaaugggcuuacuugaagcauuucucuaaauauacaaauaauaaauuggaaaccuucuggaguguguauaauguauacacaaaugugugcauugguuguuauacucgaaguagcagaaaacaucugcuccugacuuuaacacgggaacaaaugaccccagauuauuagcugcuaauagauuuuuguaguuuuagggaaaggagaaaaguaccauagccuucuuuguucuauaaagaauacguauuuuauguauucuguguuugaaccaucucagcaucagaauugacuguuuaauaguugcaguuguuuaauaauuuuuuuuuaguuaaugcaaaauauuggaagucaucuccaggcuucuggcuuacagagagucccuguagagauagcagaucacugcaucugacaucgucagcugugguugcucaaaccucugguccaggaagaggcagagucaaccuuuuuucccagcagaaugggauucuagacaugcagaucagcucuccuaaauagucuuagagucagaguauuuuaccaccggaugugaacccuggagaugaucuaguauuguccuucaaguugaggaaacugagguccaguaaguccaacaagaccuacccaaggucacaguggccuggguggcacagggcuggaacccagaccucauuguucuugucauacagcaugaccuuccauuucaaggagacuaacaaauaccaaguuuggcaauguauccacccucacuuuuauuugagagguuacaaagcaaacaaaaugagaucaugucauaagcaguucuguccuaaguggguuaggauuuauuucuucuuuucuacauuuuuuuuuuaaaucagaagguauauccccaagaacaggaacuaaaggaacagauugcuuagacccuugugacucugcccuggugguggaucauuaaugguguagaaaaugagggcagugcugggcaggcaguccaggguggggugcaugccucuuuaagagauuuauguggaggucugagcuagggagacagcgcggugguacaucaucaugcaggcgacaucagagacuuucuucuucgcuugggugcauuaucauaaaaagugauuuagacuggagcugauugaugcaaauggcccuauguucuuuccuaucauuagcggccucuuucaguggccagaggcagugauuaaagcugucauuuggagcugcucauuaaagacaagccccagaauagcaagaggaaaaaagguuggagaggcauauauauacauauaugugugugugucuguguguguguguguguguguguguguauuuuuugccuuaaaagugcaucauucuuuucuagauugagccacugaaaucaaggcuguagagacauuuccacugagaauauagaaugcuguuuugcaaguaauauuagauuuucggagugucauaguagauucugaugacagcuugccuacauauuaugaaaggagaugaggaggguauuguguuagguguguuuuguuagggauugacccuggugagaacucauuaagucucccuccucccaggcuggggacuucagaggcaggccacaggagagcagaggggaggguugccgagaguggauggccucaguaagucccacugugacaguguugaccccagggauggacagaagaaggagagcagggaggaggcuuuuugcugagcccagaugauauagaugccuggaugucacucagagagagggguuggugagaggaggccccuaaauaggaggggaauggaacaaagcaagauccauagaugcgagaagagaaauuaaucagaacaugaucccuggcuccuuggagucuuccagacagggcgacaugacuaguuaaucacucuuguggucaaauugggcuucagugugcaccugccuaccuuuucaucaacaugcauucacauccacuuacgcacugauuuuuaguuuagugucccaguaguaccuaaaagugacaaaaaucccaagcuccaaaugaauuacagcaugccccaaaugaaggcuaggguaguuaguggguggcggcuaaacagggagccagggcugugaagccagggagggagccaucuuuguuucuuggaagaaaccaguuugaagucagagaugagacuggcuggcuaauccugcacauccucacuggccaguugaugucuuacugcccaaaucccaccaaacuuucauacaagcuagucuacagcucuccucagaaauuccucugggaaaggaaaaaaauaagaaauuaucaauuuaauuucucagucuaaugaacuggucuuauacauaaaaauuuaaauuacuuuuuuuuuuaugaaaguggggaccaacaucauuuaugcaaccaccacugucuccaugacaacgccuuggauguggcagcucaugugacuucacagucacaggcccuugaaaugaagcaaaggaaaguuuuaguuucucuucuguaauuuauuggacucuagggaugcucacgauggugcuaaguggagguguggggguuucuuuuugcuguggacaguaaauagugagaaaguggugaaauuauuccuuccugcggcagggauuggaacuugcugcagagagugcuuccuugucagccucagagccaguugacagcuucagaggcguggcuuuuguccuccucucugcugcacccccacccccacgcuggccuucuuagccugggucuggcgcaucagggccuauuaguacugaugcugggcugugauguuccucuccucggggagcacggcagcagaacugaacaaagucacugguaaucugugcuuacagccuccccccuggggagaaagccuagccagcuggcacucucacgcugagcacauucacuuccccuggcuggucggcagccuggcaggggcccagaggcuggccggcugcagggcuaaccugcaccagcaccccaggcagcccagcucaggaucacacacgcauuguucucugccuuccagacuggacacuggcugaacucacagcuuggacgguguggcucaucugcuuaggccuucccaggguagcucucuagaaauaaaaauuacgaacgcuggaugaagaacaauuggcuggcuacauugagguuaauacaggaccauuuccccugucgucuuuuuccuuucccaggcucuaggucggugacaucaggaagauuuaucaugaguuccgucuucuguaguuggaaaggagauggcacaucugccuugggugaugggguggaagaguggguggcagggaugaggguggagcaggaaacaccaguaguccuggauguguguguacuuguuagaaauaccugcagggaaaaaagaagcggcuggucuuuggauccuugcucagguggaccuuccagcacacccauugccagauacaacuucugucgaacuaagacuucccucccauguaccagaaucuugcauaaagggagcagaggcuugagaggccccucuggggaagcaaugucuuuagucacugcucugcucacaaggugcaggaaaagucuagauuuuucucaguugacuuucaggcuuagaaaaaaaaaaccucuagaagauuuauggcuuguuguuguuguuguuguuguuguuguuguuguuguuggaaaagcauuuauucucuuuaggagccaucacacaccaacauguauguggcccuuaguuggcguagguagaggucaacugugcugcuuucaccagguauacagguguccuaauaagaguuuggggacagugcaaaacggcaguguguucuguucaaauuuuuuuuuugucuugcucuguugcccaggauagagugcuauggugcgaucuuggcucacugcaaccuucaccucccagaaucaagcgauucuccaccucagccucccgaguagcugagauuacaggugcuggccaccuugccgagcucauuuuuauauuuuucagagagguaggguuuugccauguugcccaggcuggucucgaacuccagaccucaagugaucugcccacccuggccucccaaauugcugggauuacaggcgugagccaccacaugcagcccagaaacuuuucuuuuagcagagauaaaggagggauuucuccaaaaagacaacaaaaaaggugcaaaugaauuagcuucuguacaucuucuucagauuuucccuauucuguuagugaguucacugagaaguggagggaacaagaggaagaaucauugcuaacaugaagccagugcuaggccuuaugcuaaaacucuuacacaggggucuuaucuccuucugacagugcaguugggaagcaugcucaccagccccauguggcaggugaagccccuggcucagagccucucagcagcuaauagcuaccacguggaggcuccaggaucuaagcccaagugccagccuaaagaccccacgcucuucucccuggcugagugcugagguaccauucggcuuuaacagcugacggggcugaugcagcugcccggugacaccaugugcccugcuguguacugcaguugccauuuugcauuuauagugggauuaucugaugcuccaagcuccacaagggcaaggucuuaguuuuuacauacuguugaguccccagugccugacacugugcucugcacaccauauguggucaauacauacuuggcaaaugaaaaagggaaugaacgaguggucaggguuaaaaaucaacguaucuuuaaaguaagccaaugugcuucccaaacccaaagaaauucuucucaaaauagagugucgaauaguuuuuuuuuuuuuuuuuugauuggagaaacuugagcauguuuuuaggccaagcaguaggaauuauuagagagggaaugauggcacuauugauggaacacggucccagaggagaucugaagugacaagauuaagagcagagaagaauuuucauuagcagaaacagggcacuuccuccuuagagaccagaggugaagagagaaaaaaaggauccgguagucaugggcuauguaucacuuaggagugcuuucagcugcaaguaauagcuugacuagcagugccugaaacaauuaaggauuuauuuuuuucaugugaugguaagacagcuacagcugggugaccacuguguugcuucaguggcucagugggguaagggccauugucuucaagacuuucuuggccuuucccucaugagaugcaccuucuagcaucacauuugcauucaaguaaaaguccgugcuauccuugcagacacuuacuucgcaugcugccugcucugcugauugaggaaauggucaagacuaaaugaccacuagucccuccuucagguaugacaguggaguccaacgguuagugggaucugaccuccagcgagcuuauuucuccuaugaugaauauaagaaguuuguggccgggcucaguggcucaugccuguaaucccagcacuuugggaggccgaggugggcggaucaugaggucaggagaucaagaccauccuggcuaacauggugaaaccccguuucuaccaaaaauacaaaaaaauuagcugggcgugguggcgggcgccuguagucccagcuacucaggaggcugaggcaggagaauggcaugaaccagggaggcagagcuugcagugagcugagaucacaccacugcacaccaaccugggcgacagagcgagacacugucucagagaaaaaaaaaagaaguuugugagggauuccuaagaaagugaccgagggagaggaggaaggggagaguuggaaaaguuaaaugauucacuuguaagcuacuagaacuuuguuaaguuuggggacaucaugguuuugugaaaucuacuuucgcugaaauuuauguccauuucuuugccuccuucucucugcacaccgccucuacucagaaauuuaaccauuuacacacaacagaaagaauuuuccucaagaucgcuacuuuugcccaguauuucugauugucuuucugcuucacaucuccagaaaauguauucccuuuaacaacuuaacuuggagaaggaggaaagaaaccuaagcagauaugacuccaccuaaguuuuaugaggaaccuucgaaggaaacucugagaaaaaugagucuguaucuuuuucucccucuuagaccaggcuuuugacaucuaccagugugcacacuuaccaauuaacaguuacguucuuauugguugagagaacaaggcauuaacacgucuggugacugcugcgcuggucccgugagaccuguagagaggccaagugguugccgugggcuuuugcuaccucuuugggcagucacuuugccuguaugagacgaggaggccggacccucucagcuccugacauccucucuaaccuccugugaucuggucacccugugggaaagccaaggcagcccuggccccucuccagcagucucucccuggagggcucggccuguuggguuuuacuuagcucgcaguuuaugccuucauucuccucugacccucauuaaccaagaggaaaaacuaauucuagaaaggacuccauuuccccccauauuguauauuucauauccacagagcaugcugugcccuauugagaauuaaacugcgaucacuaaccucaucucauuugugccaggggucuuguucaaaagcuguuuccccagcaaagcagugccguggguuaggacccccucaccccacacacacaugcuugguggagugguucccaucucuuuuuaaugccuuuggcaggggacagacagagagagagaaagagagagagagaaggaaacacagggagagagagagcaagagaaaaaaaagagaaacacaaaagaagaacaagagggaaagaaaagcucucgaacagcagcccuguguuuuguuagaacauuggcacugcauuuaucaggauuacuggagggagagcaggguuugauccucuucuccacugggagagggaaaagcuuuauuguaccuuuuuuaacaucucacaguuagaucagaacaauacacuguguauguacauacacaccauacguaugugccuaaggaugauauucuacuugggacacacccuguuuucaaagcauggcugaauuuuuuauaaaggccagauacagaaagccaccaggcucucccugggucucccuuuccagcagaccuucccccccuccccauccccuugccggacuuggaucagcaggauucacuccugucaaacaaauuagagcaucuaugaaauggggcuaucgacaugugugacuugaucuguuuuaauaggggcccggugggaguuuccucccugccccacugagcuuuguauccuucacggaaaggcagacggggcgcgggaggaugcuguggacuuuaacccuuugcugccagcagguugccugccuccugcgugcagccgcuuccuuuuugugccuggccauugucuggggagugcgugcggccugccaugcucuucaugcuuguuaucucacaggagacaagcucaccccaggagaggaagagagagcugcguucugaagcagaucuuuugauuuccuuucuucccucuccucucucaaauaauuagaagugcuggucaagguauuaaaaaaaaaaaacagccaaaggggagaaaauauauuguauauuuuauaacccuggcauuuuguuuuucaagagguguugucgggcugccauuugacccuuauguaauaauuagcauuugagcuguggcagcuagcaaguagguaagggagaauugccuguuuggaggaaggauccgaccccuuuuaaguagaagagaagagggaauuugccucugucagcauuucagaugcacccccaugcuaucacugucucccuggcccucuguuccugacucaguugcuaaugacacaaucucccagcgccugccuccgcccauggcucacccccacacccauucacuguucagguacuugagucccagccacagagcuggaaggcuggacagcagcuaagacaagaggcagaggccuugugcacaguccuguugccgagaagcgcuuagcacccugccacccucccuguaccgcucuguaggggugcagauucccaccgagcccauggccuuaccugcaccucucccuuaaccugggagugcugcgggcagaagucaggacccgcuuucuuuucuugcucuucuuuacuccuuagcacauagcacugguacaccucaauuuauagaacagacaccuuccugaaaaacugcauguaaaugcaauuuuugacagguggaauuuuguagcucauagauuuacauuguuuagagucagucgaaaugaagcugaaaacacaaucauauucccuguacuuacugguguaggaaccugagcacacagcuccuuucguaaagugagaaauucuccagcggagcguguagccguacccugguuuaccuguucaaggaguccuaugcugaagaccacaucuuaugggcaucggugugcaguaggcgcucagucacaccacgcucaucacugagauguggaaggaaagggguuggucgggcccuuugcucuccugugcugguggccaagcccagggcuuggguuguaaaaccacaggccugacugcuucuccuugaauuguccugaaccuugacccuuagcgcccucaggucguuguguuguuuggauuggugauuucauuaggauuucucacccuuuucauuuauuucauuuaggcccgaggcagaacuucugggagcuagcugaucaucugucuuuuaauuuuccuuuagggagaagaacuccacugggcuccauuucucccucucauugcuugcuggcacuggcuccauggccucuuuguuguguuuuuguuuuguguuuuguuaccguccccucuggcaccagaucaaggggcagggagggaaacugggacguuuuggaggaggguugccaaagaguuguugcaggaaagaggcauggucagaagaccaguucagcagcugagcagcgacaggagcacuuccaguuccuccagggccugagcucagagcggggaggaccaugaggggccgcgguauggcggcggugggguagggaaagagccaggagaaugaaggaagagcagcagcuuauuuaauuuggaaaaacaagggaaaagcuccaguccacauacaucucuucuuucuuccccuucccugaugcucaugaauagcacguggaaggguugaguguuucugccccacaguguggcuucugccgggagugggggcacacauuccaggcuucugugcugccuggguagcuccuucuccuggccuuucagguccaggauuacagacucaaacuguauucacugugggggcagggugggggguucuccccuuuuuuucucccauguccuagucauuuggucgcugcaaaaugauuacaacaugcaggagaucucuugccaccugaaccauuuuuaaauccucuccugaguacuaagcccaguucuuuccaaauuauuuccagcaacuuucgccucauguguagguuucucuggauuaauccccaguacaaucuuuuccauccucaaaagucacagacauuuuaguuuuucugauuucaugucccaccuuaggucagaucuuugaggggugggaggguaggagguaaggaaccacuccucaugcaggauauuagauugagaaacagaaaccuacaaaaauucagcuccacuuauuuuuaaacugaugaucaugucugaauuagaucagagcaaaagcaaagauuaaggaaaaaggccuaguacaaacuauagcaaacacaguggaccagugcugaacuuugcuagcuguucugggacgcuacagcuaggcaggcuuacguuagugcauagucauucucuuuuuuuuuuuuuuuuuuuuuuuuuuuggagaaauggagucucugucgcccaagcuggagugcaguggugcaaucucagcucacugcaacuuccaccuccuggguuuaagcaguucuccugccucagccucgcgaguaacugggacuacaggugugcgucacgacacccggcuaauugguguauuuuuuaguagagacccuguugggcacggugcucucaaacuccugacuucaggugaucugcccgccucguccucccaaagugcugggauuacaggugugagccauugcgccuggcuagcauagucauucuuaagggcauguucagaccaaguuccucuggcuauucuuggagcggagauguccuggcaacuucauuucucugucgucucuuacaaaacccccuuucuccaaguucucuuaaaaaugcaucuuugacuuauauucucuccugccugaggggccugccguuguccucuguuccuggacuuucaccucauccugccgucuagaccuggcaucuguuuuggucagugcucuggauguucuuuaagcagcacauucuugcugagcagaacacgguguucagccagguuccauagcucccgucauccccaccguugcuacccaggcccuugguuguccugcacucccgcuaacccccagacuuucuuagaaucaaaacuuccuccaguuggaucacugggcuucuauuccauaacuccuucauuuccucuugccaagaauguucuuuagcaauccgaaguuauauuuguuauuaaauauaagacuuaaaaaaggcuuguauuuuuccccugaaaucagcuuuaaugaauuaugacaaaacuuaacucauauugcuaaacauuauauguaaugggugugcucuuucaacuuagggaaaaauggauccagaacuguuggcagccuuuacacgucuuucaucggccuuuuucuuuguggaccaaaagaaagggccaaacuuagccaaaaccauuggccgcugauacucuugugaagacuguguuuuauuaccacugcaagaguuggggguuggccaaaaugauacccagacauuucagaucuuaaucacaggugcugaaaacagagauguguuugauucuagaccauuacaagugggaguuaauuaccacauuucaaugaacucuccgugugcccuccugccauagcaauuagcaagagaguggccgcuugugugcuugaugguguuuuaugaccauggauuauauaggaauuaggaauggcuucgggaagcauuugguccucacaguuauccaauaccagcauggcccaaccccagauaugucaaagccacaacuguugcguuuggcaggcauucuacaaaauguacuuggucaauacuaaauaguuucauuuagcagaccaguuuauucaagugccugacaggaguuuccuggauucucaccucuccugagaggccuucaagagcaucgcugaagguuuaucuacagcuaggguagguuaugaguaaugucuuuuaugaaacuuugcaaaccaacugucguucuguucaauucccagaggcagauuuuuaggguugcuguguccaauacaguagccacuagccaccuguggcuauuucagcuuaauuuaguuaccaucaaauaaaauuuaaacaucaguuccucagugacacacuagccaguuucaagaguacaguggucacucuugucacagugguuauuguaucagacgauacagaacauguuaaucaucauagaaaguucuggacaguggugcucuagagucucaacaugucacguguucaggggaucacuggaucuaaagccauuccuuaugggaaauguuggcuuucuugaaaauacaccagagaccagagaaggucaccauguggagaagaggcagccuucacucugccaagaaugcuggccaggcuucucuguuuuauaucucaucacaaugagggccauucuggcccuccaaaauauggauaccaaccuuuacgcacugucagaaaugggccacaauucaaaguguucucugcuguuucugaugaacugccguucuccagcucuucccugaaauggcaaggaaaagugauguucccucaagaucugccaagggagauacucccucucucugguaaucgucgcugucuccuuccaucagguuagacuaccagggaaguaccuaccugaauagcauuagcguaucuuccucacuagaauuaucuuugauagaucauacuuuaauguuuauaccuugggcuuauugauaauuuuaaaaaaucaauaugaagauaaacuugcaugugcugugaaagucauucauuacuaaagauguagaccauucagguaaagcacugcauaauacucaggaugugcuggucucucuggaagaaccgugggaccuccuuccaauggagaaugcaaaugaugugacccacuguuuuacauuuugccccaucugcccagaacuccagaguucaacucagcacucauuuauauugacuugauuagccauggugguuagaaauuggcuuucucucccuuaaccagguguuugauuuucuguuuuaguuuuaauaaccuuauuguguauaucuuuuaauuuaauucuccuuaaauuguuuucugaaagaggcgaaguauaaacaaaugaauacaaauuuuauuuucagguccccacauuugauauuuucuguuuugagguagucucuaugcaagccccaaccccaggcccuggcauaaaugacaggagggcccagggaccuccuggcagucucauuuuucuuucauacccuccugaguaucuagcacacugcuaaacauaugcugcuuagagugauguaagguagagaaacacugugccccgcgugggaaggcauuacagaauaaacuuaggaaagagggucaccucucagauuuagucagaugacaaaggcagcacuggcuucccugggguguagagauaggaaagaauuugaauaauuaucaucauuaucaucaccacauucauuaaaccccaucugcacauggcacuguguaaguccccauagguuuuuuucucugccagugagagagaauuuuguccagcagggaggcgaauccugagcucuccccagcucaccaguuuccuccucgggcuguuccacuccacagccagcagccuggcucaucacugagguugaguccauugccuccuauguucuugggagaucucugugguccuuggcuuauaaucaucuuucacguucuaggacucuggacuuucccuuuacagcacucaccacaguagcaauuaagaacauugaugcauaaugaauuagagauucucuuguaguacauuuuauccaacuagggggucaucucuguucucugcacccccauaucucuagaaccccccauuaugugugguauguagccaagugcuugaugcauauucuuagcaguaaauagcaggaaugaaugaaugaguguguauccaauuugacuuuagaguuauuucccgacuuacagccguugaaguugcuguuuccuccacguguucaaccuuugggauucacacaauacuugacagucacagcucugccaugggggacaucauuacacaaagcacuccucaccaguagucagauggcacuugauagcuacaggcaugugaauauucuuuuacugucaacuuuuguugugauuucaccuaaaaugugauaagcuccuugaggauaaaggcuaagucuuacuucuucguauuucugguaaccgcuuguaccaaacaccugccaagcauuguugauugcaccuaugaggaggugagaaagugccaggccgucaugccccucuauacaaacauguaacaguagacucugguucaucaggaguaaaugacaugauaugugauagaccacguacauucguggcuauagauaggugaguaacuguaaccauauccaauugugagcaaaaguguuuuaauuggugguuuuaaacuaauauaaaauuggcuaaaucaucauuuuucagcuuucgaaucaucugaagaccuuuuuuuauuuuuuaauauuuagucuuguuuuauuuauuuauuuuugagauggaaucuugcucugucaccuaggcuggagugcagugaugcaaucucagcucacugcaaccuucaccucccagguucaagcgauucucuugucucagccuccugaguagcugggacuauaggcacacacuaccacacccagcuaauuuuuguauuuuuaguagagaugggguuucaccauauuggucaggcuggucucgaacuccugacaucaggugauccaccugccucggccucccaaagugcugggauuacaggcgugagccaccaugccugcucugaagaucuuuuuuaaagaacugauagauguccagguaugguggcucacaccugugaucccagcaacucgggaggccaaggugggaggauugcuugagccuaaaaguuugcauccagccugggcaacauagcaagaccuuguuucuaaaaaaaaaaaaaaaaaaaaaaaaaauuauguaaaaacuuuuuuuuuucuuuuaaguacugguaggacuggauccuaccacaggaaaaaaauaauaaucucuagggcuagguaccagacaaugaaauauauuuuuuaaauaacucacuuuuuaaaaaauuuccacuuuuauuuuagauuuaggggcuacaugugcagguuuguuacauggguauauuuugugaugcugagguuuggaguaugaaugaucucaucagccagguacugagcgcaguacccaauaguuuuucaacccuuccccucauccuucccucucgccucucauagaccccaaugucuauuguugccauuuuuauguccaugucuacccagugguuagcccccacuuacaaaugacagcauucaguauuugguuuucucuuccugcguuaauucacuuaagauaauggccuccagcugcacucguguugcugcaaaggacgugauuuuguugcuuuuucuggcugcauaguauuccaucguguauauguauuacacugucuuuauccaguccaccguugaugggcaccuagguugauucugugucuucacucuugugaauagugcugugaugaacagcugagugcagguguccuuuaugguagaccauuuauuuucuuuuggauauauacccaguaaugggauuucugggucaaaugguaauucuguuuuaaguucuuugaaaaaccugcaaacugcuuuccauaggcacugaacuaauuuaccuucccaccagcaguguauaagcauucccuuuucucuacagccuugccagcaucuguuguuuuuacuuuuaauaauagccauucugacuggugugagaugauagcguauugugauuuugauuugaauuucucuguugacuagugauguugagcauuuuuucauguguuguaugucuucuuuugaaaagugucuguguguuuuacccauuuuuaaugggguuauuuguuuugugcuuguucaguuguuugaguuccuuauagauucuggauauuagaccuuuaucagaugcauaauuugcaaauguuuucucccauucuguggauugccucuuuucucuguugauagcuucuuuugcuguggagcucagauguuuuuaaugugcaaacauaguugagaacuacuaacccagucuucggguauuaaucagcaccagcucauuauuccaucucugccaacacucaaucacaauuugcucuaguuugguaacugcccucguucagauggagcagaguuggaauuuuacaguguagggcuggcgccaguuccugucauucuccauccaauuccgagccaaguguccagccuuagcagggaucccacaugcaauggaaaaagggaugcuuuguucucagaauggcuuauucauuuacuagaugugcauuuagcaucuguuauguacacgguggaggaaaagacaguuaauuucugugcugugcagucaagguugggauaaacguggucaggaugucaugggagcuucaaagaaaggaaacaggccccuguguagagucaucaaaagagacuuucugaaggugauauuaaaaccaagcccugaaaguugcauggaagcuugccgggauacucuuuccccgucuuucaccuggcugauggaagagcaugggcacagguauggaggugugcacgaagguggcucauugaucuauaaguagaaauuucuauaaauagaaauugugguugaagcacagggcacaaguguggcaaagcaaugccuuggaagccaugcgggcaauguugagagacagcccaaagagguaagcagaggccagaucaaaaaaacauguuuauuugccauggugggacagauuuaccaugaagcucuugaagcuuaagcugcagggccccuggggaggggccacauguugggcuuuguuccuuuuuuaauuugcaaaacuauauauauauauacauauauauauaguauauauauauauguauauauauauauauguauauguauauauaaauuauauaagcuucaggcucuacaaaaaccuggaucugaagcuuaaggaccuuuacuuuuuccugaagguaauaggaguuaaugaagaagggaagagaugugaguuuuagcuaggauuauaauuuaucauugaaacugagauacuuugagaguaaaagaccaugcuauuaauaguauaccuacaucccucccccucccccccaaaaaauccaguaaucagaacuuuccuuggcaaaaagcaguguaugaagacuuugauuuuagcccacuugguugguaaucuuaagaugcaguuacaggagguugagacuggagcagggagaccaguuaggaugcuguuacauucaaaggagaugaucagggccagaauuaagacagcauuaaagaaacugaagacaagcaguugggauccucaggaugggaaagcacggguaaacgggcaggagaccucugggcgccauuucugaaccgggcagcuggguagauagauggcggugucuucccuuggccugauggaacagggaggggguggcagacauuggggggaaguggggauuccagcugaauguaaggaugucgggaagugccuguggaagagccaagagaggacgaguuuaguaaguacugagguucugguggcagguucauauccaucgcggggcagucggguuugcuguacugccacagaugccaaccgucugcagaugccacuuggagauggaaaccaccuaaugcaagaagaggucagguagcagcauggauggcucagugcaaaccaacccuucuauuuaaaacacagcuaggccaggcaugguggcucacgccuguaagccuagcauuuugggaaaccaaggugggaggaucaccugagcucaagaguuugagaccagcuuggccaacagggugaaaccucgucucuacuaaaaauacaaaaaauuagccaggcgugguggcaggcaucuguaaucucagcuacucaggaggcuaaggcaugagaaucugcugaaccggggaggccaaggcugccgugagcugagaucgugccacugcacuccagccugggcgacaaagcgagacuccaucucaaaaaaagggaagaaaaaaaaaaagcccacagcuaaaagccagcccuucuguggucauagcagccaacauacaugguagggccugaauccauccccuugccaccucccuuagcagccugaauagaggcaggcgcgucucagaucauggcagcuggugacugacggagccccugauucucugagcugaccauauaagcugacccuggauuuacuuaaaguuaauuuucaucaucaucagccucgcugucucaccagccccaccuaauucuaaauuuaccuaagguucuuuuuuuuuuucuuuuuuaaaagcuuuaggucuauauuuuggacagaagauggucuuuuagcuccugaucucauacuuaaauaaaaaugcucucauauucuccuugauauauuugccuauuggauuuguuuaaugaaauauggauuuauaccauaaauauuggagucguguaguccauauuucaauuaauggaucauuuauaugucaugcuaacuuuguaauuacugaaauguaggaauagaguggauugaaaugaauuucuguucaucuuuccauuccugcccccauccaggcaugucugagcagcuuggaucgcaaaagggcaagauuuacacaugggguuugcagaggaaagggguagggggcucggaaaggcggccuccucugcgugugccaggagagcucuauauugcagugugcuuucuggguucaccuaggcagcguuacacagcuguccucagaggagcggaaagcugggcucuggcuggagggcccggucaucaauaugcugacaggccuucaucaucauuuucaucucgguuguaaagcacagccuauuuucccucuuugccaaaucucugcuccaaauguacauaacuauagauuucugacugagcccugcugccaggaaucaaccagaaagcuucaccagaccucuaagacagaggacaaguaaauuguguucucggcucccgugaacggggccugucacuuuaacugguuucuucucaggcaguggguacagcccaggacacccuuagugaacuugccacugccccugguuuucuuucucucucuuuccugcucuuccucuccugccugcuguuugcugaccagaaaaaucuggcuggagaggcccaugcagugagugaacaucacauacauaauucuaucagaauauauccaaggguggggaaucauuguucucggaacuagcugagcugaagcccgagcagaaauacuaaagucagucgugccuuugagcugccucuaacagcgcccuuuagagacccauuucauacaaaauuugaagccuguguuuauugcccauuaaagcaaccuuuauuuuauggcaaauguugcaguaauugccuuuuacgaagagcacuuuguaacacacaugcacaguugaaagaaaaccacucugguauugucuaucgggacuuaauggcgcaauuaauuuuacuccaucuguuccugagacuuuaaaggaaaauggauuuuuuuuuugagcguacuuuaaugaagaagauaaagcggcccggcuggugucccacaggcucggcgcaguaaguucagauuauugcucagucugucagaaugggcugcuucccucagcagcagccacagccagcaacccgcucuggccccucgccgcgccauuccugaugacaaacugccagccagcucccacaaaagcacgauuaaaaugucagcacaggaugacgaaggggccaagaggguccucagagacaaacuguguucagugugaguuaauacuuuacagcagggcuggggcccggcuugcugcgggcuggccgggcugcuggcucgccuugaagagaacaccagggcaggggcuggcgacuggcggcggggaagcaugugcacaugcgugucugcacugcugugugcgugucgggcaugcugcucugugcgggaagaggcucguuucagaggaagcguccaaugggccguucagguuagggaguuccgagacucuccaugauuucugaaccgugggggacgggguggucgcaaccuagaaugugggcuggagagcgcugucccagugguggccccgaggccacagguucugucccagauguucucagcaccauuuuagcgacaagggcagcuaugaaaauggcccagcugcagaaagucauuccucacgaagaaaugggugugcagagaauacagucagcaccauuuauagccccauguccccaaccuuagccuuugcacgguuggcugggccacagcaaggggcucagcagcaaaauauccuugaaucaauacugcugcuugacagcaucuccagccccgcgcccgugugugcuaacuugcuagggggcagggcgcacucugccgcuuuggcuuaguucucccaugucccuugauucaguggugugaccagaggggagacugccuguggugaaaaggacaaggagauuugcaucucuggccuccuguggagacccgaucugccguccuggugggcagcaggugugagcgccugccauugucccuaaugguuauuacaagugauaagcaggacaaaugugaagucaucucuccugcuggcaggucagagggggcuggauuuagagccccuaggagacuaggaaauuagauggucaguacccaccguggagguuguagcaacuccaggcuccagagauccuggacaggggugauuccagauguagacucauacuugaaaggcaucaagagcauccauuguuaggacggagguacagcaguaauuagugcagagugcuaauagaggaacagaagguaggaaggaggccccagcgaaaggcagccgggggauucgguuuccucuagguccagaaccgugggcugagauuucacaaaggagaagugagggaagcccugcugguuucucauuaagccccuuggccuuugcucauucuucgugggcuccaauggaggguggacccuguggcuucuucacuuugcucucugaccucuucagccccuucucugcucucuucucugcuuguccuaggacugcugucugcaggcacagaugccccccguugagccacgcagguuucugugaaucugagguucuaacucccugcugccacucucuggcucccacgucuucccugccugacacuccccucccuuccauccaucacccuccucucuccuaagagugcucucugaaucuuauugccuuuuuaugucucucuuggguucuuccuccugcccucucccugagcaugguuuuccuuuuuuggagcaucccacagcucaugccauuaauggagucauaauagccacgguuggcuuuucccgagcaaacagacuucugugggcugcagaggacacagacccccacugguggcucgaaacaccccuccugcaggcaguucacaggcuggaccuuuaagguucccaccagccaggccacacauugguuccuccauauuuguacaaaaagaugugagccaggagcaguaggcaaagcccucuaccuuggggggaaaaaaaaaaguuggucuggaggauaauggaaauucgcauggggcgagggcucugagagcagcauccaugccccaugggguagagggcaagacagugacuguccgggggccuuuucagggucgcuuggugaaacacacccuauaugaauguguugggagaaccuaaagcagaagggagagacauagagcaaaaucagagcgaggguccccccaccucuucacucuggcucugggaagagacugcuggaggauucuccacagcacagcucacucacccauccauuugcucaccaaguacuuacuaagcuucucuccagguagcuaaagacacagaacaugggccaggugcaguggcucacgccuguaagcccagcacuuugggaagccgagguagguggugaagucaggaguucgagaccagccuggccaacauggugaaaccugucucuacuaaaaauacaaaaauuauccggguguggugguggucaucuguaaucccagcugcucgggaggcugaggcaggagaaucacuugaacccuggaggcggagguugcagugagcugagaucccaccacugcacucuagccugggccacagagcaagacuccgucucaaaaaaaaaaaaaaaaaaaggacagaacacauggaaugccugauccuugauugggccguaggucuagauuuuuuaaaagcuuguauauaggauauuugaggggacagcuggggaaauuugaaugugaaccgucuauuaaauaaugccucaauugaaauuucugggugugguaauguucuuacucuaggaaauaauacacuuuccuaaauuuuaagaugguuuaggaaaaagaaauacacaaagaaacacacauucacagauaaauguggagaaauguucaucauugucggaugcuggugaagggugauggcugugucaggauuauucuagguacuagauccauaucaucagcauugauucuggguacuagauguauaucaucagugcugauucuagguacuagauccauaucaucagugcugauucuagguacuagauccauaucaucagugcugauucuagguacgagaaacaucagugaacaaaaccagcaaaaggucccugcccuuguggugcucaccuucuaguggugagaagagacaaggagaauuaaugaguaaaaugggaucuguuggaaggggguugggagugcuggagugggaaggcgccauuugaaauaggaggacaggaggcaucucccugugaaaggggcgugugagccaagacuuaaagggaacaggaggcugugcgcugcagagcacuccaggcagagggagaagccagcacaaagaaccuggguauagugugccuggggcuuuuauccagaaugucgaguguccugugaauuccacuuuccagcgauccaccuuucaucccccauuugcuguucggcgggccuagccuuggaaaugaccuugcaugcuugaggacacccuuuggauuuaagcugcacgggcuggaccuguggcagcccucuagagugcaugcauucagagcuguuggccuggcuccgucaccuuugugauucgguacaucauucucuccacacacaagaucuuuccugccccagugucaagggcgauaaccacgaugaggagaaagcacgaggcuaggaauaagaccaugugcauauggacccacauccuccaucccaucugauucagcggggugaccucagccaaccacuuggcuuuucuuagccucagcguuccuccucuguaaaaugggaguaggugcaacuuccucccagaaagguuaagaagaugagaugaaagugagcaaaggcagauugugagcugcacauugcggaaacuguuagcucucuagacauucuuggucucugagcagcuuaguguugggggcugggguuagcagacaugguccuugguugcuggucuccugcugaguaaccggagccuugaagugagucacagagccuuauaccccuucaccaucuguaaagagggagucaccacuuagugacgucugcugugucauccaccucugagagugggauuccaagaaccagaguaccgagugccuuaugaauuccacucugcgaaaaaauuaauaguaccuuggggucuuucaugccacguuagagguuggcuucugcugcaggcuagccaggcauugcucgacagggcaucuuguuugagcuccucuucaugucugaaccacaaaggcacaagcccuuucaaggacaugacauucagaugugccucuccuguguguccucucaacuuugugacuuacccccuuggcugccagugaggccuucugaacauugugaaggcagagagggcuuuauagcaaucaggcuacucuuuggaaauugugcugccuuuuaguggagauagguuagcuccugcaaauccucgaggccauggugagcagccagccccuccccacagcccgucccaggccuugaagggcuucaucugaggacccgaaggccuggguuccuaagcucucccugagcaccauuugggcaagucauacacagagagggagaggaaacgaguuuuaggaguucuuagcuggguuguucccaucucuagguggccuggcagugggaaggagagaggugagaagagcauuguuuaucagguacugucagaggacuauuccuggaaaacacugcugaaucuucuagaaggggugauuuguguucuuuccauauuggcagguuuucauuucccugcuuaacaugacuaaggacugcaggaccugugcaugcuguuagguaacucuggccccaagauggacccuaggagagacuuugacacacaauugaugaugugccagguggauagaaguggaagugcagagcacccaggcacuuucagccaauuagucuggaaaugacauccaagaggcagagagguacuggcugugcugccuccauucguguguuugccucuggagcaaaaucaggcugggcugcucucuguagggaucaugccaaggauuuggcagcucucuggaagaaggagugauuuggccaaguagaugugggccucuuaugucuccggcaggucuucagacucaaauucuuaagagaccaaaugacaucuugccuaggcuaucaggcagcaccauugcagagaggcauggaugaagcugugucacgaggaguggcccgggcaaggugugagaugguggcuucacuuccuuucacaaacucuaaggcagcauguucuccagguguggucccucaccagcagcaucgccaccugggaacuaaaucagaaacucugggaguggggcccagagagcuguguugcagccaguccucuaggugauguuggugugcuuucagaaccacuacucuaagcaauaccuucauauugaccacuauuaagacagaucacuuccacugacagaguaguugcuuauggcagccauggcaagguggaaaccguagguaucaggagaccugcguucaagucccccucuuauggauacauuuugugggaccuuagaaaaaacacggaacuuuuuugagccaguuuauuaauuuauaaagugggaauaaucauacaucaucuccguggauuuugugaggauuaaguuaaauugauggccuacaaaaauacauuuuuuuuuuuuuuugagacagagucucacucugucucccaggcuggagugcaguugugugaucauagcuuacugcagccucaaacuccugggcucaagggauccucccaccucagccuccccaagaucugagacuacaggcaugcacuaccaugcccaaguaauuuuuuuuuuaagagaugggggucuugcuauguugcccaggcuagucuugaacucguggccucaagugauccucccaccuuagccuuccaaagugcugggauuauaggcgugagccaccacaccuguccagaaagugcuuuuuaacuuccaguauuuugcauguaagauggcauuguuauguuuaucgaacaccugccaguuuccaggcaaacgugauccuuauguguuaugucagguagguugucuuuuuauccccaauuuuacacaagauaaaacugaggcucaggcuuuaaacuugguagagcaggacauuuagccugguucagccugauuccauguuggccuuggaguuucacugggaguccauguucuuaaccauuaugcuuuuuaaaaguucucauccuggcuuaaccaucaucugugacacuuucaaaaauacugagauugaggccacugguuugauguggggcucggccacugaguuucuuuaaaaccuuccuggauguuuggaauauguagauaggguugaaaccauaguacguugcguauauaccaccacccuuccaucucagaacagaugcugcaaauccagaguuacauaaauucaaaguaagggacacagagcuuuagcaaaccaugggcagucaauaagugcuuauuagauuugugaauuaagaaguuuuaaaauagcauucacugcaauuuuaauaaaucagauaacagguguucauuuugggcaagucgaagaguccaggaaacuggaggaauauaauguuacccacaauuugagaaccccuuuuugugaggccucaggagguaggaagagguaggcguuguucuucccacauuagagcaagaaaagcagccccaggaaggcucagcgauuucccuaaguagggguauuuuggggguugguuuuuauagauggugggcaaggggauaauaguguaaauuuuguacuuugagcuuuuggguaaauaggcagauucugaaaccauuguguuguaucuacugauuacuauaaaggcacagauccaggcucuuuguuaacucccuggcagacugagugcuuccaagugcaauuucccuccccuccuuucuuuagaaauuaccucgagcugcaaagugaguugggcucagguuggcaugcaggcauuuuccauuccaagggacaggaaguggcugugaaucuuguaaccuguauuccuucuuugagagucuauagaguuggaaauaaagacacagaagucuccugagugcccuggcagugcuucccuggaugaaggguuuggggagaacuucuagagagccagacuuucauuaccgaaacuccccaucuuucuccccaaacccaaaguagcagugagaccugcugaucaccuucauguaaaagaauaguaauaauccccccgaauccuguccaaaccacagaacccugcagguuuuggacgagucccgccauaaaaccacuuucccaugacuucccgaacaguaaaccccagcuuggguaccagggaauggcgcuuucaguuuuuaauggacugcagcugaagcaaguucaaaagugcgaggauuguaaacuugagagcaacucugcagaugccgcacaccguggcagaaugauucagggggccaaacuuugccucaucaagucagagaauuuucugcaaaugaacuuuucaagaauuaugccgucguuggcauuacaguauuacacacaugccuguucccgaucacucacuggaacuuauuuuguaguuaaccuccauaaaggacugugcgagcgagcacaggccugucacacacacauuauuuagaagcccuuauuauuauuuuauugccaguccuugacagcugaggaaaagccaagcgcuuuaaucuuuuuuucccuuuaguuuacaguguaagagcugcauguaagauggauuugauuaauauguaacagagaugcaauucucuguaaaaugugcuguacuuuagcacccuggaaaacaaacugcaucacaauggcuuaaaucucgguccauuguauuauauagacaucauaaauaauagagagcaggcagauauugcugcaggcuucaucugcauaacacaucugagcucucuauaauguguucaacuugucacuuuuaguacagaagagagguaauaaagcuaacagcugacuaacacacaucagcccuacuucuacuuccaggggggugaaugcucauuaagccaucuuagcccugacuuuuaaaauccauaacucuuacaaauguaaaaaaguugccgcaaaagauuaagcgcauaauauaugucaaaguauaauguuuuaugcaucucccccaacuaccacuccccgcugccgccgccaccaccacaccaaaagucugguuucuuuuauagccuucucacuagacgaaagaaaauaaaaaaucugguucucagauaaaaccaaaugaaauauuauuuucccagcaucacuaagggacuagguaauugcuuuugaguuugaagcacaugagcugaccccaagaagguugaagauugaaaccuuucccccucuccucuaagaccagcucaaaggaaacagggagcuugggcccaggaguuugagaccagccugggcaacauaggaacacccuaucuuuacccaccaauaaauaagccaggcagguguguggugcgugccuguggucucagcuacuggggggguggugaggcaggaggauugcuuaaccugggagguugaggcugcagugagcuaugauuacaccaccgcacuccagccugggugauagagcgagacccugucucaaaaaaaaaaaaaaaaaaaauagggaaucagucauccccacugggaccuugcagacaggccacuagaucagucuuagcugccuuaagcacgcccuuacauuuacuugccucaguuucccuauuggaaaccagaagggaguaaaccccuccauuuucuuucugaggggacuauaaggccgaguucagcacugcuugucauuuacuugccucaguuucccuaucagaagucagaagagaggaaaccccuccauucccucucugagaggacuacaaggcugaguucagcacugcuugugcaaucacaguugacagagguuucagagucucuguugugcucuucugauuagcagucuuguguuuuagaggaaaauuugaaaacauuacgguaugucauuuucuguaaugauggcugagccuuuuuagggauuaaggcugucaggcagaaaagagaaaaggauguuuauacucuuaacucagagcagauuuaauccuaugggaugcauuuuggugggcuaggggagcauuguggucucuuucucggggaggcugugauguauacaguacacggaugugcaugucucaugacauucaucucuuucgaaaauauacuuuagaacauuucucuuggagcuccuaagaaaaauaaaugguuggugguggcccggaugguaggaagacagguuaggaugaaacaggaaauuuuucuuaguaguuauaaaucucucaaggggaaaaguuagagccccaacacuugacucauuuagaacaaguugaaccaaccucugaaaaauaaacucacagggggaaaaaaaaaaaaaaaaaaaaaccauaaaaaauccugcaugaggucaggggacuggcaugcuaggcuaauagaaacuggaagucagcgcagacaucccaggaugcacuagaauaacauacuguuuacuucugugauuagcucagaacuaaugguguguguguguguguguguguaaguguguaagagaccaacugagacacaggggcuuucauugauaccaguggugcuugugggcggggauugaaagacggcuugguucccuuggcuaggagugugggccuagaacaguaacacacuuuuccacuggucacaaugacaguuuguuuuuggagaaagccaucauuaaacugugaugugggccguagcacugcuaccucagaauucuguugcuguccaccaggcaggcccugaaagcucagcuuuccguugcuagagcccacgccgucaucccuucuugcccauauuccugcagcagcuuccagucucaucucccagccucccgggcuucugaucucccccguuccacauggcagccaguguggccacaucauuucucaccucccaggccugccauucaaagucauccacaguugcuucuuuuucucucucauuggucuaaucccucacccagcuuccagccacacuaguccacccggcuccagccaugcugguccauuagauguuucuaguuaugcucaguacuuucccaucugcauucaagcuguuccucuggcucagaacacucuuuaucuuuguaaauugaaguccuauucccaucuuugaagagucaccaugaacccuacccuucaggaagacucacuagaccccuacuugaaauaggucuuucgccaggcgcgguggcucaugccuguaaucccagcacuuugggaggccaaggcaggcggaucacaaggucaggagaucaagaccauccuggcuaacacggugaaaccccaucucuacuaaaaauacaaaaaaaaaauagccgggcauggcggucagcaccuguagucccagcuacucgggagacugaggcaggagaauggcgugaacccgggaggcagagcuugcagugagcggagaucgcaccacugcacuccagccugggcaacagagcgagacuccaucucaaaaaaaagaaaaaagaaauaggucuuucauaaaucugugagcucaccaguuaacuaaguuaacuaagguaaucagguuccuuaguucagaacacacugucauccuggauccaugggaggccgcccuuaguuuuccccacuauccuggccugcuccccaauucucagacacccagccucaugugccugauauguaaccuugucaaguagauaguguucuucuguguggguguuuuguuuacauaagugaugauaugcuauaaaucuuaguucuguuucuugucacuccacauaacauuuuuagaaucuggccuugcuggugguugcacauguguuuguugcuucucaauaauaccgaauauucuauagugcacauuccccuaguaucagauagcuaagguugcccucaacuucucccaugaaauuagcaccacaaucaagcacacacugucaccauaaccauccuuguaaugugucuauuuauggaauucugcaaucuaccugcggugcauguaaguucuaauuuccagauguccuugcccacacuugcuguuauucaccuuucuagcuuuugccaucuugauaguauaaaguauuauaaggaguugaccauuuuucugaguuucugauuucuuguugauuugcauuuuugguauaauuuaacuaugggucauuggcuauuauuuuggacacucaaguaucuucuucaaaucuguugcccauuagcuaacuguagugaccuugauguuaagagaucuuuacuuuugcuauagugaaacaaauacauauuuuggccucacuuaauguucugggaguaucugguuuaauaagucuuuuucuauccuucgugcacagauaucauuucacguguucuuuuauuagcuucauaguuuuauuuuucacuuuuaggucuuuguuucaccccauaauacuuuguaccauuuccuagaguuugccuugaauuuauuuccaauuguguccucaaccagguguaaagucuuagaagaacuauguugcauucuccauccaagccucagcuuugccgagccuuaaccugacugaccuacuucccuguguccauacugaugacauuccuucccuacauucucaguggaagacauaucacuccucuugucucaggucaacuuuuugugcaucugaguaucuccuuccauuccauccuccucagugacuucucuucugucuucuaagcucucucgcugucagcacauaaacaugcgugucaacuccccuucucgugcaucuuccucuggcuccuugucucuugaccccauucacuugucauuccuucacagcaacuggcuuugccucugcccguugauggcacugacccauccucauagaagcuucagucauuuccacuugccaggugaaggagucccugcauucaucaggcccacccugaagggcaugugaaauguuacgaccacccuucuugauuuuugauuuuuuaaauguuuuugguuuugugauauucccgucuccucaucuucauuuugucucucuaacaauucucagaucauuuucagugauuccucagccuccacagauuccaagauuauguccacucugauggcucucgccacuuuugcaugacaaugauacuggacuaugucuccaucccaggucuugcccuuagcuucggacccauauuuuccauagccaacaagauggccaggugucuuguggacacggaacauuaaaaaugugccuaaucuaggccaggcgugguggcucacgcccguaaucccagcacucugggaggccgaggugggcagaucaugaagucaagagaucgagaccauccuggccaacagggugaaaccccgucucuacuaaaaauacaaaaauuagcugggcaugguggugcgugccuguaaucccagcuacccaggaggcugcaggaggagaaucgcuugaaccuaggaggcugagguugcagugagcugggauuacgccacugcacuccagucuggcaacagagcgagacuccgucuaaaaaaaauaaaauaaaguaaaagugugacaaaccuaaguuaucuuuccucaaccucuguguccucugcugauuuucugauuuuuaaguggauccuaagacaggucucugggaauuuuucuagacugccuuuuaaaucaaagaaacaaacuuuauuaucauguacuaauugaauguaucaucucugaucucucucuuuccccaacccuguccaaaccuguuccuguauucccauacccacaauucagccaguuaccaaagccccacaucagcaagucuccccagacucuuccuuugcugagugcuauguauuuuaccucucaaaagacuggcucaguccaucccucccuuuccaccaagacagccucugcuaugacguccuggcucgccccaccuaccauaucugugcugcaguagaccugggguacggccugagaauuugcuuuccugaccaguuccuuggugaugcugaggcugcuggucuagacgacacuuugggaacuacugcuuccguugauuuuucccauccaucaauuggcucauucaacaaguaguuauugaguaccagugucaaguucuggaauucaacaaugaagaaaacaaggucaucuauugaaaagguuguggagggaacaaacaaagaauaaauucaucuauaaugugauguguaagugauacaugcuaacaaugguuagcauuuauaaaugguugaagggacggaggaguggugauggagagggagucgucagggaagacuugcuauuuaggaaaauuuugagcagauaccuagagggaagagcauuccaaacagagggaacugcacguucuugugcuuuaaccauccuaaaacacagucccgacucuaucacuucccucgcggggucaacagcagccacguuugacugccauucugcgcucuccacgaacugucucccacacccuuuuccacacaucgucucgcacccagacugaccugacuucucccaggucucucugcugacauuucacuugccuccccuggggcacuuauuugugcuauucacccccaccccuccuaccuuccagcaaaugcccuucuuguguguuugccucaugccagauccuguaauucauucaacguuugcuuccauuuccaccuccuccaugaagccuuccagaaucauccccuuugaaagugcccucuuccuccucauuccagaaacauuuauccccagaagugcugcauaacccuuguggcaucucacccuuguauauuccucaccuggcccaacucuguaguccagcaaaugcguaguagaccuugggugaaggauggcccagaaguguuucuccugcuccuugaccucuccaagaggcgggccucugguauuuccuaaacgcugguggcuuuacuguugaaucagagcaaaaggagaaaggaaaggccauggccuaaaauggaguauuggaaugaucucuggguuucucuguuuaucccagcuuucuuucugugcuauuaccaagauaauugaguuggaaauacuaguagcauuuccuucaucuuccuucaggcucacaagcguucuucacccaaagggagggagauuaauugacuucuuuuaucuuccauucaaaugaggcuuucaugugaaucgcucccacccucccgcccccucagcccucccaaccuccccucauucauuaggagcuggacaugaaaaggagagcaucuaaaacucugcagagucccuggaucuccccagaccccucucuucccucauuccccgccaaacauuucugaccuggcaucacaacaguucacgugagaagugucacgguggggcagagcagauccaaccggaagcugcaccagccacugaacucucuccacaccaccagauggucuggugcugcagcagccuuucagaauuaauaacucucccuccagaggggcagcuucauucaggaaccguuucacauuuuccagcuaagugugguuuuuucccauagaguuuucuggccgcucuguucugggcagaccauggggccugcucacgaaggcaagagauguaucuugccuucccuccaccuuucuuugccuuuggcuucugacagcgcagcuuuuaaucuggaaauuaugguaacuuguaugugcauuuugagaguauaucauugcugcauuuaauuaacgguuauuaguguuagcguacugugcuguauucuaugucacaaaucaucaagucucccagagcaguuacagcaauuaagaacuccaucacaccuucuguauagucauuugguacuuuuccaggucuuuucaaaacuggaaauuacuaaucaaaucauuucugcugugugccucaguaucguuuauuccauuccuaaugaugugcgacuuuuuuuucuuuggccguuaacagaggcauccgugcgucuaacccauuucacaccaccgucaugcuuuagcgaggcgauaaugaacuugcagaaggaaaugcaggcuuugguucucuuuucagagcagugucuuuccucuccugcuguugggugauugaauuuugaaacuguaaaaugcaucgacagaccuacaaaccugacuugccagagccacagccaucacaguugagcuucaauucagagcucagugcgacuccugccugaucaauuugucaucccucuaaauggaaacuaauuacuucccagggaaagauugcaggcaaauaucagccuuugcaucagcagcccucugcagugagguuaaggcagaguccaugggguuucaccagaggggccauuucccucucugccuccgucaugucaggaagaauuuuuauuauuuagagcagcagugagcuugccgucacauccacuaaggucagccgucaagcgugcaucucacuuaauaggucaccuggacggucccaagucaaaugucagaggccauucaacugccagguugcaacaaaaacacccuggcaggcuuuugaugguguuuagauggggaugagccagcccgcuggaggggagcccaccgccucuggccccccaaggggauucucuuuuucuuuaugcccaagaacacugcccuggaagcauccccggaaugacugaaucauugccauuugugcggcaucgaacagacugugccgcugacagcuguaggcaagauugacuccgaugcagugccaggagaucuaggccaugcaaggcggcugcucaaggcccgcucuagugcgagggcccuggcucagggcagcagggcuggcccagaagcuggggccaggaccgggccagccagcucagaggcuguugaacaaucugaucagaggagggccuugccaguucccuaccuuugcccauuuuggaugcuguucugcucuggccuugcugcucaucauuccaggcuggcugagcaguuucaaacucagggcugauccugccaccucugugucugggcugagcugcaaggucuuuagcccagcauugcucagucuuggacauucucccagcagaagucagacaagacccaggagagaaguuuguuuuguucagcagcugauuggauccgcucacuguugacuuguguuccauguuggagaaugcguucuggucccccugagcugauauaaaggagcccaaacucaaaucugugcccauuccacguuuccccucuacuccaggauggagaguuuuuccucucauucuuauccacacagcgaaaaacacuagacacagugagaaacgcuggacggcucugggggccgugggagcugggaugagcacugaacuucucuaggccucagcccacuucgcucugcaagcccugaaugugccuggacaagaugaccgguaaaggccauuccagcucucugugcuuuguagccugagucccugugaggagugguuugcuuugaaacacaauauaauccagaaaaaacagcuaucuuaacuuggccagcucugcuuuuaagcaagaaauaaagugaugguuucuugaaaaugaugcuggccuuuauaaugccuucucccuuaaucuccccacaaacugagacaaggcauccugggucacacccuggcucgucuccugugugauguguuuucugggacuugcacuuugguaaccagaggagacugccaacuggguaucauaccugucucucaaccccucuucugcccaccacccucucucagccucccuauucccugaagcuagcaugccagggaggcagguggcauacgugguacaaggacugcaugcgcacauuuuggaaugaaacaguggccuuucuuuggaacucagaccauccagugugcucuggcuaaagacaggauuguagaucuaagaaguccauuguacugauuaguuucaucucaguuuaagccacugaccuaccaagaguauccauucaggaaaugucaccccauggccugauguagugguaggagacuggaaauagcugagugaugacggcauguacacucagcauugcuuagccuugggcagguaccgaaccuuucuuugccucgguuucucauuuauaacaugggaauaaugauaguacuuaccucuucaggguucuggugaggguuccaugaacuaaaacacaugaagagucuagaauuguuccugugcuguccuaggcccaggaugaaugugagcugcugugguuacagcuagugucauaguacuccgccccccuccaccaccagacuaccacaguuuccugcauucugugaugccgucagcucacugagucaccuucaccaacaccuuucacgccucuggacuucagcuuucucaucugcagcacgagggagaggaaugggcugaggcuugccauggugcuuucagggacaggcgugggagcaucuguggugaguuugcaguucuguguuguauaugucugcaccaaugagaguuucaugaucuugaauuuauacauucauaucaugaagcacaaccuaguagcauguuuagauguagaaacacgauauaaaaacaaaacagaauuuguuuugguuuuugguuuuuuguuuuguuucguuuuguuuuuugagacagucucacuuugucacccaggcuggagugcaguggcguaaucuuggcucacugcgaccuccgccucccccuuucaagcaauucuccugucucagccucccaaguagcugggauugcaggcaugcacuaccacgcucagcuaauuuuuuuuuaaauuuuugguagagacagggcuucaccauguuggccaagcuggucucgaacuccuuaccucaaaugaucugccugccuuggccuccuaaaaugcugagauuacagauaugagccaccgcgcccagcccuggaaggaaccuuuguuaagaguucauaguaacagggugcuaaaaugaguuuauuaaaauaaucccaguagaugaaagauuaggagaucucuuuugaggaaauuagagaguuuagaucuguuuugaaauuagggaaugccuuuuccuauugaccuaagucucugauuauauaugucaaccucagcuuacggaaagaagcugacaugucaaaauaagaagaauaggcuggauaugguggcucaugccuguaaucccagcacuuuggaggcugaggcagguggauugcuuuagcucagaaguuugagaccuuuagauuagaaguuugagaccuuuagauuagaaguuugagaccagccugggcaacaucacgaaaccccauggagcaugucuguggucucagcuacuuggguguuugagguggaaggauuacuggaccgcaggagguggagguggcaaugagccaagaucaugccccugcacucuggccuggcagagugagacccugucucaaaaaaaauaaaaaaguaagaugaauaaacaaugguuaauagaaacauaaguggugggacaugggggucaggauuuaaucucagagugucccaguggugauuuauuuuauuuauuuauuuauuuauuuauuuauuuauuuauuuauuuuuugagacggagucucgcacugucacccgggcuggagugcaguagugcgaucuuggcuugcugcagccucugccuccuggguucaaacgauuuucuugccucagccucccaagcagccaggauuacaggugcccaccaccaugcccagcuaauuuuuuguauuuuuaguagagaugggccuucaccauguuggccaggcuggucuugaauucuggaccucgugauucacccgccucgguguccaaagugcugggauuauaggcgugagccaccgcacccggccccaguggugauuuuguaggucagcagagaugaucugugugccacauuuccuuguagcuuaacaaugggccucaaucauguggugcuuggguucuuagaauguggacagccaagacauuccagccacaaguaacagaacaaaauggcuucaaccauggcaggggggcgggugugaguaguguuucuaaaugggacugguuaaguauuuuggggcacggauuggcuucucugccauucucuuagcuuucuccucaugauuucaagauggccgccauaguuaucagacacuauuuccucaggaagccacacucacagacaggaaggaaagguguucuuccucacguaccucuuuuuaucaggaggaaauucuuuucuagagaccccauagcaaacuuccccucagguuucacuggccagaacuggguuacauaccgucuccuaaaacagucaccguccaagaauaaugggauugccaaggguggccugagccuccuguaacaggggaagaccaccugcccacagcauggcgccaugcaguaccugaacaaaaccuggguucagugaacuugagggcucuugccugggcaaccaacagggucugucugggaccuuaaagucacugauucugacuuagcacuuaggaaucaggcaugugguuuaaucucucugaaugucaaagaaugugagcuggucaagagcagaucuagaacuagaaucucuuuucucuuacugugacucucauccccacucagcuuucuuccuggaauuauuuuuacuuucaaaugugugaagucagacauacaacaauugugcauuucacuugaaacuaguaucucguugauugcuaccaagaauguuguuuaaaauugagaaguacauacauuuaccucuacauaucuccagugaacuucugugaccauuaacugucaauuuuaucagauucauuuuacacgcaaagcaaacacaucuacacccuugucucaagaaguuuccaggcuagaugaaaaaacuguuccuguacccaugacaguuagacauaaauuaauagugccaacuaauugauugaugaccagaguucaaaucaggggaagaaaggaucacguugagggcauggcugaggcccaagagaaugauuucaauggacagagaggaaggaggaggaaguccgaaugggaugaagauaauguugauaguaaugaucaacauuacaguuaugagcacuugcugauaugaguaaugaucaacuacaguuauugagcacuugcuguuugagauaaaguucuaagcacuuuacaugucuuaacuuauuucauccucacaaaagcuauuaugagaugggauuauugucuucucauuauuuccgcuauauagauaaggaucaugacauacaaagaaguuaaauaagguacccagugcccuagaguuaguaaaugguaaagcuggacccagguaauguggcuucauagccugcccccucucuggugcucagccucauuuacuguagcaaacucacgaaacugggaaacccaggguuuugugaggcgacuucuguacagguguuccuuaacuuacauugggguuacaucccgauaaacccuucauacguggaaaauauuuuaagucaaaaaugcauuuaauacacuuaaccuacugagcauuguagcuuagcccagccccccuuaaacacgcucaaaacacuuacauuagccuaccaucgggcagaaucaacuaacauaagccuguuucauaauaaaguguugaggaucucauguaauuuauugaauacuguacugaaagugaaaaacaagaugguuguauggguaccugaagugcaguuucuacugagugcauauugcuuucauaccagcauaaagucgaaaaaucguaagcugagccaucggaaguuagggaccaucuguauguugauuuagcugaagggaggauuuauaggcaaaauagugagauaaaagguagggaaaguuuucacugaauucagaaguauuuggaacuggggcuggucaucuggaucccagaaaacacuggcaaacacacgcacagaaaugcacagaaaaagaauaccccaacauugaacaccaaaggcccucagacuuuggcgccuccauuuugaaggugagggauguuucuaugugucuguaagcagugaagacaucaccggauuaugaucacaucauacauugcacacgccgucacgguugcacguugcucuaaucccauguauauuacugugucuauuuggaaagcugcaagagccauuuauuuaugagugacuaagugguaguugacugccuucaacuccucauguuuuacaaaguaggaauccacagagaauagcaguaaccaauacaccaaaccaccuucauuuugagaugaauacugagaagucuuucauuacucugcaguauaaaguguuuacuaaacagaauuaagccacagcauaauacccugccuuccuucuucucuauuugauucguccuacuuaacaccagcaaaaguacuucugccauuuuuuuuuuaggguuagacaauuuaugccauuuaaaguguaaaaauggaauuuacuuggcaguuagagggaaaagaauugacauuaucuagacacaaggaguucauggguauaaagucucagaucaucauuucugcuaaagaucaaguaccuaaguaaauguaaaagacuacacugagagagacauccccaguuggaaaaugugccaagucauagaaaauugugguagcccugaauuuucaagaaugguuuuggccagaugugguggcgugcgccuguagucucagcuacucgagaggcugaggcaggaggaucauuugaacccaggaguuugaguucagccugggcaacauagcaagacccugugucuuacuuuuuuaaaaaaagaaugguuuuauugguguauuuugauuauuguaaacuaauuguagacucuaauuuacucuuggauauugagaucuguuuugacucuuggcaauggugguguuuuuuggugauugguugauguuuuaucuggccugauauccagauucuuuuuuguaauguacauacucuuuccugauaucguuuauaugacaauccuccccuccccuuauuuaaauagagguuuaaaaguuuaacaagcccaggugugguggcucaugccuauaaucccagcacuuugggaggucaagagaggaggaucacuugagcccaggaauucaagaccagccugggcaacauaggaagacucuaucucuacaaaaaaauaaaaaaucaaccaggcauggugguacacaccugcaguccuaccuacucaggaggcugagacaggaggauugcuuucgaggcugcaugagcuaugaucaugccacugcacuccagcuugggcaauagagugagaccuugucucaaaaaaaaauuaauaacccuaucucucauacuuuuauauuuucucuuuggaaaccuaacccucaauauauuucaaaugccuuguaaauggcuuuugaagaaugcuucacacuggauaccuggguucuaauccuaauucuaauacuuaacugugaacacggaugaaguaugucagucucugugauccuuacgcccuagacuucccuuccccaagugguuugccaccauuaccaauuaaaauccuauaccucucugagauccaguucaaaugcuacuucuugaagcucuuuuugauacugcuuucucacuuuccucaagaggccauuauguccuguccuuuugaagggcauguuucucaaaagccaagguuguaccuuuaguuucuugagagccaagguugcaucuuuaguaucuucagucaucuuugcaccccagaauguuuagcacagagcuugcccaugauggcuacucaaaugcugaaaggaugaaugacuaaauaaaucuugagaucaguuguauuuuuuucuuuaaaauaacuggcuacagucacuggcucucaacccugguguugggcucauggggacauuguaaucaguuguaagcggguugaagugauuuguuaugaaugauuguuagguuuuggaaguuugcaaacuauguacuguuuguauaaauuagaauguuucccuucaguaauauucuuuaaugauaauaucaucauccugcaguguuaauacuucagugugacacucucccuugcauugugauuugucuuaaauggaagaaaaaaggauggacuuagagucaggacccaggaaauuguauguuaauccacagccuaucuuuucugugccaaagcccauaauaagccagaaaucacugcuaaugguuauggaacuauggaaauaugauaguccucuacuacuguacgagaugugggggccuugucaaaaugaacauuaucugucaauuuagagaaaagaauaaccauuacucuaaaccaggggucagcaaacuuuuacaguaaaggucuagauaguaaauauuugagggcuuuugagggccauacagucucuguagcaacuacccaacuucgcuauuguaaugcaaaaaagcuauuguaauacauaaauggauggacaucacuauguuccaauaaaacuuuauuuacaaaaauaagacggaggucacauugggcuuaaugagcugcucuaagccauagaguacaugggaauguaaaccauacugcuuauuuuuuuuaauuguauuaauggcauuuauucuacuuccuuuguaauagcuaaggaguuccugcaaagaaagaaaaauuagggguuaguaaauuuguuacuuauuugcaagaauauucaguauauauuucaggguuaauauucucuagacuuucucagcauaagaaaugagaugaaauucuguugauguuguaaauaccacuauugaggcuaauucgugaaagaaaggugacuacgguauuugaugaaguaccuugucuuccaagaaguuugcuuuugugguauuaucuguggcacguuauuuucugucuugguacuuucucucagugggauauuuaggcucuacuuuccugcuuggcacuuuuguuaauaaugacuuuaaaaauccucacuucucuuuuuaaauugcugcauggaguaauagccucucuccuugacagucaaaaggccaagaagugcaacuaugugaaauaaacuuuuaaaacaaggccccaagugcacugcaaguugacuugaaauaauuagucccuggaguuuggacacccacaaaguaucuuucggaacucggauucagaaaugucucagugacagccuguggcgggaagccaucacagcagcagggcccauugcucuugggacaucccacacuguagaguuacuuuggcagugccuggaagcagcggccccugcccacauggcuuuuccacugucucacagccaagaaccaugacaggccccucagaacuugggcccucuccaguccuugagccaguguucacccucacaggaagaguguuucccuguuuuaucagcaaguaacagaaaacccagaugacugcagcuuacaaaguaaagacauuucucucccauuacaagaagcguggagaaagcauguuguagaggcucaguguugucacagaggaccuaggacccuuccaccuuccuaugcugccaucucaguguugggggaugacuucccucauggaugcaagaagguuacugaaacgccaaguauaaugucacuaccucauguggcaccgugcuuuacgguaagggggugagcauaaacagaggggauuccaagugcuguucuguuugagcaggggacauuuuucccagaagccccuggugguuuucuucuugggaccugcuugcuugaacagcaucaccugccucuggcauaggggaaagagauugccguuauuggcuuagaccaaucacuaccuucccuggcacuggacacaugccacaucaggguucuacuggaagacaagagaaagggauggcuacugggggagcagccaacccaggucugccacacccagcugaacccccuagacaguggucagagcaccuuuugcuuugaccgaggaaucccaagccuugccaagaaucuauggccaguccucugggauuauugccagcaguuuuuucuguuuguugaucaucugcagacaccugauucccugucagugcuuuuucuguuugacaggacuucuugaugcccaccaggaucgagcuugccgagucuuuuggauguuguguguuauccacccagccaagucuuuuuggggaauauuuauggaaauauuuauauauaaauaaauaauauuuauauuuccagaggugcucuguaccucugucuaucccuuuugggggauagguaagccacuuuggggcccucaaucccuuaacaaaaauaauuucauuuuucuuaguaaaaucauauaaugucugcauuuuuccuuugcaguacagaaauacaugauugguauuuuuuaauagauuacuuuucuggaacagauauuauuuugaaaauuuaaaauaaauuugaagaguucucuucuaccagucuuaauuucauggaauaguuuaaauauuauuuaauuccauggucuaaacuauuggcucuuauugucuuuuuuuuuaauauuauguauauaaaauuaggaacucauuuaagaacagcaagaauugauuuaaucugugagaugccaaauggagcuaauccugaaauacuuucuaucuguagagauugauaguuuacaaagcacuuucauacauauuauuucaguacuuuccauaacuauuaucugcauuugacggaugaagaaauaaggguauaagagcugaggugacuuggccaggauccuaccagccuucacagaguuggcacuggagccugggccuucacagccugccucugagacacuguccuguuucuagcacuuaaguuccagugucuauggcagcaugcaauaggauuacaggaggacaucguagccacagauaacccggccauguuaccuguucauuucaaccucugcgacuaggcccagauuucucaggacauuuccuuccccaugagcugaauuuuaacaugcaaaugucacucacauccuacaagcuaagguguauggguuuaugcugggacuaggucauaucuguauuuuaaaaaucccagaacaaccccagcagugguuuuagagaugaggaagagaggagacagaacaaguucugcugguuacccugcucuuggacuucucaggugcuucauuaauaucaucucugauggcauuuugaugccauuuuucugauggcauuuugcagcuugccucaagugucccuucugguuuucuaauguaggacaaagcccaaggaugaguggcugcgguugccagucagcauucucugcagaugucuuugguguguguagcugggguuaacccgccgucuuaaugucugccuacucgguuuugcaugcaaggauacauuauacaagaaaauuccaucgagaucauguacaaguaaaaucagcuuauuuuuuccgaagaggcaggggagcuacuucuuagcagagugagcuguagagucucucuggaaugcaaaacacagaccuuuguauuagaagugaaauauuuagauagggaucauuauggagcucuuuuuauagcaaggcaggccugaaaaacagagagagagcugggaaaggaagcacaaaggagguaauaauaucugauuagcuaagcagcuggauaacugaaggagaauuuguuaaaaaccuaucaagacaucaaagcuagaugugaguugcucuguuagcccaggccacuuguggagccaucucuggaauauuacugagcaucuaauuugcugcuauuuuuuccccuagcgucacuccuucacuaagggaucugagcuguaaccugaccuguagcugucaucagggcuuuuuuuccaucccugucauggcaugggaucccaguauggagaagcuuaguugguauucaagucauccgcaucguacuugaccacgugugaacaaguaaccucauguuucuggggacaggcagggagaaacuugagaacuugauccccuugggggcccuuggaggauugcuuccaccaagcccuggguuuugcaagugacucguuucccaaucuauggcacauccaagccucuuugguuuucuuuuucccuguucacacggauauauuugaggcaccauacucuaucugcccaagaaaggaagaggggcaaggaaaaccguguaagucaugcuuguuuaaauauuuuggcuucugccaaagcagauaugagaacaauuggacuauaaugagaguuuuccauuggccucaacuauccuggacaguugaacgccaagccuaguuugauagguaccuacuauggaccugguggagcuccuucuuaaaauuagacaguguguacuggccagaaugucucagcuugcagccugaggaugauuaugcugauccuggaggcccuggggaacugucuagggcacuaggggugccugugcuaacagcaaaagaccacucccccccaacaccacacuugcacaugccucaugcacagaggaaguaggugccaggucuuuucagagaagagcuucaaagcccugcugccaccuacgagagccuuugauccaucucucggcugaauccagccccucacggggcugauccgcuuugaaaccagagccagcagccccucuacaacucccucugaguuaccucacacagacaagagcacaggcuucuggggggcuucuuuuuaucuucccuaaauugcgagagguacuucuuucagcguuguccuauaggauucuuaagaacugccggggagaugucuuagggccaacacaaagaauugcaaacaacagcccagugucuuggaaacuuucucuacaguuuaguacggauaaaccacaugcagauagaaaauaggaagaaaaggaaauucaugguaagccugcguauuuucuuauuucgggugcgaggggaguggagaaauccgucauggauaaaauccaacuuuaaugacagucugaagcccugaagcacagacauauugcagagcuaauguauuauuuuguuuuuguuuauucugcagaaauggggaaauuucauuuuuuaguagaauuacaagcuccccuuuuacuauucacaagcccuaacaugcauggcauccugagccagagagccuuccgugauuuuaauaccagcuucuuugugaaucuaaacugguuuuccaguccacucccuggcgggccacggggguuguuggagugguguuacacauacuuagcuuucuuugggugcuugaccaccgccuguucucaggggggacaaggagccuugcugugggcauuaccagugggagguaggcauggacagugagguucggcaccugaccucugaauucccgcggcccuugcaggauaucacgcccacgacuggcgguccucagccugaacugcgcguuggaaucaccugggaagcuuuaaacauacuaaaccugggcccugcuaaaugacacccguauucugauauaaugggucuggguguggccuggauauuaagauuucugacuuuccccucccaccuaggugauuccaugugcgguccgggcugagagccacugucccgcagccucaucauacagcuugccuagguuccacggcugugucacuuccuggccaugugaccccgggcauguuaacugagcucagcuuccuuguuuguaacauaggggaaucacugcaagauucauuacaccuaucuccuagagauuauugcagggguucaaguuauggacauuacugggaggauaccauggaccagacacuguugugggaccuggaacuguuauggcugggaaaaaaagagaucagagucccugccuuuguggcgcuucuuuauuuucuagucauggauaugguggauaaacaaacaaacuugcauauacauaguguaaugucaaaucgugggcaguacugugaagggaaaauauggccaaggggaaggguggcaaguggcaggagagagugcaugcacauaaagggcacaugcagucccgggcugucagaaaugcaggcaacuggcugggcaugguggcucaugccuguaaucucagcacuuuugggaggccaaggcagguggaucauuugaggucuggaguucaagaccagccuggccaacauggugaaaccccaucucuacuaaaaauacaaaaauuagccaggcauggugaugcaugccuguagucccagcuacucuggaggcugaggcaggagaaucacuugaaaccaggaggcagagguugcagugagccaagacugcaccacuguacuccagccugagcaagagagugagacucugucucaaaaaaaaaaagaaaagaaaaaaaggaaagaaagaaagaaaugcaggcaacugugcauggcauccuuggcagggucuacaguguugcaguuccuaccacuucacccugggucaaugagaucucagugugaugucuuucucuaaacagauuauagacacucccucaagacagaccucagacucugugcaagcccagggcccggucgccaucugugugaugaauccaggcaccuagcuccgugcacagcuucucaaagugagcguagauuuggagagaagaagggauaaucagauguuucauuuacccagguacaacagauacguauugaaggccugcagauggcaagaccugguucaagcacaauggggcagaauaugaggaaggcccaccccuuccuuugucucuucccccacagccacuacaguuccuuccaccagugucaaccaccaccguggcagagcauuucccgugagacaggccgcaggcuacauacauuaugugcauccugucgucauguccucaccaggggaaguagcuguugguuuauucaaccccauuuuacaugggaaggcucuggggcuuugucaugcuaucguuuguucaugucaccccaggccacacagcagcuaaguuggaaaguguuugcuguuagccugcauuguuguccuuccaugagggaccuaacgugcauacuaaaggccuacuaugugccagagccuggcauuucaccauuaagucacugaauccccauaacacugugcagauggaaccuucucagcuuuccugaccaucccuuaucuugggcuagcccucaugacacaugucacacccugcaauuaccuucuuuauucauuuguugacuuuuauuugucuuucuccccuacuagaacaucagcacagacaguggacuguuaucauucacuccagagccggcauuugaauggagauuagcuggcauucuagaugccgccuaauuaccugacaggagaaagaagaccaggacagaagcagcugaaauuccaggcagaacauagguuguuucagaagaaacacaaacucucccuggcggcgucugaggccaucuucuucaggaagguguuucuuggaugcacuucaaagcguagggggcuucacagguagaauuagguugcaggaaugaggggaagguaguccccuggaaaaugugaaaaugaggguugagaugcaggcaggaaaauucaggaggacuguugagugaauagucgcucccuguggcaggugaccagggugggaggaggguggcagugugaggacauccugaaacacacacgcuuuggacucagaucuugcuguuguagcuccgcuaccugaucagucugugaccuugggcaacuuccuuagcuuuaucugugaaaugggaauaauagugucuucccuucagugagaaccaaaugagacaguacuuucuguacaucgaaugcugguguagagcaguuagaacaaaucuguagaucuguagaucgaugcugguguagagcaguuagaacaaaucuguagaucuguagaucgaugcugguguagagcaguuagaacaaaugagucuggggagguggacccaggcuguguugcacgagcagggccucugcacaggcccagcacugaccucagguuuaaccuuuuacuugagguacgggaauggcuuuuuggauacuguuguuugaagaaaaaaaaaaggucaugaauaaaacuuagaauacuaacaaccacccagaaagccagucccaucucugcccaguaacgccuuccuuuccugcaggaagguuggaaccuuccacaguuccaccagguauuggccugguggaccagauugaaagggugagcagacaaugggggggcagacaccugaagccagagaugugggccaggugggggcugucggcccuucccacaggcccaggcagcugcgcugacacagcugucccuuugaaaguuggccccgagugggaagcucugcauuauucucccagcccacugcagaaugccuucugcccauugcacaguggcagcgugcuuugggcagcuugaugcuggggcugcauggagggccucagaaaaguagguagacucguaagacgggcuuuauccuggaacaggcaccaccacccugcccuuuccagagccaagcuauggacauggguccuggagaggcagaaaugucuuaagggaaggaaagggaaauccuaauuacuaccugggaaacaguccucauuuccaaacccagcaggugaccugcaggauaaugugugggcagugauucauuagaagcuguaauccccaguguucaagcgagaguuguaacuguaucuagggccugagagagagaaacgggcuucaugaauuacuccucuggcaccguugccuacauaccuaggccuguagcaauuuaucccaaaugaggaaauaauaaugucauuuuccuccagccuuucccugggaggaaguucucuaauagaggguaggcagguguuaagaagaaaucuuucugggccacaccucauuacaagauugggauaagugagcucuuuuucagcuucugccucuccuguccuugccuugucagcagcaggguugggaguuaggcacagggcauggugggaaagaagucuugcuggguucucagucauugcaguugguuguuuuagguaaaguaaauugauguuguguuucuuuucccuaaauauugacuguugaaccuaguuguggaagaaaagauaccuguauuuugcucuuauuacuugcuauucacugcuacucuucaucuggaggucacuagcaauuuuuaaacacuuauccccauuuuacagauagaagauaguaaguucuauggaggaaugaaaggccuuuuuacagaguaacugagguuccauauguugaacuagaauaaaguuuaagcuccugaccaggugcgauggcucacgccuguaaucccagcacuuugggaggccgaggcaggcggaucacuugaggccaggaguuugagaccagccuggccaacaugaugaaaccccgucucuacuaaaaauacaaaaauuagccaggcauggugguacacaccuguaaucccagcuacuuggaaggcugaggcaggagaauugcuugaauucugccaggaggcagagauugcagcaagcugagaucaugcaacuacacuccagccugggcaacagcgggacucugucuuuuaaaaaagaaaagaaaagaauaaagugagcuccuauagcaaguggagccccacaggaagaaaggcuucaauggaacggacguugacuucucguccauccgacagucuuauggaucuugcugguuggcccugacuccccuuacagugucuuagggaccccguucuuuucaucucguggcuuugccaucucguaagccucuuacuuucuauauccacccaaucauggggaggaagacucagaauugacacuuagcaccucugccauugccaagaacuagucaugugaccuuaacuacuagugaaaggcagggguggcccggaaauggaguccuucaccagacaguugcuuaccugagacaacaugcauguaccugugaaaugcguauacuguagaaggaucaugaguuuggcacauaauuaguggauaauaaucacuaccacgucucagaaugagugucagauaauuaguggaccauaaucacuaccacaucucagaaugaguguauuugcuaauagaaaugugguuuuggcuuaagucacauugucaguggugaaugcagccuaaaauugaacucaaauacccaggccauaguuguuuucugacuccaccaaggcagaaaugaaauuguugaguuugagaguaaguagauggggccagccaaagcaagauggacagaaugacauuccuuuacuguccuuauugacaauuuaugguucaugcaauagaaaagaaucuuaaaagucucucuuuaauauacaagaagagaaagaccccuggaaacuugucuuuucaucauucgaaaccuaccuuaucccuucagucaaaugcagugguaccuguaaagcucacacacaguuuugcaucaaaugauuauguggucagccauguaauaaguggauucaaagaaacguauauuuaagguggccacuugccccugggguaaauggcagcuguuggacucugugggauuuuguguuguuguugaacuuguaaagugaugaaaccucauaauuucucuccucuuuuaguucccucucugucugagcagcuguacugaaguuugucaaacaugcccauuagcuuucacauguaaagauggccuuuuuauauucaaauuuuaguaauauauuauuuaaucauuaggcaguuuacuaaggguauauuuguggccauuguucuuucugaaugccuaaucacuaaaggaaaacauuuuggaaacaagcacuuucuuccagaaacugugguuuccaggagagagagucacugggaagauugggaagccaucaguggcauggcacagagacaccauggaugcugcugcuagaccagcccugacccaguaguaaggccuagccaaggacacauugaacuccuugaaauugcugauauuuggucaggcacggugccccgcgccuguaaucccaacaccuugggaggccgagcugggagguuugcuugaggacaggaggucaaggccagccugggcaacauagcaagauccccgucucuaccaaaaauauaaaaaauuagccaggcguagugaugcacaccuguaguccuagcuacucaggaggcugaggcagaaggaucgcuugagcccaagaauugaagguuguguugagcucugauugcaccacugcacuccagccugagcgacagagagagacccugucucaaaagaaagagaaaaaaaaaugcuuauauucaacaauuuuuguccuuccaaacaacaauuucaucauauucaaacuaauacaaaacuggcuucccaaggagguguuuguuuauaaggcuacagggcaccauuuuccuaccacuucuaacauugucuuauaggagguucucugaaaugagaaaugcagaucuuuuuuuucuucuucuccuaagacagggucucguucuguugcccagguuggagugcaguggugugaucauggcucacuauagccucaaccuccugggcguaagugauccucccgccucagucuccugaguagccgagacuacaggcacacaucaccaugaccagcuguuuauuuauuuaucuauuuaucuauuuauuuauuuauuuauuuauuuauuuuuguagagguagaaucucacuguguugaucagccuugucugaaguccugggcucaagugaucuucccgccucggccucccaaaguauugggauuacaggcaugagccaccacacccaggcagaaacacaaaucuuuagugagguagcauuccauuuagcuacagaagcacucagcaugcaguugaccuuuaaacaacucggguuugaaaugcauggauuuuagauguggggcuuuuuaaaccaaacuuggaucaaaaauaugguauucacaggauacaaaaaccacauauacagagggcugaauuuuuguaugcauguauucugccgggccaacugugggacuugaguaugcacagauuuuacuauacucaaguguccuggaaccaauucuucacauauaccaagggacaacuguaaugugaacacaaacccauaaacagugcaacauuaccagcuuucccaggaugcauguggcugacagaggagucagcaucaagaagggcuccacuggcggcugggggccucugagcuggagcuuacugacaaguggaagaugcccagaugauaaggugccgugacagauuguggugguagcauugugagcugguugacaacacagaacucuggaaucagauggccuggauucaaauccuggacucaccccuuauuggcugugugagcuaaggcaaguuacuugcccucucugugccccaauuucuucaucugcaaaaugggaauaaugauaauggcauuaugguuuacugaaaggauuaaaagaguuaauauguuuaaguacuuggaacagcauccagcacgacacuaagugauauggagguauuugcuauuuuuauacagagcuuaguggcaugaagaaguuagacaagcaaugaggaauucaaggugguguccuggaguagaagagaaaucgguucuggaagggagacuuagauuacaggacagacagagauuuggguguuguuuccacgacuggaagaaggcgacaguuggcaaauacccaccuauguagugauguccagcagaaacuguccugagacccaucuaacuuugucauuccacuaucucucugucucugugcuuucuccugcccuucuuccugucucaaaaccucuaguccuuuuaauuauaggaaauguucacguuuucccaccacauuuuuuuuuauauaugucuggguguaggaaauuucugugcacccccaaggacaccugcagcuccucucucuuugaguuugguguaugccgggaggguagucagaaaacagccauagcccccuccuuugcaacuguuucugcuauagucuuuuugauggugcaagguguacccuagggcugauuguguuccugggagcuggaagcuguuacugcaggguuaaaucagcaacaggagagcaucacucccagcaaccucagaaagaauagagaaugauguuguugaagggagcagggagcuguguuccuagugccgucuucuuaaaaaaaaaaaaaaaaaaaguuuccuuccccccucuucucucugccuuuccacaacacaccuuguacuaaauacauuuuucagaccugacuuugugcaaacacaguguuguucggcaagcauuaaaaggcaauuuaguacucaaaggauuaaaagcucauguuaaauugaagacuacacuuggcauaaacauuaaaaauugacagaacaccccgcacauuaacugcaccagggcuucguaauuagcauuuaaaaguaaaacaucauuuccuuacuguuuccuacuuacucauuuauaaugcauuuauuauaauacagaugugagcaagaggcuuucucccaucaucagcagaugaaaaauauaccugugcugagaaagaaacugggauuuauuaauccagcccaaaaagcaaaaccaauaaagaaaucucucacugggcugauuugagagauucaaacuaccccuuggaagauugacacaaggcccccaaagaaaucgccuucacacuucuuuuccuuuucuuagccuuucacuaacaaauacugggaagaaaauccaaguaagcuucagccaggcacacacuugcguuuaaaacugaucaacuggcagguuaccaaaggaauguggaaaagagcuuguuggcccauugcugaugcuucuucaaaacuuugguaagacugggauccaauuuucuaacucagggaaauucugcugacuuaacacagauggcugaauuuguaaaugaggacaccuguucaugacaccuuugggcuccugcuuaaaaucaggguuuaguuuuuagcauuaccaaauuuguaaaaucugaaugcaguccaaaucugauuuuauguucuuccuccagaguuaauccuaaaugugccaccauugcggucuuuggaccuaauucucggccccuucuuaguaugguagguaguaauucccaaacucuagcaugcaucacgaucacugggggucucccuaaaaugcacauucugccugagcagguccaggguggagcaugagauucugcauuucuuuuuucaccuaggcuggauggagugcaguggcacaaucucagcucacugcagccuccaccuccugcguccaagugguuguccugccucagccucccacguaggugggacuuuaggugugugccaccacgcccaacuaauuuuuguacuuuuaguagagauggguuucaccauguuggcuaggcuggucuugaacuccggaccucagaugaucugccugcgucagccucccaaagugcugggauuacaggcaugagccaccgcgcccagccagauucugcauuucuaaaaagcucccaggcagugccagugcugcuggccccaggaccacaucuuugaguggcaacguugcacagaagacucucaucaguuaucagucaguggauucagcucaucaaaugugaaagacccccaaauugccagcucccugugguaaacccauggcaaugacuaagacaaccaaacacagugcuugcccugaaugaacuuauucuagaaauaucugagaccuuguuaucuuucucaggccucuccuacuggaccucguuugucaugugugauugcgaacaccuuucccugauguuaucuagagauccugacaggcauguucugcuaaaacagaccucccaggcuguccccaaguggccucaaauuccccagcuggggcaccuuaaguuuaucacguuaggcaguuaacaggacaaauauaauuucugggccacaaggccagucugggugaacgcaugacauaaggguguuaaaaguggaggggaauuccgaaaauagacuuuacucuugucagaauggugccaggggcuggcccagccuguggaaugccucagcgcuagagggcuugggcaguaaggcacgcuucccuggggaggguggugguggcuggggagaggagagccagguucccaagaaaguaauuuggcaccugcucuauggcaaucccuuacaggcgaagagagaaaaaggaggcuuugggacagauaggggaauuuucugauacaagcaguccccuuguauuuucuuuucauugucguaaugauuuguaaaauuccagaaauguauucgugccccuacaugacuugaaaaugccgcugucucacuaagagccaugggcuaaaacacacccgaacagcggucagaagugaggcucgcugucucugaggugaggacaacagccuggauucccgagucaggcucacaucuaagccuggcagggccuggagggcggcaacgugugguuugcagguucguucauuaccccaguguuuuuuaugggaagaugcuuggguguguuugugggaacagaacccugauuuuaauuacaucccuucugguuauucagauuauagacuucuaaggaucuuguuucucuggcuuucuucugcccuacagagggacacaaggguucagcagagaaagugccugugcucuguguugacacauagaagcagagaauuuuagagcagaaagggacuucagugcauuuaguccagcacccucgaauuauaggugagggaacugaggcucagagagauugaaaugaccugccuaaggucacacaaguaggauuaaaacccaggucucguaaaccucucuauuuuguacaucaugcugucugcacauaauuauuucuuuucagauauuuaauaaaagucacaaucagaguuaguccauuucuugucucuccuuugagaguugaagucaucgugugaauagccauaauuacugcauuuucugugcguuucuuauuugauucuucuuuggcacaagggcucugaggaugcuucagcauuguaccaggcagaaaaacgaacacaauuagcagauucaaacagaugcacaucgcaucucacacagguuaauagggaaugugccuuucuaaagcgaaggagccaggguuaaacagggcauggaagaauucaaaggguaaaaugaauaugauucacauacuuguagaguggccaaggagggccuuauuuuuuacucuucaacaaaacagagguuuggcgcuaaaaccacaaaguaacguucacuguaggcgcaccucaggcacaccccgucccugcuacgcuacacgcugccuggucucuguagacuguuacugucugaggaccuccucucacaaacacuuauuuaacaauggcacuuuggcuuuuuaauauuuuauuugauuucuguuuuaugguauuuuuaauugaacccuguuuuaauugccuuuucugcacaccaagagccuagguggggaaggaaggcuuacaaaugaaaugauuauuguuauuacuuccuuucuuucugcagcgucuuagucaaauuauaaauugauuccauccacauauuagccccgauccucauaugcaugugucagaaaacagaaaguguugaauaaggaggcugaaaauuuucaucuagcugagaauaagauuugucagcauuauuacagagugaggaaaggaaauuggggcuaaguucuugccgucgaguugagcagaguacuugguuccgggugacacagcccacaggugggcaagguuucauaaacugagagcuagaaguggccuagaaaagacauuuagucgcucccucguguccagucauagcccagggcagacauaguuuauccugcacagccuuggcugacaccuccauaaauaaggggaccuuccuuuacagcuuuucagagucucaagggcagcuacacaguugcccuuaggauaaaagaauaaacaacccucauccccuuaaacuucugccccucuuuacccagugcccccgcauccuguuuuuuggaauuugaccuauuuaugcccaggcacugacugcaggguugacaguagccacccugaaggggccuugguagggaguaacaaaacaggcggggugcgguggcucacgcauguagucccagcauuuugggaggccgaggcgggcggaucacuugaggucaggaguucaagaccagccuggccaacauggugaaaucccaucucuaauaaaaauacaaaaauuagcuaggugugguggcgcacgccugugaucccagcuacucgggaggcugaggcaggauaauugcuugaaccugguggggggauggggacacggagguagcagugagccaggauugcaccacugcacuccagccugggugacagagcgagacuccgucucaaaaaacaaacaaacaaaaacaaacaacaaaaacccagaucuggcacacacagaaauggcuucuggccuuauuacacccgcugccuccccagcuggguauucagugggcagccacucauagccuucauaaaaugacuuagauuugaugcuugaaaugaaagcuugucaauccuggguaaccgcuugaagaaaggaacauuaucccuuaaaaggauagcccuagccccuagaauaucuuucucaccuugggacuugcuaaaauagaauuccuuauuucaaaggcaguaaaauguuuugaguuccuacuauguguaguaugcuaggcuaggcacuacaggccaagcaaggcaaauaaaacuagccucuuucccuauuccccugcauuucagaaaagacaacacauuucaaggcucugcuuugcaagagaccaggcaccacaguuuccuccuaucagccugggcauggcaaguaauaacccccccuaugaaugaagagguugcuguguucaaagagguuaauaaaguguccaagaccguacagugucagugaggcagggaagaaaucugaaagcuggucccuggcuaaccugucucuuugcguugucaaccuggaaggaagugucagaugguuuggcgcagagcucuguccuugggccuggccuguuugcaaccuuugcuuaggugaaaagugagaguggaagacacuagauuggaagaagacaaucaggauaccaaaaaauaucccagcagacugaggaccagaacgaaagccguggcagugagaguggaagggaggaaaugagcaagaggcacagggaagacagagcagccugaggauucggugaacuggguuuggaguuagggagggugauggccuagguaagaccacugacaaucaggaggaaaucccaaugaggucaucuguagauuguugauuuuuaaagugccaauggacaaucagugccacacuccaccaaaugaguuggagauacagaaguguaaggcaggaggagcuggagucuugggagcccccuacuuggaaauuacagcggaagcuggggaacuggugagagagagucccccacuuccuccuuucuagacauugaagggauaccugaagaaucucaauauuaaaggauaagagaauccaaagaaggcaauauuacuugagaaacaagagaauaauaauaguauuuugucacggaagcccaguaacaaagggagagacagucugccacuucugcagaaagagacagaaagggccacuguguuuguuaauuaggagguccucggccagagaccugcuaagcucauaaacguuaaaggccagaguuacucucuuuggguggaacagcuccagggcagcugaauagauaauagucacugcuuccucgaaaggguaggacacaugauuucuuuuucuuuuuuuuucuuuuuuugagacggaaucucacucugucaccaggcuggaguguaauggcgcaaucucagcucgcugcaaccuccaccucccagguucaagcaguucuccugccucagccucccaaguagcuggaacuacaggugcccgccaccacacccagcucaauuuuguauuuuuaguagagacgggguuucaccauguuggccaggauggucucaaucuccugaccucgugaucugccugccucggccucccaaagugcugggauuagaggugugagccaccauguccggccaggacacgugauuuuaaaagcaggggaagcucccaugcuagucaaaacaacccuacuacagcauucauagaagaauaagauagaaaaugagaugggagcuuagcuggugacacagcagggcacuugcuugcuugggucagcccagccuagaaagucagaggugacggcacuaaucagacuucagggaaacuggcuggcugguaacacaaaucuucuguuuacagugaggaguauaaccagcaacccaacgcgagugaccuacaugcaguaguuggcccauaugccccccagggacaaucccuaaggaauccaaauuauaaucagaaagucacuugcugaccagggauuauaggaauaagggaccugggcagaacugcccacucucuccuguuuuaguauuggugaaacucuaguacugugcagggacuuuugguacucacuuguaacacuugauugucuuuuuuuuucuuuucuuuuuuuuuuuaagacagggucucucuuugucucccaggcuggagugcaguggcaccaucucagcucacugcaaccuucaccuccagggaucaagcgauucucaugccucagccucccaaguagcugggacuacaggugugcaccaccacgcccagcugauuuuuauuuuauuuuauuuuuuaguagagauaggguuucaccauguuguccaggcuggucuugaacuccaggccucagguaauccaccugccuuggccucucaaggugcugggauuacagaugagagccaccaugccuggccggauuguacucuuuugauccuaccuguuucccagugcuggauugugagcucucugagagcagagccugggucuuacucaucuuuauauccuggugccaaguauucuguguuggucacagaaucaucuacuucuauuuggaaucaucuacuauuucuagaagaccuuaguagagauaaugguauuaguaagugcuucuguguuuggggugccuacucuaugccugcaggcacauuagauaaagauaucuuuagagcuaauagaugccaugaggcguauccuacagauaggauccugagcuucagagaugacagaucucauguaaucaagccggcuuuaugagguaggaggggaucugaaccuggucugccucacuccagagcacaugcucuucccacugggccgcauuaccuggagucacuaaggccuguuucacaggccccuugacugggcagcucccggcucugcuccguggaugugcugugugcuaaaggggcggugggggaggggggcccugagaaaggaauguucaggcauugguuaaaauagguguccuagccucuugucaugccuucauauucacaaauguucauuucuuucuuucucuuuuuuaaaaaaauucuuccuagggaugaugacugacagauuaauauaugucuaacuacaugucucagaaaucaaaaggaaggugcugucagaaucacuugucagaaaaugagauuaggcgcacuugucauuugcugaggauugcagucuuucagagauaagguuucauuuaaugaggguaaaaagccuccuuuuaaaaaaagaagagggagcgagggagugagggugggguaggcgaggagugaugauucuuuuuucuggugucagccaaguguuuuaucaccuaacgcgaucccgcggcaccugguagccacugauaauggcaaccuggccuucuccaccuccucugccgcugcaccacuucaaaagcagcugcuuguuaccugcuuuuaccucuccuugaagcugaagcuccuucuccugugggaagagggagcuaagcauguacucuagauuuaaaagcaggcucaagaaagcaugcaguagaaaggaaacguacagucacauuucccaacaaacuggaaagaauccacaauggauuucagugagauauggagccugucugaguagugaaggguaacuaaugaggaacagagcuagaucccauugcaaccaauuguguuuuguuauggaaaauauuuaucaaguucuuuugcauuuguugauucucuuacaagugacauaguaagagcuccuggcaugugacuugaugcaccuccugcacccugcgauucaggcuggcaauuucuaucccuuuauuaagcuucucucuaccucagguguggccugugcuccagaaguauuucaaauuaauccuccccccccucaacucccuaccuccaaucguagaaaacugccucugaaaugaacaacuuuauuguggagaaugccggugauaaagcagaaaauccguauuucagaaauguuuggugaccaggcgcaguggcucacgccuguaaucccagcaccuugggaggccaagguggguggauggcuugagaucaggaguuugagaccagccuggccaacauggugaaaccccguuucugcuaaaauuauaaaaauuagccaggugugguggugcaugccuguaaucccagcuacucaggaggcugaggcaggagaauugcuugaugagcccaggagguggagguugcagugagccaagaucgugccacugcacuccagccugggcgacagagcaagacucugucuaaaagaaagaaaaagaaacguuuguuccaguucucuacuccaaaacuuacugguguaaagcaguacccuuuucuucuguuccuggauuuggugggucagaaauucagacagggccaagcagagaagcaguuugucucugcuccaccaugacugguggugacaugaauggcuggggacuggaauccccuggaaaagucuucacucaugcaugaggcacuuggcagggacaaaagcaccucugcaagccuuguccauguagcaugggcuucucacagaacggcgucuggguugugggaggaguugccggagggguugcuaccagaaagcaaguaucccaagagcuugaggcagaagcagcgagacuucugaccuggccuuggaaagucacauggagccacuucugccauugagcugaagcacugacaagcccaccaggcugaaggaaagaagauggggaccgcuccauggggcagugucaaaggaugugcagcugugcuuuaaaaugaucaucaugcuguaaagguuucuuucuaccuguguuucuucacaucucacgaacgaaauggccuaggaauguaaaguaaaugacauuuggaugguuacugacuugguauaaaagguuauuccucuucauuaaaaagaagaagaagaagaauaagauauaggccagaugugguggcucaugccuaugaucccaacacuuugggaggccaagaugggaggaucacuugaggccaggaguucgagaccagccugggcaacauggaaaaccccaugucuaccaaaaauuagccuggugggguggugcguaccuguagccccaacuacugaggaggcugaggugggaagauggcuugagcccuugaggucgaggcugcagugagucaugauggcaucacugcacuccagucugggcgacagagccagacccugucucaaaaaauaaagagagagagagagagagaaaagauguagacagagagagugagcccaaccacauuaauggcccagggagucugagggguggaguguccuguuccugcucucuguugcuaaugguuuaaaacagacucagacuucacuuaaaugggcaccuuucuggccgggugcgcuggcuuaugccuguaauaccagcacuuugggaagccaaggcagguggaucacuugaggucaggaguuugagaccagccugggcaacauggugaaaccccaucucuacuaaaaauacaaaaauuagccaggcgugguggcaugcacccauaauccuagcuacucaggaggcugaggcagaagaaucacuugaacccaggagguggagguugcagugagcugagauuaugccauugcacuccagccugggcgacaagagugagauuccaucucaaaaaaaaaaguucaccuuucuguuucuuuccaguccuucucuguuacacucuucaaaaaucgucuguacauacuugccucuauguucuuacaacuuuguuuagaacuuaacauuuaauauguaaccuagcuucaaccccauuuucuaacaauucuccugcuauucaccagagaccuccuaaaucagcgauccaccugucuuuucucaguccuucuccuccagcaccucuaacacaucugccauuuuugaguucuccuccuccuggaaaucccuucuugucauucaacucugucugugacuccuuccccagcgcaguaaacguggacacuguccagguguaguccuugguuguguuuucuuuucacgccacgacauucccucaucucuuugcagaagacauuugcaacuuaucugcaaauccgagcucucuuucugauguuccacucccaaauuucugaccguggcuaggcuuuccucacggucuucuaaauucaucucgucccaagcaaagucucuauauuccccugaaagccuccacaugcuucuguguuccugauguuaaccaguuccccagccuuuacaucuuagcaucgcccuuuguguugcaucacugccacacacucgugcguuccuugagguucugccuccuaaguguguuuucucaccuuagcuuugccccgugucuccugccauuuuccucgagucacuuuuccuuuuuucuuuuuguagaggcagggucuugcuuugucucccaggcuggucucgaacuucuggcuucaagugauccuccugccucggccucccaagguucugggauuauaggcaugagccacugcagcccaccucgggugacuuuucuuaaugcuucccuggauaccuaucagguucuaccuuauaaaauuuuuauaauuuuaguagguucuggccaggcgcgguggcugacgccuauaaucccagcacuuugggaggccgaggcggguggaucacaaggucaggagaucgagaccguccuggcuaacaccaugaaaccccgucucuacuaaaaauacaaaaaauuagccaggcgugguggcgggcccuguagucccagcuacuugggaggcugaggcaggagaauggcgugaacccgggaggcggagcuugcagugagccgagauggugccacugcacuccagccugggcgacagagcgagauucugccucaaaaaaaauuaauaaauaauaauaauaauaauuuuaguagguucuaccuuccccacguguaguuguccucucucccuccuaaauuauaaguuuccuaagggcagauaacauguuuuguucuucuuuuuuuuguacauaguucauacuuaguaaaaguauccauacugaaugaauggcucuuacuuauacuguaaagaaauaaggcauacagcggaaguguguaugcuuaauacacauacaauacacaaacuguuggauuuaaggaaagauuuugaugacaugaagaggcuaacacugccgaacguacuuccaaauauugccuugccccucaacucuccuuggagugguacuggggggagcaagacacauaagcaacaauaauaacaagaaucauaauagauauauuuauugagcacuuacuuugcaguugaugcucuucuagcuaagguaaucuucacaacccuggucuuuucaagacacacuuugagagacagguacaguauguuuuccauucuagagauaaagaaacugacagaaaaaucaaauacuacuuuuuuuauuaguugggugaaugcuuaguaccaccaaacaaaccucuuuuugcaauccgugcuaaagcaaguaagugccuuaggcucaccaccaaagcaggccuuccuuuuucccuuagucuaaauuuuauuguggguugaccacgaagcucagagcaacuuccaaggggccccuagcugagcuuagucaucaccaguccugaaggcaacagaaggcagaagagaggcccaagugugugcaggacuuuuuaaauucaaagcugugguuuuucgaagcacagggacccuguccacuggcaaaccuggcccaaucagagucuuauaugcuaauacucggauuggcaaccaugaggaaagcugggagaguuuccuuucccucacacaaacccuaaaugaguagaugaauaaauagacccugcaugguauauguaaucauauaccaagcauaaugagagacaaaggaaauguggcaaaauguuaucaauggaggaagucaagcaaagaguuuuuggguguuauucucaccaucuaucauuauuuuuuccuguuagaaauuuuucaaaauacacacuuaggcaaaacuuuaaaagacaucuaaaacaaacaaaaaugaguaacuguaaagguaggagucaacaauaaauacacgggaaaggaaucugaagccaggaacguuguggcccauccaagggggaagugcccagagagaagggaagagguagaacuggagacagcuggugcuucuuagggagaugcucagccugcccaagaggcuaauuuaaaacuaaaucuuaucccuggaucccacagcccuuaaugugacccaaacuuuccauuaccaaauucugggguuuuaaauccugauauugugugcuugaaucuggaaucugucucauccauuaaagaucugaccuauugaggccacaugugucuaugcaauaaguucuuuucaagccaaacuuucauguuaaaaaaaaaaaaaaauccugagaggaaauacauguggucccuguccgcuucuagcccacuucaggcuauuuauuguuuuauuugauuguugagaagucagaaaugacuaaauugguucucaauguggccugcacauuuccuuggcuaggaauggucugauuaaggcaaagcccaacuuagaauuuagcaguguucugaucuguguggguuugggggaaggcauguguauuuuguucuuucguucugaaguccuucccuuguggauuucagacuaaagugggugugaugacacauuuacccuuuugguuuuguuuuuaaaacacaaagcugacaaauguguuuaauggccccguaguaccaacugacagcggcacggagcccaggaggcucacuuguaccuugacugucucagugaggaagcugaauuuuacucaccacuuagaaggauuaaaugcagaccauagcauacuucugacauuucauuggcuuaucaggaaauuccaugagaguggggaggaggguggaagcagaagagguacauacauugaaugguauauccuacuuagaaauuauaaacucuaagaaaauauuaauagaaggaggaaaauauuuauuuuucagcacagagacuauucucuguuuauacauuagguaccagaucauaaagaaucacagagagagagagauuauucaucccaacuggugugcauuuuaauggugaagaaauaguuaccugacuuacccaaagucauaacuaguugggacuggaccuguuguaaaauccagggcuucugaccuuucuaauccaguacaguauucauucagcaccucaucuucccugucauggucuacaauagcccugcaaacagucuucuaaaacucaucagaguuggcugcucaugugauccgguccaggucgguucucuaaucugccuacaggucaguucuuugaaaucauuuccaugccuccucaugcacccccaaacucagcuggucauuuugcaaaugcagguugucagcugugagugagcacugguaacagaaagaaaauccaucaccacgagugcugauggaaaaacaacugggaacguacugccuaguagaauguuguuuguggcccgaucuuuguauaagaaggaaaacaucauaaauuaaaagaaaagcuaccagccaacaacuguauuuuuaccagccuccucuucuuccagaaaacucauugcgaggaaaauaaauagcauucuuucccagcagcacaaccgaaagucuuguuaguuauaggcgaguggcuauuugaaagccuggcuacaauuuuccuguuuuacuaacacuuguaauuaaauccaucaacucccucuaagauucuguguaaauaccagaugcucccuacauuuuuuucucuccuggagaauaugaaaaguuguacauuagcaguagaggaacuucaaaggaggcacagaccugagugaaagugaaguucugaagauccacacucgcuucccugugaauuucuuagaguguuccagggagggcagcccaccacacuuggccagcacaggcccaucccaucucucacccgaguggcggauguuaaguugacauccgugccccaguucaggagcagauggcucugcguggggcauggugguuugggagaauccacccgggccuggcgggaauccuguuguugagggaggaguagggcccugccucccgcuccccgaggguuugcagcccgcuuuucaugugcuauugaugcugcccccacccgcugucacuuggagucauucagucaaucacauggagaaucagaggagaggcuugggauggcucuggauaaauccucccucgcuacugggggugagaaaauccucuucagagcacaugcacuccucagagggcaucaguguacauauauauauauauauuuuuuuuuucuucuguaugcaaagaagaguaacuuguucccccaaggugaaggauuucagcgguaggcaaagcaacaccacuaccaccccaacccgcccacuuugcuuuuccagaauuaaacguaguugccuagagcugucaugaccuacagagaaagcugaggaaguguuaagugaaucaugaaagcaaaucaacagaccugcugguauuuaaauuuuaguguauuccaguguggauuucuugguauuuguaaugcaaaaacugggaacgggggcuccaccuccucucccagcagauccaacccuauguuccaacuuagucccagcauauucgaccccauguuuugugugaauuuacuuuaaagucuuucacacucccgaggccgucagcaaagcacucauaucuuaugggcaacccccagcccucuucgcuuauaaacuaacuguccguggcuuugggguuguucccuaccaguuuuauugggcagguuguuagcuaagggauucauucuagaaccagagguuugaggcagaccucuaagauccucuugacucugaguguguggaggagagugagggaaaggacagaacccauggcccgcgccaccucagcuucuuucaguuucuauuugaaacugaaaucacagaagagcugucagauggcagcugugcauuugguggaaaugagaauuccagauuuuaugcuaauucaguuucagguuccuuugaaccugcaguuuauggggccgugcugaaaacugcaaucuguuuuggauaaaagaagggauuacuaaagacuuuuuaguuguacaaacauucccagccuccaaaaggaaaggggggagaccagauuuauucuuucauuaaaauugucauguuaaguuuucuucugcuuuaucaaauagaaaacuuuuccuuauuuuggcaaugauuuuucuuauuucaaguuuuuuuguuguugccgugauuuauuuucauuucaguagcacucuuucucgaacuucaaaguccuugucacuuccucccagaggcaggaacacaaagguggugcccauggauguaucucauccuggcaugugcucaccuucuuccauucucgcaguguugauugaggcugacccagaugguuguuucacuuaccuauuauugcuuuguaacaaaccacgaauuuggagccuggaaauacaaugcugccauuagggcagggcucugcagagaagcuuccucucuguuccacauggcaucugcuaaggcaaguucagcuggagcuggcggagccacacccaagauggcuucuucacguggcuggcaaguugucaggggcuguuggcugggaacucagcuagcccuguggucccaaggccucagcuuacuuccaugugguacugcuugggcauccuuacuauaugguaacuguguuacaagcuuaaauaaccagaagcugcugggcccaaacucugaaucuccagcauaucacuuccuccucauucuauucaucaaaacagucacacgucagucacaaggacauaaguuucaccuucuaaugggaggcaugacaugcacauacagaauuauuugggagccauauuuggagaugagcaaccacaaugguuaaugauauauuuuuuagaauuuugauuuucaggagaauguacccacgcucuguuguuagccauauggguuucuauauucugugaaaucccaaacuguuggcaauucguggaaaggacuuugcaguuuaguuuuauguuugagauaaugucuucauucucuucuguuuuaguuggcagagaucuggucauuuauuuauuuacucauugaucugaccacugcguaucaacccaucucuuacaugugaugcaugagaauacuguacuagauguuaagggcaauggugguguguaagaguacaucacaguccugguccuugagugauugaaucuacagacugcucuccaaagcaguaucuuguucccagugaggauacgugugccccuaaaggaauggcaguguccagaggugagccgagaaacaacuacauguuauauauugucuuagaucuauguuuccauuaggaagcauucaagaaaagcuguaguuuggagcagaagaagaaauuucugguguaauucauuugcaauacagaucuguaaauggaaauuacauaggaccagagaggagcuggcgggucuuuguaggcacacaggcuugcccugacccuauguaacagcggcauaugaucauaauaacuggcauuucuguaacaguuaaccaucuacaaacugugcuaauuugauugauaaagccccagagauggaggcuauuggaauggccauaguaggguuucccauuccauucugauagcauggaagagacagagagaaaaacuaaggccagagcaagagggaaaaucagaaaccuugcucaauaagaaugcuuucaggaaaucgaaacuaagggaauucuacgacauucuagcuccucagcuacuaccccagcaaguguaugauuccccaaaccaguagaagcaaauauuuuguccucagccaacaagaauuccugcaagucaauauuuggaccaucaggaugcuuaauaauaaggcuagggaaaaaaaaaaaaagcuuuguuagaucauuguauauuagcauagaugcaggagucaaauuuucaguacccuaaagauuauuaauacuuucagguaacguuuccaggaggagauagcaaagccuuugaguagaaggauggacuaacaugcgguuggccaccauucucaggaugucaguaaucuuucaaaccacaaaaccugggaagguaaacuacuuguauaucccaggaauagucacgugacuuauagacagccuuaccaugacccuucagaucuuaaaaccucucuagaguuuagacagcagaaugauuuugucuuagacaucuggccaguggagggagaaacugagauuuacccagcaguggggauaggaugguguggugugguaugguguggcgugauguggugugguguggcguggcguggcguguuguggcgugguaugguguggcguggcauguugugguaugguguguguggugugguaugguguggcgugguaugguguggggugguguggcguggcguguggugugguaugguguguugugguaugguggggauggacagugggagcaugguauuagggaaggaaugugacaugccugcuggcaccaugcuauaauccucauuccuucacugcagaggaccuccuuacacuccuguauccauuuccuuaucuaaaauaaggaagaaacucuccguuacucucuuugccucacaagauugauguaagagcaaacgacauuauaauuguagcauucuggaaaaauauguguuacucuagggcauuuuuggcagcguccuuuggagaggcugaaucuuagaaccaguaaauggcaccgucacauauaauuuauggcucaugcucuuuuuucagucuaggguucacuucuugguugguugauuucucccucccuuccauuucaaggcacugaaaugaagacuagaaucauauuuugagcuugacucaguccuagaauagcagcagucuuucccugggacuaaccaaagcuagaaaugaggguccucagaucagauacagaaaaguaguucuuggcuggguacaguggcucacaccuguaaccccagcacuuugggaggcugagguagguggaucacuugaggucgggaguucgagaccagccuggccaacacggugaaaucccgccucuacuaaaaauacaaaaauuagccaggcauggugaugcaccccuguagacccagcuucucaggaggcugaggcaggagaauagccugaaccagggaggcggagguugcagugagcagaaaucgcaccaccacaccccagccugagugacagagcaagacucugucucaaaaaaaaaaaaaaaaaaaaagaagaagaaaaaagagaaauaguucucccucaguaguccucccucaaacugagcugaaaugauaauaacauaugugguaugacuuguugaaugguaaacauggucggagaacucccaaaaagguaguauuucuuucaauauucauauuagucauuccagcauccaacugaggaacaucuaaggugguuucagggcccucuuuuacccugaauuguuuuuuaaaaaaagaaaaaacugcggagagcucagccuaaaauggcuaaaaugccucuuaccuagagaacuggaaaacgcgaucaguucaccagcaguuccccguuucccacagugguuguuucuaacauugccacuuagugcaucugcugaaacacagauggucgcaucccuaccagcaauugcagagacucccuucccacccucccagaagcugcacccaugcccgggagcccauggcuacagcucuuaauuuauacaugggugcaaugacagccacuguuugcugagcaagcccccgccccagcaccaucucccccagcucaguccuucuucuuucauaguaagcuccugucugggauccucaccugucaacagaccuuacagcaaggcugccuuugucaggcuaccauauguccuguccccuuaggggacugggugcuugacaaccuucauuuauaaaacuaagaggggcugcuagaagucagcuuuccugaaacuauaagaaugucuacuccuaggugacuugucacuaaugaugaagguaaguugcuguuccaagugcuuuacauacaugaauucauuuaacccuaacaacaguugcagcaaaguaggugauguuauggccauacuuucuagauguggaaacugagguacagagaugcaaaguccucucuccaccaucacacaguaagugggaguggaggauaagcuaggauuugaacccauugguucuuucaugaguggcuaagcuuuuaaccacuagaccaacuaccucuuaguuguccccaaacauagaaauggcuggcaccuguuuaaaggcccuuuuuguuuuguuuuuguuuuuggagacagagucuugcuguaucccccuggcuggagugcaguggcgcaaucucagcuuacugcaaccucccggguucaagcgauucuccugccucagccucccccgagaagcugggauuauaggcaccugccacuaugcccgguuaauuuuuguacuuuuaguagagaugggguuuuaccauguuggccaggcuggucucaaacuccugaccucaggugaucugcccaccucggucucccaaagugcuaggaccacgcacacgugagccacugcgccagacccgaaagcaucuuuucauucauucauuuauuuguuuuuaaauccaaucgaauuuagcaguggggaguugucuuaagugucuucuuuuccgcugaacacauuauuuuccucaaucugucaucucugaugacugacuuacacauuguguucuacgccgauccguccuuucagcucaugcagacauuuuguauacauuuucauuuuaauuaccaccccccaacucugccccauguucauauggaaauagaggagccagguguuggauacaugagccgguaacuaaggcaggaugcguaccuggacuuaguagggucccccagggagcauggacucaauaugaaaugcaggucgcuagaccccaaguuucaaacacccaucaauaugacaugaugugagaaagagcaaaccaaguccagacggaaacgagacagccaugaccaggggaggcagagaggccucacaguucucaucacaugcacugcuguaaaaaguaagaugagauaccuacagccaauugggugacacgagcagggauuggauuuauuuguauuuuucauugccuuucuuugcaggguugucagauucugaauauuaauaccuuaauguagauuuggugguuaaguaagauauauuuuauggauuuuuuaauacuuuuuccccuuuguaguuuauaguacauugugaaguuugaaaguaaaauuccuuuccuugacuucuacacucggaaaauauuuauuccccccugugucucaaugguaugcaucauaaacuaauccaguucaguuuauuuacuucccucuuguugcagauccaugaucaauuguagcaacacgggcauauaauggcagagguuuuuacuuuacagcaguacgagcaugagcuauugcacucuccuuucagggugauaaggaaggaagcuuccauuuucagaaucacccauucagaagggguuggggggcacugagcagaggaacugggggccaccugacguugauuagcccugaaucgcuaaggaagacaucccaauccauaguuucaaaugaaucagccuacacagaagaaaucccugggaaccagaaagaguuuuaaucuccugggcugaacaguguggaaggcagaauauuaggaauuagcagaggugacaaguaggacaaccucggccugccucccaguggcgggcaaccuguugacuccaguucuccauccuaggacccuugcuugacugccaugaguaagagcagugggcaccgaagucaaaaugcagaucccuccaggcuucucaguagcuguugucugcccugagcauucucccaaccuuaucaguuacccagacacuuguugggagcccucagacuaacuagcaugcugggacaauuuccaccgugucuucauuccucucaucauggguauguugagcaaggccuccuaacucugugcuggguacaaauuccaagauguggacaaauucuaagaugugaauucuauccacaagaaaccaggugaguucagaaggcauggcucggggcauacaggaggauuuaucaucacaaacagauaauaaaguguugucuccagacacacaucuguuauuuauacugcugcuguggcauggacaaagacaagcaagacacaguccuuggauagucacauuuaaagccaaauugaggugguggguccuccauacagagaaaauaaacaaaaaaaacaaaucauggccgggugcagugacucaugccucuaaucccagcacuuuggaaggccaaggugggaggaucgcuugaggccaggagucagagaucagcaugagcaagauaaagagacccugucucuacaaaauuaaaaauuagcccagcgugguggcgcaugcccauagucccaguacucaggaggcugcugcaagaugaccccgugagccuaguaguuggaggcugcagugagcucugauugugccacugcacucuagccugggcaacacagcaagacgccaucucaacaaaacaaaacaugcuucugcaccaguaagacaucauuuuuauagucguaggcaaaacgguaguccucuuaaaacuggaaauuacaauuuaacaugucuaaaugacauaauugggaugcugcuauuuuauguuuuaagaaauugaagcccucacuauuaagaguuucaucacaucuuaaggcuggcaggcuuuuauaacauuuugcuggauucagggucgacuuuauaaucuaccaagaauauccauguggcugggugcaguggcucaugcccauaaucccagcacuuugggaggcagaggcaggaggaucacuugaggccacgaguucaagaccagccugggaaacauggcaaaacaccaucucuagaaaaaaauuuuuaaaaaauuagccagauguguuggugcacaccuguggucccagcuacucccagcuacucccaacuacucaagaggcugagguaggaggaucacuugagcccagcaggucgaggcuguagugagcugugauggcaccacugcacuccagccugggugauagagcaagacccuaucucagaaaaaagaaaaagaaacacccuuauuaggagacccaagcuauccacuguccagguucugacccugucuggagggauucuuugcaguagguccucuauaaagaugucguucccagccaggcacgguggcucaugccuguaaucccagcacuuugggaggcugaggcgggcagaucacgaggucaggagaucaagaccauccuggcuaacacagugaaaccccgucucuacuaaaaauacaaaaaauuagcugggcaugguggcgggugccuguagucccagcuacucgggaggcugaggcaggagaauggugugaacccgggaggcggggcuugcagugagccaagaucacaccacugcacuccagccuaggcgacagagcaagacuccgucucaaaaaaaaaaaaaaaaaaaaaaagaugucguucccuaguagagaugguacaaaccacuguacccacuuuaugggacuggugucauuuugauguucaugugguuauuuucauuauuguggugauccccacugggagaacccaguagaaggcaaggcuauggccauuguggcccuaauaaaauagacuuuuauuuuguuggucuccacgguaaucaaaagaagugugucaucuguaaucauaauagacaacaaauauauccuccuuacuaagugccaggcacuguuacugaugaaggccccaagagguguggcuccuguuaucucacuuucuagauaaggaaacugaggcagggagagugaagagauuuacccaagcuguccuggcucagaaauggcagagccacaauuauuaaccugaugcuggcuccagggcccagcuccaaaccucuacccugaagaacaaguagaaacuuggauuuucagagcuugcagaaccuuuagaacuugaaaagaauggagacuuccauaguuucagaaauaaaccaggcauggugacauccuugccgaggcuaguuggaguuaucacccuccuucaaucaccuagugaucuuuuaaaacuacaucauccauaacgaaagguucgaggaaauucuggugaagacuuccucuuccuuuaaaccaccucaagaagcacacagcacaugcgcuguuagagugccugaacuucauuauauuuaggagggggagcacaaugaaauuaaugaacuuucucuguauaaaacgcuuaacagaagacuauaauuuguaagaaauauuuugcuaaaauauauuuagcuuaaaucugguaauuugugauauaaauugaaucccaucucagauuauaauuuuuaagaauuugcaaguauaggccagacagagugguucaugccuguaaucccaguacuuugggaggucaaggugggagaaucacuugaggccaggaguuuaggaccagccuggucaguauaggaagaccuugucuguacaaaaaauaaaaauuaguugggcguggugguacacaccuguagucccagguacuuggaaggcugaggcgggaggauugcuuuagcccaggaguuccagguuauagugagcuaugauugugccacugcacuccagcuugggugacaaagugagaccuugucucuuaaauaaguuaauaaauucauaagaauuugaaaguauagauugacuuacaagaauuucccuuuguuuuuaaaccuaguuuaaaucuuuagauguauuuuugagauuugaggaagaaggcuccauauuuuaacguagcuuuacauuuuuuuuaaacugauuaaucauaaacuuggcuaagaucuuugggcauauauuaaaaauuauuucugaaaucauuaaucuaacaccagaguggaaauugaguccacauucuugcucucugcuuucuauuagaaaggguugccgcuuucuaagacuuguucuccuuagauuggguucagaggcuaaaggugauguuaagaagccauuaguguuuaguauguuaauccaccuccauguaacagaaaagauagcuuccagccuuugacuuggcaucuuuauauuaaaacuccaauaaaaggaaauuaaauuucucaaggaaaaaaaaaaaaaacaaucuuccugauuauugaaagcccucugaccuggauucagucccuaauauauggauuaucaaauuuagucuucuuucuuccuucuuccuacuucugaugcuguuguguaccugguccccuccaauuuugacauucauucccauccccgcuuccagaaagcauagggaauagagcaguuuggaaaccagucagaaaugggcucauuugugagucuggagagaggaugagaaauggagcaggucacagugggugguguucugcaaccgggccagccaggggacccuggggagcagcacuggagguggccacaguggucagaggcuuggcuuuuggcguucccagguuccucuugaugagagaucaucaaaagaucuggacacaugcagaucuggcugaggccgucaucugaggccuaaucccugguaaccauugaugacaauuuuuuuuuuuuuuuuuuugagauaaagucuuacucuguuguuuaggcuguaguacaguggcauggcgugaucucggcucacugcaaccuccaccucccagguucaagcgauucuccugccucagccucccaaguagcugggguuacaggugugcaccucuacacauuuuauuaguagagacgggguuucgccauguuagccaggcuggucucaaacuccugaccucaagugauccaccugccucggccucccaaagugcugggauuacagacgugagcaacugcgcccagacugaugacaaucuaaugcaaggcaugauaaaugucagaagugccaccuaaugaaagcacccuggagggccaagugguuucagcuggucagcuaagcugccaugccaucgugcucucaguuuacccuguaggggauggugcaggagcucaggcaguuucuucccuguaacaccgauuuugcuagaacaacaagauaagaaaacuguuccauuuugauuguuccaaaagaaacaaccuuuuaaugucuucucuagaacauuucauguccaccuuugagcuauccugguauugucuaaacagcuucagaaugaaugccgccucccuggaggaccacagcuggguauugugacaucuuguaagcaacuggaaaauccaucuccaaaccuauaccuucugagaugccuuuucuuuugacuucucaggaggcagugguagagaaaaaucacuguuaccuauauuuuuaaaaagacuuguauaacaccacauugugcuaccaguuugggggagggggugaugaagcuagagagagaaggcuucuuauuuccaaacuuagaggcuagaggagggggaaguaugccauacagcaagcacccccaccuuuuuuuuuuuuuuuuaacuugagagguuuuucaagagugccaugaaaucaaauagugauagacaugcaacuucaaagaggcaaggaguggccaucauuacuuuaaaccagucugcaugucauucauauguggugugcaucucucccaaccccuguucucuuccucucuuccuccagccacacuccagguaacgguggcacugggaggggacuuagaacugaaguuuuccucucaccccaccuuggugugcccacuguacuccacaacccuaccgguugcaaccuagggcuugcuugcucuuuuucuuguacuaggaaaauugcagcagcuuuuccucugcaccaaggagggaccuugucaagcugcagguguggaauuaaaacuccagauguuuucagaggguuuccucgcccggggugcguucuggugggaguggguugcucaggggaaucugcugagugccucauuucuggccauucagucccccacacccucugggggcacugcacugugcucuaggggauacagacacgauacauguuaggaugauagacguaacugcugcccauguagcgaggcuuugccauugcuuucauucuuucccuacauucggugaaugccaggggaagcaacaggcuccacuuuuguggaugcagggugugcacgugucagagggugugaggagcugggaggagaggauuucuaaguggccaguucaugcucuuaaguuauucaucaaaccgagcacacugcggucagucggcugugguggggaaggagguuaggugaagaccuuugugucugagacccagaccgugauccccgucuccauuuuccacaaugcaaugauuauuuuguauugagcgccuacuaugugccaggccuuuuacauacaugacuuuaccacugagcccucacaaccgcccagagagccugcucuuugcagaugugacuggcuugguggcaauucaaccccaggcugcgggccuaguggccuuucccugccauggcgcaaucuuggaagcggcaacugcggggagggcgaggagcggugcaguuuccgccgcgcccgcccgcaaggaaggcagccggggggagccgagggcucgagccgcggggggagcaacagcugucgaugucgcgccuggggaccgcgccuccgcugggccgacccggcgccggggacgagaggaggggcggcgaggggcggggcgcgcggggcgggacggaggaggggcgguggcaccggcggcucgggcucggcgcgccgaggaagucccgcuccgagagcugcgagcgucuggaggaggcgcgcucggcgcagucggggagcgaaguccggagcaaggggcccccgcguagccgccgcccccuccugcuaccguccagccagggagcccgcggcggccgccgauggaguucacuugagcugugaaccggcgggagaggcaggcgcccgcaagccgagcgcgggccggagcccagccagccccgggcgcucacccgccagcccgcaagcuccggccagaggcgccgccgccccgcgccccgccguugcagcgccuccugggccgcgcgccggcgagauccgcacaaaauccagacucccggagcggcucccuccagcaccgcggcgggcccaggaccaggcagcccgcggcgcggcuggagaggcgggaccggcugucggggagccccgggcggccgccggggagaagccgccgcgcgcccuccuccuccuccucccucucccuccucccucccuccgcacauggucuccuuuguccugucgccgccgccgccgccucgcucuuagcuccgcgcgccgcggcggcggcucaggccgcucuucuccgccucgcccucccgccggccggcccgggacgcgccuuguuagcccccgccgcgccagcgcggccccgcgcgccgcaggagcggcggggagacaguggcgagcgcgggccgggcgaucucggcgggcgcgcuccucccgccgcccggggccucggccgcgcuggaugugugcgcgcggcgccggcucucggucgccccgaagcuguugcccgguucggaucugguucggcgccuccgcucucggacuuuggcgaggaaggagcccagagacucuuguggacagagccgggucgagaguugggcguuuucucuucguguguuuuggugguuuccccccuggucuuugacgaucgcccuucgggagcccugcuaaagaaccaaaccaugaacuuggggcugaccggaccguuuaacccuuugcaaccagguaaugaagcccccggggcgcggcucgcuugccuaccucucgcggucggaagggaggcggccggaucgggggucuuuuguugcggcggccgggccggcgggcagggguggcaggggcgggcuucucccgucuggcgcgcccaagcgccccuucgcuaccccuccucccuucuuuccuccccccucugcggcccugucgcccgccuuuguacuuuccucccucggccggccgggcucggccggagcugcgcggucgugcccgggagggccuggcguucgccgccaagcuccgaugugaggagggggccggggccugcguccgcuugagcugggggcccuagcguggcgcugcccgcuccuggggucgcgcuuccccagcgcggaggucgggaucccggcccgcacccggugccaagggaggcgaaaggagaucugggcucggguucggcagcgggagaaagaacucgcgcuuaaguuuccaggagguuucuguuuuguuguucgaaagccccccuucucgccugugcgggugcggagggcggcccccggggucugcguccgaagggagugagggugggccugaagcaggaaucgcugggucccaccccgucugcacgcacggcuuuuuauaaguuuuccuuauucuccgcguucccgccuccaaucuguuucacuuacuuaacuuuccuuuaaacgccaacuacggcuucuagcaauauuuuuuuuacauccaaaaaaacaaaaaaacauauucccccuucccuuaaauaaaaagcagccaaaagagagcuuugguuuucugucaguuuuagauucaaccacuucaugccccuacccuccaaaaccgagcgaggggaugaaaggaagugaguaaaaucuucaagucuguagcggguagaggugcccccguguucgagagaaggaagagcucaauucgucggcucauucugggcucgccgcuuuuccauuugaauaauaauuuuuuuuaaaaagccaggaaaaugguccagguaauagaaggaaaugcagacuauuuucugaaagcaacgaaaaugauaaacauccccaagauucagacccaaggaacaaaucauuuguacaaaugcccuaaaacccuaaguagaaggaaaguucguugaggaaaagcaaaggguacucgugucguuuccccugaagauuuuggcaaagaaucucucuucugacuuguuaggacaguggccggccacaguuguaaccaccuggauaggagagagaagggauccagaauguuuucacggucagccagagccccauugcagucgucaucuuuuggguguuuuucuggggaggccuuucugagacacccccuuucccaguugcaagaggcaugguguccagcccugugacuuguaucagccaaguaagggcuuagaaagcuuuuagucgaagauacacuccuaagccucucugaauauccggucagacuuacuuccuuaauaacuuacugaucggcaucauaauaauggcauccucaaguuugguucagacaugaggaucacguaagugucugucugagaaucccauguggagcugacaaagguggcagaagcaaaaggccuguucacccacagcuucuguccuuuucacucgaacacacacacacacacacacacuaagugcaaauaaaaacuuggucaggaaccauuuacuuucccuguuuaugcuuuuugcauucagagacaguaauuuguuuuuacauuucuuggggccaauuagagucacuuuaauagguaaucccagaauuuucaaagguuaugucaguuugguaaaacacuuuaauaaacaggcuuuuuuuuccccuucuaucaguucauuaauuuuguaagccaugaauuuaacaugaauuuacauucaaaaagaauuccaacccguucuaagaaacacuuuuucaugaaaggaugguaaaauacacauaucucgaguuuuuagcugggaaacucacaguccuagaaaucucacuuaauauuucaguguagcaucaucaugcaauuuuuggcuuuauaacucacuauucuugaucuagguaugacuuguuucucucccauuaacauuuuuuuuuggcaguuuguuuuuauguaaagguacuguuauauauaguuuaagaugucaggaaggcccucuguauuuuucauuauuccugcaaaauaggaaaaaaucuaucuaggguuuauguuaaacugcauguauaaauguaugcacuucaauguucguuuugcacauacauucauuguuucuggauugguuaaucauauggacacccccauaaaaguaauguuagaauuaaaauaaagcaaaaaacagucuuaauacaaauauuuugucuuucuauaucacuugcauugagaacuagaacaugucccccagauguacacaggaauauuucaucuuugucaguauuacauggaaagacuaaauugaauauccucuuugucccuaaaagcuagccccagagucaaaauaugcugcacuucagaauuccccccccccauuuccuauauuuccuuuuuccauauuuauucaacauucuaggcuuuugcuuucucagaauaugcaucucuguguaucaagugugaaagaugagugauuucucaugaggguuauguagugaaaacagcacaaauauagcuuggccauuauaacuuuaaaugcagauauauccucacguuauguaguggagaugcuuaauuuuuauuuuuucaaguucuagaaauauucagugcugaaacauuacagcauuuuccuucaaaccgacuuccauguuuauuuuccagaacauuaguguauaauuuaaauuggcuuuaguuuuacuguuuaaacaggcuuauuucaccuuccucaagccacuguaauaauuagcagacauguucucuagaaaauggaaaggaaauaaugcugguggcaugcauaguggucggauuuuggggcaggccggcuugcaucuuuuugaacaccaaggucguuugguuacugcaagggacagggaucuuggagucaucagaugaaucuuaaaaaaaaauuaauuucuggcaguguuggcuuacacuuuuuagugaggaaaagcuuagcauuaaauaauaggcauuucugauuugugaaagaaaauugaaaaauuggcaugucugcaaauaccacgaaaaacauaacauuuccaaaauaaugaucugucaacgaaauugcaaaaucauuaugugaaugagcugaauugcuuuguguaucaucucauagaaauauguuuugcacagauaaugugucuaauaaggacacauuuuuaaaaucagauuuuuuuccccccagcaaauagcugcacugcaggucucucucaagcagucaacuagcaccaccuuauggaugauuuggggacauugcugcuucccugcuaggcuuucguaaaauguagucaacugauuuaaaauaaugggaauguugauggugaugacaauauuaaugacaauaauaaugcuuuuuucccccuucuuguuuuucaggcaucagaugccagcucugaaaaacucuucaacacuguuauuguaaacaaagguaagacccauucauucuccugaguaauggcuuauuuuuauguuaguuucauugucauugccuaggaagaaagaagagcuagagugaucuuucucuuauaauucugaagcuacuguugauguuucauguuuuugcuugagauggaagucugcauacuuugugaugcauuaacauuaacaaccaguuuauuuuaaaagaauacauugagucccuauuuaaacugauuugacuaaucacuacuacuaugugacuuuaauauagaaagcuguacucgagaagaauaguucucaaaaugccugaacuuuauuguuacuuaucaacuacccagcaauaggagaaauauaaauagcugaugugcauugcagacuccaguaaucaauggauguuuagaauucacaguauuauggucauaaaccaagccuuacucugcugugggcuuucuguaaaguuaauaaacgagcgagagggcagaauuuaaauaugcacuaucccauuaauuucuuccaaaccacgaucuagaguaagagaggcuaaugauauagcaguacauuaagggaaaacuaaccuuaaaucauugccaguagguuucugcgcagcuuucauuuguuagcaguaucguuggaaauaaggaaauuuaggggagucuguaaucacuggcucugaaagguguguaauuugaaagggacaaaccauauaaacuauuuaaucuuccccuuuccacugucgagccugauuuaggggcuggcaugauaauugcuaaguaaagaugugcuuucugugauaaucucuuucuggguuacaugggcgacacuugguagcacuugaacagacuugggccuucacaaagugaaauuugagaccauuucagccuucuguaguugccuuggcuagcauuuuugcuagcugguuaguaagacauuuccaagugcaguuauuuugagcucccagauuauuuuagaauuugaaccaauugcaauuuuaaauaguacauuauguuuagaguucccuugagguguaugugauugccguuacucccagaauuacugucauauugaauuuuaucuuuuuuuauugcauaauggaguauuccaguuuuauauuucaucauauuuucugauggacugaaaguuuguauaaauguguuauccauaaugcuaaaagcccaauaaaagaagaugugugccauucauagcauacaguacucguguguaaaaaugcacaauugucuaccacuuggcguuuccuugugagaaaggagggugaugggagagggagacugggguagagggcaggucaccaaaggcagggcuucuucguuucugcagccccccaggaccucugccacaugugacugugucugucuucugcugauuugcuacugaaagcuuuggaauguauuuccccuuucugggaucaggcccuagaauaagaguuggcuccaagaccugcacucuggccgccacugcccugaaagauugucuucagggcggaugaacagcucgccucugccucuucccucugguucuuucccccccuuuuuuuccuuuuccaaucaaacguuucccacauucuuauuuuuguuuacuuacagagugugauuuguggcaucuauuugguugugaauagcccucccccugacagggugccuuucuucugagcugcuuuucuaggggugauuuaguugccuugaaaggauuaagguuucuuuguguacacuaaaaucaacauaggcuuuuucuaagcuuugcuugggaaaccauacacaaauaagcauuuuaguugauggcagauuauuccuuugccccuuauuuccaucaaaauggccuuucuuuucuccuccagaguuuccccuuaaugccuuaugcuaauuccuguugguaacaugaaugacaagagacggaaucagugcgaauccagguggugcaaaguagacugacugguaucccgcacccccuuuccucccuggggagaaagagauuaagggggguguggagggggaaagcaucggggacaguuuuguuaaggggauuaguauucaaacugcuaaauaucaggaaaacaacuucaaaaagggauucauuguguagcgauaaugucaauaauugcuucaggacaggugcagagucuccuuauaggcuugugguuuugggucuguuuuuacuccggguaguggcaguguuuacaggaugaauggcugacaaggccuucaaggaacugucagcuucaugcacaucaaguucaaguuuuccugcaaggcggccugccugccugaaagucaggucuccuaucuuuguccaguaucuuuagccaagagcaauaaaaagcaucauaagaaagggcaaauuuacaccagguaacaaacacaacuggggaaaucuucaaagccccagcuuaugggacaaucuaaccagagugcaggggagcugacacguguaucccuccaccuccagauguuuaaguuacacaucacuucucccucucaagagacugguaguauucuggccuuagaggaguguggcuuuaagcugcuggugagauuaugcugcugagccugguggcaggcagauuugguccauaaaauuucaccgugggagggcagugcuaaucucacaagcugauugugguggggguugggggggcgcagcccugauguugggcugcacagugcggagaugaagcucaggcagaggcagcaggggccguggcucgaggcccaucagucagcuugugagcuugaauaagucauuuacccucuuuaggucaagauuuucaaucauaacaaaaccuauuccagggccaacaucucugguggggauaaaacaauuaauugggaaggggcagggguugaaacagaguggauacagugaguauauuuuauaucacguuuguucaucgauuuuauuuugacuuucccuguguuauagaugccauccaguuucauagagauuuuuguguuuagguguuccgaauggucguuuucuucuccugccuuuuauuuccugcuuuaaaacaaguuaaucaaacagcacaugcuugcauguacacacaacaugccuaaugaggacugagcauuucgaaagggguguggcauugagcagggcuuagcguuguagacacaaaaaaacaguuuaacuuuaaucaaggucauaguugccauauuuaaucuuuauguguuuaaauguuuacaggauguucaugugaauuuuaugaauccuucugucuuugugauucaaccaucugccaaagaaaaaauuaauuuucccacugagacagaggcacagagagagacuuaguaacccuauuuaguugauugaaaugcuauaggagcaacaggaccuguaccccaaauucugggguauuuauucuauaaaggaacuuucagucuauucaacauggcuaguauuuauuauccucucuugccuacuguagauccuugcuggugucaccaguuuggucuguagacaaaagugcagaaaaugaguucuuugcugcacacaauuauccugccaagauaaugaaucuuuccuaaaacucuuggauugcuccagagcagagcugcuugaggaggaaagaaaagaagggaagccugucugggaggaaggacaacacuagucaggcgucaggaguucuguggagcccucuguuuauaggaugccaguccuggcauguggcuguggucuagguuaggggaagagaaaaaucccugaauugcucucccuucuugguucagagcccuccuucccaggauuuagcccguaaccaagacaagucacagauagacgaugacaagucaagacaacucauagauagacggugagaggggcacagugguguauuuuaccccgugacuuucucaccccuucucuuuccuucaacuuugucucaaauugcagaacuggguacuccuggggaaaagccuccugagugagccaucggggagcugugcccagcuaaaugggcauuucugaaugguuuccuccagcagggaaugaggccccucauucugcuucuuucuacugugggcacccagugucuccugaaaugugaacagcaacagagcagcugcucacccucguaggcaggaccccaccucaccuccaucagccugggagguucuaguggauagucacucaccaagaagagcaccagacgcaacgcucuggccaccuggagcccucucugaccaggacugcuuuuccucucccgggcccuaccaggccuauuaguggaacacacccggccucuucuugggguugguuuugcacugagaauuuccgguggaacacagaugagguuggagccuuuagguuagugaagccuuuggauauuuuuggcaguaugguucuaucagcauuguagaaagaagaccuagcuuaaaaauugccugaaaucugaggagaugagguaagaaacaaguuacccagcgauacugcuggcuuaguaaccagguaccuaauaaauucuuccauggcgaccauaugaccuuauucuuuagguuuagacacaagggauuuccuugguuuggugacagaaagguaagaguuauauuaccaucaaggucaccauuugacuuuuaagaaaaacccauucccgccgagcauggucacucaugccuguaaucccagaacuuuugggaggcugaggcaggaggauugcuugagcucaggagcucaaaaccagccugggcaauauagcaagaccucaucucuacuaaaauuccaaaaaccuagcugggguugguagcguguauuuguagucucagcuacuugggagggugaggugagaggaucacuugggcccacaaggucgaggcugcagugagcccugauugugccacuauagccugggcgacagagugagacaccauuucaaaaaaaaaaaaaaaaaaaaaaggccuuuccauaaaauaauucuaugcaugaaaauaaugcaguugacuguggaauagcucucuuaagaaaaaaauuugguuuacaguuuaaaaucccuuuauaaugaacauauggagaccauuuuacaauuccuccuagggucuuggguuuagucgcagggaggacaugauguaaagugcauuuccgaugugcacaagagcaaacugcccguuucagucucuguaaauuaguuugguuuuugucaugccuuaaauuccacauaagggagaguuagaacaucacucauuuauuuuucucccucuggaccuucuuuguacuauuucagagcauuuucuugaguuuuuaggagauagagaugucuggagaguuaaguaguauuuaaggguaauugguacuugaugcaagagacaaaggaguuaugaguaguucagucccuccuccuacuccauacugcaaauagcaugcaaucagcuccuuuuguuauggaaauugaccuuccuauagaagccgacucuuggagaauuuguuguauagaaucauccuuugagcguucuuggaaacagaugccuuguacuguuagugugaaaccaccaguaacagucaaaaaauauuccauguugcaugaaagugucucccgaaaauuuuccaauaguugcuuuggccgaacugaucuuuugccgaacuugugaaugcgugugguggugaauccugggauacuggaucccaucacuggaauugugaaccggguggaagauuccaggcauucgaagugaucuugaugaugccuuuuggguagaacuuuugacagcugccacuuuuccauccugagugccccugugauggaggaggcguagauuacaguguaacccauuccauucuuuuagucagauguucaaacaucacucugguuacuuuugagcucaguggaaagcccuugacuuauacugggcgauuacugcuguccuuugaaagaguuuucucuauccuuggcaauauugaccaaaaagcuugaauguucaucagccucucuucaauccauucauauuuagcguuuuguguaguuaaugauguaguuaguauuugguugucucagaaaguaauaugcauucaugauagacaauuggaauugaaaaauaucagaucaguucucuagagucuaaugagaacaguugagugacaaagggcucaaucacgcgggccaaccccagacaggaggguuccuaaauggaggaagcccguggcuagcccguggccucuggauuauuucuaguuucugacaacugcagaaaaauguuguuuucucugaauauguauguuuauuuaacuagguuucuuuuugcuucacaaucuggauuccauucagucaguuaccacuccaauuaacuaacaauuauuuaacauuaacaguaauuacagacgccaguuaagcgccuacagaugucaacuguuagcuuuguaccuaaucacucaaugaaauggagaaaguucaacaaacaucaauuagcuaagcaauuaguaugaguuaggaaagagcauguuaucaugugugagcugauucaauuuauuuuauuuuggcaguaaaauacacacaggcaagcagcaauaaguuccucagauaagauaaaacucuauuguuuugcggcuuauauaagaauuccuuccuuuccugugcauaagucaaauacacucucgucuggaauuuauuuaacagaauuugucucaauuacucagaaagcgcagucucaggaagcaccuuuggugaauuaugaauccagugacuguacuguauaaggaaaugccagaaaacuucaguggagaaaaugauugauucccacucgaguaauccgcuccgugcauuucggauuuuuaccaguuuauuccugaaccucugguggaacgagugcaacagugauuuuauuaauuucauagugccugaacuuuuacucagcugucuuuuauuuagcccggagcuaacaucaaaguauuuuaccuacuugcccagucugugcuuuuaaaaaguagaaacagcugucuauugaagagccauuucaugaauucaccaaggagauuccagacucuccugaacucagaggugcuguuccacucucuuuuuucccccuucgccuccuccaccccacagacuugacucuugucauuagcugagcuugccuggacuuacugggagagugcacucugaggccugauuguaugaaguggcccagaaaguggagauucauuuuaccuccaagaggaaagcugggcauaggagcugggccucugggucuccuccuacaaaugacuucucaucaacccuuaaagcccuuggauaggaguggaagaagucaaucccucguggggugcucugauaggucugugugcauccuaugugcagaauuuuccauccgaacaagccucucagcaugaacugaaugugggaguagggaaaaaguauucugccacugguauggcuuggggugaagggccaccuugucccaugugcaguuucuauuauaaagcauuuccucguauacaccacgaccccaguacaugcuggaucuugacagaugucugcucuucugcaucaagucacugggucucugugagucugcuuugucaaauuuugcugcaguaacaaaauagcucagaguccuacaacaacaaaagucuuauguuaggugucaucugccaaucagccgcagguuucuuuguuuuuauucugggauccaggccaaaggaggaguccccaucgugguuauucggcugguaaaggggaaaagagcagagacagaaacagagaaugccuccacuuggagguggguguggcguuuccaaaaaucucauuggccagacaaagucacaugaccaagccugccaucaauggaguaggaaguaaacuccuacagggaggagcagaagagaagagggauccacagggauccacagggccuuggaaggaagggaaagcaaacccugcauggguaaugcuaucugccacaggcccaucccagaaaccuaacaaaucaggagcuguugccucuuacuguguuaaugcaaaugggauggaggguggcuugcauagcuuugaugaucuccguaggcuuuucuguuagagaccugguucccuaauagccauuugguuggaguuuauauuaaguuagaucugauaaguugucaagaaauuaaaugcuuuuuuauuguuuaucuggauuaacuuauugcuggcuuggaaggacuuauggaaaaguugccccagagugcagaaaugacuucagugauuugcaaagaauaauuguuggacuggccagauguuuagacucugcauaauuaaccugaggaagcaugauugcuguaaaacuuuacugcaaaguaguaugcguugucaugguuaccuugaacaugggcuuuggauuuaagauucucacagacacugcuuugaaucucagugcuuugaagacgcuuacuagcuguggaacuuugggcuaguuaaaacaccuuagaaccaauuuuuccuucuguaaaaugggaauaaccaaacccaucucuuacaggugcugugaggaugaaacgaggcaauggauagaaagugcuuagccuaccuuguaccauauuuugaucuaaugauacagugggcuaaguauuuuacauacauucuauccccuaaucuucacagcagcucuuaauuuagaaaagaauuuagaaauagcaucugcauuuuauaggcagggaaacugaaguuagauaugaauagcuagcauuuauugaggacuuucuuuuugcuagguauuguucacuuuauauguaauucacucauuuuuuaagugaguaaacugaggcucagaaaugaggcaacuuguccaaggucgcgcaccuaguaagugguggagcucgguccagcugacuccuagacaugcucauagcagucauacugugcuaggcucuggggauauggcagagaauagaaaggaggaggaucucuguccuuccugagggagacacaaagcgggaugguaaaaauucggauugggggaaacuggguucuaugggaagacacuggcaggaacccucaacaagggcuucccuagggcuuuuccucccauaccuucccaaaguauuuaaucuucucauaaaacauaaggucccggagguucucauccaggacuucuccaggaugucaaccauuaucccaucaccuguggccagagucgccauaguuacugcagcgcaguggggcucagcuuaaggcaccuccaguuuccucgcucuuccaugcccauucuugugccuuugcgugaacugaucuuuacuuuucagccagauuuuauuagaaaugauuuaggaauuucaagcaggggcauuucccuagcaaccgaugacauaagcacaaggcccaaaucugugcuguuaacagggaauggcguucugugggcuccgaucugcgucucugacccucguaaaccuugucuucuaaaggaggaggcugagagcacaucauugcuuuucuaagaguccuuuugaagagggaaaugucucaagugugcccguuaauagacugaugugggaggcaguuauauuuggaugccuuuaaaagccacuuggaaaacauuuucccccucuuaucuaucaccuuucacaucucucagcagaguaacacuaaaaccuaauuuuagccaagauuacaucauuuucucauucucuguucauagcugggaaagguuuuuccauaguaaagcuccucuccccgaaaacccagcuccuccgcaggaccucuugggcuucugugaaggcuucuuuauccauaaaguuuaguuugacaaggggucuucugaaagcagauuggucagcuguuaaagaaaugacaucaguggugauuccauugauucguucaauuggcuuaagguggaaaccauauugaaaugaauucuuuucauucacauauuauugagccccaaccauggaacaggaucuggagguaacaacacugaauaauagaugacacccaccugaccagaagaguaaaagaguuuaaauguauuuugaaauguuuuucaagugguauaauagcaaacucacuaauuaaaaaaaaaaaaauagccuuaagacuuucuuagguggaaaagcuuaucugaggugagccccgaagggucagcagaccaaaaauugaccagcccucaaacugcagaauuaugucucgcauuuagagagccccagaaucugccagcuugugcucaucguuagacuaaaaccuaccccuuugaguuuuccauuuuaaaaauugaugcuauuguuauaugaguuaauuaagcuauugcaaagguuuuuggcagugccauaaagaucuguacaucaccuaucaauacaguccacuuuuuucacguuucuucaguuagauuuuauuguuuaaauacuuuuuuuuuuuuuuuuuugagaccaagucucaccucauugcccaggcuggagugcaguggcaccaucucggcucacugcaaccucugccucccagguucaagcgauucuccugccucagccucccgaguagcugggauuacaggugcccgccaccacgccucgcuaauuuuuuguauuuguaguagaaaugggguuucaccauguuggccaggcuggucuugaacuccugaccucgugauccgcucaccucggccucccaaagcacugggauuacaggcgugagccaccguacccggccuuguuguuuaaauucuuaccagguuggcccaccgcaaggagguggcaggagggaagccccaugcccaagccugagcaagacuauuuguaaaguugagcagaucacuccauuugacuugcuuuucucauggguaucaugagaaacugggggguggccuccaagacuccuugugaaucuaaagaccaaaguuuguguuagaaauauucuagggccagccagcacaguggcucacgccuauaaucccagcacucugggaggccgaggcgggcggaucacuugaggucaggaguuggagaccagccuggccaacauggcgaaaccccaucucuacuaaaaauacaaaaaugaggugggcaugguggcacacgccuguaaucccaggugcucgggagacugaggcacgagaauggcuugagcccaggagguggagguugcagugagcggagauaggcgcuaccacacuccagccuaggcaacagagcaagauucugucuggaaaaauauuuacauauaucuuuuagggccucucagaaccugacgcuucugcugagggcacacauuuucccugcuagcugugaaagagauucugaacacuuagcauucaaaagcaguagugccucguagccgauaccaggacuucaguccugaacuugugaacaggaauaagccucucuccucuucaggagauugcaucuguguaagaaagaucuuaaagguaagaggggauugagccccggcacaagggaggaguggaaaagacaguggcuacaauuugaauaccagcuguuaagguauuacgguauuaaccuccagaauaagaguaacaauacagaguccuccuucucugcuugccugcaucuugggugcuguuaaaagagaugauuuaucugcucaguaaauguuuauaaaaccccacuguauauauaaguacuuaggguuccuuuguacuugacuucucaaguggaaugacugucauuuggaccacuuccuaggcagggauugcugcagguuagaugaggguggggggcaggggcgagauaccagagaaagugcccaagagcaccccaggggcaacugccaggcagcuucuuuuucuaugagaugacucauuuuaccaccacgaauugaaaugaggcuugcaugggccauuguagauaaucgaaagaaugucaccacccucccaucugucuucagcugucacagacucacacaccaagcauuucaucagaguucuaguucuucaaguucaucuaggucuuuuugacuggagcaaucugacuuccuacuuuucuuuugcuagaaggugauaauaauugcagcuucauucacucagugcugcauuugcuguuuguugguuuguaauucgaugcgcagucuucuugugucuuugcgggagaguugguuuuagagguggcacacaccaaaaucaugaauggauuuaaggagggagaggcugaacuaauuugauuguuaccaaguccauaauguguuccuugggaaaauuccacuugucuggacugugcuccucacuuucugagauugagaacuggagaaaggaggaacgucacagacaagacagcaagaagcuuaaaaaacaaauuccuggauuuggagcagugugcucugguggaauauuagaugauaaacuacacuuugugguuuuguuuugugcaguuggcuguagaggccacauggcccuguauaaugaccucuucccaagauguuagacaucaaaucaguuugauuucuacccccaugggaagaggaacuccgguuguaaagaggcagcuugagaauaacugguaaagggugacuugccauuuccccgcuggucuugccucccaggaguaacuguuauuugaccacaugacccaguuacaaccuguuaccccuguguggccagggccucacccccccagagcacaccuucgggucaggcucaugccugauuugugccuucuuuccuucucagggcccuccagguugagggaagacagcuuuacaccuccaccuucuguauuagcuccaggauaaacuugaaaacugccuacucugaggguuuuuuuggcauuuuaaaaguuaagucugacuuuccgagcccucucagcauccugccagguaucuuaucuuauucaaauauccuaauugcuucuggggcugcacaucauccuagcaccuaacugacaaaauagaccuucaccugagggccucauuaugcuuucugccugugcaucaggccaaaaauaccuccacaauaccugcucgacauccugggcuuccaagugacaaacaaauaauugggugaaacaaacccugggcgccgagcagcugccaucagugucggagcacagaagaguccacggcaguaacagucacagcgcugccugguucaugucagagcaaaucuuugaacaguggguugugcugacaccagagaaugacagcuuuggaaauggcaugcuaguuacugcugcaagugaggccucucauguagaccaugacaagcggcugucauuuccauacaggugaacaacugacauccuagaagggggagggcgggagccacgcaggaggcuguguuuggcaguagguggggccagacuucggagaggggucccaaguaccggugacccuggcgaaaacuagccuaaaaacacagucucuuuccaugccccuuuacucacuccccacacaucuucucuguuaccucuuuggaguucaucugagagagggcuacagaaauacaacccaacaugcuuaaaggauguuugcauuuucacucuguucccuccacaucuuuucuucuuuuucuuuccuuuuuuuuuugagacagggucucacucugucgcccaggcuggagugcaguggugcaaucucggcucgcugcaaccuccacuuucuggcucaaguuauccuccagccucagccucccaaguaggcuaggacuuacaggcacaagccaccaugccuggcucacuuuuuuuuuuuuuuuuuuuuuuuuuuuuuuuuuugcagagacaggguuucaccacauugcccaggcugggcucgaacuccugagcucaaaaugaaccgcccaccucagccucccaaagugcuaggauuacaggcaugagccaccacgcccaguguccuccacaucuugauaugucagggauuagcuuuccggucgcaaugcuuaguuuuauagaggauggaaaaggcaagguuucugcugauaaggaacucaccaugaaaaggaauggguuagaugaaauuaagugcagaauugggucuagaccggugguucucaaagucuccaucagcaauaucugcauccucugagugguuguuagccaugcagaaucucugccccaccccaaaccuacagaauuggaaacucugggguagagucacaacucuguuuucacaagccuuccagguaguucuaaugcagacgacugugguccagaaaaaacgaggaagaacauuuuggcagugagguuuuguaaaugcucagacgauccacagagucacugggugaaaucauacucuauugcacagggaauaggucuagguucguaguugggcagccuuuuuuuuggaggggacagagucucaaucugucggccaggcuggagugcagugucacgaucucagcucacugcagccuccauauccugggcucaggcaguucuccugcuucagccuccuggguugguuuguuuguuuguaaauaucaacuucaccugaucuguucaaagugccccugcaccuaccauuuccaauccuuccacucucuauagccuugugaacaggccuacucauguuuagcgugguucugacagaugcuaggccuguaccuagggcucugcucaucugaauagaguuugaaaccaugaccuugggccaauguuaugcuguaaccagcugagcuaacuugcucaaccgcuucugaaagacaaacuguuccaucgaguuccuucuuggcaggugcugcaucaccaaugccggccugccaucugugugaagggcuaucacagcacacaacacacacacauacugggcaaaugugccgugauuaccacuaacuauuuuguaaacaaaguacuguguuaauucuguuuuaaacugcuuuauccaggauuguagaacaaugggcagaaguguuuugaaaucuuuuuuucuucuguauugaauauuagaguuuuaaggccauaaaauuaacauguaaauugaguuuucccaaaaaauguaaaacucuuaagaaguuuaaguaaguuaccuaaauaguaaagcuuuuucaguuguccuucaagaauaggcaucuuccaaaacuaguuguguuaaaguagugguucucaaacuuuagccugcaucaaaauuagcuagaggacuuguuaagauacagcuugccggccgggcgugguggcucacgccuguaaucccagcacuuugggaggccgaggcaggcggaucacgaggucaggagauugagaccauccuggcuaacauggugaaaccccguuucuacuaaaaauacaaagaaauuagccgggcgugguggcgggagccuuguagucccagcuacucaggaggcugaggcaggagaauggcaugaacccgggaggcagagcuugcagugagcggagaucgcgccauugcacuccagccugggcgacagaacaagacuccgucucaaaaaaaaaaaaaagauacagcuugcggggccccaccuccagugauuucugauucagcgugucugggcuagggcuccagaacuugcauuucaaguaaccaggugauacugauguuuccaguccccuaagagcacugugugaucuacauggguuaaauuuaaaugccuuuuucaauagggaauauuuucaacagggaauaucacaccacucaaaggugugaaauguaucuuuacauguaagaugaaauugacacaugaaagugaauucaauuuuaucaugaaucgggagcuuuuuacaaaaugaaaauuuucaacucuaauucaauauagaaaauguagaaaugaacccccauauauacccauuaccuagauucauauuaagacuuuuccacaauuauuuuuaggugauaggcuggauagggcgauguccaccuuuuuuuucuuuauugcugaaauauuuuaaagcaugucucagacuucauaucauuuuacgacuacauacuuuagugcacaucuauaaaaaagaacauuucuuacaaaaucacauguuguuaucacacuaacuaaauaugcaguaauuccucagugucaucugaggaauauacccauccaugaucucaucuccaugauugucccacaaggggucauuuuacgugaucugugcacaucaggauacaaacagacacacauacugcaugucuuaaaucuagagugcuccacccuccccagcuucccauucuuucaagucauugacuuguugcagaaaccaggucagcuguccugaagacugccccacauucuggaaguccuugcggugucauuuagcuuguuccucugucccucguauuuccuguaaauggaaguuggccguaaagcuuugauuagauucagguuagaguuccuggcaagaaaacuucauaggcauugcaacgaaccucauguugccucacaucugggaacacacagugucugggugucccaguuuuagugaugucaaaauuauucaguaaguuuagguuguggcaaccugauacuugcauuggcauguuccccgucaagcuuuuaucucauggucucaucuauugaugaugcuugccugaugcaguaauucauuagagauggcagagggugacuuuucuagcauuauuccacauuuauuggcugaaauucuucaguacaauggcacuuucccucaucaacuagaguucuuugguuacacucaaauauaauacaaggaaaaaaguaaaugcucaauucucuccuucuaauugcauguuuucagagcaaaaaguuggugcucuaccaggaguuuauuaauaagucugaacaguucucugcauuuuucuuacaauaaaucuaaccuaugcuuucagugcauugagcuuuucuuacaugguuuguguuuaucaauuggagggacaaaauaucuaaaaauuagaaagguacugcaagaacaacaucgucaaaugaggucauacacacuuaagugugugugaauuuagucauaccugcccuucauagcucuguucaaaugccacauucuccaggaagcccuccuaccuucccaagguuugaaccuuuccuguggcacuuccugcauccugccugucuuuuuuucuuuucuuuucuuuucuuuucuuuucuuuucuuuuuuuuuaagauggugucucacucugucacccagccuguagcaguggcaugaucucagcucacugcaaccuucgccuccuggacucuagugauucuccugccuuggccucccaaguagcugggauuacaggcgcaugccaccacacccagcuaauuuuuguauuuuuaguagagaugagguuucaccauguuagccaggcuggucuccaaccccugaccucaagccauccaccugcccuguccucccaaagugcugggauuuacaggcaugagccaccaugcccacugccugccugucuuuuauugaaguuguagauguccucuuccccuuuucucugaauucuaccccuauccuacccauggugacccacagggugcuuugaauuaaaaugaauuaaaauauaauauccuaaaagugauuucaaacuuuggaauuuagguuauauccugagaaucuuaagugacuugauucaagaaaguaggcaaaaaccugaaucguguuuggucugaucaacccauuuggaauuaaucgaaaaucugaugaucccaacuggguacuuuucaggaaaggagugggaggcugcccacguauauugagugccuacagugugccagggcaccugcugauuuauuugauucauacaguagccuagccagguccgucuauuaccugugagaacacuggugacugguaagugacagugaguucuugccaucuccuguucuuugcccuuucucuuauaccagcccagcauaaagaggaucgggggcuucaguuuggugaauuuaaaaaugucucuuguuaaaggccgggcacaguggcucaugccuguaaucccagcacuuugggaggcugaggcggguggaucacgaggucaggagauugagaccauccuggcuaacacagugaaaccccaucucuacuaaauauacaaaaaauuagccggaugugguggcaggcgccuguagucccagcuacucgggaagcugaggcaggagaauggcgugaacccggccgggaggcagagcuugcagugagccuagauggcgccacugcacuccaaccugggugacagagcgagacuccgucucaaaaaaaaaaaaaaaaaaaaaaaaaaaaagggaagucucuuguucacaacacagcuucucauccagccugaccuguuugaaguaugucugggguggaagauccuggugaugcaauuccagccugggaaaacuugaggagagguucaguauagcaccaugggcggcaggcugucaguguguguuagauguauucgguuacuucguuuuaugggagauuucaugugauacuaagacguaaccucccacaaaaugagauuuauagaauuggguauaugucuaaucaauaaacaucaaacuggaaaaacuguaaaggcauuucaagugauaguaguuauggcuggaaaucucaguggaguuauuuuuuuuuuuuuuuuuuuuauuacuguuuaagccuugacacuuuuauuuauuuagacacugggucucacucugucacccagacuguggugcaguggcacggucauagcuuacugcagccuugaacuccugggcucaagugauccuccugccccagccuugcgaguagcuaagacuauauaggugcauauauacgugcgugccaccacaccuggcuaauuuuuuaauuuucuauggagacaccgucuugcuauguugcccaggcuagucuggaacuccuggccucaagugauccuccuaucccagccuccgaaguagcuggaacuacaggccuguaccaccauacccggcuaacuuuuuaaauauuuuuguagagauggggucuugcuguguugcacaggcuggucuggaacuccuggccucaggcgauuaauccucucaccccugccucccaaagcaucgagcuccuggugcacuuucuaacucacccuucgaggauguguguauuuauaugugucagggagaggaaauugaucuccugagggguggguggaagagcacuugucccuaguuaauccuuuuuugccuguucuuuaaaaagcgugauagauaggccaacccacuaugaguuuucugguggcaaaaguacaagaaaucccugcuauuuauccacuaucuguguagcuuccucuuugaagcaccucaagcccucgccagccucuucuuguccguugcugaucuuuggcucugggugccagucagccucaggggcggugcugccuuuuuuggcagaguaucacuguuaagccacuuuuucucuuuaaaaaaugcuacacagagguuuuugaaccugaaaugcaauuauuuuaaaggcauccucaccacucacuucccgagugcucuguuacacccagcgccaccugccaaccacagugaacauccagccaugucauuucuuccauuccugcccuggaguaaaguagauuuacugagcugaugacuugugugcauuuguacauugcaaccuuagcuuaccucuugaagcauguagagcauucaucacccaccauucauucacugccuacucccaccacagcuguuucguggucugucugcucccugugccacccccaccccaucaggugggccuuuugcaagugaugaagucaccugugggggaagagcuuuccuuuccucuccucaacucagaaggccucuuccucuugcucaagagggugcugcugcuuucugccuccuuccccggccggccuccaucccaguucaccuuuucagacauggccccucagucaacucuucccuuuucuccuggcuuuuuauuucucccagucucuuaagaguauccuuagcuuuaaaaacaauaacacagaggaugggugcaguggcucaugccuguaaucccagcacuuuggagccuggggcgggcggaucacuugaggucaggaguuggagacuagccuggccaacauggcaaaacaccgucucuacaaaaauacaaaauauuagccaggugugguggcgcacaccuuugaucccagcuacuuagguggcugaggcacaagaaucacuugaaccugggaagccgugguugcagucaacugagauugcaccacugcacuccagccugggcgacaggguaagacuccgucucaaaaacaaacaaacaaacaaacaaaaaaacccaauaacacagaaaugcaaacaacagaucuagcccugcugcuucuucauauacuucaaacaaagaaaccuuuuuugauaucuuuuuuucauucccccuuuguauaaaauaccuugcauugguauaucuuuuuggugauaauuaaggugacuauauaacuuacuguccaggccuggacacuuuugagagugaaaucgacuguuucuucaucauuauccugggacaacaggccucacccuggacuguccauguaaaccagggcauauaaucacccaagugaucauccaagguuuuucaguuugucagagugguucaauccacucgugaugauacugccauuuauugaguacuuacuaugagaugagcuuuguucugaucacuucaauuaacccauggaacccucacagugcccuuuugagguagaugguauuaacacuguuuugacugugaggaaacuaaggcugaacaaguugcucaagguuacacaccuaguuacguccuccacacucaccccaugcuacaucagcccccaaggucaacauccauaucuccccugagcuguuagcagagauuucuaaaugucugcucaauuaaaaggaguguacacuguaaacaagaguaucgccuuccaaaguaagcguuuaggguugccugguugucaagggcucaauaacaggagugaaguacuuaauucuucucucaaauaguauguggagccggcucggaacaagcagggcuuccccuaucacuaauauucucuaaaacacacuccccaccccacccacccccgaaauggagucucacucugucgcucaggcuggagugcaguggcucugucuccacucacugcaaccucugcugcccugauucaaacgauucuccugccucagccucccgaguaggugggauuacaggcuccugccaccaugcccagcuaauuuauguauuuuuaguagagaccggguuucaccauauuggccaagcuggucgugaacuccugaccuugugauccacccgccucagccucccaaagugcugcgauuacaggcgugaaccaccgcacccggccaagacacacauuuuuaaaacaaagaaauggaaaagucuagacucuaagcugguuacaccccacacagugaaauucugguuauuuguuucugcugauuuuucucaucucacagguuucucauucccgaagguaauuuaggaugauguuacuuaagaacuggaguuaacuuagugaccagauauuaagccaugaauuucuuggucuuccuaggaaugggaauuuuacacaaguacaagcaucucuuuugagaacuuaggccucucacagaucucuagccugacgucucauucguaucucuuuucuuucccuugcuguugcuguucuucuuccccuacuuuaaaaagccuuuccugccaaaaucugaaucguuacuccacggaguuuauuauuuaggcagauccgaagaucaacacgaagucuuuuuguuguuguuuucuuguauuuuuuuuuuuaaugccaccagggugacaggaagauuuacugaaagcugaacuuauuuuguuugcucuaauauucacaagccucaagaguuuaaggaagugguaaguacacccgcugccucggggaauacuguuaggguaugagcauaaaguuauccacacucgucuccaaaucgcaggcgucaaucuguagggauuaugcagcgggggaagaagguggcuauuacccagaagagagcugcuugagagcuuuucagcauucuuccccacgggcacagagcaucuucucuucauguuccuacaaaguguuauggagaggaaaguaguugguagggaucuuuuuauuguacauauguuuuaacacacacacacaccccuuucuuucagcucugguucccucuaaaaagguccuguucucauccuggccaccagacuucuuccaccaggggucccuucucucuuucuuugucaccaggccaaguuuguuaaccaucuucagaauuacaggacuuuaguagcugaggaauuccuuuuaaagugguuccaaacucagcaccuuuaggcaacacagcacauuguucugcuuuguuaagagaagcuuguuuugaagagcuaggaaaaugaguucaagcucagauuucucuggguagaaaggguaucccauaucagaugaugaugugaagaagcagauugugaacuguaaagugaaaaggucuuaaacacgagagauaagcaaagggguguguauuucagguaacauacaaacacaagggaaacagaccucuggcaucucaucgcaucuauaaaucuggaugauuucaggcaaaaaugaaaacauuugcuuuucuucaaucuugggaauuucuaaaacauugaguuuuuuaauaauaauaauaauaauagcaccauuugcugagccccaaauauaugucuucugcucuacugggcuccugauauacguucucucuagugggcccaggaccugcaaggcugguauuguuacugcuguauagagguucaaggagaugacaugccagaggccacacgacugacgugugugacagccagaauuucauucguguguguguguguguguguguguguguguguguuuccgauggagucucacucuuguugcccaggcuggagugcaauggcaugaucucagcucacugcaaccuuugccuccuggguucaagcuguucuccugccucagccucccgaguagcugggauuacaggcaccugccacaaugcccggcugauuuuuuguacuuuuaguagagaccgguuuucaccauguuggccaggcuggucucaaacuccugaccucaggugauccacccaccuucuuuugucaauuuauccagugaucagguauuugagugccuaccugacauugucugagagacaguggacacugagauguuguacauagcuuugcuuguagcaguucaugaccugcuacugggcuagucagauauugacccugagucuauuggaccguagcucacuuucuuuuuauguugcaaaauugcaaaccuguagaaauguugaaagaacaguaugacaaacacccauauacccuucaccuagauccacuguucuuaacauuuuucuacauuugcuuuagcucucuuuuuuuuagauaagucauuucaauguuaaaaguaucaugaugcuucaguauucaucugcugcacuuucugcauaaucucauaccauuaucauaccuccgaaaguuagcugugauucuguaauguuaucuaggauauaauucauauugaacuuuccuugcuuguuuccaaagugugcuuuuuuacaaaauagugagcuuuuuuuuuucuuucauuuuugaauccaggauucaaugaagaccacaccuuuuugguugauacgucucuuugaccucuugaaauuaaauauagcccccagucccggccccaaccccuuuuaaaaucuuuaaaugacaucagcaguuuaaagagcccaggcugguugucuuuuaggaaguccuacuuugugaauuuccucauggugggguuuguuacccaauuauuuuuuaauuaaaaaaaaauuccauuuucagucuguguucacacugcuuuaugaguccaguuugcuuagauuuuuuguggggguacuuagauguagcugcuuugggaagagggacacguggaaaauauagagggagauggggaauauuuaguucagcauuuuauaugcuauaaauaauuauagcuguauagccaaaugagcuuuuagagcucuggauuccauuggaauuuaaggauuuuucucuuccccucuuuucuuguagagauuaguuuguugccaacaacccuggaacuggcgaacugcuuaaggcauaauguuuucauuaagaaaggauuuaacuaauuagauuugacuagcaagcugacagguuaaucaauaagggaaguggggcucagcaccccuuaaguugggagucuccauuaagucauuauggugucugcuaaaacauucuucuucacaaugauucuuaagaauuuuuacgugaaucccucuaauaaauguuagaaaauccugucccuuucaaauuccguaaagaucuguauuguguucauguauuucagauucaaacuguugaguauuuuagggagccucgcagugucagacaggcccuuaaauauugucuuauuuuuacuuuugaagacccagugggccuguucauccuuugucauguuacuucagcuuuuacaaacuaacuucacugcaguuuauuauuuaaauuuaauuuguucccagauaaaccugaauguugauuaaaaccaguaauuugguuaagugucagaauuagaagaaggauguggaaagugacgagucggggauaggaguagagaacgugagcuucuugagucaccugcaaugggugguguuuuauaaugcucucuucccuaaucauguuaaucaggagauuuuccuuuuggaacuccugacugaaagcuucuuaguuuacacacauguuccuccaggaugaacgcugaaaauaacuuuuucgguuuuguuuguuuguuuguuuuccucuauacaaccccuugcaauugcuuugguuuagaacaccuuuggauucuaaguuucaugguuguucugggagacaccacauucacccucucaacccaagaccuugaagaugggagguuuuucggaccucaucauagaccuccaagggcacuuggaagcucagagaggccaaacugccccaggaccagugggcuggcaaauggcacaccuggauuuggcagaaagccccuagagccugcacucuuagccacucuguuaaaggagcucuucuuuuugagucagacagacagcaggaagcgcccgcuguacagauugucaagugcauagugcuuggaggcauuugaaggaaguaaaaggcucuauuuuuuuccccagagaaacuguuuuaauuuaccuuucugaguuguagagaaaaauacucgcguagcucugcucuuauuuauguauuuucaauaaaacaaacuuguguauuuggguuuuaguuuaacaggucauuggcccacauguaaagcugauuuguuaggagucauuaccuagaaaauaaaauucugaaauaaagaucaaguauuccugaaacuaacguuuuguuuauagaccuuugcaaguauacauguagacuuuuugagaauuugagaaggguuuuugagacagagucugggucugucacccaggcuggagugcaguggugcgaucaccacucacugcaagcuccaccucccgguucaagcaguucuccugccucagccucccgaguagcugggauuaugggcaccugccaccacaccuggcuaauuuuuguguuuuuaguagagaugggguuuuaccauguuggcaaggcuggucucaaacuccuagccucaggugauccgccugccucggccucucaaaguguugggauuacaggcgugagccaccccauuuggcugaggacuucuuuuauaaaugaagauguggcugugauuuugcaggcacauauauaccuuuagguguuuucaguuacuuucauaugugcuuaucagcaauuugauuccauauuugauuuauaacccugcagguguacaaaacuaauauuauaacuagauucucuguuuuauaguaagcuuaucaaaaaucaaggcauagugagaauuaaaacaucaguuuauuuuuggaagaaugauuuuauuuucauccugacuuuuuuuuuuuuuuuuuuuugagacagagucucgcuuugucgcccaggcuggagugcauuggcgugaucuuggcucacugcaagcuccaccuccucgguucacaccauucuccugccucagccucccgaguagcugugacuacaggcgucuaccaccacgcccggcuaauuuuuuuauuuuuuaguacagacaggguuuuaccguguuagucaggauggucucgaucuccugaccucgugguccgcuugccucggccucccaaagugcugggauuacaggcgugagccaccgcgcccggccucauccugacauucuuuauguguaaggugcuaaggugguagcauacugcuaaaacuagauuaguaguacuuaaucuagagggaucuuuucaauaauuccauacauuaaacaauuuacugucuccauuacaagguguaccauugacuuaauacugguuuuuuggggagggagugaguuugagaaacacuaggacguuaaaaacugcuauguugauuguaggauaucuggauuucagaaacguuagcacaugcuugugcaggggugggagagggagaaccugugucuuagaaaugaagaacuaugguacauuuauguaggauaugauaucacauuuuauaauuugucugcuuaaacaaugauuuacagaucuuuugagaaagagagcaaggagguugggccuuuuaguaagacagaaaaaugaccuuccguuuaagacuuagacaaauuaaauuggacuuugaaagugguuuacccuuuuccucucggguaaaugucggaagugagugcccuggcugaacauaagggaagguccauugucagcacccugaaagccuguuugaaaugucaucaacuuggagcauucauuggcagcgacuaucaacagcccauuuuaaaaggaugccuuggguagaauggaaauuacaguggccagccguuaauccuuuuuaauaagggcaacuguugaggagaauuauguuguaagaaugaaugaaauuugggagcaacucuaguccccauguucugucgugacugucaacaccaaauguacuuucauuuuugcaacugccuaaggauuuuccauuuaacaaacuuacaugacaaaugggaaagcaguggcauucccugagaguccaaaaucugguuuggcucugccguuagcacauuugccugcagggauugauguaucugauugaagaauguugaguucagccaagaguuaagguuaagguccuucuauuuguuuugggucaguuccuacagguagagaauuugaaagcccugaagugguuucauugccccuaguagagauaaauggccaaauguaauaaaaauagacagugcuguccuuaauuguccuccccuuuauauaaaggaccugggagguggaucaccugaggucaggaguuugagaccagcguggguggugggcgccuguagucccagcuacucgggaggcugaggcaggggaauugcuugaaccugggacauugagguugcagugagcagagaucgugccacugcacuccagccugggggacagagugagacuccauuucaaaaaaaaaaaaaaaggaccugggagaagggaaggcuagagggcuagagccaguuuguauuuuauuaggggucaggauuuacuauguuaaguuuuaggaugugaaucuggaauuuucuuuuuuuucauguuuuaagaagagaauagaaagaugauagaagauauuugacaccugaaaugcuaccucucaacacauuagaaguuuuuauauagagacaauggauguguuuauuagaaaucuuuauuuacucauaaaggaaaucucccaaggaauauuuugcugucauaccauacauauauuugaaugagaaauggcauuucuuaaaaaaaaaaaauuaccucauugacucauuuccaccacauauuugaacuaaugaauugcuguauggaaauauacuaaacaacuuacagacauccuauugucguauaugugauauaaaugucaacauuuccuaucaaaauggcaucugauguuggcccucuuaaaguucuguggcuuaaaauacuaacaguaggaggaaaauaaacagagaccaaaaugcaaacucaacaaugaguaaaaauaccacaguacaaguggaaccuucuauaauucuguaucccagaauuuuugagaagagaagauaacaucuuaagcauuaagaaaucccaagacccuguccagcuuauugcuguuggagagccccaagacccuuuaaugcuccaguuuagaggaucauauugucaagucagagaggcuuaaacacaauagcaucuucuggaacccuagugaccuguauugagaguggaucuggcgcuuuuguucuuuugagaggcagguguaaaggauaacacacgggauuaucuuauuuuaaagcaucuaaaagccaaucccaucccccuuccucauucucuuuccucucagcuuuuagagucuuugaucagguaaauucuaaaggcagacgcuagugaagaguagguagguaggcuuguguuuucacuucuccgugccagcuuucuguccucacccuccucgucaguuagcacugaugaauguguagaauuagugaaggcuggguauuaacaucgguaauguaacuuucagaaccucugcagugucuaaggggaggaagguuauuuccaccccaccucgugggaauucaaagguagcuuuccgauugugaucagguuaaacaauucccuccaggccagcgugugggaaccugcacauuccuaccaaagcaacgguaauuguacacaaguguguuuucagauuucugucauagcaagcaaaagggaccacagccguguuuguuagagccccaaaugccuguuugccacagggcuggguuuuuuuuguuuguuuugagauggaguuucgcucuuguugcccaggcuggagugcaauggugcagucuugguucacugcaaccucuaccuccuggguucaagugauucuccugccacagccucucaaguagcugggauuacaggcaugcaucaccacacccggcuaauuuuuguacuuaguagagaugggguuucaacauguuggccaggcuggucucgaacuccugaucucaggcgaucugccugccucagccucccaaagugcugggauuacaggcaugaaccacugugccaggccaggcuguuuuuaaaacuuacguuucagagguuaaaaauuugucuuaagauaaaaagacuuucuuaaucaucuaauguaucccaggaucuaugucuugguuuuauaagacaggcuggcaguaaauuucagaccugaccuaacaaguuaaaauccuacuccugggcagaagucuucuguguuagugacaauguggaaaugaaggaaggcuuccauuuguggauaagugugauuggacaaaggccaggaucugcagguaauacaguggaggaaacuuagcaggaccugauuguucagauucuucuauguuccccuccucugggaauagggagggcaccucucaaaugaugguuuuaugguguauuucaggggaagguuagaaaauccuuucuaaauuuuaugaccugcuuuggggaaagaagggugggaaggugagagugaccugcugcuacugcuguuuucucagaucccaacaggccguguuuuaggguaguauguccugaagcacaucgcuuauagaaacaaauaaaaaaauuguuugcuuugugaugcuguccugaucuguggaucuuaauugcuauuacucugagauuuucuuaaagcauauaauucuuuuuaaaugcuuuaugccagccaaaguuagaagagaauccuaaacuuauccuuaaagugcaggauuaucaugguuuuuguagugcagcauuaucugguuggaaaacuaggucagaaagacccuuaccagguugaguuccuccaagcaauuucaaaguccaucuggaggccgggcauggugguggcucaugccuguaaucucagcauuuugggaggccgacacgggugggucaccugagaucaggaguucgagaccaaccuggccaacaugacgaaacccugucucuacuaaaauauaaaaaucagcugggcaugguggcgggcgccuguagucccagcuacuugggaggcuaaggcgggaaaaucacuugaaccugggaggcggagguugcagugagccaugauugugccacugcacuccagccugggagacagagcgagacucugucucaaaaaaaaaaaaaaaaaaaaaaaguucaucuggaggcagcaccgugcaaguugugccuuugaccauuuucccaauuggugauucuaccagugagagagaaauucacaucuuguauuuuuguguguguggccugaguaagagugccaaggcagccugcauucuuaacugauccauuaacuuucuuccuccacagaucguuuccuuaacaaugcucccugauuagaagaaaugucuccucuccucccaguuacucagugaacagcgcucucucccaaggggccacaugaaagggaaacccaggcaccaccuccgggcaggauuagcagccugggaggagccacuuucuguucuuugugaaagcuagagcugcucugcucuugagaacagccauuuacaaaauggggcgaaaacgacggccacacccuccaucacucuuuuucuccuggugcuuuccagagccuuuggagaccugugccggggguggggcuuggagcucccgugccgaugguuaaagguaccauggcugggccagugcggaccccagugcuguuccccacuacuccucugccucucuccacuucccaguuccuuccuggucaggagcccggcagccccaaagacugguaauagccuggccuguaccagaugcccuguuacuuccccaggggucuccuccuucccacacuucaugaugcccaguuucuguucuguuuucuuuccaggaacgugucccuaccuggaauccccaggggggcuuccauguuccauuagagaacuucacauucaacccucguuuucuguuuuaaccaaucuugccaguaaguggugagauccuucaggguaggacccaggucuuacucuucaguaaacuccuaguuucagguguugaaauuuggcagucagucaggcguuguugaaaugaccaguaauuguuucuguacuguagguaauaaagcugcggaaauuauucucuuccugaaaccugaagacuucagaaaugugaggaagccaggccucaagugcccuccucuuucagauguuaggauaagagguugagaaguuguuguaauugaaugaacuguauaagcacaaugucaugaacuucuaauuuccucuugcugaagaucaugacacuguuugcccauuguauguauguauguauguauguauguauguauguauguauguauuuagagacggacucuggccccaucacccaggcuggagugcaauggcgcaaucucggcucacugcaaccuccgccucccggguugaagugauucucuugccucagccuacugcguagcugggauuacaggcacacgccaccacgcccggcuaauuuuuuguauauuuaguagagauggaguuucacucuguuggcuaggcuggucucaaacuccugaccucaugauccgccuaccucggccucccaaagugcugggauuacaggugugagccacugcacccagccuguuugcccauuauuaagcaguaaaaggacaaccaguuuuuuuuuuuguuuuuuguuuguuuguuuguugguuuuuuaguuagacuucacagaccaugaaauucacucuuuuaagggguacauuucauugacuuuuaguauguuccaagaguuaugcagcuaucacuacaauuaauuuuaggacauuuucauucccccaaaggaaacucuguacccuuagcuucuguaccccucauccucccaaucccucagcccaggcagccacuaaucugcuuucugucucuggcuuugcccguuccugggcacuucauauacauggugucauacaacaugugaucuuucgugucuggcuucuuucacuuagcauaauguuuucaaaguucauguuguggaauauaucagcauuucauuuuuaauugccaaauaauauuccauuguauggauaugccacguuuuguuuauugauucaucaguugacggacauucaaguugcuucuauuuuuuuggcuacuuugaauaaugcugccgugaacauucaugcacagguuuuuguguggauguaaguuuucauuucagguauguaccuaagaguggaagugcugggucauguauuagcucuaugguuagccuuuugaggaacugccagacgguucuccaaagugacugcucaguuuuucauucccaccaacaguguaugaggguuccaguuucuccauauacuugucagcacuugcuauugucuguguuucuguuuauagucggugugaaguaauauuugauuguggguuggauuugcaauucccugaaugacuaaugauguugagcaucuuuucaugugcuuauggccauuuguauaucuucuuuggagaaaugucuaccccacccauuugcccacuguuaagugggcuauuuguuuuuuuauuguugaguuguaauaguucuuuauacauucuggauccucgaccuuuacucuuaaaaugaugugcaaauauuuucucccauuuugugaguuuucuuuucacuuucuugauagugucuuuugaaggacuucuuuuuaaaauaaaacuaaagacugaucacucauuuuauuucaccuuuuagugaguauucauuccaaaugacggucaagaagauacuauuuuuuuuuuuuuacuuuuuauuugggaauaauuuuaaacuuauaggaagguugcaagaauaagaauagcacaaagcucauauauccccuuuacccagaucuuuuuuuuuuuuuuuuuuuuuuuuuuugagacagagucucgcucuguugcccaggcuggagugcaguggugcaaucucggcucacugcaagcucugccucccggguucaugccauucuccugccucagccuccugaguagcugguacuacaggugcccgccaccaugcccggcuaauuuuuuauauuuuuaguagagacgggguuucaccauguuagccaggauggucucgaucuccugaccuugugauccacccaccucggccucccagagugcugggauuacaggcaugagccaccgcgcccagucuccuuuacccagaucuaacucuuaauuuguugcuccauuugguuucuauuuccguuucuuccuccccuuccccuccgccaucccccccgcacaaauagacaauuuuuuucugaaccacuugaagguaagauauauaucauaaccuuuuaugucuaaguaauucacugaguauuuccgaggaauaaggguaaugucuuucauaaccacaguacagcuaccaauugcaauaaauuuuucacugaugugaugccuuuaucuaaucagcucuucagauuccaggugacaaaauguccuuuacggcauuacuuuuccccuccaguauaggaucuugucuagugucggguguugcaucugagugaaaaaauuaaugucuauaaggguauuuccuaaacaugugauuaauaaucauacuaaaguguauuaugcauuacagcuuucaaaguguuuucuuguuucuuuauuauuaaauauauuuauuuuuccucauagcaaauacuuagaauagugcuuagguuagcauaguaacuaauacuuagauugguucgugcaucagaauuucuagcaggucucaucugacccaucugcccuuuaggauuccucacauggagaagaggcuuccauguccugagcacuucccuagagaagagggggugaaggagauagggauggaccagucuaccuguugagaaagagacagagaagugggucucaguauccgagguuccuggguugaccugcagacaucacagggccagguccuuuccuuccuagcagugcuauuugucaagaccccugucugucuccccugacagaaacauugcggugguggggguugugggggugcauccagcaugaauucuccuuaucguuuugacucuuccuguucccgccuggcucucauugaacccacuuaaucuucuuccugaugaguuggcccaggcaggcccagcuuucccuuuaacaauuugucaucuuauacaucaccagauuccaaacucucucaauucuagcaauucugcuuuaggauaagaaaaaagcguguauuacuuuugcaaacaggugcaaaguaaauugguaaucguacugaaguacauuaugcauugcaguuuuuuaaagcauuuucuuguuuauuguaguuaucuggccucauaacacacacuugagguagauguggcacaugugaucuccauuuuguccacagaggaacugugguuuaggagguggccccucaccaaagcucacaccugucuucucugauuuugcaucuuaugcuauuuccacagggcugugcuuccuaaucaguuuguuaauaaaacucaguauugugcauuugguaggaauugguuuauacaccauucaagaauaguaaacauuuacacccuagauuuuuaaugaucugagacagcaccgaaguauauaaaaaaguuaggcuccugagcacuuaauucuucaaggaaggggauggaggaaaaucucuaucugcagagauaauagcagcuuaaggguaucuuaaaugggaugcuucucaggacucuuggagacuuagagcuagugguguuuaauaaccacaguuuacaucacucagagucauggaauaguucuauugcauaaacagagcauuuuauggaaacuuagaaacccucacugcugcaggacaaaugcuguacaaaaucgaagaugccaauugucuagauuauuuuccccuaacaauuuuguaugaaaaauuucaaacauacagaaaagugaagaucauuguacagugaacagcuuuauucccaccucuuccacucccaccuguacucucaccaccccccuacccccacaucuagauuaugcaguuguaacauuuuucuacguuaguuuuuuggguuuuuuugagacggagucucacucugucacccaggcuagaguacagugggguggucucggcacacugcaaccuccgccuccaggguucaagugauucuccugcuucagccucccaaguagcuggaacuacaggcgcccgccaccacacccugauaauuuuugcauuuuuaguagagacaggguuucaccauguugaccaggcuggucucaaacuccugaccucaaguaauccuccugcuucggccuccaaaagugcugggauuacaggcgugagccaccacgccuggccucuacauuaguuuuaucacauaaauccaggcuauuuuugauauacuuuguuaauaaaaucauuaagcaucuuugauguuuuggauggaaggcacccuacagucucuugguggcugaguuuccuuuuauuuuucagaaucccuuugaaccccggcaacaugggacagagcugagagcaagggccuugauucucauacucaagccucccgacagcccgcugcaugcgccaggcuucacguuguacucguuuguccagauaccaugaaaacccuggucgggugugguggcucacgccuguaaucccagcacuuugggaggccgaggcgggcggaucacgaggucaggagaucaagaccauccuggcuaacacagugaaaccccgucucuaguaaaaauacaaaaaaauuagcugggcaugguggccggugccuguagucccagcuacucggggggcugaggcaggagaauggcaugaaccugggaaguggagcuugcagugagccaagaucgcgccacugcacuccagccugggagacagagugagagucuaucucaaaaaaaaaagaaaaaagaagaaaaccuugauaaauauuaguauggggauacauuguccccuccccccuuuuucucucaguuaaaaaucugucccagaaugagguuuggcgggacauaugguuuggcgugcuugugggggcuggcagggugagguauguaugguaguguaguuaucuggcaucuuaucugcucacuggaaauguugggcacugaauagauuagucagaguuuccagaaauagaaaauaaagccauauaauaaaugcagaaguccccuaguuaaugucagcuguugugugauaucugcccuaagucauuuuauugccuuuguaagauucuuaaacuguuuaucauuaucccugccuuuuuuaaaaauggaagcaacaucuuccuaaagagguuguuaugagacauuagaaggccugcuuucaugccuaauaguuaucaaaacugaaauucaguauagcaguguugaaggugaaagaagguuuggguacuuuuagguagcaagagagauaauuauaagcuuucaacccaaggucaagauaaauauaaaucuggaggaggaaaaaaaaaaaagaagucuagcuucucauuaguaggacagcguucucauuuuauaagaccuuaauacccaauaggaaauggccgucaauucuguucauuucauauucucacagccugucucucaggugggagaacacagcuaauucuuaggguaaguguccucuuuuagaauaaaaccuuaccaaaggagagcugaaauggguugucccccaaggcugggagauguguuugguucccuuugccucacuucgaccuuucugaaaucaagaaacaaacaaaaugaaaucgacuugugaaaggaugucaaaacgacauggcaaauucaguugguuuguucagaauuuucuuccuguauuuccuuuuugaaguuacaacagucauucaggagcacguccagaggagaagagcugggagggaggacggguggcuucuagagucaaggcuggguuugccuaacccugacccucacgggggugaugcggauguuccgaagaaugcauuagccuuugacuuuaaggaccgcgaggagaguuuucuuccgaaucaagugaaugcgggugcaucacccugucuuccucauucccugugucagggaaugcaucgguagccuaaaugacuuucccuggaacugaagcauguguuggcucuacuguggugcuuuaauguuuccugaaauccuccauuuggaggauagagugcccaggagugagagaauacuguguuauuagaaugcuuguuaagagggaaaaagaaaauagagcauuaacagacaggcaauguuccauucccccgaggaagauuuaugugaccuagaugaacggaacuacaaaucuuggagggacaagagacuucagaaauggcaaguucuuaguuugggaggcuagguauugaaguuuauccaaauuaauuuggaaguuuagaucaguugcaaucaaaauccuuauuugauugacaguggggauggauaaaauggaguuuggauuugaaaaucuacauaggaggaggaaguaauaguauaucuauuuuauuauacguguguguguguauaacuauaacaauuagaauaucauaacacuguuaauagaccauaaagugacaaacuaccccaaaacaaaucccauuuucacauaaaaauuuaauauaugauaaaaaagccuucacaaaucaaaggggaaugaaaggcaagauuauucaucagauaguuaggucuucaucuuacaccggaauaaauucaauugaacugaagaguuaaauauguauuacaaaaaaaaaagccagcagaaaaaucaauagaucauaucaaucacuccucuagaaauggacauuaugaaaaguagaugucaguauggaaaaauacuuuuacuaccaagugauauaaaauguggauugaagaaaaaaggugaaaugacuggcaugcuuuauugccaguugguuuagggggucagguguagauauuuuuguuacuuguuuuccaagaucugugaugugguuggaguaauucaagagaaauguauuuauaauaugcaugcuuuaagguacgucuauuccuacuuuuaaaaguggcagauuuguguuuuuuaaugcauaaauuaguugaauguucauccauccaaagagggauuucuucugauagauuggggugauuagcugaaagacucaguuccuggagaagagaacacuaguggaaaaugcccaacuguuaggggaaugaggaacaacagugcuguucacugcauuccuaacgccggcuuaucagaguuuuguuuucuguuucauacacuuaggaaaguauuguugccacaaagugcaucucugccuguuagaaggauccagacauagcguagacggauugugcaauggagucagaaauaggcuguccugcucccagugagugacuuccccaccccuucauccuccuuguaaaucaccggcauuccugaucacuuuccgugguuccagcuagguuaacaacagaagggaucauuucccucauaacagucuccccauuagucaaaaguuuuacucucaagugacuaaaacguuacucauaacugcuuacaaggagaaaagauuuauuuuccuuuuacuucuuuaaugcacaucugguggagacccugauaagcaguaagaaauggaaaaagcagggaccuagaaagugaaaguagacagauuuggguagugcaugcaggcuaauuaaugaucccaggugggcuggaguguucugguuacauuuuccauggguccagcccuagagcagagaccaugggcaucagccugccccuucccauuauguggcucaagcaccaccgugugccaaagggcgggaacauuagauuuccccaccgcuguaacaucuguaaauuccacaguccauagaaucaaaauggaagagaaccucacguuucugauugccagucagaaggaauuuauuuuugaaacccaguuugcucuguuauuuguagugcaagauagaaauaucuuaaccgauuuuauccaguucuuauuuaaugucugugauuuuaggaggaagagacuauugugucauagguauuugaaauucacaagccccucuccaaccuaauuuuaccgaaauguguugguuuccccuuuccuuaaacucacggaccacaguuacuaaauaguuuccagaguggacugacaugcauuuuucuuuacagcucugucauuacuuucuuuauuaucagagaguacacaggauauugaaauaaccuaaaauccagagaggaggaggagccaggggggugaagagaaguccugaccuauuuuagagcccuugggcuucauagguaaccuugaaaauggaaacacaucauugcccauuuuauugagguugugauuagcaguaaaauauaaugcagacuaauuauuauguugcagccaauuagcaauaaagagaagcauuuuaauauacaaauaauuagauuuuaaaauuuuggcuuugggaauuuacaaagcccucuauuugaaggcuuguacggaagacauucugaaaccaacuuuuugucagauaaaguccauaaagcugaaaacugacaugaggagguauggccggguuuuccugcgucucacagugcaguuaggaggcuuugauacuucaugggcccuucugcaaacuuuccuuaguauuaggaaaugaagucuuccaagucagucaaguuguaaacaugcaaaaaugcugggaguggcagucucuccaaacaaaugacccguucucacugcgguuuucuccuggugcuagaaccuguaacuccugaguugauucucuccaauuggccagagaaaugggcguugcugcuggagcagaugaaaaggcuauuaaggcuuccugaagcacuuagauuaacuagcuuuuuuuuuucucuuggagcaaaaaguuggaacaaguuuuuuguuuuuuuuuuuuuuacuuuuuggacauaugacaaauguguauaaaguuguguguugugccugaggagcuggugaauggaguugcucuuuugagaguugcuuuuauaucauugcuagcugugagguacguggugggcaugaagagaaccagugucagucccucugcagaagcagaggcugugagcuccacugugagcugccaaggcccauacugcugggggaucuuuaaugcauggcgcaaggcuccugugccccaaucccggaggagcggugacaguccagggaagagaggggaccacgugaguguuacauguucuugaucacauuuuucucuauuggaaaggaggauguugaaaguuaaucaugugguuuuucuagucacuuaaguccuuaacacacuggauauacauaguucaaauacaaggaaauuaaccugguuucaaaugucuuuuccucauuuuauggcacauggaguauagagcauauucaaaacccucccaucccccacuuuguagacaacacaucuacucagaagguuuuaacuuaacuuucuguauucuggugauguccacgagguuuugaggccuuuuuuuuuuuuuuuuuuuuuuuuuuuuuuuuuugagagagagacagggucuugcucuguugcccaggcuggagcacgguguugcugucauagcucacuugcagccucuaccucuaggguucaaacaauccuccugcuucagccuccugguuaggugggaccauaggugugcaccacuaugccuggcuaauguuuuuuauguuuugaagagacagggucucaccauguugcccaggcuggucuugaacuccugggcucaagcaauccuccugccucggucucccgaguagcuuggacuacagugcucaauaccacaccccacuaauguugccuuuuuuuccuuuuuuuuuuuuuuuuguagagaugagaucauauuauguugcccaggccccucucaaacuccuggccucaagcgaucuucccaccuuggccucccaaaaugcugauauuacaggcaugagccacugugcccagucacauuuuuuaucuguuaaaaaaaaacaaaaaccaaguuuggauguuaugauguuaguagugugucugguucugaaguuacaggauaggagauagagaaaaauugugaccugcccaaagucucaaagcuaauucuaaauaacuaaaguuguagaaucuuuuguuuggaggaccaucuuaaaggugugaucuguacucagccauuugucugauguguaaauccucagucuguagcuucccggccacguggucaccaaggcugugcuugaacaucccugagacgccuuucaaggagcaccguucugucuuugggcagcucuaauuguuaaaaaaaaaaaaaaaaaaaaaagucuuccuuacguuaggcugaagucuguuccccauguaguuguuccccuuggggccauguaauacaagucuacuuccucuuacaaaagacagcccuucaaauguuggacaacagcaguauucccggcccuccuggcuccccuccccucauccacuaccaaggaagcauggcugugaguuuguucaucauccuuugaaugugcuccaacucaugcacagccccuuuaaaaggaggugugcagaaccugauucucccaguggagcuuaaucaguaccugucauccccauuuucccagugacagauuuuuauugagacagccaacacuuggauugguguugccuuugacgaauuucagguuacugcaaagugaauccaaauaccaacuauuuucaaauaaaagaaaggagaggcaagacuuagcagcagcaggcuuuuuacaguccuucagguuucaauugugggaccuuacacguggugcuauugcagcuccaauuuuguuuuuuucuuuuaacccaucauuucagcuuguuaaacuuuggagauucauauucugucauugagaguuguccuuccuuccuuugcugcuucagaggacuuagugaugccuuuauuagagcuuuuacuacauugcauuauggcucuuuaugucuuuccuccugaguucugcuaggaucauaaucaugucucaucauauuccucuucucucuucaacacugacagcucauaguaagugcuuaauacauuuucauugaaugaaugagucaaaaguauuugcucuuccaaauucugcuuauugauaguuuauuaauaauuauauauuauucaugcuguuucaauauuuaucguacuuauuugaauauauacauuuauauuuauauaaaguaauaaauguggguauuuuauuaauaaauaaguuacuuauuaaguacauugaagaggacaauggcuagaugcuguuuugcagcccacuagaaacuuuccccugggccaggcgcaguggcucaugccuauaaucccagcacuuagggaggccaaggcagacggaucacuugcggucaggaguuugagacccgccugggcaacaugguaaaaccccaucucuacuaaaaauacaaaaauuagccgggcaugguggcauguaccaguaauuccagcuacuugggagggugaggcaagagaauugcuugaaccuaggagguggaaguugcagugagcugagaucgcaccaccacacuccagccugggugacagagcgagacccugucucaaaaauuaaaaaaaauaaaaaaaaaaaagaaacuuuucccugggaugacuguugaucuguucuuugacauucuuuuuaagauaagguuuauuuuaucaggaauuucccuaauuuuauagucaguucuguuacaacgcuacauacaguuuccuuaaaaucaccaugcuguucacagugguacaaaugaagccauaagacuuaugggagaaaugggauuagggaccaaaaauuuaucacugacagaaaaaaaaaaaacaggaacccaguaaaaacaguaacuuaguuuuacacaugcuaaaugguuaagaaauaaauaggccgggcgcgguggcuuacgccuguaauuccagcacuuugggaggcugaggcaggcggaucaucugaggucaggaguuugagaccagcuugaccaacauggagaaaccccaucucuacuaaaaauacaaaauuauccgggcgugguggcacaugccuguaaucccagcuacuuaggagacugaggcaggagaauugcuugaacccgggaggcggagguugaggugagccaagaucgugucauugcacuccagccugagcaacaagagugaaacucuaucucaaaaaaaaaaaagaaagaaaaaaaaaagaaaugcuacaauaaauauggcaucuaccuuguaaaaagccugaaguuugcucaugggagcugacaugaggaggguuggagccggugguuauaguggcgugguggaaggaggauuaucugaacuuggaaagaagguuguaacagcagaucugaaugugcuacacucguagcacacacagucagcugaggaaggcaagggaugcuugaggcuguaugguuaauguauuccugugggcuccagaaugcggcucaguuuucuccauucaccuuguacuuuuugcagacaaaauugcaccuaagcaaacguuacauucacauuagaauaaacucacauuucaaagcaagugucgcagcagcuccuguuucuuuguuguguuauuugcuugaucaguaaagcaucuuuuuuguucuuauaguaauuccaggcacugguauauaaggauacauaaauuauacuacccacucacucucuaaaacucuuguucuuaaagauuggcuuauuuuugcuaggaggaaugaaaguacauguuaaagagacauacuuggcugaucuagccauuuuccaaagucuccccccgccagaggaauaucucauaagucugguuccuaauuacauuuagcagauuucucuaaaaucuaaaagcuggaguuugaaugguucuuacuuuucagcuaguaucuaaaaggugauucacuuaggagcagcauagaggagaaacuuguauuucaccuaucaaguuucugauuuaaaagugaaauuucagccaggcacgguggcacacaccuguaaucucagcacuuugggaggcgaaggugaguggaucaccugaggucaggaguucaagaccagccugaccaacauggagaaaccccaucucuacuaaaaauacaaaauuagccuggcgugguggcgcgugccuguaaucccagcuacucaggagggugaggcaggagaauagcuugaacccgggaggcagagguugcagugagccgagaucgcgcccuugcacuccagccugggcaacaggagcgaaacuccaucucaaaaaguggaauuucaccucauaucauuuacaugugugugauuugaugauggcuuuaacugaaaauagacuaaugccaauagaaucggagacucuuagaacuggaaaggaccacagauaucaggaagcccaaacuucucucuuuuucagaugaagaaaccaaggcucugcgaaguggaguguuacaugcacagucacuuagcuagugguaaagccagaacuugaauccaguuaauuuugaaacuauaauauguugccuugcaaaauuguaucauagaaggacauaaaaucugugcauuuaggaggaaaucuaaacucauauuauuucagcuuuuuagucuguuuaguaagggaguuucaccaauucaguuacuacugauaauaagcuuccccuuguuuuauuuuuguuucuuuaagaaaucugggccggacacuguggcacacaccuguaaucccagcacuuugggaggcugaggugggcggaucacaugaggccaggaguucaagaccaacauggccaacacgaugaaaccccaucucuaccaagaaauacaaaaauuagccgggcguggugacacgcaccuguaguccaaacuacuugggaggcugaggcaggagaaccacuugaacuugggaggcagagguugcagugagccgagauugcgccacuguacuccagccuggcugacagagggagacucugucucaaaaaaaaaaaaaaaaaaaaaaaaacuaguaugacacaaacucaccaaaguggcuauuccucagacucugugcuuuauaaauucacguuuguuagggcagacagaaaauucuguuucuuuguacccaaaaagauuuaagcauuugucgugcauugaucugggguuuugagggggaaacauccuugguuaugucugugggauuuguggugccuucuggaggauuaagaugucauugccucuagucagggcaugcucucuuuuccaguuggugggucuuauuuuguuuacaucugcuuccucccagcacugacagauuugaaaugugugccugaagugcaccuuugugccaggcccauaguuuugacuggggcccucaugacccauuggccauggucacuuugccugggagcaaucaucauuucuaggguauaggaacuugaagcaaagaauuugcugcauuuucaaaaagcaggaaggggugguuaaaguguggauggagggguaaucuccccccacccccgccccagccccuguuuuguaagagaggcuauccaacucauguauuuccagccccgaguguuggcaaaaacauuuucauauuguucucacuuuucugacugaguccaaaaaguuccugggaaacagguuuuguuuuuccucgggggauguuuggauuugaaaacaccaaauuucaacugcaaucguuuguccaagugugguguugaaaguacugucuagaucugaguaaaucagaaucugaagaaauauagccaacgucacucauuaacaauggguuuuccaagggugagugacaugaggccauuugucugcggugagguagaugcgcuccucuuuucaguggcccccugaggccaccaaugucacgggcaagcacauccucgguuuggggccauuagcugaaugcccucuguuucaucuugccuuuucuaggccgcccucuccugucuuuaaggucaggguuucagaauguccuucaguucugcuuuagucaggacuaaaagccuuccacagugccuugacgaggaggacauauaaggaagaggcacaauucaaguaaagucagucuguauugauuuugugaacccggggaacaguaagccagccuucagugccgccuggcugccgggcgcaugccguugucagaccgaugagcgaggcuccaugcagacaggugacauauucgagguggcaagagcagcaagagcuucuagauccugucauuuugcuucugacagugucuuugugucuuuguacaguuggaggaccugacugacacgugagccccccuuggcagccaucaucuucagaauacugcuuuccucccacgggaggagcuuguaccucucucauguguacagggugcuuaugugcucaugagcaggcaaaggagcaggggacgguuucuuccagaucacccuuccaggugcucuggaguugauguggccuggccaccuuuucaucaucgccccuccaguuccauugcagugaugcauugcaggcucuccucaggaaaauggugauuucaguauuauauuaauaauuagcaauuuuuuuuuuugcaguuuuaaaaaauugacucuuacccucugcauuugagaaaaguccuuauuauacguuucuguauuguaucaucucccaguuugauguguauguaucccgauuguauuucacuaucauuacggagauuuuuauugugucaagacaaaacccuguuucugucuccccagccccauguacuuugagcuuagucauucgggcaucauuucuuccagcauucacugcuccucaguguuucauuuccauuuaauuuuucuauuuaguuuuuagcaguucucguuggcuaauuuuaaaaagauuuguacuuugauuugcuuauaaugaguguuuuaaguuaccugcugacugcgcaguuguuugacuuuguaucagguuuccggauuuaaagccaguguucuguugaaaauuuaaauacuauagaaggcugaaaauaugaauccucugacagcuccucauaacaauucccaggguagcagcuguuuauauuuucuuauuuuuuucuuucuaugcacauaaaaguguguuuguccucauaaagaguguugacugcuauagacggagcgugcagaccacaggcguauaccuggaggcuucucccaccuuugauuauuaacacugcucgccuuuaacauuauuugcuuuugauugcucuuuuuguuauacaaaaauaaccaagcuauuagaaucuuuuaugauuuaaaauagaacauuaguuuuauuguauauugaaaauaguuccuuaaacuucauaauggcuuccaauuauuucacacuugcuugcguuauauacuauuauuuuauugcaguaugauguccaauuauggaaacaacuccagagagacaugauuuuucuggcuuaacauguaauuguuuauugaguauuuuucucauuaugauuuuuuuccuuuugaauugcaguuauaaaggaacuugcuuagauuuuguaaauuauuaugugguuaaagaaaucaacgauuuaucaagugcucacucuguggaaggcaucgugugcagaaucgaaguaaaggcaaagauugaaagaaaucauuccucaaaaaaguuguguguauuaaaauaugaagagcaguaagguuuuuuguuguuguuguuguuauuuugagacagagucucacucugucacucaggcuggagugcgguggcacaaucucagcucgcugccacuuccgccucccgguucaagcgauucuccugccucagccuccugaguagcugggauuacagguggcugccaccaggcugggcugauuuuuguauuuucaguagagacgggguuucaccauguuggucagacugaucucgaacuccggaccucaggugauccgcccaccucggccucccaaagugcugggauuacaggagugagccaccacaccuggcguaggauuaaguuuuauugucauucaaauaugaacauauuuaaucuuguauaauaaaauauaauuuauucuauaagaaacauaauguguugcuugcuaauaccaaggacauuaaguguagacuagaaguucaucagagcagauggcuagcaggggcugugagacuggauagggguuaaccgugaggcugaaagaugggauucgaaagugcaccugugugggaaaggggagagcgcaggaucuuggcgcacuggacgguggcugaaggagagggagaggggggcaggccuugaugaggaguugggagggauucugucugugaugagaagccacuggagagcuuuaaaccagcuuuugugaacacggggaguagcaguguuguuauaaguagugauuauugucagcaugaucgauuuacauuuuaagagcucacucagggugcuggcggacaguggauucuguaaccauuauuuuguuuuaaauagcgucacauaagcaauaauuuacccaugaaccaccaguuaauauugggggaaugaaaacaauggaugcugugauucugagcuuagaugauggggacaggacagagugggaguggaagggggugggugugauuuucguccuguugagcuggagguaaugguaggacagccagguagacaaggcccucaggcaacaaggccauuuagguuaauuuguguagcugcuucuugaagaagaaacaaaugaaggccguauuaccuucugccuucuuuuuugaaagcaucucugaagauaaaguucaggugauugcaggaaaguagaagucauucugacaugcauuuccgaagcaucaacuugguugucugagagcauuucccuuccaggauuauaauugugagugguaagcagcacuaguguauuggugacuuacuccagcuguauccaaggacagguaaaacuucccacugucucuuucuagaggcuacuuuguagcauuucagaugugaaaggugacuccagcagagagcucaucuauuuauuauuuauuuuugagacggagucucacucugucgcccaggcuagaaugcaauggcgcaaucucagcucacugcggccuccaccucccagguacaagugauuuugcugccucagccuccucaguagcugggauuacaggagcccaccaccacaccuggcuauguuuuguuuuguuuuuguuuuuguuuuuguuuuuguuuuguaguagagaugggguuucgcuguauuggccagcuggucuugaacucuugaccucaggugauccgcccgccucagccuccccaagugcugggauuacaggcgugagccacugcgcccagcccagcgagcucauuucuuuauuuuauuuuauuuuauuuuauuuauuuuuguuuuugagacagagucucgcucugucgcccaggcuggagugcaguggcgcgaucucggcucacugcaagcuccgccuucuggguucacgccauuguccugccucagcguccccaguagcugggacuauaggcaccugccaccacgcccagccaauuuuuuuuuuuuuuuuuuuuuaguagagaugggguuucaccauguuagcaaggauggucucaaucuccugaccucgugauccgcccgucucagccucccaaagugcuaggauuacaggcaugagccaccgcgccuggcccagagagcucauuucuaacaagcuauuaucaccauccucacugcuuucuaaaccuuauagguauguagcuucaaaguuuauauuugaacguuuuuccuuuauugaugacaaauuaaggauaaugaaaugaaguaauggcaagcgaugaaauaauggcaaaagauuuuauuuuccuacaaaguauuuauuacauggauguuuuauagaaaaucaauguaaagguugauagacuuguccuuuaaaaaagauacauuucuucaaauauagggaacagcagaaugcucccugucacccccuuuguaaaaaccucuuucagcuuugcagccaucauggcuggggauaaguagauuuauuucuucuguuccuaaagauuauuauagaugaaaaucauuugguguggagauucuucauuuacagcuacguaggauguagcacuuaucaaaauuucugcaaaucaaggagaauaguguucaugaaccuaccagugagauauuuuaaaagaccgcguucuggaaaagugaaggaggauaaagaagcaguguucuucugagggugcuaccaacauuugggacucucagaggcccuguagcccaguccccauuccacuccauggguaacaccucaugguucuuucauggguguucagcauucucuugaaugcuuccccuaaaggcaguuuguucuccugugaggcagccuaguccauuucacuugaaaauuuucuucugcaauaugcauuguuugguccugguucuguccaugaugccauuuccaaucaaucugcuuccucuucagugugagaagcaucagguccuugaaggugcucacaguuguacuuggggcaaggcucuggaacucccuuuucugcaugguccagugaaucugcauagagccggacugggaacagugccucaaacaggagcucccuguugcuggcuuucgugaauauguuguuuuuggggguagcuccuaaucuggugaacaucaccacugccucccaccaccgcauccuguccaaccuacaugucgguagaggacccacccuaggaaggaaugaaggaaagaauuucuaagguugggucuugggaagcagagacagagaaggauccgcagccuuauggacagccucccucagcaguggggcuugcugaggcucuuuaacccucccagcagugcuguagaacagcucugugcaaacuugaaugugcauggggcagggcugggcggcacggggagggggguccgcgaauguaccguccuaacaagcuccuggaugaugcuaggguugcugggccguggaccacacugggaauagugaggcuguagcauacaucgaagucauagugugagcugguagauuguuugggaccagaaagaucaaaacuuacuuagaaaaaaaugucaaaguccucuuuucccugcuccuccuccucuaacuuaaagaauuaagggcugugugauagccagaaagcuacuuucauggauucauuuuagcagcaucucuggugcucacgcauaagcuagucagggagauugcaggggguuggcagcacccagguccccugggccauagcagguugugugaacagacuugaggagaaguuuugucuucuguccucaggaguacaaacaggcaugucugaaugcugacagagaagucaucgccaaaggauaguagauauuacccaaggcaaagccugcuucucagugaacuguugccuaugggacaagaaugauacugggaaaacagugauugcuuuuaggauauuugauaaagcucuaaaggaauagaagagcuuccaccuacacuacacuccaagugacagcugugugaacuugguggaaaacuugacugaggucgcugagacugcugguggaaauuaaucacccuccugcucugcagugauauuggcaaaagaugagcuuagggccagagugguccacaugccugggugucuguggucccuccccugcagaacagaaugaaacagucacugccauaagauaucacagacacuucuuucuacuaggguaacuuggagccuuucuuuggcuaccuggacccugaugagaggguaaucuggaggaauaggaagugggcacagggauagugcaugguacaggugacucgggugcggagaguauguguguguagggccagagcuaagaaaaagccuaggauaaacucgacagauggaaagucuuuuuuuuuuuuaaacagggucucacucuguuuuccaugcuggagugcaguggcauugauuacagcucacugcagccucuaccucccaggcucagguguuccucccaccucagccuccaccucccaggcucagguguuccucccaccucacccuccaccucccaggcucagguguuccucccaccucagccuccugaguagcugggacuacaggcacacgccaccaugcccggauaacuuuuguauuuuuuuguagagacaggguuuugccauguugccuaggcuggucucaaacuccugggcucaagugauccgcccacuuuggccucccaaagugcugggauuacaggcgugagccaccacacccguccaacagauggaaauuccuacuuugccucuuggcaugcauacccagccucuuuucuaaaugggucucagugauuguccaaugugugccccaaaucagaugaaauacaaucaucagaugcaaagcaggaaggugguagaugacggacaguauguaagucggucuuugcugcuaguggcuuuacuucauccuugagaaaaucaucuuugguaaagucauaaguguugaaacucgaaacuaggguuuacccuagacccacccauuggccaaccuuaaugggcacacugacuuuuuaagagugugaaaguuauuagcuaaaugacuuguuccauggccccauuauaucacagacauguugaugucucuguuaucaaaagacgugcaaaacaccccaaaaucguugaugacauuaacagguaaaaugacaggggcgcguugcaacacagaaugugugcuucagauggugaccagggcuggauuagccucaugguuauggcccauuugggguguggacaucagcuucucggaugaagguguuaggguuagcagagggcagcgguaggaaggaaggugucagaucuauaaugcaccccaucugugagccucgcggcuuugccuuccacacaauauuuaguaauguaaauacuggaagcagggcugccuguaucuuuauuuuauucaacuuaaugugaaaagcaggaugguuagauacugggaagacuaucuuuuuaauuuuuuuacaccaaacaucuaaaauuauuccuauucagugccuuggucucacccuugggaaaauuuccaaaauaagcuaacauuuuccccauugucuucccgccuaaggaaugugugcuguggcuuuuaggucaaugauagccuuguccuucaauuucaucuuuacucagaguaggcgugcuguguggugcaaauccauacauguuuguuugaaaauccuuuuagaaccuugccuuguuaggaccuccuacaccugugucacagacacagaaguaccguguuuaaguauugagcauacacuaguuuuuugugacagaaucucacucuguugccaaggcuggagugcagugggacgaucucggcucacugcaaccuccgccuccuggggucaagugauucuccugccucagccuccugaguagcugggauugcaggcgcgugacaccacaccaccuaauuuuuguuuuuuuuuuuuaguagagacagaguuucaccauguuggccaggguggucuugaacucuggaccucaagugauccacuggccuuggccucccaaaguucugggauuacagguauaagcugccacgccuggccugcauacacugguuuuaaggguggcugugcuugggcuguguaugugcguaguacacagugucaugugagcacuuaguuaacagccaggcagggguggacaggccaggacagcuaagaaucgcggaaggagucuggggguagcaggaaggcugcacugggaauggaaagcaagcaggagaugaucuuauccagaggaagcagcuaauaaauauugaggcuggcaggaggauacaagcaaacaaacaaaaaguggggccgugucuuuaaaagcuuucuccgaaaccaauauuuggaguuuuccuguguucuuggaagugacuggagauugcauccuucauaccuuauuucuccugucaggucucuacauaucacaucacaggauucagcugauauuggccuaagacccuuggggucggugcagugggaacguguuauagauauaaaugccuuaccguugauaacucagaauaagauauaggauaucaucauuaagucugauuaucuaagcuuaucugugagccuuacagaaaacaaaaacgaaagaucaggaccacagguucuuugacuaccauuucccuauuuuuuucauuuguccugaacagggccuaacacaaagauaggcacaugaggcaggguaguacaaaugaguuuuucccccguaugaagugacaaucacauggauuauaugugaccuugacauuguugaguuucuaaagacuuuuuaaggaugccauacccacccccaauagaucacaaccuauuucucucauucuaauguuggucauuugauuacauaguccuuuguggcucuguuugcuugagacugcaaaauaaacaaaauguuugcaaguccagguugacccuaaaagcucuucauucuguaggccaaagccaugauucagagaaccuguggucuccacagucaagauugugguugauacaccccccuugaaggcagauguuuugguuuuaaggcaucaggaaugugggcaugugcaucaggauugauguguuuuggugugggguuuaggagcaauaaacuugaaacaaguuuaaguacacucaacugcgguguguugcuuuuccuuuaaucccuagcagauuaaccccuaucaggguuaaucugcucaacuagaugauagccaaacuagcuucucugauaacagcagccucuaauccacuggacuccacacagcucucccagugggcugcugguguuuuggcagaugcaauggcuauuuuuuccuauuuaggauuuugcuuuuaauaggaacccugaaggcccucagagguuugugauacagacuucagcccacagcucagccucccagaugguaauuaauguuuacacaacaugacaagcacaaaauagaaucucuucgagcccugccaagcacccaucauucccccugaucuuccacucuugcaguguuugaaaauuaauuugccuugaacaaacaguggguuuuccucaauuuauuuguacaguuucagugaccaagaagaagagcugcaagacugaaugucauccuuccauucguucaaguaauugaaucuucuaauggaacaaacuggucucugcuuaaugauuugaagaaaagagggagaggaggaaaauaaagugaaguguauguuagagaaaguggacauuuuucugcaaaacaucacugaauguagaauuuuggagauacaaucaaaacuuagcagggggaauuuaaaguauugcuaaauuaacucaguagggcgguugggguuuuaauacguauauacaaugugcagucuuugcuuaaaaagagauuuuguuugaggcaacagaauagacaggugaagguaauuaaauaaugaacauuggccgggcgugguggcucacgccuguaauccccgcacuuugggaggccgaggcggguggaucacgaggucaggagaucgagaccauccuggcuaacacggugaaaccccgucucuauuaaaaauacaaaaaaaaaaaucagccaggcgugguggcgggugccuguagucccagcuacuggggaggcugaggcaagagaauggcgugaacccaggaagcggagcuuacagugagccgagaucgcgccgcugcacuccagccugggcgacagagcgagacucugucucaaaauagaauaaaauaaaauaaaauaaaauaaaauaauaaugaacauugauugggcaggguggcucacaccuauaaucccagcacuuugagaggccuaggcgggaggauugcuugagccuacacguuaaagaccagccugugcaacauggugagaccucauuucuacaaaauauaaacaauuaaccagcaugguggcacaugccucagccucccagcuacuuggagacuaaggugggaggaucauuugaguccggggagucaaggcugcagucugcugugauugcaccacugcaucccagccugggcaacagagugagacuguguccaaaaaaauaaaauaaaauagacauugcuaccagcuugagguaauugcauguugauucacagaaauuugauauuuccauaugucucugggauugccaguguuuaaacauuucagucccuuauuaauguucgcacuuuaaagucuggguuaauuuucuuauuugacugugaucuguagucuuucuguguggugugcucuuuguggcuuugucauuuggacaguaacgagagaagcuaacuggaagauggaauaauaaaaauaggacaugucucuuucuaagucauaaggauuagauauucaaaaagauacggaugaauggaugaugcauggauggauggauguucuaggagcuagugccccccacauaguuuucuugaugccuuuggaagcuucuucagguuugcugcgguaaugaccuuguaguuaguaaguccuguuaggagacuucguaacagaauaugaagaugugaagaccagaagugcagaagcuguacuuugggagaguugguuuuuuguguauuuuuguuuuuguuuuguauuccuccuccuccuucaucaauauucacccuuuccuuucuguccaaauaauacccaguuagaaccaguuagaaauucugaagaacagguggaagguuuaauaugcaccauguucugaugugugccuguagucccaucuccucaggagacugaguggggaggaucacuucaccaugugaguuugaggcugcaaugggcuaugaucacuccagcgugggcgacagagcaagacccuuuuaacuuuuuuuuuuuuuaaacacaugcaccauauuuuuaaaaauuaaaacuaugcaccauacacagagucaaauauuuaucuguccucuuggugaagagauuuuuaaaaaaucuauucaauaguccaggcaugguggcucacgccuguaaucccagcacuuugggaggccgaggcggggguggaucacuugaggucaggaguucgagaccagccuggccaacauggugaaaccccaucucuacuaaaaacacaaaaauuagcugggcaugauggcaggccccuguaaucccagcuacucggaagguugucagaagaaucaguugaaccugggaggugaggcagaggcugcagugagccaagauuaugccacugcacuccacccugggcgacagagugagacuccaucucaaaaaaaaaauucaguagguaaggcaauuuaaaaagacuugaacgaucacuuucucaguuggcuuauuuuaaugguagagguguauuguccgcgaaaagaguuaauuuuaaaauauagcaucucuuuuuuuacuuuaacaauaauaauacucuuauuuacuuuaauaaaaauuuaauaaguauacuuuacuaauuacaguaaauaauacuauuauuuaauaacuauauauaauuauuugcuguguuuaauaacaaagugaacauugacuuuaauuuuuauauugugcuuaacuuuccaaauuuucuauaauauucauuuguuuugcacuuuuccuccuccuccuccucaauuuugaaaguuaaaagcacaauaugagaauuaaagucaauguuuauuucuggaugaugggacugcaauuaauguuuaucuuuccagucucuuuucugugcauacuuguauacauuuacacacguaguuuucacuauugagaucacacugauaauagugcacuuuauuuaauggcaauuuugucaugagauauuuucugugacauuaaauacuucuucacaauaguuuugggaauauugauugauuacuuacuuauuauguguugugcauuguggaaagcacuuuacauggccuaauuuauuuccacaaccacccuaggagguuguuacugcauuugugcaguaagucauuggacuuuuagaaguguaggaguucaucagaguauaccgaaucucaacccuaccagacccagcauaauaauaagaaauauuuuauagcgcauucauuuuuuacuuucuggaaugaaauagauacuuaauguacccaucuacauacauaauuuaaaaguauauauaaagcccuaauaaaauauaaaggagaaauaaguggaaaccaagucauuuauaauaacauaccuuuaaguauguaagugcuuguuuauauuagaagacaauguuugacuuuauaucuagaaugguaucuaaauacuucuacuacaaaugcagacucacacaaauacauggucauggagauucagauaccuggagcagccuuaccauugugucaugauuuucccaaauagccaucaacccuugcauaugacccagauauaacaaaguacagucccugcauuccuggaaaaaucagcguauauuaaaacccaugcaaagaauuacuuuguguuuauauacaaaaacagaggugguggguucuaggguuuucagcugcacaaaugucggguggaauuuaggaagugcauugagauguugucgugugggguugcugcgcacguugcagcaaaucagacaucccuaagagccaccagugaccugcagucauagugauagccacacacucccacaaauuuccaucucuucccauagggaguaguauccuccaaugggaacuaucuauuacgugacugacuuaguucgcgcuuuuuugcacugaaaaacacuuugaaaaaagcaauuuugugggggaagccauuucugaagguuuacaagcccuguaauuuucuuguuagguucauucccagguguuaugguuuuuguuauuaugaaguggauccuuucuaaacuucauuuucugacuguugcugguguauagaaaagcugagguugguugugguuuuucuuuauuuggauaucucauugcacucucuuauuaguucuaauauuuucucagcugguugccucuguuuuccagcuagguaauuauauuuuuuguaaacaguuuuuccucuuucuuuuguuguauaauauuugcuguugguuuucaauuuaguugacaggaauaauuuguuucuuaaagguuuggccaacauugucugugaaacagauaccuuuugggaggggaggugaagguuuggauuauugaguacuuuuuccuuuuauuuugaugauccuguuggguuuuuaagucaauuuuagcaauuuauauuuuuucauaaaauccauuuuauuuucaaauuuauuacacauucacagauuacauuuucuuauuuuuuuaugcauauauacacacacacacaccccaguucccugucuauccaguucucacuccucccaagccccuaaacagguagucacugcuguuacuguuuucuugaguauucuuccauggcuucuuuuuuuuuuuuuuuuuuuuuuuuuggaaacagggucuugcucugucacucaggcuugagcguaaguagugcagucucagcucacugcacccuccgcccaaguagcugggaucacaggcagacaccaccacaccuggcuaauuuuuguauuuuuagcagagauggaguuucaccauguuggccaggcugguguugaacuucugaccugaagugauccaccugccucggccucccaaagugcuaggauuacaggcgugagccgcugcgcccagccacacggcuucuuuguacguaaaauaagaugaauauauauauuauuucccuccauuuuccacaaaagauaguaaaugcucuacguuguacauucggcauucuuuuuuacagcugcaagguguuccauuguguggaucugcaaacauacguaaccagucuccuaaugguuacauuuagguggcuuccaaacuugguauucaaaccaugguacuauuucauugugucuguagacuaaauccuuaacacaccacaccaagggaacuccauuuguuauuuugcuaaaccuccacagagguuguagaguuugcauucuacuaguaaaguacaaaaaaagggcccauuuuccccaggcaacuuguaucaaaccuauaucaaaaugaaaccaauuuuuccuaaucucuuaaaguuuguuuauugagguacaauuuacaugcaauaaacucacccuuuuuaccguaaaguacgcaauguaauuugaauuugcauguauuuuaguauaagcaugaugaacuauuuuuauaaucacaagaagagagaguuuuaaaccccaaaauguaaugaauacaacauuuaaauaagacuacucaauuuguacauucuuaugucuuucaaauucagcaacuuucauucuuuccuuuauccuuuggcaaauucagaguaugcagugcaauaccaagcgauuucuuaaaauguguugcugccaauuuuggagaaguacaguaagacaaauugacugucaagauggaaaagcuuaacugggaagauacauuuauugaauaauugaaaggaagaggaaaugcauuaccgauuagccacaaaaaugccugacgccugugccucaagagacucuuguaaauggggagucauaaaacuguuucagcccccgaaguucuuaccagcucaaacucaucacugcuuuguuuauagguugcaguaccagagcaacgauggacugauugcuuucagggcuggcugaagugcaguguuacagccacucuuuguagcuuuacuaacccucuacacuuuaagucugauguacuuaaauauuuuaacugaauccuggauuuaucauuaccugcuuugcuuugagacuucugcuuuuuaggaggcagcauaguauagauuggagaaaaggcaguugguguuggcagaguugggacuggaacucaagccuucugguuuacaaaacaaggacgugacuuccagcaagcaaguuccuucacuucucugggcauauucccuaucuggucagagaguguuagauuagauccugcuacucaaaaugugauccucacaucagcagccucagccuuaccuagaagauccucagaaaggcagaaucuagagccgcaucccagagcuguggaaucuggauggggauucuaaucagauguucaggugauuugaacaugcauuaaaguuaaaggagugccguacagauuugcaggguucccuggagagguuggggucuucccuucaucucugguagcuuguuggagguggugcugacggccacagccuuggcaccacuccucauguucuagcugugguuagguugagauugagacagugaggcaacagaggagacaagaaagucaacuccaguggccuuuccggggccuugggaagcgagcccacgccugcaggaugccaucugcaagcuuggcuguguuauccaaauucuugaggcucguucaagaacaaggagguaaacagagucaagcuagauaucuguaguacuuccuuaugugucucugaugugccuccuuaccagcauaaguaagugugaaugauauacuccaagugguguccuuuggaaaaggaagcugauuuugggagggaauuugaauguauacuuaccaagauagaaaguauuuauugaugucuucaccagcccagucuggagaaaacagaguaauacaaaaagauuuuuuuuuuuuuuugagacggagucucacacugucgccuaggcuggagugcaguggugugaucucagcucacugcaaccucugccucccagguucacgccauucuccugccucagccucccgaguagcugggacuacaggcacccgccaccacgcccggcuaauuuuuuguguuuuuaguagaggcaggguuucaccguguuagccaggauggucucgaucuccugaccucgugauccgcccgccuuggccucccaaagugcugggauuacaggcgugagccaccgcacccggccuacaaaaagauuuuuaaaaaguguuucugccauuguaccaagcauaaaaauccugaauuagcugucagugugagaagaguccugcucauguaccuagaacuucucacugggugaaaccccuccucuguuuugugcuguuaggauuucugggcuguucuuacuuucugucccagaccugacucaaaggccuggaucaugcauaugaagcacgugauuuuucaaugccuuugauaauagcuugcugugggaaaauccugugaaagaaaaauaugggaaauuuugugaagacacauggagagacacagagcuggaucccuaacugugacaucucugaauaaagggccuuccuuccucauuggauccaggagcuuugcuagcuggauggggaccuauccgcagcaagggcuuggggugccccuuuagcccugaaguuaggaacaaagguuuugagaagccuuucaauuucagcuuuauccuaagcaaaaaucuucccagaaagguugauaagacagcacuggacagaaaugucggaaguccagaguuacuuuucaucagcgcuuugccaagugcucggucuuuucauaccucugaagcaugugaagaaggcagcuuucuucccaucucgcugguguuauuguuccaggcuguuuggagagaccugaagauagccaaguucuguuagccaaaaauuugcuuuguuuauaaacccaaguuuuguuuuugcuuuugugcauguuaucgguuugaucuguguuaccaaaagaacauugaaaauaaugaauugcuuugaugagaauuccaaggaauaauggcaaacaaguguguauauacaacaguacguaaacagaaauauguaagccgggcacagugcaggcaccucuaauccuggcuacccaggaggcugaggcaggaggaucacuugagcccaggaguuggagcuguagugugcugugauuacaccugugaauauccaguacaguccagccuaaacaaccuggggagaccccaccucuaaaacaaaaaacagaaaaccccagaaauacauagaaccaacaagaauaccacauacuuuucccguuugauacaaugagguaagaggagaaaguuaacgcccagggcaguucauuuaagaaugccugaaaaacaccuucauuucaaaggauguugucaucuauucuuuuucucuuuugaaauuguguaguaauaaaaggaugcaucuuuucagcacaaaaauaugggaaggauaauuuucccccaguuguauacaaaaguacuuacucccaaauggggccauucuuuucuauugagugcccuacuggucuuucguuauucuguuuugagauuuuuauggaguuuggcuuaugggguaaucaagccauucuacuaaauguggcccuuuugaccuuuggagggagaucuuuugaccuuuggagggaguacaucuuuuacauccauacaggagcagcuauuuucuauauuucuuucacgauuguagaauuucacuuaaauuuaauauccaagguuagucucaauguccagcaccccuuuaacuugguugaguggggaaccccauguggucccaggggacuuucuuaaaagcucuagcaaguguaguugaugggaaacuuuauuucaguucccguuugcaccuuugaucucagaaguugcugggaucaggugacgggcauuaagagaccugccuuuucacuuggaaguugagcacuugcugaacaaaaaauuaucuguaaaugucaagugugucccuuuggucaaaauggaaaguggggaggaagggaaggccaagaaaaaacauccgugugauguuaaauaauguuugacucauuucaauagaaaacacuucucuuuuguauguucaacaaauguauuuguuuuaaaagggaaaaaucaacuugucaacuauuguuucuuaauugugaugccauaaaagacuuucuggagauuaaggaaaacauucauuuucagaauguagucuaggcugcuguuuuuucucauacagagacagagucucgcuacguugcccagggugcucuugaacuccugggcucaagcgauccuucuaccucagccucccgaguagcuuggacuguaguacacaccaccacaccuggcuaauuuuuuuuuuuguagagucagggucuugcuauguugcccaggcuggucucgaacuccugggcucaagcaauccuuccaacucggccucucaaaguguugagauuacaggugugagccccuaugccuggcgcuaggcuacuuucuugaaugcagucuccucuggccaguuggccuuucucucccuucccacacccccagggucauugcuccccauggucaaaggcuguuccugcaucuuucucuguccaccauugaccccauuugcugugggcgcauacccccgcaggugguggagacaaggacccaagccaggaggguuggugccagguccuguugcuggaguugugugauagccuuggaguuuccuuucccuccuuaugccacacucgcaugucauugccugugguuuugucuuugcucucucccaugcagauccggaguuagguguuggcacgcuaccagaacaugacagccaggaugcagggccgauuguccccaagauaucgggucuagagagaagccaggagaagagccaggacuguugcaaagagccaaucuuugagccuguggugcuuaaagaccccugcccucaggucgcacagccaauaccccagccgcagacggagccccaacuccgagcuccuucuccggacccugacuuggugcagcgcacagaggccccaccucaacccccaccucugaguacacagccaccacagggcccuccugaggcccagcuccagccugccccgcagccucaggugcagaggccacccaggccacagucccccacccagcugcuccaucagaaccucccaccugugcaggcccaccccucugcucagagccucucccagccauugucagccuacaacagcaguagcuuaagccucaacaguuuaaggugaguggccugcucuucuuuggccugacuuuugcccucucccuggggaucaggugggugggagucggggagggaucccuagggagacugagguuuccuuguuggaaacaucauccuuuucucugagacuagagacagggaauggggcuguugggugagacucgggucucuugggaaaggacagguugggauggguggguggugaggacauuguaaagaaguaaaauauuuaugggcacucgagaguggaggcggaaggagaggaaggcuuggaaagcccugggccagggagacccagcagcagugggaggcagggagucgaagccuggggcauaucagaggccaugcagugugagcagauccuuucaagagaggcucucugccucugauggaagaaguguuaaagaaaacucgucucccugcagcuccaaaggcaggaagauugggaccugaugaguauuccagcuuaaggauuuuuuuuuucauucugauuuacuuccuccuaugugggucagagaaguagggaagaaacaaaacaagcugcauuuagagaaagugagaaauuucuuuauggaaauccaggcucucuccucugucuuguuuuugccaaguuacaaagaagcgucuaaaaagcagcacagaggaacacagcaaagaaaagagaggcagaaacccagugugcagcgccaaguagagccgagcccuggugccccgggggcuauaauucuaacccggcacagcuccugaggcugugugucuuuguuacuguuuuucuuuugaaaaccugguggcuuuggugguuccgggccuugcuuuuuccuaagaggggaaagcacagucuuuggggggcagguuuccuccuuccccaaggagccgggcccggcuucugcccccucggccguuucuguggccuccagaccauaaagugaugugagaacccaggcaccuggguuucaccucuucuuugugugucuucauuuaagagguaacaagacagauggggggaacucagaucaucgcuuuuuuuauuccuuuuuguuaaccguugcuuuauaggagauguagcuaguggaggauggaaggcuggggauuuucuaggggcauugaugagaaucuggccacaggagcgagagaggcccugagguuuaggcagaaugagcugucucgacaccaagaugccccacagcccugaagcagcaguuucgguuugcucugucugcaguagcgaugggaaaguuugcaggaguugugauuucagaaagugugcucguacagggaggaucuguaaagaggaaggggcaagagagacuguggugaggguuuaggggaaggagguaggauucuuuuaaagagaauacauugcuuaccuuuuuuuauuuuuuucuuuucuuuuuuuucuuguuccgauagcagcagcagaagcagcacuccagcgaagacucagcccgccccaccucacaucucccaccaccccucugccuccccguucccccucucccugcccaaccacagcccccugcacagcuucacacccacccuccagccccccgcacacucacaucaccccaauauguuugccccucccacugcucugccuccuccaccaccacugacaucaggaagucugcagguggccggacacccggccgggagcacuuacucagguaggacggaggggccugugcucgugaccccgacccccaccgccccucgcugugaccucacccuaccuauguugucccgauugcaagguugcauuugccuacaauuuuuuccuuccuuacugugaucuuccucaaacgcucucuggccugagguccagcaaaaauaccugucagcacccauacuaagcuagcucagccccugugaaucagacacugcccgaagagaguggguuuguuuggaguuaggaggcauuuccagcuaaauucagccacugaguggucagacccagguagugugucccgugucgucugggcuccccugagggcgauggaagcguccccaagcccaugucugucucgcuccaggaucuuagauuguguccugguuuaagggguuucuuuucauugggcagggcagggccuucuccugucuccuugggaggagaugacacacucuuugugacaauauaucccagaauuuuaagggcagaucucauguuagacacaggguccuugucuccucaccuguguuaaucaggucaagcgucccaguuuugguccaguguagccauguuaugccgccaauacagagagccauauagcaguaauugacacuugaagaggacaugcgagcccugccgugugaacagcugacauuuauuagugugcuaucacuguucccaagcacuuaaacgugcaaauugcuuuaacccucaaaaaucaaacccaugaguuaggcaauauuauugucccccucuuggagaugggaaaacuggcccucagauggguuauuugccaugcccagggucacucagccaguggugacagcuggaaaucggacuuuggcauuuggccuggaguuuguuccccagauugauagacugccugucccugaaagcugggagaccagcuagagaacagggagacagggugcgaccgggccuuggucucgucugcuucauugauugcccccguuuaucucagggcccagccacacccugucaccccugccacugugucaccagccccguaccccuccacaggaaggcaguccgauguccuuuucugaaggaaaaggcgucaucgucucccucuucuucucuuccagagcaagacaucuugcgacaggaacugaacacucguuuuuuggccucucagagugcugaccgcggggcuucccugggcccuccgcccuaccugcggaccgaguuccaucagcaccagcaccagcaccagcacacccaccagcacacgcaccagcacaccuucacgccguucccccacgccaucccacccaccgccaucaugccgacgccagcaccucccauggugcguaccccaggcagaaaugugaggauaaguagagcacgacucuuuucuuuaugcagcacgugggaccgggcugggcagcggggccaccagagaucgaauggggacugacggcuguuggcuggagagaagggaauguguccuagugcccugccucaggcagcucugacuucaggggccuaaaguaggaacuucuuucuaggcaguuguauccagcacugcgggcggaaaugauuccaucugcccucaaaacagucauguccaguguugauggcuaacuucuuaaaggguuguuuaguuuucuugaacuucccgggggacugucaccaggcagaaaaugcaccugcuugugcuuugcaucaagugcuagcacauacauucuugcaggguaaugggggugaagaagagagaagagaagggagagagaccucugccaggaggcugggacugcauugggugccaccugugcauuccgauggcuucccuaaacccacuuuguuggagguguuauauuucuuguguuucauaagacagucccuaaucugguauugugcucugucagccaguguucagggauccccgcagggacagaacgcucugccuuggggcaagaggaaccacuggccaugacauggucuugcuuuaacugggggcuagcacauguccagaaccagugaggaauuuuuuuuuaaguuaauaacgauaauucauagugccauauuagaaugcuaaauauucucagauagaguccugucuaacagugaguauuagagucauuuuuuacuuauuuaauuuuuaauauuucaggaaauacuggauuuuaaggccauuacuauaggcauugugagaauaaauugcaugauuuuaaaaggaguccacuucacccaacuuugcuuccucuccuuccucucccuccccccaucuuguuuaacuuacuuuuuaaaaauguguuuuuaaaguuuguuuuauaaauuucauuucaaggaauauuagcaaugaggccuugugaccagaaauauguucuuaauagcaaauccuguaucucuuuuuuggaugaauuauacuuaacaauuagauuuugaagauccuaagauuuugagaaaguuuucugcuggccugugugagcuguuucacaaauaaauuuaaccaaagguaguuauagcaucaauaugaugacauuauuuagagggaacaauaguauacucuuuuucuguuccaaugaaaggcugucuggccuaccccagaucacuuuguauuuggguauaauacauuucagaagacagcugcauggcaagacaguuuuucugccaaagugaagaugaaaauagggggaauucacuggguaaaucagaccaaaugcucaccucucucugauuuaucuggauaauuggcuguucucuccuguuuagagguuugguucgugccaaucuguagaaagaaaauaguaggaagaaaggcauccuaguacgugcagaacuaaaacguaccacuugguuuuuaauuuuguucuuccauuucuguuggcuucuugucagggagacucaggagcucagaaugguuucauauguaaugagguuauggggucucaugacagcuuaaugacagggaagcuuuguagggccaccuccacuguagcagugaacaaaaaugcagauuaaguaacuagcuuuugcuuugaucccuuuacaguuugacaaauacccuacaaaaguugacccauucuaccggcacagugugaguuucauuaccaugcuacacauugaauguaacugcuuugccauuuuugugcucuugccacagaucagucaaugacuagcagccuuccuuaaucaucuuugcaagaguucccauugcuccucgccacuuuggaugcuugcuuuugugguguuuugcuuuugguaaagaugcaguaucaucuucugaaucaaaagaucauaagcauuccaaaggcuugaaagcagaguugcucuuuaguggcagucaggcaucuguccugcaaagugagaugucugcaauggagucaguagaguuccaggagagucugaaaucacagcauuucagucgucaguugaaaugccacuaacacagaaguucuggaaugcaaccugaauuauuuccucuuaaauagaaagucccuugucuuuuugacucaugacucuucaacaaguagauuuucauuugcucuagacuaaauguagaaccuucuuccacauggcugguauuguucuguugaguuuguuacaauagaaaguaaaaauaucacuuaauuaaaagaaacucccaaaauugaaaugagugauauuuucucuuuaaacucauucuccuuuauuuaaaaaaaauaaaaaaaacuuguuuuaugccauuuuaagaguauguucuggaacuucaauugauaacacccuaaguuauagguucaguuaacuuguaagacaagagcuuauuuuuauucaaagaccuugaauauuuccaugauauuuugaugauggggugaauacugcaucauuuuuaucugaaaauuugcaaguuucuuugccagugauuucuuuuuuuuuuuuuuuuaaugaaaccagaaaaaagagaagguuaaucaugcuuguagccguguugauucaccauacucaacuguucuugcuuagguuuguagauaguguuaucauuugagaagugcuacuuuaauagaucagcaaagacugaauucauucauauucugaaccagauaauuagauaccauguuagucaagagguuagcugagaagucaaggcuagaaaauauuagaaaucaauugaaaauuauguacucuaggggcauuuagaaauaacguaagaugaaagaccucuucaaaaagaaguuagaaaaguguauuugagugaugccuccucccccucccucccaacaugguccccgcuguucugcucaguaccagaauacaaaaacauauuucacggggacacccaaagcccaguagaccuauggguuuccucuuugggucuggcccauggaugccaccauucugcccuuagucuauacucugcugauuuaaaguaaggaccagcuaacaaaauaauucaggcugggugcaguggcucaugccuguaaucccagcacuuugggaggccgaggcaggcggaucacaaggucaggagacggagaccauccuggcuaacacggugaaaccccgucucuacuaaaaauacaaaacauuagccgggcgugguggcgggcaccuguagucccagcuacucgggaggcugaggcaggagaauggcgugaacccgggaggcggagcuugcagugaucugagacggcuccacugcacuccugccugggcgacugagcaagacuccauuucaaaaaauaauaauaauuaauauagaaaguugagcacccaaaaaguggcucagauuuacuuucuaggacccacugcggugccuucugauacgcauauucuacaguccuaggccaaagauggagaauaagccuggaggccugaauuuuuggaagguguauguauuauuacuuaggcgcuucagguuuuuagucagggggaggaauagucagcuauauuuauauucuaagaggucaaugauggaauaaagcaaaaagaaagugguaagaacauccaguuuuuaaauuguaaacauuaaagggaaaagcccaccuggaggcagaauacuagaaauuugaguguguuucacuggggcauguauuuaauuacucagcuuuauucaguguacugugggagaguuauuucauauuaggaguuauaguggauaauauaugaaguacucagucuccccugcuuuggggauuaggacauuauaaggggaauuaagaugcaaugcacucaaguaucuaaaacacaauuuuagacuuaaaaguaguuuuaaaugagggcacuuggcuugcaaucacuguuuaaguggauuuaguucaauaucaauuagucugaaaaacuuugcugcaucauugaagggagcaaaaugaaauaaagaccaacagaaaaaggacgugcucugaacacgggauugcgaaaugugaauuucagucauuaccaaaaauaacuaacacaaauacuuuauuaagacgagcuucaauuauuguuguaauuuugacauaauaaaccaccacgaagguggggcauuauuuaaaauauuuguaugguggcuugauaaauggaaacaaaccaauaggaccucaaaaagauuaaauuuuuagaaggagggaaaguuguguuugcauugucuucagauucucuguauuuuuuuccucaauuguguccuuuuauaggcuguugauucaggaaaauucauagucuucauucagaaucauucuuuuaccaucauagaguggacuccuacgugaagggcuuggcuugaguauccuccaaagagcuuguucauuuaauagcagauaccauucagaaguggccauaaaaacucagacuucauauguuaauacggaagugcuuugaguaccugagacuuaaacaagagcaacugaaagcucgauagugauauuccagacucggguuauuucugugcaacuagaauccaucuucuagacaaauuggcagcuccauuuaaaguauacaucgagucguuuuauuuuacccuuucacaaauauuugucauuauuuuagaugagagaauuaaauuguccucuggaacugccacuucugcaacaaccuaaugaagcaaggauugugaauauacucucauuuccucaaacuauuaaaagucugaaaguacuaauugaguuuuaaugguauaaaauccuggcacucaugaagacuucuuuuucuucccccuuuuuuuuucuuuuuucugucuuuuucccccucuaauuaacuuguaauuuucugggcaucuuauuuggcucaggaucccuccuguuuuugaaaugcauuaaaaucuccaaucauuuaggacuucuaucugauuuaacaauuaauaauuagaaaagcucccuuucuaaugaugcccucacccgggaugucauuugcuggcugauugauccugaacuacuuuuaacuuuuuaaguuacacauucguggcacgucugugugaucauuccaucauggcuucuugacuaauggcaucaaacugagauuacguggcuugcucaugucgaugucuuucuaugggacgggaauuugaauaugucacuugccuccuacuaaaaucuuuuuucccccucuccgucuuuggccacagcucuuccauuccuauccuccugcagugucgggcauccccccuaugaucccacccacuggcccuuuugguucacuacaaggagcauuucagccgaagguaagaaaccucacagugaaaacacacaggcaugugucuaaguggcgucccgggccaggcgugcaggaaguucugcguccucuugccugugcagugacucauuaaucagguccuaagugaccacugggauuagagugagccuauuuuucuuuuuuuuccaaguccaucuaguuuuaaauggccgugaaaauuuacuuuucaaacuguacuacccagauaaucucaguuaagcuaagauuucuugugcucuucaaaauauacacaauauuuauuuuuuuacuaccaauaucguggacauaacuucuggucaggaauucuaugaaauaucagacacaugugcgccagguuguuccgcagguguauguaauuaguaaagacacaaagcuggguccuuacugauuuuaguagaaguggggauaaagguuccacaacuaaaauuguauccuaugaauucucauucucccucauuucccucgccaaccccaucggcugcaaacagggccugccggcaggugggguggucgccucccauuuugguccuccuuucuuucucccucucucucagccaucccaccccugccaugguuacacuggccaaggccaagacuuugucaucaguuacuaacauccuagugugaaauuaaccuuucauccuuuauaaaaaucaaauucuguucuaccuagucagugauaaugccguccagcguuggcuacagcugucucuaaaggucaauauugaagagucauucucgaaacacucucuuuuuaaauauacuuacaauuucuauuuuaccuucacacaaaaauaaaaagagccguacuuucauguggguaaccauucucagacuugaagauauucugcugugugccauuggguuuucguuuuucuuuuccccaccaucucauggcuaagguaaaacacaguuuugguccagagucuuccaggauaagcacauaacugcauuuccaaagacguguuucauuaaaagaauuaaaaggcauuagaggugggguccccucccccuucaaaaucaccugcauugaauugcauugaauucaguucaucuauugaauuugccugcauugaauugcagccuauaugcaagguuacagauauacagggcuuuuaugacugccucguuaaacaccuccugucuggagauaaaaugauggugauuuuaaacuccuucccccagucugcaccucacuacucccucagacccuggucuguccccucuagguuacaccaaaucucuggggccuccccaaacagacugguaggucauuuaauaaauuagacuauuucccucgcucacaauuauccaaucacacagaaaacuacaucugggcaagaaagugucucuccugguguugaaauaggccuuuccaggccaucguccugauugaauauguagauugcaguucauuaguggaguucuucauauguaugcaaaucagguuguuaacaacuccagcuuaauuguuaguuguacugcagcugauugcuuuucuuucuuucauucuuuucccccccuucuccuuguaggcaagcuucgggccuaaacuugagcuccuuuuccccacgaguuuaacuuccuggugugggggguguucauagaaguugugauuucuuccauaaaauagcuggugucguguccugaauccuuucccacuagaaauagugauugugcccaaaguaggcuuuuuauuguugcuaauucaaaggacagaagcucacagauaagguuaauauuagcaauauuugagaaugguggugggaauagguaagagcaagcagaauugcuuuagaaaucaucaaagagcagauccgcaaggucccuaaauuagguucucuugucccauuuccaccacugcuaaugaguaauuacugaguauaauuccuuauuauugucuaccaguuaaaacggagagcuuaaugucuguaaaguacuuccaguuauucugaugagaaacaccugauacugccaauuauaauaauguucacuuaagcguuucuuggaauguuuggugauuaagcaaaaaaacaguggcagucccugccauggguucauucagaggaagaggaguuccaggacagcauuuacguuuguugcuucucuuuuuugguccugugcuuuuuauugcagugaaauguucuggggaccucucucugcuuuuacaugccauugcuggagagagcaagcuguggucaggcccccuugagaaagagcauguguggucccugagaaaaaugaaucuugcguuucagaaggaaacaaacaaaugaaguuuggcuucucucauuuagcagaagggaaggaucuugcuuucaugucaccuguuuugugcuuccuaaguaagcuguggucuaauuaauuuguagacauccaacccuaucgaugucgcugcucggccugggacagucccacacacuuuacuccaaaaggacccgaggguacgugcaaagucaggcuuggucucagguaacaccaggguguguguguuugcacgggacggccagcccagugcucgcaucuuccuuagcuccuuugagcgagcugcuguuucagcuguucuucuaguuuguggaagaaaaugccaauuacucuuagaaaacacagucucuccugcucacugcgagcauaggacacaaagagaccgacuugccgaugggagaaaagaggaaugaguuacggucugagcccagaaauuggacagugucagcuuguauaguuuuuacuuaaccaaucuucucugucuguaucuccuuaaauugucuuacacaaaugaaguagcuacagaauguuuugaauggaaaagcacuaaggcgcuuuucuuccuggaagucaggcuacacacauccccccgcuugccuggggucaggaaguuauuguacugcacggcucuuuggcccucuauuuuuaaugugcuagggauccuuuuguacucuagagcuaaauaaaauauccauuaugcuuugguuauguuguuuauucauaauuuauuaccacugccugcuuccaaaaaaggaaucugaaguuauacgauagauacaaucuugccucauuguuauuuguagucaucuuuauacgaaauaugaaaaaaucuuuaacaauauugucuuuuuaccuacauaagggcagucagaaauugauaaccagaguuagauagaaguuuaaaaugacucaacuauguaaguaugucaugauguauagugaacuucuggaaaaugucuaauagcuauaaauaauguaaagucaucaauguaaggguauugguaaagagagccuaauucuccuggauggauggaaaggacaccucuccccagauaccaguuaguagacagcuuuaaaagccaggggucugaaggccauucucccucagaccuacccggugugguuuggagcucaaaacagugaaacuccuggugugugaugugagcaaaucauguugccagagggcacauugcuauugauuaaacuuguacaggggcuugucagcguagauguaccaaggcuugugaagugggggaggggacacuuggcacuuuugauagugugaaaauggguuaauuauucucuaaaagggcuucauuuaaaaguaaaauucuaacauuuuaauuuccccuccuaaugaagcacuacaaauuuguuaauuagagcaauuguuugagugacaggcauguaaccaaguugucauuuucucuucacaguugacagauccuuucagaccuauguuaaggguaagaaagcuucuuauagaacuguuuugcaaccucuauuugacucccuguggguuaaaaauacaagucuauuacaaggaaauaagccauagaaauguuggaauaagacauuggaaugacggugauuggguuuuucagauagugugauugaaaauggccuaaacuguuuugcuuugaccguuggaggccauuggcuuuuuuuuuuuaucucuacaacagagaaaagucaacgaguccgaucucuuguuagcaguucugguaaaagguuugacuaguuggaacuuaaggggaaagacugaagcuauaggcugaaguuagucucucuugcacuuagaaaauauguagcuggguccauuuauuuuggcugguggcucccucuuucuguaguaagugacauugacuugccauagccguuugaccuccuuuuaaggugcaggaaggagguacuauaagcaucugguuuguuaacaucuugcuuaaagcaaauuguucucgaggucuggagacuggccagugugaugaccucuaaaugaauccuggugguuggggguaagacagacaugaugaauuguuggacagaagauggauggacagcagauuucuugcuaugcauaacucauuucuagggcacauaaucagauaauuugauuucuccaggggaaaaaggagaauugugucaucacuuaggugaggcaguauauuauuugugauuucaaacuacccauaauuucauugcaagagaagagaacugacccagacuugcauuuaaguauauauuuucggaacuaacuccauacuguagaaaccagaagcuucuguucuucgccgauguagaaugaggcuguguuuucuucucaucuguccaguagucacugagcgcgcacgccgagcuuauggguagauuacuuagcagaaaugaagugaaaagguggucccugcccgcugacugguagaagagaauacacucacagcacuccacuccuuauaaagcaagacaugaaauaauuggggagauguggauucaaauucaaccccagaggguggaggauggacuugagaucugcagaggccuagauagagaacaggaaggaaggaauauucuucucuuuguuucuuucuuuaaacuuaggaacagcgcccaccaacacgaauggguaguugacucuuagcauuuacgguaacugggcuucaaucaaaaugugaauuucuuuguaccacuuuggggguuaaaauaaaaaccaccacggucuugggggagguuaggacagguucuguacccucucuuauuuugauuugacucacagacauucacuaaugagcucuucugaacagcugauuugcauuauagcauggcaacauuuguuaaguagggcuucccacucuaccaggucugccagcuggcagcagaaaagaaagagaagaggcacagagugggauucaggcuuuugccgucuuguccuugguaaccggggaggcccuugucaaugugguuuucugaguagcaaacccacguggggagagagggggagcuggcugugacucccuuaugacugggcgcuggagagcuacugauggaaggcacuuggagaguacaaagcacucuuguuucacgaaaaaagccucugcagccaaaaucugcugaaagcuuuggggaaauugaaggugguuuucucugaaaugucuuccuccuaaccacguugcucuuucuuguuccagaaaccagggaaguggugugcuaugcauguucacaucgccuggcagauuuaccaccaccaacagaaagucaaggucaguccgaccuucgugguguagggaagaaugggaugcacaugugagugugugacgugcucgggagaaccugaugaaggaggcauuuaaaacacauuuuacagacccauaguuaggaaggaucaagccucucuuggaaaagcuacucagaagucuuacuuauuuuuuccuagagucagggucucacucuguugcccaggcuggaguacaaggggacaaucauagcucaccacagccuugaauuccugggcucaugugauccucccaccucagucucccaagcagcugggacuuuaggcauauaccaccauacuuggcuaauuucuugauuguuguuuuuguagagauagauaggggucucacuguguugcccaggcuggucucagacuccuggccccaagcaguucucccaccugagccucccaaguagcugggauuacagugcaagucacagcagccagcucagaaaucuuacuguuaauuagggaaaccacuagugaaauuacaaaacaaaagcaaacugauaaugccccaggguuuuguucccuuuauaauuuugucauuuuauugauccaaaggucuugaauauggauuaaaugcuaaaauaaagcuuuuggaaauaaaauuauagugaccaagaauuagaauacagaaaauacucugcaucugggaagagcuacaaaugaauguuggguuuggguuuuuguaaaaauagugacuggugcauucuuuucauuuuauggcugugggaaaaugguagagucaugugugcccuauaugaagaugaugccgcugaacugucauugguccuccugauggucagugccagggauuggaauacagucaguacuugcaggagccacguucuggcuaguuaccucgcuguccaaagacgauuuuuccuuuuugucuauauuuucaucauagggaugaacauauuccauguucugcuagagccuuuaugacucaguaggggagagaucaagaacuucugcaagucccuggauacagcaucagcgcuuggcuuagggaacaaaguaacugacaagucuguauuuuacagucuggguauuuauaggcuauguuacgaugccugcaaaaaugggagcaaacaagcaaucaaguaacuccaauaagcuucacuuaauccauuucuucaugaacaagcuuuuaguccuaacagcauuugggaguucucaugaaagaaauacaggagaccaaugagccaggagauagauagagcucuucaucacagaagagacauguuuuuaaaaggguuacgugauuuuuaaaauaaaacaacccaaguuccagucacucuagaggcugaggcaggagaaccccuugagccugggaguuugaguccagccugggcaacauagcaagaucucaucucuaaaaaaaaaaaaagaguaaaaaauaaaaacccgguuaaaaguuuuaagaugcaaaccucaguaaaugaggucacuaagauauuuugcuuugguugucagauaccugcucuuucuuauaacaugccaucagugaguuuggcucauuuguacuuuauuguuaggggaaguuuaauuggaagccuuguggucuaucuuagaaaaugugugugcuuugaagagcuaacuagauuuugaugauuaguucaauucaguuuuuguucugguugaugugguuaguggaacgguagguaaagcacaucuuccuuguaacuucuuugguuaaaagagaugagggauguugcacgugccacuuuagcaacuucuuucccauaaaaguguccccagugacuuaaacuuucauuaucccaauucaauuagaaagaccucuugaacaugagauaacuucguucaucuucccuuuucagcaaacugcuuguaauccccaagcuccauuuugcuucauggcccuaaguugugguuaauggaacugugcuauguaccaugcaauauuagcacuaaauaauuuggccaccaaauuaaaggagguauucaaaagaauuuuauagauucauagugaauuagaagcuugguuuugaggcuuggcuauuacucgauacugggacuuucauuauagcauucccuguagauuugagcagaaauuacaucuucccucucucuguaacguucauuuacgcauucuuuuagucguucacccaguguuuauugaaagagccuacgccugcagguuccuuacuguggcgggcugggggcaugcauccuuccuggcgucuaguugcuuagaguucaguaaugaggaucaguuguguguaaaaagugaggaaagugugugugcccucuuaauggguggugucauuuccagcuggaggugcacggguagcuuuugcuuucaguaggggugaugggugagugggacguugccgucagcaguaagagaacagcagacuucccugucucagauccucacgccaugcucugucaauauagaugcccccucauggggcuuugcuguuguacagcagggcaaggaucccucaggacaugagggagauugagcugaggcuagaauggggcuaaaggggcugagagcaucagaugaguccgggagaucagaagaguagccaggcacgauggcucacuccucuaauccaagcacuuugggaagccaaggcaagcacuuugggaucgcuugagcccaggaguucaagaccagccugggcaacauagagagagagaccugucucuaccaaaaugaaaaaacauuagcugggcauggugacauggaucuguagucccagcuacucaggagacuaaggcaagaggaugcagugaacuaugauugugccacugcauuucagucugggcaaaagagcgagacccuaucuaucucaucucuuuaaaaaaaaaaaaaaagagugaaagucagaagcagguacuaagggcagugaaaacccaggagacugauggggaagaggucauagcaagggaaauucaacuagaagcuucaagucccaggaccccaugccuugggagcagugcuuauccaaggcagugugaagccaguucaaagagaaagcugucaagaaacaaggagguggggcagcuuugaaaccaugcuggugcaagggccuccagccuagagaaggaugccaggggaaaagauugagaggaagauuaagacccaauuucuacugccuaagaggaugguaggcggaaagauuagccugaggauagauaaauaagacaaaacagagugauuucuguccaugauaaggacuucacacaagaguuuguuuuuuuuuuuuggagacagccucggucacagcaaccuccgccuccuagguucaagcaauucucgugccucagccuccccaguagcugggacgacaggcgugcaccaccacgccuggcugaucuuuuguauuuuaguagagacaggguuucaccauguugcccaggcugcccuucaacuccugagcucaggcaguccgcccgccuuggccucccaaagcgcugggauuaugguuuacuugucuggauggacacugcccucccccaaccuuccucagguaauuacagguaguaggaagagaaagggccucuguuaguuaaauuaauacuccuacuuuguuuuucuuuguuauuguuauauaacagugaucauuugaaaguuagcuuauagacaugcaaauauuucuucauaacuuuugguuacuaauguacugugagcuauuagaguauggcaaagagucauuaaacaaacaauuaauuuauacagcagauuguucaugcagaauuccuaauaaaaugagcuuuaagacacuauuauuuuaaaccuuacuaaaaugggccuuuacagcaaaacacugaacuacuuugggagugguggcagucuccauaaauaggauaugguuuuauuucucaagccauuaaccuugaagaccaaacauagcugggugcgguggcucacaccuguaauccuagcacuuugggagaccgagaugggcggaucacuugaggucaggaguuugagaccagccuggccaacauggugaaaccccauaucgacaaaaaauacaaaaauuaacugagcauucugggaggcaccuguaaucccagcuacuugggaggcugaggcaggagaagcauuugaacccaggagguggagguuguagugagccgagaucccaccacugcacuccagccuggaaagcagagugagggagacuccgucacaaaaaaaaaaaaaaaaaaaaccagaccaaacacuaguguugucacuagacauuucugguguaacaggcacuaccggccugcagaucugacauuugagggugaaaugguuuuuguguagcugcuuucucucacaguguuuguaaacuugaacccaagugcaccguucacagucuccagcuccagcucuucacuaacaccuuuauuccuugcuguuggccuugggacccuuacuguuccccuugcuguguagaaacagaugcagucagacccacauaagcuggacuuuggacugaaaccugaguuccugagccgcccuccaggccccagucuuuuuggagccauccaccacccccaugaccuggcacggccuucaacuuuguucucugccgcuggugaguguggguuuggguggggggacagagcugagaaauguaguucucagguaacuaaauaaaugagguuugggcucugagcugccgcucagucaccaccuacaaaaauacaguuaaugccagcuugcaaggcaacaucgcagcacauccagggaguugggaaucuucauugauacacucucuuucauuaaaggaggaggcagagaucaucuuucccuuacagggauucacauugcuucgguucauuauuugcuucuauauuaaaccaguauaacucacaagcaugucaguugcuauugagaaagaucugaaggcuugcaagggcagaucggaaggaaacaaugccaggaauuauagaaggaugcggucgcccuuaauacggugcccgcagagcacuguaauuuugcaccgggaugcucagucaugccguguuuuaaaguccugaggauaaagaaaggcgauuaaggcaguugccaggaguauggucugugauagggagguugggccacucgguugcugguuuucucugcuacaaaacguaauacuauugccugguugguuauagcgguggaagaaauuuaggaaacgguguaaacacccaagugaccugcucaucggaucuguaauucauuuaaccucugagaauacacacugucaagugugcguguggaaggggugagguagagagugacgauuaugcucauuccugcuccagguacaaacaaaagacagcggcuguaaggacugugugugugcuggaugagaacagcccucuugguauuaaggguuucuugucauucugucuucucuaaagcuuuuuuaaguguaauuucuggcacacagagcucagcucaguuaacacuuaaaaaugauggcacugagcucauucugcuaauaacuucauacccacuaugcuaaguagaauuuauucuucuggacguaagcagucaaggggcuccccauuucugauccuuacgagacaagucuuacagccauccugccagcugccaccccaggcuuuuauccaagacucacuguugguggaccucuggcucuucuguucaggaagagagaagcacccacacugcaagaaaucaucauuauaaugggccuuagcuaccaaagcaagugcgucccccuggaggguagauggaauuugcuaaggucucagguuuuucucugucagugcugucuggggacauauuugaaggcucuguuaccauggcaccuaggcucugagacagggcuacaugaagagcaauuuuuggaaagaauagauuucucucuggcuuccauuugagccaaguggaugaauuggcuucuuuugcuucaauaauucuggaacugcaaggcaccccugggggcccugggcucagcaaagcucuggucuucauugaagcauuaauuagcuugcacuacacagacaguauguggccaaaauuuuauuuagcugacaacacugcuaacggccugaugaauauucuggaauauauucacuugguggaggcgggguaucauuuuuacacuucccagguggaaaauaagccaguaugcagggcugaauagauaacuccucaggugucuuccaauuccgaacuacugugacggggaugauguuccuccuguacugaguggcuuccucuccaaacccaggccacaagacuuuugcagcccagggaacagcaguccaaaacauaaaucgaguuaacagaguguagacagcaacaaccccuacguuuaauccauuuuccuaagggaauuuauauuuguuuauaggaacuuagacaaaaugcaaaggauuauggaacaguuuuuaguaaauucuuuauccaggccuuguuuauacuuccauucuagaauguaaccuucuuuagcauaagcaguaugggauucugcccaaaauaguuauuuggugaaccuuguaacugauguguauaacuuguacauacuuaagaaauccagccauuuucaucuugcuauugggugcuaaucccaugaauauaaacuagagacuucuucagaugacccuggcaaaucucucgucuaggacaaagccugccuuccaggaagcuagccuccuuagcuaguaaguagccucguauuaacaagcccauuuggugcccuaaggccuuuagaaauguccuucccuaauucacauuugcacacucucuuucucugucuccuuccuuccuuccuuuccuggcuuccuucaggaacaggaauagaggcaucuucaagaaguacacauuaggcaaaauacagagaagaggaggaaauguggaucaagggacaacugaaggaaaccacuaaauuagaccugaguucccuggcaggcaaagcaaaaaccugucagagucaguuauaagauuuucagugccccaaaacauaagaaucaaccagcuuuuccuggcauugaaaguugagagacaucagaggacuucaucuccuaaaaccuaauugagcucacaauaaugaguuuuauagagucgggucuuauaguauccuucgaugugggugcaugcgaacuaacauacucuucaggagaagggauucugcaaguccccagagcagcguagccaagaaccacagcuucaggaccaccccuccugagccagagaugauaacgggcuggguuucuggaaguguuucucaaagugaaaacuugguccuccgagaugcucuaugaggaguggauuccaugaugaaauguuccccucuuagagaacgaaggagccuauaagcuuauuaauaagcuuauuaauggcucuaagaagcccuucaguaaagaaacuugcuuagcuuuuuuuaauccaguauuucuccaaauuuacuugguuauaaagccuccccuccucccaugacccagggcaguuaucucugucuuuguaauacugugugucaucggcuuaaaaaagaaauaccuguuuuuggugguggccagccacgcugggaaagagaaagagggaugauugauuuucugcuuccuaaaaaaaaaaaaaaaaaaaaaaaaaaaaaaacacacauuuucuuuuacccugugucuugccugcaggggccuggguggacuucagccaugaccucccuugaacauauuuucucacggggcccuuaagcaaguagaagccgguugcaucuucgaaguuggcuuuuuguaaacucugguuucguuauguuugacuuaacaggugcugcacacccaacugggaccccuuuugggccaccuccucaucacagcaacuuccucaacccugcugcccaccuaggugagucgcccaaaauaaugggaacugagaugugugcuucaggcaacccugcuguguuuaccaugcucccgcugcaccuccgggcaagcuggugggagucccagauacccugcuuaccauuuaggcaggagauggugcucucuuaggaguuucaguacaucccguccagcuuccagauuucaucucuuacaccgcauucuuucgguaguagagcugugcucggcagugguucugccugaacuucccauggugcagugggugagagccauuccuugguaucucagggaauccgaguuuacaacagccuguuccugcccauuggaagaagauggugagcucuugccccauagcaaaggucaccucuaggaagcggaaagaaacacaagcugacguuauggagaggaguuauucuacaucucacugccccgauaaaugagucucuuccuaauaaaggugcaugcuuuguguggccuuuguguauucgaucccaucugcaaguguacaggcagauucaggcauuggcuugcacaacaucagggcauaucauaggcacgcccucagaguuucaucauggauucagaugccaccuccuuucuguucuguuagaaucugcagagugcauuccuggcagaggcgagacugggcgggaaggcaaguuaguacauccuagcuugaguaguguccccacugggcaaaggaagaguaauacaaaauacacaguuguagaagaagaguccucagaaauauuuugcuaacccagugccuaaauccaaguguaaugaaaaccuuuuacaccaucugguaggaaaagugggacaggccaggugggggcguagagagggcagggaucccgcaucgcccugcucccaggaagcucuggguuccucucccagcagagccccugaccauuuccuucuuccccaucuuguuugcagagccuuuuaaucggccgucuacauucacaggccuagcagcaguugguggcaaugccuucgggggacuuggaaauccuuccguuagugaguaccucuaacuuuuaaaaaucugccuuggacuuuuuaucuccugugauccgcauauggcucaagaccuuucuagagaaaaggaaacuaugcucuggggggaccaguguagguuauaucacugcaaaagcaggccuucacaguggggugagguggaagugugcagagccaccacugugagggcagcccccuguggcuauccaguucugaggggcaggaacggcaguguaguugaugaccacagaaaguuuacucaagugcggaguuucauccacaucccaucucugcucuccaagauuuuggcugcagcucacauuacaagugaaagcaauaguuacagcaauuguuacauuucaucuugcccguggcauucguggaauugaaaaaagcacaaugaaaaauagcaggaagacaccaccaggcugcgacaccaccaggcuugggauaaucaagauuuggcaccauuuuauucuccaucaucuaggaggacucugcagcuuucuacuauuaaaaaagcccaucucgauuaggagaagaauuacaaccccaucucacguucuaaacauuaguguuuagucgcugaauaugcaaauuauuuucuuucaugcuacauaccauauauuccggguacaggaagagcuaaaacgugucucugagcauaccgucacaggucggucuuuauuuaaaacacaggaaggagaccugugugucuggugagggcaagguccugucuggucucuggugacacuugagagggccacgguggguagaggagacagugacuucuacugugaaucaauuuagaauuguuaauccaaaucccaccaucauaacacacccuucugcaugccuggaacuucugcaugcaccagauacguugaauuaggucaucucaguacccauuuggucccuuuuccuuuuuaacuuccccuguccccaccuuugcuuuugguuuuaaaaagaaaaaaaaaagcugugagcuaccucuccaguguaggacaagacuuccucuaaugaauuuguuaaucuccuuuccuuuuccagcucccaauaauauguauucauuuuaacucugaaugcuguuaaaaguuuuuugguaaguaccuucauuacagcagauuauauaauuucucuuaaaccuuuuuguucuccacuucaccauuucagcacccaacucaauguucggccacaaggauggccccagugugcagaacuuuagcaacccucacgaacccuggaaccggcugcaccgaacgccuccgucguucccgaccccuccgcccuggcugaagccaggggagcuggagcgcagcgcguccgcugcagcucaugacagagauagagauguagauaaacgagacucaucuguuaguaaagaugacaaagaaagguacggaaagaaaccgcucucgaguccccacgggggagccugcucuaugccaaguaccaguggaacuggccgcccacccucccugucccagccucgugcuuuagccgccccgguagccucagcuccuccccacagccagugcccgcagccccucgcaguccccauggcccauagcauauggugaccguaggagauagcagagcuagcgacagauuccugucucagucgcaguuauacaucagcacgucccaagucccuguuagcguguccaaacagaagucuuucucuagaagacagggaguuggagcuucgggccagacacacacagcaugaaucaauuccauauuugcuuucaaguccgugcaguccauuuaaccauccauagguuuuucucgcucuuuuccucuuuuuguuuucuuuuagaaagccauguuugcauugccucaucauauuuuucucaaauuuuguucaaacucaaagccuggggcucacagaugacuaauaaaauuuuacucacauagauguagagaaacgucgacaagcaguuuugguuugguuuugguuucacuaguggauaauuuuguuaaccguugucucugcacuugguaacccaugccuaaaaaaaaaaguagcguuaaacagggaaugucuuggaguuuuuuuuccaaagaauaucguaacgcauucuugacaaaaaugucuuuuuuuuuuucuuucuuuaggcuauuuauuuucacuuuaaaugaacugauaaggaaugcacaaauaugcuugacagaaaauaccuaaucccaauuuccuugcaguauuuaagauucaaauuugauccgaaucuuuaauguuucuuuucuuuguauaccguguauguauguguguguguauauccuaguaauuucaaagaaagaauucaacuuugcaggcucuaaauggggcagauuaguagauacucaucagaggccaucaugcugacugauaaaagaaaaacaaauuuuccuucaaggcaguaugauaacaaucucuuaaccacugggaggaauguuuaugacauucaucucugagcugugaacugccaaaaugaggcacgccuagcaacauaaccuggccgacccuaggccgcgagcucucuguacacagccugucacuaggugcaaugcaggauguggccaccagcccuuugcguguuuuucuggauggcgucaaaauggccucuuggauuaaagucaggaagcuuaauaaauaaaauauacucuucuuccauccuucccuuaaaaguuauucuucuucucugcaugugggcaagaaacagcccuuauaggggagccuccugaauacucugugguccucugauccuugcacaccagcaccaagccagcauggcagccugcugcucuccucaacuuugccauaucugucuuggcaccauccguaagaccugccuggucuuaguuuuaacucaaguuuuaccuuauugucauuccauuuguuuuugcauuuucugcccaauacucuugagcccccauccaagacaggucucuaaaauucuugucucguguuuucacucacagcugcucucuaaaauuguuuucaauguccccaugagguuucguguuuagggaccugcuuuuccuacugccuucccuccgucuucucaucagacuuuggcuuucuuaucccaucuggugcacaagugcucuuugcaacccaaaaguccuccaacuguggcuuccuuuugagccuuucucacgugcugugucuuggagauggcucuguauccacguucuuugcucugaaacuggucacuuguccuuguaaggagcaagagacuucugugacacugauguugaacccuuucuuccacugguucaguguugcaaaguuggaagaaaagugauacugggcguugggcucuuaaaacgugauucuuuacacuagaugaucccgggaguccagacagucgggcuggauugccacaucauugccuuauugaccacaugcagccaucuuggcuuucuggaagcucuucuucugugcucuugguugaggcucuuaacaugcagagagauucuugcucccagcagacucccccucacccucaucccugguccaucucccccauuaagcuuccucuaaaaucuagguaaguaggauaaggguggcuggcucugcccuguccagggcacggcugcugccuuggcgaccaugggaagcagcccccagccuguccucuucacaccaccauuucacccgcagccccuggcccggccgacucgccccuuucauuucaucugcguccuugucuuccccucucucccccagggaaagcgucgagaagagacacuccagccacccuucaccagcaccuguccucccggugaaugcccugggacauacccgcagcuccacugaacagauccgggcucaucugaacacugaggcucgggagaaggacaaacccaaagagagggagagagaccacucggaaucccgcaaggaccuggccgccgacgagcacaaggcgaaagagggccaccugcccgagaaggacgggcacggccacgaggggcgcgccgcgggcgaagaggccaagcagcuggcccgggugccgucucccuacgugcggaccccggugguggagagugccaggcccaacagcaccucgagccgggaggccgagccgcgcaagggugagccggccuacgagaaccccaagaagagcuccgaggucaaggugaaggaggagcggaaggaagaccaugaccugccuccagaggccccgcagacccaccgggccucggagccgccgccucccaacuccucguccagcgugcacccggggccccuggccucgaugcccaugacggugggggugacgggcauucaccccaugaacagcaucagcagccuggacaggacucgcaugaugacccccuucaugggcaucagcccccucccgggcggagagcgcuucccguacccuucuuuccacugggaccccauccgggaccccuugagggauccuuaccgagaacuugacauucaccggagagacccgcugggcagggacuuccugcuaaggaacgacccgcuccaccggcucucgacuccccggcuguacgaagccgaccgcuccuucagggaccgggagccucacgacuacagccaccaccaccaccaccaccaccacccgcugucuguggacccucggcgggagcacgagcggggaggccaccuggacgagcgggagcgcuugcacaugcucagagaagacuacgagcacacgcggcuccacuccgugcaccccgccucccucgacggacaccucccccaccccagccucaucaccccgggacuccccagcaugcacuauccccgcaucagccccaccgcgggcaaccagaacggacuccucaacaagaccccuccgacagcagcgcugagcgcaccucccccgcucaucuccacgcuggggggccgcccggucucucccagaaggacgacuccucuguccgcagagauaagggagaggcccccuucccacacgcugaaggauaucgaggcccgauaagccgagaacaggagcaagaacgaggaagaagaaacccuaggcagacaccaggccaggcuugagagacagaacuccugcauggcucacacagacugggggggaaagccccaccccuuccccuuguaaaaaauguauagacucagugcacauuuugaaauguuuuguauauuauauguugagauuuuucagaucuuuuagcccagucauauguucucacgucuccuacuuuuuguuucucguauaaaacuuuuugauuugaaccaaaacagugaagaugacaacacacaccaauuggaugauaauuguagcgggggcggugggggggagaaguccacgccauccaucaugcaaaauucuuucagaugaggugggaaggccguguacauaguuauguaaaaagagauugcuucaugagcuaaugguucauauaugcaaaaggguaagaugaaagcuuuacuuuguacaaauguaaauagauaaaguaacauaauacauuaauacuucuuaaaaugugcuauuugcaaacuuacuuaauaucagugaacacagucggcuaaagcuguguucccauauauuguuauagacagcuaaacccuucaacuaugcaaugaauguucgggcuuuucacaaaagcccgccuaacucaaaggagccuuuucaaauccauuuacagcauacuuaaggucauauuuucccugaacaagcgcuuacgugauaugacucuguuuuccuugcuuguuuuuuuucaaacggagaaacauccuguuuugcaaauuggaccccaggcuggaacuuagcaucugaaguugccgcuugugggcucugggggaaaguguagccccggagagguaacugaggacaugagcaaccagugccagggagggugggauuugccagaugccaaaaucaggggacgggugguggugucugucagacacacacaggucgccagugacuucacacacaccucaugugagaaccaugccuuuuuuaguguguccuauuucauaccuguacacacuuccucguuuuguaaugagauuuacuuacacccaaacagauccugaaagaaagcuucaaguuuucucagaugauggauauguuuucacuguauucaauaacugacggauguaaggugcacguuuccugaugugacgcacuguauuccagcuggugaucaagucugggaacagccguaacaggucaaccuuguggagccaucgcgaguuagagggugaaagauggcagaaaaaaaagucuugugugugaguguguuuuuugaguuugcaucaaucuuaaugucucuucauaauacuuuuauaauacauuaagccucuugucuacauauuuggagagaauaugacuuuacuagcagagaaauacaauauaucuugucuacuggacuguaaaauauauguaugaaauaaaauuaguuccauuuggucuucuaguauauuaaagugcuaucugacguuguuauccuguuuuugcaa

SEQ ID NO: 191545 - RNA, 33417 nt, Homo sapiens
ggcugccgucagcgccuuugccuucaaccaggaguaaaaguggccguagccucuuccggcgaggacugguguuaagggucacgcaagauggcggcgcccagaggcugcugaggcgcggaacggaggauggcgcugguggcguugguggcuggggcucggcuggggcggcggcugagcgggccggggcuggggcgagggcacuggacggcggccaggcgcucccggagccggcgcgaagcggcagaagccgaggcggaggugcccgugguccaguacgugggcgagcgcgcugcccgcgccgaucgcgucuucguguggggcuucagcuucucgggggcgcugggcgugccuuccuuuguggugcccagcuccgggcccgggccccgcgccggcgcccgaccgcgccgcaggauccagcccgugcccuaucgccuggagcuggaccaaaaggugcaggccgcggcuuccucccucucuccuucucucucuuccgcgcucccggccucccucgaccuguucggcucucuucaagaaguuggcuccucuggguggacagacuuccggcaggacgacccucgagcuggcugcaagcccaggaggggaaggcguuagggguggccaucaacauuuauuggguggcagugccagauguugugccgggucgugucauucgcuuagcacccagugagucgacaguuauucccaauuacagggaaggaaggggaggcccagagagguugaggcccgaggccccaccgcugcuagcuguuuauaugcgguggaauucucacucaggccagcgugacugcaggaguucugauguuaggaaagcaaaauucaaaaguccauugaaaauguauaccagcugagguguuucaaugaacaacucagaaaggggauuuuuuuguuuuaauuuauuuuuuauagacagggucucgcucugucgcucaggcuggagugcaguggugucaucauagcucacugcagccucgaccuccugggcucaagagaucguccugccaccuagcccggcaaauuuuuguauuuuuaguagagaugggguuucgccauguuugcuagacuggucuugaacugaacucaagcgauccgcccgccuuggccucccaaagugcugggauuacaggcgugagccacugugccuggcugaaagaggauugauuuuaaaaucaaaccaucuuuggucuauauccaaccucacuggaagccccgguuuucucaucgggucagugaagggaggauugaugagaguguaguuaaaacacccaacaaagaccuugggguugucacuguguuaaauucacaguagcuguaguacugaguuuuccuuuucaugguaauagccugaguacguaacgguguagugucagugaaaagcaugcagucaaguuacucaaccuuuagaagccacacuuucucaucugccuuauacuacugcuaacagcaauaagaaauagaaaauauaauaacaaaagcaauaacaaaaacuaaacaacaacaacaaaaagcauacaauauaggccaggugcgguagcucaugccuguaauuucagcacuuugggaggccaaggcaggaggaucauuugaguucaagaguuugagaccagccuggguaacacagugagaacucaucucucugucucucucucucuccauauauauauauauauauauauauauauauauauauauauauauauauauauauauauguauauguauauguauaaauuuaaaauacaaaauagaguacaaaauauagguuuguuuuuuuuuuuugaucuggcucuguugcccaggcuggaguacaguggcgugaucaugggucacugcagccucgaccuccuggguucaagugauccuccugcuucagccucccauguagcugggaccaagcuuaaauuuugauuuuuucauagagacagguugucacuuuguugccuaggcucaaaauauagcucuuaccuugagauggguacuauucccuauaagggcuuuagcuauauuaacucguuuagucuucacaacagcuuagugagagagaugguacuauuaucaucuuuacuuuuuagagaaggagaaacagauauagagguaaaguaaucuaucucagaucacacaguugguaaggauggggccaggauucaaaacuaaggagaucugucaacuuaccuaccgcgcuaagagauggugguguuuuuuguuuuguuuuguuuuguuuuguuuuugagacagagucuuauucugucacccaggcuggaaugcaguggcgccaucuuggcucacugcaaccucugccucccagguucaagcacuucuccugccucccgaguagcugagauuacaggcgcacgccaccaugccuagcuaauuuuuguauuuuuaguagagaugggguuucaccauguuggccaaagcgggucucaaacuccugaccucaagugaucugccugccucagccucccaaagugcugggauuacaggugugagccaccguacucggcugcugcuagauagugucuugaucuuggugaauggggaugguaauaccuagugguaagcugacauagaccauaaauagacuauauuuauggucuauguguaaaucacccuucauagagugauuauaaagauuaaaugagauaauacuuaucaaacauauaguaaaugcucaauaaaugcuaguugcugucuuaauaauauguguucuugggccaggcacgguggcugacgcauauagucccagcaccuugggaagccaaggcggacagaucacuugaggccgggaauuugagaucaccugggccaacauagugaaauucugucucuacuaaaaauacagaaguuagccagacguggugugcacaccuguagucccagcuacuugggaggcuugaaccugggagauggagauugcagugagccgagauugcgccacugcacuccagccugggcaacagagugagacugucucaaaaacaaaaacaaaacccccguaaauaguauguguucuuggauuugauaaauaaccugucauuuacuacugaacaaacuugacauuauaaaucaguucaugcuuugugggaacugcuuuucagauuucaucugcugcuugcggcuauggauucacacugcuguccucuaagacugcggauguuacgaaagucugggggaugggacucaacaaagauucucagcuuggauuucacaggagccggaaagauaaaagugagcaucccuaccuugucuccucuuugccgggauuggucugagaaagcucuuuuuuuguauuuuuuuugagacagagucucagucuguugccaggcuagagugcaguggcgagauccuggcucacugcaaccuccaccucccggguucaagugauucuccugccucagccucccgaguagcugggauuacaggcacaugccaccaugccugccuaauuuuugcauuuuuaguagaguugggguuucacuauguucaccaggcuggucucgaacuccugagcucaggugauccacccuccucagccucccaaagugcugugauuacaggcaugaggcacagcgcccagcccucccuuugguguucaagaacaugguuacauaaacaaagaaauagcaaagaaauagaggaagacuuaaagggauguuguuugaaaccaucugggcuagguuauuuuuuagccucuuugguaacaauguugaacccucaggcaaaaggcaagcaccuggcauuugcagauaaguaaagauguucuuuuguggccuaaaagagaugaccuuuuuuuccuggcuuggagacagacagcgugaaguacucugcagugccuagaauauguuuuggagggaaaaagcauugaaaucguuaacauggaggcuuuauuccaaauguuugagccuuggauuguaaaaauguuagaaauaacuuauaauggcauuuuaaaaaguagacauuagccuggcugggcguggugccucacgccuguagucccagcacuuugggaagccgaggagggcagccuguaaucccagcacuuugggaagccgaggagggcagaucacuugaggccaggaguucgagaccagccuggccaacauggugaaaccccgucucuacuaaaaauauaaaaaauuagccgggcaugguggcacgcaccuguauagucccagcuacuucggaggcugaggcacaagaaucucuugaaccugggagguggagguugcagugagucgagaucaugccacuacacuccagcuugggugacagagugagacuguccuaaacaaacaaacaaacaaacagaaaaguagacauuagcuaaaaauuacugugagaacaguaagaaauauuuccuuggccaggcacaggggcucacgccuguaaucccagcacuuugggaggccgagaugggagggauugcuugaggccuggaguuccagaccacgcugggcaacauagcgagacucugucucuaaaaaaaagaaaugaaaaacgaaaaagaauuagcugagcaugguggcaugcaccuauaauccuaguuacuccagaggcugagguaggaggauugcuugagcccaggaguuugaggcugcagugagcggugauugcgccaccgcacuccagccugggcaacagagcaagaucaugucucuuaaaaaaaagaaaaaagaaagaguuccuaaaauagagaggaaaugccaggcgcaguggcucacgccuguaaucccagcacuuugggaggccgaggcgggcagaucacgagaucagaaguuugagaccagccugaccaacauggugaaaccccgucucuacuaaaaaugcaaaaauuagcugggcauggaggcgcgcgccuguaaucccagcuauucgggaggcuggggcaggagaaucgcuugaacugggaggcagagguugcagugagccgagaucgcaccacugcccuccagccugggcgacagggcaagacuccgucucaaaauaaauaaaagauaaauaaauaaauaaauauaaaauaacauaggaaauuacccagaaguacauacuggacaaaccuuucauuuuuguuuuuuccuguucccuuguucacagacaaauacauuuuuacauacauagcauauauuuuguuuucugucuuuuuucauuuauuuuguaucagauaucuuuuuuguuuguuuguuugagauggagucuugcugucgcccaggcuggagugcaguggcaugaucucagcucacugcaaccuccaccuccuggguucaggugauucuguugccucggccuccugaguagcugguacuacaggcgcccgccaucacaccuggcuaauuuggggauuuuaguagagacggggguuucaccacguuggccagguugguguugaacuccugaccucaagugguccaccugccuuggccucccagagugcugggauuacaggugugagccaccaugcccgaccuauauaucagaugucuuuuauaagucaguauagaagucuuuauuagcuguaagauguuacauuacuuuuuuuuuuuuuuuuuuugagucagaguuucacucucguugcccaggcuggagugcaauggcgugaucuuggcugaccgcagccuccuccuccuggauuuaagcaauucacuugccucagcuuuccagguagcugggauuuacaggcaugugccaccaugccuggcuaauuuuguauuuuuaguagagaugggguuucuccacguuggucaggcuggucucaagcucccgaccucaggugauccaccugccucggccucccaaaguggugggauuacaggcgugacccaccgugcccggcccgcguuacauuuuuuauaccuuuuauucagagcaauuuuagacuuacagaagugugcagaguaguaugauguggcaucaccagcuucaggcaucaucaacucaugccagucucguuuucuucauuuuucccaccuucccccucaauaaauuugaagcaaauuccaacaguuuaauuuuuuggggggguaaggggagacagggucuugcccugucacccaugcuggagugcagugucaugaucacugcucacugcagccuuaaccucccuggcccaagugauccucccaucucagccuccaaaguagcuggaagugauccucccaccucagccucccaaguagcugggaccaacaggcaugcaccaugaugcuuggcugauuuuuguauuuuuguauuuuuuuuuuaaaacagugucucgcucugucucccagaaggcuggagugcaguggugcaaucuuggcucacuggcaaccucugccuccuggguucaagcaguucuccugccucagccuccuaaguagcugggacuacaggcguccaccaucacgucuggcuaauuuuguauuuuuaguagagacggggguuucaccuuguuggccagguggguaucaaacuccugaccucaagugauccgccugccuuggccucccaaagcgcugggauuacaggcaugagccacugcccggccaagauuucuuuaauaagaagacgaaguaugcauuuuuuuuuuuuuuccagaugaagucucgcucuugucccccaggcugaagugcaauggcgcaaucucagcucacugcaaccuccgccuuccggguucaagcaguucuucugccucagccucccgaguagcugggauuagaggcgcccgccaccaugcccggcuaauuuuuguauuuuaaauagagaugggguucaccauuuuggccaggcuagucucgaacuccugaccucaggugaucugcccgcuucggccucccaaagugcugggauuacaggcaugagccacugcgcccagccagaagaccaaguaugcuuuucuggaacccgcauuauguaauagagacagcccaugccaugggcugggaguugggcuucugguccuugcucugcgccuaacuuaccugucuugaugagucuuuccuaccuccgacucucuuuuuuccaguguaguagcguggaguuggacaguaugauuuccagugguagaaaugcaugccucaaucaguguccugugucuuuuccagcgaggggcuacgaguauguguuggagcccucacccgucucccugccucuggacagaccucaggagacacgggugcugcaggucuccugcggccgagcucacucucuuguguugacugacagggaaggaggugaguugaccuauugaagggugauggaagagugcagggaccauuucacugugaacuggagccucaaaucaggccugaguggcuugaucgauugagccacaucuaaugagugaaaugugguauuuccugagcagaucagugggauugcucaagacagcuggacaaaccuuguugauucuuuauuuauuuuuauuuauuuauuauuuuuuugagaugaagucucgcucugucgcccaggcuggagugcagugguguaaucucggcucacugcaagcuccaccucccggguucacgccauucuccugccucagccuccugaguaguagcugggacuacaggugcccgccaccacauccagcuaauuuuuuauauuuuuaguagagacgggguuucaccauguuagccaggauggucucaaucuccugaccucgugauccgcccgccuuagccucccaaagugcugggauuacaggcgugagccacugcaccuggccaccuuguugauucuuaugugcucugcucucugguucuuggaaaaucacauguauuuauaaauguaacugcacacaaggcagccugauccauuugcuaugaagucccugagcugggugguguguagacguggcuuuuucuuuuuuuuuuuuuuugagacagagucucgcugugcugcccaggcuggagugcacuggugugauuuuggcucacugcaaccucugccucccagguucaagcaauucuccugccucagccucccgaguagcugggauuacaggugccugccaccacgccuggcuaauuuuuguauuuuuuguagagacgggguuucaccacauuggccaggcuggucuugaacaccugaccucaggugauccgcccaccucggccucccaaagugcugggauuauagacgugacccacuaugcccggccggaaguggcuuuuucuauuggaauugaaagaagccuauuugcuaacacauacucuaaguaguugggggcuuucagaguccgggccccuggguaacauggccucuuuuuagaaacgggguuuuuccagggaaaggucaaugugaucacauuuuucacauuucauuuuucuuuuuuuuaucugagacggagucuugcucugccacccaggcuggagugcaguggcacgaucucagcucacugcagccucuaccuccuggguucaggugauucuccugccucaguuucccgaguagcugggacuacaggcacccaccacugugcuuggcuaauuuuuguauuuuuaguagagacaggguuucaccauguuugccagucuggccucgaacuccugaccucaagugauccaccugccuuggccucccaaaaagcugagauuacagucaugagccacugugccuagccucaaauuucauuuucuggcugagugugcucuguaggagaaggcggagguggcauuuaggagcucuuucuuuuuuuuuuuuuuuaauuaaaaaguaaacguuaaugucgaaaaugcaaacuuggggaagaugggaaagaucacacacaaggcugucacuucacacuuggaagguugcacagcggcugggcagaggugcuucucacuucccagauggggcaguggccaggcagaagugcuccccacuucccagacaguugacgacugggcagaggcgcuccucacuucccagacagggcagaggcgcugcauuuaggggcucuuucuagaggggauugguguuaagggcagccuggugacagguguggggaguccgguucuagccucagaagguggaauucccaagaaguggaucuagggccaggaggggaaggcgggucuagauucccccaugccccuugugaguuucugcagagccugagaaaguuggagaaggaaacccaggggcaguuggggggugggggugaguaaccaggacgggaccaccagcgagaccccuuccaguccucacauucuaggaucccacaaaccugcagaacugauuugauuggugguguuauuuuuagucuucagcaugggaaacaauucuuaugggcaauguggaagaaagguggucgaaaaugaaauuuacaggugaguuccuaaaaggccuacccuuccccauguugaguuaagugucaaaacauuucuagggagaugacugugguaaacccgcggggcggucagaggcaugccugagagggggccgugagaacucagcagaaagcugggggagugcugucuguuucagguugagcaccauguguuagcuuggugggagaagagggggcaugagcauugguuuuaauguguaaaaccuccggauaaauuuuuuuuuuuuuuuugagauggacucuugcucugucgccaggccagagugcagaggcgcaaucucggcucacugcaaccucugccucccagguucaagugauucuccugccucagccuccugaguagcugggacuauaggcacgugccagcacgcccggcuaauuuuuguaguuuuaguagagaggggguuucaccauauuggccagaaugguuuccaucucuugaccucaugaucugccugccuuggccucccaaagugcugggauuacaggcaugagccaccacguccugcccucuuaggaugaauuuuuacaaauuaaguuuuuauuuuaccaaauugauuuuuaaacauuccccuuuauucauuuuauuuuuauuucauuuuuuucauuuuauuuuuauuuauuuuuuguuuguuuguuugagguggagucucacuguguuacacaggcuggagugcaguggugagaucuaggcucacugcaaccuccgccucccaaguucaagcgauucucauguaucagccucccgaauagcugggauuacaggcguccgccaccgcacuuggcuaauuuuuuguauuuuuaguagagaugggguuucuucauguuggccaggcugguuucaaacuccugaccucaagugauccgcccaccucggccucuaaaagugcuggaauuacaggcgugacccaccgcgcccggugaguucuuuucauuuuaguguuuaaaaacacuucccucuaguuccuuguauguuguuggagggccuuaacaccacucucaacuuuggccauguguuaaaaucaccuaggauuuuguuuggcuuuacuuucaugaccaggccugacucgaccucagauuugaccuugagaguuaccccaacaguuacugugugagcggaggggacgggccaucaguuggggugacagggaaagggcugcacagugcuugucaugaccgcaucccuugcuucuucccaauuuguuccuggcuguagugaaagucacagaguccacaggaugcaggacuucgauggccaggugguccagguaagagagaugggccgagagcugcuuguuguguuccuggggugcuuuugaaaaguugagauuuggguagggugauggcaaauuuguuagggggauuuucugaauuaaauuauuuuaguaaaaauuguagccuacuuacuauaggccaggauuuaugcuagauucuagggauacaaaguuuaauaagauuuuggggccgggugugguggcuauaccuguaaugccagcacuuugggaggccgagacagguggaucaccugaagucaggaguuccagaccacccuggccaacauggugaaaccccgucuuuacuaaaaauacaaaaauuagccgggugugguggcacaugccuguaaucccagcuacucaggaggcugaggcacaggaauugcuugaaccugggagguggaggcugcaaugagcugagagauugcaccacugcacuccagccuggaugacagagcaagacucugucucaaaaaaaaacagauuuuuggggaugacacucuagugagugaacaaguuaaaaagcuaacugaggccggaugugguggcucacaccuguaacgucagccucuggggaggcugaggcaaaaguaucacagcacuugcuguauucaugcauaugugcauugaaauauuuaugauagguaccuaccaugagccaggcacuauucuggggaugagaauaaaauggagagcaaaauacagcuggcuuagaacaccacagcacuaaucauacugugauacggcuggcuuuuugguuuuauuuggaaauuuuuuagaggcagggucucauucuguugccuaggcuggaaugcaguggcacgaucauagcucacugcagccuugaacucuugggcucaagugaucuugccucagcccccuguguagcugggucuacaggugugcaucaccauccucggcuaauuauuuuaaagagacagauucucacugugcuggccaggcuggucucaaacucuuggccucaagccauccucccgccuuggcugcccaaacuguugggauuauggguguaagccaccaugucaggccuccuucaccuauuagacugagugacuuugugcaaguuaccagacaucuccaagauaguuucuuuuucuuuuuuuuuuauuuuagugcaguggcacaaucucagcucagagcaaccucugccuccuggguucaagcgauucucgugccucagacucccgaguugcugggauuacaggcaugugccaccauaccuggcuaauuuuuguauuuuuaguagagaugggguuucaccauguuggccaggcuggucuugaacuccugaccucaagugauccaccugccuuggccucucaacguguugggauuacaggagugagucacugugcccagcugagauucaguuucuuacuaggugguuuugguuauugacuuaacacaaugccugguguaaaaauuguucaauagauggugcuuuucuuuaggcaguuagaaaaaugaguuuggaacugaggagaguuguugagaccagagaucacagugcagaggccacaguuaagcauugagaauggcucccaucucccaggguagcaugaggagugaggagagaggagggcaggagacacacccuggagagagaucccaacagcaaagggucugaaguagaggcugagugugugagcaaggcuggaagcugugaaaguagaagagagggcugggaggagaaggguuauggagaaggggugguucuuuggagauggcgugggauggauggcagagcucuuggauuugccccuuuggagaucugcauuuuacuuuaacaagagcaguuucaaugcagugggagacugguagauugagaaggaguaagaugagcauggagcagucugccuggaccaugcuccaggugcccaggagcggcaggcgauggugcugguccuucuuuggaugaggacaccaggguucuaaguauuucuucucaucccccuuaccucuguuugucugcuaggucgccuguggucaggaucauagucuguuccugacggauaaaggagaagucuauucuuguggauggggugcugaugggcaaacagguagaguucuuuucaugcacuggggucgugaaacuucucagcccgugucauguggagcugugagcuguagggcauuuaugggcuagaacccuucuuccuuaauucagcucuuaccucuuaucacuuucugaggaacacuauucuuggcuccaucgcccaagcuggagugcaguggcgcgaucacaucucacugcagucucaaacucccaggcucaggugauccucccaccacagucuccagaguagcugggacaacaggugugagccaccaagcccagcuaauuuuuuguaacaacaggguuucgccauguugcccaggcuggucuugaacuccugaccuuaagcagucugccugcuguggccucuuggugggcugggauuccaggcaggagccacugugcccugcuguaauacuuuuuuuuugcaucccuuccauuccccucagcccuggcucccauagaaaugaacugagagaaggcugggugcaguggcucacaccuguaaucccagcacuuugggaggccgaggugggcggaucacuugaggucaggaguuugagaccagcuuggccaccauggcgaaaccccaucucuacuaaaaauacaaaaauuagcugggugugguggcacacggcuguaaucccagcuacuaggaaggcugaggcaggagaauggcuugaacccgggaggcggagguugcugugagccaagaucgcgccauugcacuccagccuggacaacagagcaagacucugucucaaaaacaaacaaacacaaacugcagagaaaaggacaggcaggaccugcccaaaggcaaaugucauuauuggcacuugguauggggguaaccccuggccagcagcccaaggcagagcacugaacuguagacucuugccuucauccaggguccuuaaaggggccuauuccucagcaggugaauggaucaaccguggugcauccagacaauguaauguuuguuauuuagcacuaaaaagcaauaagcugccaacccauggaaaggcauggaggaaacuuaaaugcaugauacugauuaaaagaagccuaucugaaaaggcuacauacuauaggauucuagcuauauggcauucugaaaaagacaaacuauggagacaguaaaaagaucggggccgggcgcgguggcucaugccuguaaucccagcacuuugggaggccuaggcagguggaucacgaggucaagagaucgagaccauccuggcugacacgguaaaacccaucucuacuaaaaaauacaaaaaaaauuggcugggcaugguggcgggcgccuguagucccagcuacucaggaggcugaggcgggagaauggcaugaacccacugugcccagccucucugcuuauuguuaaccaugccauuuuaaguucccuguuuuuugggagugguguuggggauggcaugggcucuuagagauuuucuuuacuuuuagcaagaccaccagugcauuagaaauugcuuguugugaucaggcagguggcucacaccuguaaucuaagcacuuugggaggcugaggcaggaggauugcuugagcccaggaguucgauaccagccugggcaacauagugagaugcugucucuauuucaauauaaaaaaauuuuagaccaggcgcaguggcucacgccuauaaucccagcacuuugggaagcugaggcaggcggaucaccugaggucagggguuuugaggccagccuugccaacaugacgaaaccgcaucucugugaaaaauacaaaaauuagccggcugugguggugcgugccuguaaucucagcuacuugggaggcugaggcacaagaauuaaagaacugcuugaacccaggagcuggagauugcagugagccgagaucgcaccacugcgcugcagccagaggaacagagugagaccgucucaaaaaaaaaaaaaaaguuguaugagcaugcaacuaagcagauuaggguuucuuuucuuucuuucuuuucuuuuuuuuucuuuuuuuuuuuuuuuugagagucucauucuugccaaggcuggagugcaguggugugaucuuggcuuaacuggaaccuccaccuccuagguucaagugauucuugugccucagccuucugaguagcugagauuacaggcauguaccauuaugcccuaauaauuuuuuuguaauuuuuuuuuuuuuuuuuuaaguagagacaggguuucgccauguugaccaggcugaucucgaacuccugaccucaagugaucugcccaucucagccucugaaaguggugggauuacaggcgugagccacugcacccagccccagacugggauuucugagcugauacuuguuaagugcuuaaaacugcacuuggcauauaguaagucugccuauguguuuguuaaaagagcgaauaauuaaaaaucuguauuuuccacuguguuaggucugggucacuacaauaucaccagcucgcccaccaagcuggguggagaccuggcgggagugaacguuauccaaguugccaccuacggugauugcugccuggccguguccgccgacggaggacuuuuugguuggggaaacucggaguaccugcagcuggccucugucacugacuccacacagguaugcagucgccgacagcguggugcugggagguuuggaaacauuaaaguguuaaggggccgggugugguggcucacaccuguaaucccagcacuuuggaaggccgagacaggcagauggcuugaggucaggaguucaggaccagccugggcaacauggcaaaaccccaucucuaccaaaaaaauacaaaaauuagccaggugugguggugcaugccuguaaucccagguacuggggaggcugaggcaugagaauugaaucguuugcagauugcagugagcugagaucgugccaccacauuccagccugggugacagagcaagacucugucucgaaaaaaaagagcaaauaggcugggcgugguggcucacgccuguaaucccagcgcuuugggaggccaaggcaggcggaucaccugaggucaggaguucgagaccagccuggccaaccuggugaaaccccgucucuacuaaaaaaaaauacaaaaauuagccgggugugguggugggugccuguaaucccagcuacuugggaggcugaggcaggagaauugcuuaaacguaggagguggagguugcagugagcugagaucgcgccauugcacuccagccugggggacgagagugagacuuugucucaaaaaaauaaaauaaaagcaaguaaaggaauaaagaaugacuacuucauaggcagggcagccaccacacacuuuuaagugaccagaucucaggaggaccaaaaaagguuauguuaaaccaugagaaaccacccccaugagccagucaucuccgaccagaccccaccuccagcauugggguuuacauuucagugugagauuugcgggggggacagagaucuaaaccauaucaaucguauaacuaaucucucuucccaucacucauuuuccacaauuaccaacugauggccaauucaaaaaauagagauaugauucacauaccauaauucaccauuuuaaaguuuacaauuuaguggauuuuaguauuaacauauucacaaggcugcacaacuguuacuacuaucuaauuucagaacauuuuaaucacuccuccaaaaaaccccacaccacuaguggcuaguuuuuuguuuauuuguuuguugguuuugguuuuguuuuuuuucgacauagggugucacuuuguuguccaggcuggugugccaucauagcuugcugcagccucgaacuccuggcucaagcaaucuucccgccucagccucccuaguaacugggaccauaagugcacaccaucacgcccagcuaauuuuaaaaaaaaauuuguuauaaaacaauuagccaggcgugguggugugcaccuauagucccaggugcuggggaggcugaggcaggagaauggugugaacccaggagguggagcuugcagugagccgagaucaugccacugcacuccauccugggcgacagagcaagacucugucucaaaaaaaaaaaaauuuuuuuuguuguagagacagggucucacuuuuuugcccagccuggucucaaacuccuguccucaagcgauccucccaccucagccucccaaacugcugggauuauaggcacgaccacugcuguaccuggcuggugcagugcugcaguuugaggcuguacuguguugugaucaugcuugugaauagcugcugcacuccagccugggcaacauagugagaucccaucucuaauaaauaaacauauuacauuccuugauaugaucaaauuucugacaacauacagcaagguuuuaaauauauauuaacagagaaaucugcauaaagggaaacuaaaggucagcuaagaauauuuuuuuaaaaagucuccucuguggucugguacaguagcuagaagugguugcagauuuggcuaggagcuuccuaguaggcaaagcaaagaagaaacaugguauuuaaaugauucauuguuccauaagauaaacagcagaaaagguguuggggagaaguacggcucucccuguuaccaaggucugagagaaaugucacccauggccuuccugugggggacagauccagugguaugccauuguuaucuauugccacauaacaaauggccccaauacuuagugaauuaaaacaauacacuuuauuuauuuauuuauuuugagauaggaucuugcucugucacccaggauggagugcaguggugugaucacggcucacuguaaccuccaccuccuggguacaagcaauucuccuggcucagccccccgaguagcugggacuacaggcacuugccaccacgcccagcuaacuuuuguauuuuuaauagagacaggguuucaccauguuggccaggcuggucucgaacuccugaccucaagugauccaccugccuccgccucccagagugcuaggauuacaggcgugagccaccacacccggccacaaaugucauuuuauguuaauuuugguugacaucugccucguccacuagacuagaacucucugaggguggaaacugggccucuuuugcuucccauucuaccccagcaccuaguaugaugcuuggcaugugauguucaggaaguaucuguggagugaaugaaugaacuaggacucagcuacucuguaccuaagaccagaacacuucccgguccuuacuggcuugcuuuccuaacaguguggcuccuuucuuugguucaggugaaugugccccgcugcuuacacuucucaggaguggggaaggugcgacaggcugcaugcgguggcacgggcugugcaguguuaaacggugagaccuucuuuccgguggcucauugggaagcuguagguagauuacauagggaguggucaguguccauuggauuugcaggccguagaccuuagccuuaggaggguaacauggcugggcgcgguggcucacaucuguaaucccagcacuuuggggaacugaugcaggaggauugcuugaggccaggaguuccagaccagccuggacaacauaacgagacccugucucuaccaaaaaauggagaaauuagcuggaaggcugggugugguggcucacaccuguaaucucagcacuuugggaggccaaggcgggcagaucaccugaggucaggaguucaagaccagccuggccaacguggugaaacccugacucuacuaaaaauagaaaaauuagccagacauggugguacaugcuuguaauccuaguacuuggaaggcuaaggugggaggauugcuuggacccaggaggcagagguuguagugagccgagauugcgccacugcacuccagccuggaugacucugucucaauagaaaaagaaaaaaugaaaaauuagcugggcaugguggugcacaccuguagucccagcuacucagaaggcugaggcagaaaggucccuugagcccaggaguucgagcugcagugagcuaugaucaugccacugcacugggcaacacggugagacccuguuucaaaaaaggaagggacuauggccaugggaagauggcauuggauuagaagauggcauuacagggugugaaugaaguucuuaacaaaaagcgaauagucugcgauuuaucuguagauacauggccacagagcugagucauccuagagcaaaccucuggaguggagagcgaacuacuucauuccccucccuuagccugggccagagagacuccagcucugccuucuccagccaaaaaaucaaaggcagaugggagaacagccuucagcuuuggauaacgaugaaauaucuggcaccacugaugaauauuaaacuuucuauaaccaaaacaucauuucuaagaguuuuaagaaucuggccagacauuguugauguguuuggccuucugaucagugugaaacacagagcugucauuagggggagaaaacauccuccaauucucugguauucguauggguuuucuggaugauuuauacgcucgucccuuccagguuacuaacccucaagaugugggaaguuuguguucugagccaggagagcuggcgagacagacucccccagcaagaauuuaagcaggggagagagaauuauuauucuaaaucucugucugcauguucuugccaagcaaggaggaaaaaaacagaacaaaaaaaaaacaaaaaaaaaccguguggaugucauaaaccuuggugguguaguuugaguuucuggugagggagguucuuacuuggauggacuuacugacccuuguuuuuacuguaauguaggagaaggacauguuuuugucuggggcuauggaauucuugggaaagguccaaaccuaguggaaagugccgucccugaaaugauuccacccacucucuuuggcuugacggaguucaacccagaaauccagguuucccgcauccgauguggacucagccacuuugcugcacugaccaguaaguuaccaagcccgguggcccuggugugagcccagcagagguucucugucuccaguucaaccccaaacugcgggcagcucucagguuccacccauccaacagaacggcgccuuuguacugauaacucaagcaagggcuaagccagaaguuguuugccucgagguuguauaaugucuuguuuucccccccuggaguuuuaauuuugguucguuugguuuguggguaggcuaacgugaacgugcauuuucucaagagagcacccguuggugguaggaaggggcauugcuaguacgucgggugcuggaggaaaccagcagaggcuuggcggauccaugggugggugauuaggaagugaauguguggggcuuaaucccauucccuggccgagcccagacccugaucugacccaggauaugggauggcaaaaggccgauuugucagacugucccgugguuucacggagguaaaucuaccgauuucuccaaagugccgggguagagaaugaugaaaggggagagcaaaauggagguuuuucccaaaggccugccagauuacaaagccacagaauauccgcuuacccugcaggguaaggguaaggaauguguccuuuucuugguuacaucucuuacuccaccacaguuaccguggguucaauuugcugcucuuuaguugacucgaauaguaaaacuguccugaauuaauuucauucugugauucucaaguaaauuaguuauuuccuugcaauuaaaagaaucuuuucaucucauggcaaguaauuguuuucuuuuuaaacauccaggccgggacagucaguuggugucaucuuugguugaguucucuggccucauucccacguggggccugucccagaugcucacccucuguaccaggguccuaacugcuauucacuuauugucugaauuccaggcuccagaggccgucaaacaggcaggccuggguuguuauggcugccagcuggaguuuuaucuggcucuaggcugaagcacugaaguggcaguggucaugacuaagccagagaauuccuggccacugcccagccagaguggccacuugcauuugcagcugaguguaggucucaugaauucuuuuuuuuugaguuggagucucacucuuguugcccaggcuggagugcaauggcgcgaucuuggcucacugcaaccuccgccucccgaguucaaacgauucuccugccucagccucccaaguagcugggauuacaggcacacaccaccacgcccggcuaauucagugucaugaauucuuaaagcuauuuugauuugauaaauaagagucguauggacuaauuuuuggggaaacaaauaucuacuuuccagaaaguucuuaaggccucaacuaugggcagagacacauguuuagaaaucugugugaagcauuugacuagagcagaggcuuuucuauuugcccucaugccauguagccauuucaggucacagcgaaaugaaauuccuuucuggauuucuccccgagacuuaacaggccuccuucuaagggugaguuacugccuguugguagacagagccuagcugucuuccugccugugugccuggcauuugcagauagccaucugggaauuagaguugguugguuuauccuguggucugcuagcauuuuggggagccaggccgaauuguucuauuaaacaccuaagggcuagcugggugcaguggcucaugcuuguaaucccagcacuuugggaggccaagaugagaggaucccucaaagcccaggaguucgagacuagccuaggcaacauagugagaucccuuuucuacaaaaaauacagaaauuagcugggugugguggugugcgccuguagucccagcuacucuggaggcugagguggaaggacugcuugaguuugagaguucaaggcugcagugagcuauguuugugccacugcgucgcagccugggcagcagagugagacccugucucaaaagcaaacaaacacacacacacaaaaacuaucuaaggucugaguguggagaacaaggggcaugcuuagaucaggggccuaagacagcuuguaauuauuccguacuucaucagccccaggucuuguaguccuggcuuuuccaugucacuuccucugccucccaugacccaagccuuuugcccaacagcugauggugacaugggcccaggagugccccagcuggugcagacagagucccaccugaaggccgggcuaggagaggccaucuccuggguugaccucuuaaacagcaucuuguacuuuuucuucaugacaguuuuuacaguuuguaaacauauauuaaaaucaucugucuguuccgucucuggccaguccccagcuccuggaacacagaccuagacccagcacaagcaggcacuuggucauuagaugcccuguggcugaaugcucccaagauauggacaaucaauccaggaaugacaaauugucuuacuuuucacugucaaaucaggaagcccagggugucgccaggauuuguggaaggcagaguuugguggcacacgauugugggcggggcacaaggggugagcagagugggccgugugcaccagugaccuccagccccgugcaccacccccagaccccagcuccaugcaccacccccagaccuguccaccacccccagaccccaacuccaugcacuacccccagcccuguccaccacccccagaccccagcuccaugcaccacccccagcccuguccaccacccccagaccccagcuccaugcaccacccccagccccgugcaccacccccagaccccagcuccaugcaucacccccagccccgugcacugcccccugccccaucuucauuugagugcucaucucccacguggguggaugcagcagaaguccuggccguggauguguuuucgauauggggacagcaucucagacccuuacuuuugccuucaaagaaagcaugaacgccugguaaaagcugaacagugggcucuguagguauccgguucuagaaagccuguucucaugacccauccucuccuuggagacuuguucuucacacagucccaaccaaccccuguuuuccucccuuugcagacaaaggagagcuguuuguauggggcaagaacauccgagggugccugggaaucggucgccuggaggaccaguauuucccauggaggguaaggcuggccggggaggucuugagaauggaugcuaagaguagagucaccugacgucacugcagacaccucgcgugcagaugggccaggacgagggccaugggaccugcucccccuuccggguccuggcugcacuccugcagcgcggcaugcuaugucauugcacacucuguggugacacccaugagauacccguggugcaucugcauggugugaugcgugggggagugacaccaggcuucuuggggugcaggagcugggucaacccaucccggcccacugacugggagguuggagggaguagcccacucaagcauccaguccuauaagaagcccugucggaggccauccuugggguggaucggggaaacagaggcacgauggugcaaaggcucugguagggugccaugaggcuccggagagggggagauauuggaugaaguuggcacgcuagaagcuguuuacagaagcccaugugggggaaugcuucacaaugaauuuaaaagaaagcaggauguuuaauauuuagauggcccaaccgcagcuaugaagugaaaaaauaaagucgcuuccuuaggggcgguaguaugcaauuagacaaaaaggcuccuuccagaauuacaggggaagagacgcucauucuaaaauuguaguuuaccuuaguguuguuuacuaagucaguucuuuaaggcauucuaaaaaaggagguuuuugggguuuuuugaacaugaaacauauguucaugguacaaaaaaaugcacuauggaaaaugagucucccaccacccaguuuuuguuccagaggcagccacugguccugauuucuuuauguuccuuuccagagauagucucugcauagagacuggugugcaugcgugcuuugugugugugugccugugaguacauacaugugugugcagugugcauauggguguauuuuaucagaagguuggauuuuaauuuguuuugaaauugugaaaagcguuuuuaaaaaggacuugcaccagguguggugucucacaccuguaaucccagcgcuuggggaggcccagguggguggaucacaaggucaggaguucgagaccagucugaccaacauggugaaaccccaugucuauuaaaaauacaaaaauuagccaggcaugguggcacacgccuguaaucccagcuacuugggaggcugaggcaggaaaucacuugaacccgggaggcagagguugcagugagccaagaucagacgcugcugcacuccagccugggcaacagagggagacugugucucaaaaaaaaacaaaggacuugcaaaagaaauguguauauauauauguguguauauauauauguguguauauauauauguguguguauauauauguguguguguguguauauauguguguauauauauauguauguauuuauauguguguguauauauguguguauauauacacacacacauauaaauauauauacauauauaauacauuuauauuauacguuuauauauauuaaauauauauauauauuuuuuuuuuccaagacuaucgguggaggcucugagaaagcaaguugaaauggagacuuuaacuuuguuuuuuuguuuuugcuuauuaugagacagggucucacuuuuaucacucaggcuggauugcagugaugugaucacagcucacugcagccuugaccuuccugggcucaggugauccucccaccucagccuccugaauagcugggaccacaggcguacaccaccacaccugacaaauuuuuuuauuuuuaguagagaugggagucucacuauguugcccaggcuggucucaaacuuccggcuucaagcaaucugccucccucagcuucccaaagugcugggauuacaggcaugacccaucacgcccgggcgacuuuagccuuguuggaaagcuguuuguauaauagaguuguucccaaggugguggggcuugccggcuuucuccugagccuggaaacugccggugugaggaacagagagucgggcaguggguguggcucagauaaugugagcaucagucaucuacaugcccacuugcuuucucacugacuccucucuucucucacuuugcccuuucuuucgaaaaggacuuccuucugaggggggaacuugggaaacaguuaaagcagccggguuuugggugaaagaacgcugacgagggucugccccccgcccucauuuccuucaaaucagagugaucagccugagauuugacucaggucacguugccccugccauaagggcaugugcaaagcgcuggucccugugcgggcagggaguggccggagcccgaucccguugacauuccaucugggucacuugcccuggcucgccacacaccaaguguccuucuggucauuugcuuuuuauuuuuauuuuuauuuuauuauuauuguuuugagauggagucuugcucuguugcccaggcuugagugcaguggcaugaucucagcucacugaaaccuccaccuuccggguucaagugauucuccuuccucagccucccugguagcugggauuacaggugcaugccacgacgccuggcuaucauuugcuuuuuaaacacauuugugccuuugggaaaagagcaccccagccugucccugugacggcggcauuuggcgccaaaccauuguccuuccucuugcacauucagggagccccuaaggguuugugcacggaguggccucgaccccuguccucuuuggauuggggugggagaguccagucccuucugaugacucacuuaaaaaaaaaauuacaagugauuuuucuuuucuuuguuuuguuuguuuguucuuuuagacagggucuugcucugucacccaagcuggaguguggugacaggaucucggcucacugcagccucugucucccagguucaagugauccuccuaucucagccucccgaguagcugggauuacaggcuugcacaaccacaccuugcuaauuuuuguauuuuuuguagagauggggucuugccguguugcccaggauuuuuuuuuuuuuuugaaaacagggucuugcuuugucgcccaggcuggaguauggugugaucacacucacugcagccucaaacucccaggcucaagcuauccuccugccucagccccacaaguaacugagaugugggaugggaugacaggcaugugccagcaccacacccaaauaauuuuuuuuucguuuuuuuuuuaagagacggggucuuauguguugaucucaaccuccuggucucaagugauccucuugcuucagccucuggaauagcugagauuacaggcaugugccaccacacacggcuuauuuuauuauuuauauuuauuuguuuuauuuuauuuauuugagagaugaggucuuccuauguugcccaggcuggucucaaacuucugccucaaguggucuucccaccuuggccucacaaaauguuggaacuacaggggugagucacuggcuugggugaucuuuauucuuuaaaacaacuauguucaaauuaaucuuccguaggggauauauuacaucauuuaaaaaguauuccagaaaagaagagaaaaaaagaguaaaacuuuacuuguagcucauacacugguaccaacuaguuauucuuagacuugcagaauuuggccuuuucugaguaugugggcccgggaggugacaucugagccaccugauucaaaccucugcuuccagaaacuuuccaggacauguuuuuuugcuacacguugagacucaucccucagagagguucagugguuucccagggucacauaucuaaguuggagucagagccaggauuuggacucaguuacaucugacuuuuaagacaauggucuuuccacggccacccaccucccugggcgagccugaagcugguguggagagaaggcagcacgcaguggcacggaacauuugaccaggcguugucuggccuuccaagacccucugaccuaagggggagugccacagaccuacagcaggcagcgaggggguguggaguggccuucaccccucaucccccagggagcgcccuggcuuuccacagacaaacauuccagccuggcuucgggggagggcagggcauggacagcgugcugggcacgugauguccauucucucucauccuccagacaccuugagggugggguuucucccuccacagugugcacacggggacacggaagucaggagcgaaggggcuugccccaggucucacggccccugagcucauuggguauaauuugaacuugcgacucugccuguagacggugcuuccccuccccgugggcccugcaggucaggaccgguggggucuggagacacaagcuggggagcucgcugacuucuagccucgcuuauacgacuccuuccauagcccugggucuuagguggugguucuuuuuuuuuuuuuuuuuuugaggcgauguccugcuuugucacccagguuggaguacaguggcacaaucugggcucacugcaaccuccgccucccggguucaagcgauucucuugccucagccuccccaguagcugggauuacaggcaugugccaccaugccuggcuaauuuuuguauuuuuaguagagaugagguuucaccauguugcccaggcuggucucgaacuccucaccucaggugauccaccugccucggccucccaaagugcugggauuacaggugugagccacugcuccuggccggugguucuuuuuuuuuuuuuuuuuuuuuuuuuuaauuauuggccaggcgcuauggcucaucucuauaaucccagcacuuugggaggccaagaugggcagaucauggggucaggaguucgauaccagccugaccaacauggcgaaaccccgucucuacuaaaaauacaaaaauuagccaggcgugggggugcacgccuguaaucccagcuacucagaagucugagcaggagaaucacuugaaccuaggaggcggagguugcagugagccgagauugcgccacugcacuccagccugggcgacagagugauacucugucuccaaaaaauauauauauauuauuuuauuuauucaucuguguauguacccaccuaggugguucucacaaugcaggagaggaguacaaguuaaaagccgggcacaggccaggcaugguaacucaacgccuauaaucccagcgcuuugagaggcugacgcgaaaggauugcuugaggccaggaguucaagaccagccugggcaacauagugagacuccaucucuacaaaaaacaaaugacccaggugcaguggcgugugccuguaaucccagcucccugggaggcugaggcaggaggaucacuugagcccaggaguuggaagcugcagugagcuaugaucacaccacugcgcuccagccgggggcaacagaacaagaccuugucucuaaacaaaaauuuaaaaauacaaaagcggccgggcgcaguggcucacgccuguaaucccagcacuuugggggugccgaggcgggcggaucacgaggucaggaguuugggaccagcuuggccaacauggugaaacccugucuccacuaaaaauacaaauauuagccaggugugguggcgcaugccuguaaucccagcuacuuggggggcugaggcaggagaauugcuugaacuugggaggcggagguugcagugagccgagaucgugccacugcacuccagccugggugacagagcgagacuccgucucauugaaaaaaaaaaaauagaaaagcuggugccauugaacugcagagcugggcgccggaguagucucccuuucucuggcucucuuguccccacgaaggacucaccgcccaggguuccuucuucccgcacccccgucuuucaccuggugggcguucguuuuagcaacuuguaauuguggauagggauguuccuaaauggauucugcugagacuuuuaagagagucaccaaggcuaaauaugguucugguuuuuggaacuguuucccucagcagcggaguugugaguguaaauuggcuuagaagaaaaacgccauuuaaccuugccuaggacaaaaauaaaacauggcugagggcagucuccucuuggacucaguucagagaccgugugagauuguccgccagggggagcuggaaccuuggggagccucccgcuggucccuagggcuggcucccaggagccgggcccuugcugcccaggccacccgcagcagagaccaucguggcuuccuuugcuuugggcuugaauggccagagcccucggggagcaaggaccugggggcuuaagugcagccgugaggaagcgcacugucccgggaaagguaaauaaagugcucccuaauggcuggggagguugcuaagaggcggucggggcccagucccugcagaggcagccuguuuucuucuccggccagccucucaggcuuucugcaucgacgugccuuugcgauucacugggccccguucuuguuuguuuagugauuccuguaauagguucugcuaaagacauucauuuguuuagggacagggcugggggaugacagcaugacuugguuucuagcauccaucugcuguggccaggagucccuaauggucuugucuccuggcguaggugcaaagcuccggggucggcgccugccgccucucggcuuuuagggccaggccaucuggauuaggcgguuucccucuuaagcucgguaaacuccacagacugugacagauccccuuuccagcugucacaccaccuggcugcaugcugccaccaggggaggguggucgaauucggaucuggucaguagaucaagugccagcauccuggcaggggucuuccggccaagccaggcagggucacuuucuuugcaguuggcacuuaagaaaggaagagaaggccaggugcagcggcucacgccuguaaucccagcgcuuugggaggccaaggcagguggcucacgaggucagaagaucaagaccauccuagccaacauggugaaaccccaucucuacgaaaaauacaaaaauuagcugggcaugguacugcaugccuguaaucccagcuacuugggaggcugaggcaggagaaucgcuugaaccagggagucggagguugcagugaacugagauugcgccacugcacucuagccuggugacagagcgagacuccgucucaaaaaaaaaaaaagagagaugcauaucugcuucuuugcauaaagaaccucuggaaggccaggccuggggaucacaccuggaaucccagcacuucgggaggcugaagcaggagaaucacuugagcccaggaguucgagaccagccugggcaacauggcaagacccugucucuacaaaaaauacaaaaauaagcugagcauaguggugcaugccaguaguccuagcuacuugggagggugaggugggaggauagcuugagcccaggaguucgacauugcagugcgagcuaugauugugucucuauaauccagccucggcaacauagugagaccucugucucuacaaacaaacaaacaaaauuagccaggcaugguggcacgugccuguagucccagcuacuugggaggcuaaggcgggaaaaucacuugagcccaggagguuaagccugcagugauugcaccacuagacuccagccugggcaagaaagugagacucugccucuuuuuuguuucugagccagagucuugcucuguugcucaggcuggagugcaauggcgugaucucggcucacugcaaccucugucuccugaguucaagcaauucuccuacuuuagccuccugaguagcugggauuacaggcgccugccaccaugcccagcuaauuuuugcauuuuuaguagagacgggguuucaccauguuggccaggcuggucucaaacuccugcccaccgcggccucccaaagugcugggauuacaggcgugagccacugcgccuggccuagacccugucucuuaaaacaaaaacaaaacaaaccucuggaaaguuaauaagaaaucaguuaaaaguaguuuucaguucagaggcagauggggacuggggcagcuggugauaggugugguaaugaaagacuuuuuuuuuuuuuuuuuuuuuuuuucgagacagagucuugcucugucgcccaggcuggagugcaguggugcgaucucagcucacugcaaccuccaccucccagguucaagcgauucuccugccucagccucccgaguagcugggguuauaggcgugcgccaccacacccagauaauuuuuguauuuuuaguagagacaggguuucaccauguuggccaggcuggucuugaacuccugaccucaaguggaguccaccucagccucccaaagugcugggauuacaggugugagccacugcgcccggcauaagaaucauuuaauagcuuuuucuucuuuuucacugaauguccuuuuaucuugcagcuaugugaaugcacugccuagucauaauaaacaagaaagagaaagcagagugccccuuuccuggauagcuggauuggcuauggcccugggcacaccuggaguuguugaggguguccguuuccauggcgaggcuauagaacagugggcgcccuuccaacaggcuagagccuccaugucucagugaggccaucuucuugcucccuugaagcuugggcuguccucugaugccauguugucagcccagacaggcagugugaucagggcuccuggcaagggucuuugagacacagccacugccccugcuugguggucgugacuugggacgcagccugccugugacuggagcugggggugacggguaagaugaguggagauguugggccaguggggccugauucccagacuggaccugcaaggcaagagacaggguuucuggagcuuguuuuugagacagagucucgcucugucacccaggcuggaguguaguggugcaaucuuggcucacugcagccucuaccuccuggguucaagcaauucucccaccucagccucccgaguagcugggauuacaggcgccugccaccacgccuggcuggucucaaacuucugaccucacgugauccgccugccuuggccucccaaagugcugagauuaugggcgugagcuacagcgcccagccccuggagcuucuuagugagccauagcaguggcucccaggagagaucucugaacaccuggccugggggcauggagccuagugggguuagggucagaggggagcagccccuguagggcgugcagguuccagggaugcacacaggcccauguuccugcccgacaugcccucucaggcugaugugaauggugauggcugccauugacuggagggaguugggauggccuuguccucaugaccacacgcaguuguccugauggaccugcuggggaggccuaagugcccccauucccagaggguagggagccgaggcucagagaagcugucuccuacugagacaagcugucuccugcugagacaagcugucuccuacugagucuccuacugagaggcagggccgggucggccaacaccagcgccugucuccuccgggugcgccacccccacccaugguaugcuggaucuuauuuuucaggugacgaugccuggggagccuguggacguggcauguggcguggaccacauggugacccuggccaagucauucaucuaaaccucccucaccugcuugggcggccccgucccgggaaccacuggcacuccuuggcagaggccagcgcguggccagccccccgggguucuuggauggugguggcggaggacccugcgugcagugugacgcucuguccugaaucccuuagcggguaccuaccaggaggaucagggcaaggucccucuccagcugcaggugaggccugcggaacucagcuuggauggcagccuuuggugggccgcuguggcccgcacgucucuguucucuccaaguaacaugcgacggugucuggugucacgucucgccugagaagcccgucuuaggaaagcuuagcuugaacacagugcucgggagguuucugcucugucugucauggcagucucuugguuugugucuggccaaggccaugcgugugccucggaccgagccccagcuuaggcgagggagucaggcuggcuucggcccucgguuuucauucaggccacccugcucauggcccuuccuggccgccugccacaccgcaagcucgcuggggggacacuagaagcaccguggccugggauuccaucuggagcuguccgcaggcaccagccccagccucccaccacgcucacugccuggcuuggaaaaguuaagaagccccucaggaagagaaucgaggcuaaguuccucugcgccgagggccccgagcauauccgccaaggcucagcugcagugccaggcggaggaggaagauccagaaauugugaacaauguuugauuuaguagcgugacuugccuuucccuuuaaaaacaucuuuuacaaaucugucuuggaauaaagucuauuuucugccuuuugguuuuuaagcucugaa

SEQ ID NO: 191546 - RNA, 22907 nt, Homo sapiens
gguggcgggaagaggaggcgcgagaauggagguggaggccgucugugguggcgcgggcgagguggaggcccaggacucugacccugccccugccuucagcaaggcccccggcagcgccggccacuacgaacugccguggugaggucccaggccguaaagaaugggcgcguuuggacgugagggugggcgaguggcgggccgugcuccggagaaacucgggggucaggggcucguuuuggggaaucccgagggaggaggaggccccggguggcaucgagaugauuucaagaaggcgacggacauggaucgagaguggccggucuaaacucugcgagcggagucucgcucacuacaaugcuuaugacaauuagggcuaccccggguggccaccuacucugaccuaguugguuuuuucaaaaguuuuuguguauaguaguguaugaccuaguguuuucaaaaacuucaaucuuuuaaaaaaaauaucgauuacauguugaaaauaauauuuugacuguuagguucaauaacauuuacauuugaaauuuuuuuaaaaaaaucaagacggggguuuugcuguguugcccaggcugauguccagcuccuuggcucaagugaucccccugccucagccuccuaaguagaugggacuacaggcacgcaccaccaugcccaguuaauuuuuuuuuuuuagauggagucacacuuugucacacaggcuggagugcaguggugugauuucugcucacuacaaccugcaucucccugguucaaucaauucugccucagccuuccuaguagcugggauuacaggcauguaccaucacacccugcuaauuuuguguuuuuaguagaggcuggguuucaccauguuggccaggcuggucucgaaguccugaucucaagugauccguccgccucgccuucccaaagugcugggauuacaggcaugagccacuguacccagccuaggccuacggugucuagccagcuaugcuguguauuuggcacacgucugcagaaacuggcagguaauccuugccuggcaugguggcucacgccaguaaucccagcacuuugggaggcugaggugggcagaucaccugagguugguagugacccaagaucgcaccauugcacuccagccugggcaacaagagcaaaacucugucuccaaaaaaaaaaaaaagaaaagaaacuggcagguaagggaugagaaaggagcuugguugcacccauguugucacaccaaaugaugucagugcuguaugugcugggccucuugugacgggcggacaggguugcagcacagugucacauugcuccagaugaccugugcuggccgugcuccagcagcaacagguguuucucugcuguggcagguuugaagccuaugcuguacaauucucaugccuuuaacuuuucaaauggcacuugggcaucuuauuacauuuuauuuauuuauuauuuauuuuugaaacagagucucacucuguagcccgggcuggaguauaguggcaugcaugaucucagcucacugcaacuucugccucccagguucgagcuacugugccuuagccucccaaguagcugggauuacagacgcacaccaccacauccagcuaauuuuuguauuuuaaguagagaugagguuucaccauguuggccagacugggcucaaacuccugaccucaauugauccacccgccucagccucacaaagugcuaggauuacaggugugagccacugcgccuggcugucaucuuauuacauuuaaaacuugcaaccauuuggcauaguuguacugaauguauguaauuuuuuaacaaagcucucaggauaacccuuaggugcuuuuugugggguagugugaagauaaccaugucagcauuuuuaugcauuuucuuaacaggguugaaaaauauaggccaguaaagcugaaugaaauugucgggaaugaagacaccgugagcaggcuagaggugaguggcuuuuuuuuuuuuugagacagagucucgcucugucgcccaggcuggagugcaguggugcgaucuccgcucacugcaagcuccgccucccggguucaugccauucuccugccucagccuccccaguagcugggacuacaggugcccaccaccacacccagcuaauuuuuuguauuuuuaguagagacgggguuucaccguguuagccaggauggucucaaucuccugaccucaugauccucccgccucggccucccaaagugcugggauuacaggcgugagccaccacaccuggccuuuuuuuuuuuuuuuuuuuuuuuuuuugagauggagccucccucugucgcccaggcuggagcgcauuggcguaaucuggccucucugcaagcucugccugcuggguucacgccauucuccugccucagccuccggaguaacugggacuacaggcgcccgccaccaugccuggcuaauuuuuuuuguauuuuuaguagagaugggguuucaccguguuagccaggauggucucgaucuccugaccucgugaucugcccaccucggccucccaaagugcugggauuacaggcgugaaccaccgcgcccggccuuuuuuuuuuuuuuuuuugagauggagucucgcucugucgcccaggcuggagugcaguggcgccaucucagcucacugcaagcuccgccuccuggguuuaagcaauucuucugccucagccuccccaguagcugggacuacaggcacacgccaccacgccuggcuaauuuuuuuauuuuuaguagagaugggguuucaccguguuggccaggcuggucuugaacuccugaccucgugauccgccugccucggccucccaaagugcugggauuacaggcgugagccaccacgagcggccuugaguagguuuuuaaaagaugaccuaaggcugggcacaguggcuuacaccuguaaucccagcaccuugggaggcuaaggcgggcagauuacuugaggccagguguuugagaucagccugggcaauguggugaaaccagucucuacgaaaaaauuuaagaaugagcugggugugguggcacaugccuguagagucugagguucaaacugggcauggugacaagugccuguaaucccagcuacucgaggccaaggcaggaggaucccuugagcccaggaguuugacgcugcagugagcuaugaucacgccacugcacucuagccuaggugacagaguggacacccuuacuuugagaaacaaaaagaguuugggcuucauagugagggcagggaggagucaaggauuucaguuagggaaaaauguuuuaauagggccgggugugguggcucacaccuguaaucccagcacuuugggaggccaaggcgaguggaucaccuaaggucaggaguucacgaccagccuggccaacauggcaaaaccccgucucuacuaaaaauaaaaauuaggcaggcaugguggugggcgucuguaaucccagcuacucaggaggcugaggcaggagaaucgcuugaacccgggaggcggagguugcagugagccgagauugugccauuguacuccagccugggcaacaagagcaaagcuccaucucaaaaaaaaaaauguuuuaauagguguguacuuuaggaaaguggucgugguuacaggaugggaaauggauuugaaugggagcauggagaccacuuaauggcccauugauagcaaucagacgagauaaugggcuuaagaaagugguagccgggauggagagaagggauggagagaaguaaaggacgcuggagacgaaggaggaggauggugaagcccugguuauugaaguacucagggugaggaugaggccaaaccaagaugauggcaaccucaacuucauggcauagacaguccauggugggaaacauggguggggccucagguuuguacaggagaaugaaguguucaguuuugaagaugccgaggugaguaccuguagucccagcuacucgggaggccaaagcaggaggaucacuugagccugggaauuggaggcugcggugagccuugaucacaccacugcacuccagccugggugacagccagagugcaucucuaaaagaauaaaaagaacuugaggugagaguuccauggggcauccaguccauguggauaaauuuguagccacguuuacuacacaggcuguguagcuggggagauucagcuccuaaagcuuacaaauuaaccagguuuuguguuuuuuuuuuuuuguuuuugagacagggucccacucuuucccaggcuggagugcaguggugcagucacagcucacugcggccuccacuucucaggcucaaccgauccucccauuuuagccucccgaguagcugggaguacaggagcacaccaccacaccuggcuaauuuuguuuauuuuuugaggagacagagucucacuguguugcccaggcuggccucaggccucaagugauuguccugccuuggccucccaaacugcuaggauuacaggccugagccauugugcucagccgaguuuuaaccugcuuguuuguucuuuuuucuaucuuuuuuauguagucauccagaagcaaguuuuaaccgguuuuaaugaucauuuucgccguaggucuuugcaagggaaggaaaugugcccaacaucaucauugcggugaguacccagcccugggccuguugagugucuccaugucucaucccacuguccgcugaacugcuuucuugugcacagcgcugccucccuggagagccccuucccauucccccggcaaagggaaguguuucacucuaguugggaggccugggguugguugcuguauuuuuuuuuauuuauuuauuuauuuuuuuuucugaaacggagucucacucugucacccaggcuagagugcaguggugcaaucucugcucaccgcaaccucucccucccagguucaagcgauucuuguaccucagccucccgacuagcugggauuacaggugccugccaucacgcccagcuaaguuuuguauuuuuaguagagacgggguuucgccauguuggccagucuggucuugaacuccugaccucaggugaucugcccgccuuggccucccaaagugcugggauuauaggugugagccacugucuccggccagcuguauugaucugugugugcuguggguggaaugcaggggucagaggugacggagaugcaaacagcagugaacauaacucaagagcuaccugagguccuucuggugguuugaagucuuuacuggagaucucauucccagggcccuccaggaaccggcaagaccacaagcauucugugcuuggcccgggcccugcugggcccagcacucaaagaugccauguuggaacucaaugcuucaaaugacagguaggucuuagagucagaccuguaggggggcgggugcucugcauugagaauuguuacagaaacaaccuuucucagcauuggguuguaugcgaagccuugccagcuaugugauuuccuccaccccuucccagugaaagagcguugcucacuugucaacuugccgguuuauuuuuuuuguuuucauggaaauuuucaaaaacuguucuucucagccaggcaugguggcucacaccuguaauuccagcacuuugggaggccgaggcagguagaucaccugaggucaggaauucgagaccauccuagccaacauggugaaaccccgucuccacuaaaaauacaaaacuuagcugggcguggugcugggugccuguaaucccagcuacucaggagguugaggcaggaggauugcuugaacccaggagaaggagguuacagugagcugagaucgcaccguugagcacuccagccugggugacgagcaaaacuccaucuccaaaaaaaaaaaaccaacuaguuuuucucuuuuuucaaguuuaaaaauuuuuguagagaugggaucucacuauguugcccaggcugaucucaaacccuuagccucaagcaauccuccugccuuggccugcuaaguugcuaggacuauagacacaugccaccaugccagcuuuuucuuguggagacgggaucucacuauguugcccagucuggucucgaacuccgggacucaagcgauccuccuugcaucagccucccaaagugcuuggauuacagacgugagccacuacacugggauguucaaccaguaaauauaaugcaaaauuccaaaaugugaaaaaaaaacccagaucugaaauauuucuggucccaagcauuagggauaagggauacucagccuguauauuuaaaguguauggaaggccggccaggcauggugguucaugccuauaaucccagcacuuugggaggcugaggcagguggaucgcuugaguccaggaguuugagaccagccuaggugacauaaugaaaccccaucucuguauaaaaguaaaaauaaaguguucuggaggauguguauaaguuaauaugcaaauacuauaccauuucauauaagggacuugagcaaaagugaauuuuggugucugaggaagggccuagcaccaguccccaggaacaccaagggacagcugcauauuguucacuccuugauucuucaguuagggaaaaugucuggaggauauuggcaucugaagauucauagucugagauuuugcuuauugaucaauuucaccaucaguagcauuuagaauguugcuauuggugucucugcaguucuguacuguucuguucuguucuuuucuuucuuucuuuuuuuuugagacagagucuugcucugucacccaggcuggagugcaguggcacgaucucgacucaccauaaccucugccuucuggguucaagcgauucucgugccucagccucccaaguagccgggacuacaggcgugcgcgggcacgcccagguaauuuuuguauuuuuaguaaagauggauuuucgccguguuggccagguugaucuuaaacuggccuggagugguccgcccaccuuggccuccuaaaguguugggauuacaggugugagccaccaugcuuggccuacauugcaguuauuuucugauucaccuaauaauuaggaagaguccuccucucaauuuuuuucucuuuccuguuguggguagagaaugaaaaauuuugaauucuuggcugugguuagugaaagcuuacaagauaacaaaggugguauaucugcacuucuauuacaucuuuugaaagauaauaugguaucucaagcaaugcaguuaaaaaacugaaggaugaggcuuuuuuuuuuuuuugagacgaauuaucgccaggcuggggugcaguggcgugaucccggcucacugaaccugggaggcagagcuugcagugagccaagagggccacugcacuccagccuggaugacacagcgagacccugucugaagaaaaaaaaaaaaaaaguguauauuuucuuuguucuuugaaagaccuccaagaaagaacaaaugccauaaaaucucaauccuuauaaauaguuacaauugccccccaaaaaaacucaaaaauggaaauugggccucacagucccugauauaccgauuguuuaaaaguccuugugaaggcaacugaauuggucucagaaggugccaguaaaaaccugucauucuuucaggggcauugacguugugaggaauaaaauuaaaauguuugcucaacaaaaagucacucuucccaaaggccgacauaagaucaucauucuggaugaagcagacagguagagugcuuugccaaauguauuuugaccuugaucucuaaaucucuuuuucgguuuuauucaaucaggauaaaaagcacuuuuaugguagauuugcuuaucauaucuuccacaagcaauuuaauaggggccugcaccuuaaaucuuaucuuuauuaaguaacuuacaaacauuugucuaagauagucauucauuuaaugugcugguuucagcaucucuuacguuaauaauuuaaaugaggguuuuuguuuuuuuuuuuuuuugagauggaguuucucucugucacucaggcuggaguauaguggugugaucucugcucacugcaaccuccgccucccggguucaggcgguucccuggccucagccucccaaguaucugggacuacaggcaucugccgccacacccggcuaauuuuuguauuuguauuuguauuuguauuuguauuuauuuauuuauuuuuuuuuugagacagagucucgcucugucucccaggcuggagugcaguggugcgauuucagcucacugcaaccuccgccuccuggguucacgugauucuccugccucagccucccgaguagcugagacuacaggcaugcaccaccacgcccagcugauuuuuuguauuuuuaguagagaagggguuucaccauguuagccaggguggucucaaucuccugaccucgugauccgcccgccucagccucccaaagugcugggauuacaggcaugagccaccgagccuggccuaauuuuuguauuuuuaguagagaugggguuucgccauguuggccaggcuggucucgaacuccugacuucaggugaucuacccgccucggccucccaaaaugcugggauuauaggugugagccacugugccuggccuguaaauuuuuuuauugugguuaaauggacauaauuaaccauaaauuuuuuuuuuuuuuuuuuugugagacggagucuugcucugucgcccaggcuggagugcaguggcgcaaucuuggcucacugcaagcuccaccuucuggguucacgccauucuucugccucagccucucgaguagcugggacuacaggcgcccuccaccacgcccagcuaauuuuuuuguauuuuuaguagagacgggguuucacuguguuagccaggauggucuugaucuccuggccucaugauccgcccgccucggccucccaaagugcugggauuauaggugugagccacugcgcccggcccaaaauuuaccauuuuaacuauuuugaaguauacaguucaguggcauuuaguacauuugcaauguugugcaaccaucacaacacuucgguugguauaaaugaagaaucugaguccaggcucgguggcucaugccuguaaucccagcacuuugggaggccgaggcaggcggaucaccugaggucgggagauggagaccaacauggagaaacuucgucucuacuaaaaauacaaaauuagccaggugugguggcacauaccuguaaucccagcuacuugggaggcugaggcaggagaauugcuugaaccccggaggcgaagguuguggugagcugagaucaugccauuugcacugcaaccugggcaacaagagcgaaacuccaucucaaaaaaaaaaaaaaaauugaaaugacauuaagaaaagaauauagaacccuaacccuauaacguuguuuuuuguuguaguuuuugagacagggucucacuauaucacucagacuagaguccaauggcacagucauagcucacugcaaccuugaacuccucggcuguaaugauccuccaccucagccucccaaguagcggagacuacaggcuugugcaacugcaaccagcuauuuuuuuuuucacaggggcaggaucucacuauguuacccaggcuggucucaaacuccuggccucaagugaucugucugccucggccucccaaagugcuaggauugcaggcaugaggugcugugccuggcgaaauaaauuuuuuuuagggccaggugcgguggcucacaccuguaaucccagcacuuugggaggccgaggcgggcagauugcuugaggucaggaguucgaaaccagccuggccaacguggaaaccccgucucuacuaaaaguauaaaaauuagccggacaugguggcgcccaggcuggaaugcaauggugcuuguaaucccagguacuaaggaguccaaggcaggagaaucgcuuguacccgggagacagagguugcagugaacugagauggugccagugcacaccagccugggcaacagagcaagacucuguuucaaaaaaaaaauuuuuuuuuuuuaauguggcaguaauucauguucuuugaagaaaauuuagaauauauuaauaguuugcugccuuuuuauuuauuuauuuuuuugagguggagccucacucuguugcccaggcuggagugcaguggcaugaucuuggcucacugcaaccucugccuccuggauucaagugauucuccugccucagccucacgaguagcugggacuacagacgugcgccaccacgcccagacaauuuuuuuuuuuuuuuuuuuuuuguauuuuuaguagaguugacguuuugcuguguuggccaggcuggucuugaacuccugaccucaagagagccaccugccucggccucccaaugugcugggauuacaggcaugagccacuaugccuggccauuaauaacuugcuuuuuuucuucucuuuuuauauacuaucaauguuuacacaguugagaucauaauauauauaauuuuuguauccugguuuuuccuuuuaauguuguaggcauugcucuacauuaugauaaucugguaaacaggcuuuuuuguauuuuuuaaaauuuuuuguagaaauagaggucuuacuuuguugcccaggcuggucucgaacuccuggucucaagcgguccucccgcaucagccuuuugagaugggaggauugcuugagcccaggaguucgaggcugcagugagcuaugauuccaccauugcacugcagccugggugacagcaagaaccugucucuuuaagaaaaaaaaaagaauaaaaaaggaagaaagaaaaguuggcagcuggugucaugauuguucuccugaauuugugucaugaaggacuggagagaaccaauucccacaagugugauggcagcccuuguagaucgugguuuucgugaguuucacuugaggguuguucugaugcuguagguacuaaaugcuguuugcacagucuuugagagagcggccugcagguguuagcauuagagggauggccugcguacuuccaaugagacccucauuuaggacauuggaugugucuuauguccuggguuuuuguauagggaacgauuugugucacauggucucugggucccacuugcaaacuuguguuuuucuucucagcaugaccgacggagcccagcaagccuugaggagaaccauggaaaucuacucuaaaaccacucgcuucgcccuugcuuguaaugcuucggauaagaucaucggugagugggagcuuucgguggcugggggccacguggugcucaacugggcuuuuuucuuuuuuauagauguggucucccucuucgcucaggcuggagugcaguggugccaucacagcucacugcagccucaaacuccugugcucaaguggucuuccugccucagccucccaguagcugagacuacaggccugugccaccacaccuggauuuuuuuuuuuuuuuugagacaaagucucacucugucgccuaggcuggagugcaauggcacgaucucagaucacugcaaccuccaccuccaagguucaagcaauucuugugcuucagccuccugcguagcugggauuacaggcucgcacaaccacacccagcuaauuuuuuuuuuuuuuuuuuuuuuuuaagagaugggguuucaccauguuggccaggcuggucucaaacgucugaccucgugaucgccugccucggccucccaaagugcuggaauuacagaugugagccacugcaccuggccucgccuuggcucuuuagcgcuggaagaguagggauuuuuuuauuguguagcaugggccaagcacuauauaaucaaguuuuuaaauuuauauuuuuuuaauugacaaggagaaauuguauauauuaugcacauguuucccauuguaaucaacuuuuaaauuuaaucuuacauaauccuaugaggagguauuauucgcuucaguuuagagaugagaaaacuggagcuuauccugauguuuaggaucuaaggaaaaaagagaaagaaaacgagcuuggagagguugaguaguuuccccaaagucagagcaagugcaagagcagcugggauuggagccccaguucuaucacccucuugcacucuuggaggcacaaggauguuguugauguccccugcacggugucacgaucacagucgcucuccagauaccuucuugugcuauucaugugcucugaguacuugguauaggcaguaucuguacauuggaauuuguugccuccgggaagcuccucucucaaauccugcaguccgucuuuucucuaaccuuacuguuugcccuuccaccucccucccugcagccugucugcuucugcauggguuugucccgccccaggucccaagagugcucuagucugucaacuuccugcugguuucacauccuucucuuucuuuuuuuuguagagagagucucgcucugucgcccaggcuggagugcaguguugcgauuucagcucacugcuaucuccgcugccuggauucaagugauuuuccuaccucagccuccucaguagcugggauuacaggcaugugccaccaugccaggcuaauuuuuguauuuuucuuagagacgagguuucaccauguugcccaggcuggucuagaacgccuggccucaaguggucugcccaccucggccucgcaaagugcugggauuauaggcgugagccaccacggcuggcccauccuucucuuucugacacaggcugccugcacagcccagcuguccucuuuccucauuuuucauugcucucucagccgcuuucuuugccucacuucugcccugcugaaccccaaccauaugagcucauccaucugacaacccccuugccacccaggccgcuguugccgacgagcgcauuaccaaauauggcacccacaaagucauggcuaccagcccugguggggcucucagcagugucaagaauccuuugcauucuuuucccuucccaaaaucgcacugauuugugcauugauucauuaacccauucaccgaacgcuuaacucugguucuuaguagccgccaggcaccaugcuaguggagagcucguggaguuuaaugagaaguauucuccacuuugcagaugccagcaaugaaauggagaaaaaugcauuccuaggucuugauuuggcagggcacaguggcucaugccuguaaucccagcacuuugggaggccgaggcagguggauccccuaaggucuggaguucgagaccaaccuggccaacauggugaaaccccauuucuacuaaaaauacaaaaauuagccgggugugauagcgugcgccuguaaucccagcuacucaggaggcugagacaggagaaucacuugaaccugggagguggagguugcagugagccuagaucacaccacugcacuccagccugggcaacagagagacuuggucucaguaaaaaaaagaaagaaagaaacuggccaggcaugguggcucacaccuguaaucccugcacuuugggaggcugaggcaggaagacuacuugaggccaggaguucgagagcagccugggcaacagcaaaacccugucuaugaaaaaaaaagaaagaaacuggguuggcccauucagauugaauugucaugugcccagaagggccaacauccagcacacaccaauuccagaguccaccugggccagggcugacucaucuaacagcuuguggcaggcacauggauguguuucuacuggaggaucauuuccccgucuggaagccguggcuagccaaggccaugugggcagugccaacugaggccucugucauugcuuauugguugacaccuugacauaucacccuguguuuaccaagucucucucucucucuuuuuuuuuuuuuuuuuuuuggagacacagccucgcucuguuguccaggcuggagugcaguagugugaucuuggcucacuucagccuccaacucucgugcucaagcgagucucuugccuuagccuccugaguagcuaggauuacagacgugcgacaccacacccagcuaauuuuuguauuuuuaguagagaugggguuucaccauguuguccaggcuggucucaaacuccuguccucaagugauccucccgccucagccucccaaagugcugggauucaggcgugagcccucguguccggccuaccaagucucuauugagugccuggggcuguguggauugugcagcugcagccuuaugaccaaagagcuagcaggaugaugccggccucugcagggaagccucacuacugucccgucucuguucagagcccauucagucccgcugugcaguccuccgguacacaaagcugaccgacgcccagauccucaccaggcugaugaauguuaucgagaaggagaggguacccuacacugaugacggccuagaagccaucaucuucacggcccagggagacaugaggcagguaugugggcugcuaccauucaggcgugggcauccugugccugccaugccccuuccauggggaaggggagggaagugacagcugcacaagguacaacaagagaaagagacagagaccuggcacccuccugggacagugggcugucuagcucggacuccaagaagagaggcagggaagggcagagcuuuaaaagucaccccggaggcugaggcaggaggaucaccugaggucaggaguucaagaccagccuggccaacauggugaaaucccaucucuacuaaaaaaaauuaaaaaauuagccaggcauggccaggcacaguggcucacgccuauaaucccaacacuuuggaaggccaaggcggguggaucacgaggucaggaguucaugaccagccugguuaacauggugaaaccucaucucuacuaaaaauacaaaaaauuagccaggcgugguggugggcgccuguagucucagcuacucgugaggcugaggcaagagaauggcauuaaccugggaggcggaccuugcagugagcugagauagcaccacugcacuccagccugggcgacagagcgagacucugucucaaaaaaaaaagcugggcaugguggugggugccuguaaucccagcuacucaggaggccgaggcagaagaaucgcuugaaccugggauacggagauugcagugacucgagauugugccacuacacuccaugcugggugacagagugagacucugucucaaaaaaaaaaaaaaaaaaaaaaagucacccuuggcccggugcgguggcucaugccuguaaucccagcacuugggaggcggaggugggagaaucgcuuaagcccaggaguucgagaccagccugggcaacauagcgagacuccugucucuacucaaaaagaaauaaauauaaaaaucauccuugacauguguuugcuccugaacaggcgcugaacaaccugcaguccaccuucucaggauuuggcuucauuaacagugagaacguguucaagguacaagcgcuagugugggugguacugucagcagaagccgugcuucccugugggggccaguggggcugaagggcugggcuggcaguggggacggacaucuagcugcucuugugggugccagggagcccacccugcucccgucuguccucucccuauugcugcuuugcugcacaagcuggagaguuucgggggaccuggaacgucacuugugugugguaggugagggaggaccacggaugcaucagacccagggucgagcaauuucugacgugucuuauuugaucccagcgacuucccugcacagagguucucaccaucacauugugggugaugacgugggcccaggggauccccuggccccuaaagggcaggcaggagcacugugcuguuccccaguagccuucagaccccacacccuggguuuuuucugcaaugcugugcccugcuccccacuucugccccuggaggguggguaguaacccucaaagccaggcugaggaaaagguuucucacuuacucucccaugucagcaaaacauuuuucucuugggaauucuuuugaaaacugcuuccgcauccugauaacuccgcgucuaaaugccauuugagagauucacuucccccuuauuugggggaagaaacugggaagggcuguccaagcuuucagccuauagcuguuucuuaccagguuuguggacaacagacaagcgauuuuugaagcaucuggguagaucugggcagugaaugcauuuucgaggccacuuaggaaggggaggcccgcucagaaacaggggugaugguucgggcccuguuuugucuuggagggucacugagggcucaggaaaccauggcuuccaccgggaaaaggcaagggcaggugugggugaccucuggagccaucaggaggcuuucauugggaagauguaggggucgacauuguaccagaggcagagccucaugccacugcggagaaugcugcagggaggacggaguccccagcaccaugcaccugccugcuggaguagccugaccccuuguuuagggugucaggcugaggcugggggaccuuuuguagggaaggccaguuccuacuccgggguggaggugggaauuggcccaaaagaccucccaguucuaaagugaauuccaagugguucugggcaacugaccccccaagugaucuaagacagaugacuugugacuuuaaagcuguccccaagugagcauccuucacaggcccuugguugcucucuuguucaucugucuuauguuugggaaauuuaucuuccuggugccggaagcacuucucuuugauggugagaggagcauuccccaaacucauccugguugcuggagaauuugaugaaaacaacagguugagaaguuuuacccauagauugccuggaagucggucuguuggggccuccccgcucacauugucccuucuagccccugaccgccuuuccuuucccuuuggccaggucugugacgagccccacccacugcugguaaaggagaugauccagcacugugugaaugccaacauugacgaagccuacaagguuggccuccuuccccccguccuggcagaggaaccgcucacuucuugggcagaggagagcgggagcccuucugguaccagggacauuauacacaucacuccauucauucuugaaaucuuacuugggagacugaggcaggaggauuuguugagccuuggaggucaaggcugcagugagcugugauugcgccacuguaccccagccugggugauggugagacccugucucaggaaaaaaaaaaaauuauuaauaucaugcuauguguuaaucugucuaggaacuggaaaaaaaaaauuaugcuaggaguugggugcacuuuacugaugagaaaacugauucagaggcugaauuccuuguccuaaaucacuguguuuguuuauuuauuuauuuauuuauuuauguagaaacagggucuuacucuguugcccaggccggaaugcacuggcgcggucacagcucacuguagccucuaccucucaggcucaggcgauccucccaccucagccucccaaguagcugggacuacaggcacaugucacuaugcccagcccuaagucaugguuuaaaagcaguagaacuagaauucaaaaugguguuuuucuccuguaauuauauccucugcaggagaaauuugucagccaaagucaggaggaaagaccagccuagcuccuucuccagggaagccaucuucucuccaguuaaggggaaguguccccauccauucucauaggcacaggcauucugggauccagcagcccccagcuagccaggagaggagggagcaggaagauucuagccucacaaugggacugagugcugugagcagauuccagcagauguggcugggguucaggcgaccucaagccacauggguguggugugguuggugugguucaaggucauugauccagucaugguuucccucugccuacccccuaacaaacuagguuggaaguugacuggguuuagggcauaguuccacccaaugugaaaccggagugcaaggcggggagacugagcagagacccaggcccagggucccugaguagaccugaagaaagccuucagauuugugggcacagagcuucucugccuccugaauucaccccaagaugccaaaacaaaggcaaaaaggccugccuccagacgcugcagccuggguggggcagggugggugggaagcaggaggcugggauuacccagucagggugugcuccaggcucguccugcagagguugcauugggacugcagcuggaugaagcuagcagaugaauggucugcuuuuuccacuuugcuauaccuagucaucagauuaauaaagcauuuuaagagcuccggaucaagagauuacaugggugugguaguagaccauuuugcaacacagcuuaacacauuugcgauaggcugggcucaguggcucaugccuguaaucccagcacuuuuggaggucgaggcaggaggauugcuugaggccgggaacuugggaccagccugggcaauauagcaagacucuuaucuuuauauuacugaaaaaaaaauauuuaagcaaaacaacaauacauuugcaauguuaucucucuaucugccaugaaaaucaguuaagguacccccaugugaccugaagggugggccccaccagcuguggugagucucaaaaucacaugucuucuuacaguuuaaagugguaagcagccuuuucugucuccuuugucuagauucuugcucacuuguggcaucugggcuacucaccagaagauaucauuggcaacaucuuucgaguguguaaaacuuuccaaauggcagaauaccugaaacuggaguuuaucaaggucggugagaauguagaaaugccucuguccucaagaauguggcccauaguggccgggugcugugggccacaccuguaaucccagcacuuugggaggccgaggugggcagaucaccugaggucaggaguucgagaccagccuggccaacguagugaaagccucugucuacuaaaaauacaaaaauuagcugggcauggcugggcgugguggcucaugccuguaaucccagcacuuugggaggccgaggugggcggaucaccugaggucaggaguuugagaccagccuggccaacauggcaaagccccaucucuacuaaaaauacaaaacuuagcugggugugguggcaagcgccuauaaucccagcuacuugggaggcugagggaggaggaucgcuugaaccugggagguggagguugcagugagccaagaucgcaccacugcacuccagccugggcagcagagcgagacugucucaaaacaaaaaaaaaagacugugggcccuggcuucgcuuucucugcucacaggccuggcaucuagaaggugcucaguguuucccaacugcagugggagggaggcugugucuuaguuccuuugaguuacuauaaaggaauaccagagacuggguaauguagaaagaaaagagguugauuuggcucacaguucugcaggcuguacauguagcaugaugccagcaucugcuucuagggagggguucaggcugcuucugcucauguuggaaggggaagugggagccugugcaugcagagaccaccuguugagaacggagggaggugccaggcucauuugaacagccagcucuccagggaccuaauugauccagaacucacucacuaccuuggggugggcaccaagccauucacgugggaucuuccucaugacccaaacauccccacauuggggaccaaauuccaaaugagauuggaaggggacagacguccaaacuagaucaacguggcugauuguccugaggaccaaguuuguuucacacaguucugauuuucuucauucaaggcucucuuguguauugacugauugauugauuuuucaagguuagauuaauugagguuuaauuuacauagaguaaaauucagccuguuagguacaggacaaacgcacucagucaugcaaacacuaucaccaucaggaugcagaaucugucaucccagaacaacucaugugucccuuugaagccagcccccuccccgacuaccacuuggaaacuaccgauguaguuucuguuucaugggauacaguuuuccagaauaucauauaaaugggaucauguagaacuuagccuugugaguuuggcuucuuucuuucacuguagcagaaaugccuuucagauguguccacgcugguacuucuauccaugagucaguccguguuaucacugagaaguaauccauccugugcguguaccacaguuugcuuaucuguccaucagcuggaggacauuuggguuuacagauuguggugacugugaauaaagccaguguaaacauuugcauauauggauuagugugaaugcaaauguuaaguuuuucuuuuucccaaguaaguucccaggggugaaauugccugggaaaaugauaaguguauguuuuacucgauaaggaacugccaaacgguuuuccgaaguggcugcagcacgugcauucccaccagcauuccggaggauccucaaccuagccaccacauggagugcucaguuugguuuuuaagccauucuaauagguguguaaugaccggaugcaguggcuuacaccuguaaucccagcuacucgggcggcugagggaggaggaucgcuugaacccaggagguggagguugcagugagcugagaucacaccccugcacuacagcuugggcgacaagagugagacuccaucuuaaaaaaaaaaaaaaaaaaaaaaccaauaacaacaacaacaaaauaaccuaauaggcaugugaugagaucucauugugccuuuaauuugcauuucccuaauuacuaugcugaacauuuaaucaugugcucguuugccauccagaaucuucuuugaugaaacaucuguucauauauacccauuuuuuaaaauuuuuacauuuuuuauuuuaauuguacuguauuuuuuguuuagagaucauguuaagaccggccaauuuuuauauuuuugguggagacgggguguccccguguugccaaggcuggucuugaacucccgggcucaagugauccucccgccucggccucccaaagugcuagaauuacaggugugagccacugcgccuggccuaccuuuuuuauguuuuugagagacagggucuugcucugucacccaggcuggagugcaguggugcgaucauaguucacugcagccucaaccuuccaugcucaagcaauccucccaccucaggcucccgaguagcugggacugcaggcaugugccacuacacuugggucauuuuuauuuucuuuuuuucguagaguuuggguguugcuauguugcccaggcccaacucugggcaagugauccuccugccucagccucccagaaugcugggauuacaggugugagcuacugcuccaggucuaaaucuacccauuuuuuaauuggguuguuugauuuuuauuacugaauuuauuuacuuauuuauuuuugagauggagucuugcucuguugcccaggcuggagugcaguggcacuaucucagcucacugcaaccuucgccucccagguuuaagugauucuccugccucagccucccgaguagcugggauuacaggcgugcgccaccauaccuggcuaauuuuuguauuuuuaguagagaugggguuuuaccauguuggucaggcugaucucgaacuccugggcucgugauccaccugccuugaccucccaaaguacugggauuacaggcaugagccaccacgccuggacuuuauuacugaauuuuugagaauucuuuauacagucuggaugcaaguucuuuaucagauauauaaauauuuuccucuagccuggcuuuccgugccaccaccccgcccccccucgccccacccauuuucuuaacaguuucuuugaaagaacuaucagcauccuuuuaagaaauaaauagaacuuuagguaaacauaauccauugcaucuuagcauucauuuuccggcugggguuggaauuccucaugcugauuuugaaaaaaccauuaguucaguuuguuucuguuuuuauuuuuauuuuuuucaguucagauuuuaaaaaagaacucccccacuuauuaaccagauuugaauuugguuuguuuuucaggaaauuggauacacucacaugaaaauagcggaaggagugaacucucuuuugcagauggcaggccuccuggcaaggcugugucagaagacaauggccccgguggccaguuagagcagagacuucacugacugacuuacaggugcccuauucugagguacaggagccgcggcuuucugaugggggaaaaugccgccuuaggcuggagccaacaugacuguccuuuaaacuccaguggcuggccaggcacgguagcucacgccuguaaucccaacacuuugggaggccgaggcagguggaucaccugaggucagaaguucaagaccagccuggccaacauggggaaacccugucuuuacuaaaaauauaaaaauuagcugggugugguggcgggcaccuguaaucccagcuacucgggaggcuguggcaggagaaucgcuugaacccaggagguggagguugcagugagccaagaucacaccauugcacuccagccugggcgacagagucuccaucuggggaaaaaaauuaaauaaauaaacucccgugacuugcauguuugcuucugggacgucugugccccgcaaguguuugaguuuggccuccaccccauugaugcggugacggggcggaaaggcgcagagaagcugagggcggucucugaucuguguguggguugacauuuuagcuaauaaagccuugcaguguuuguuggcaa

SEQ ID NO: 191547 - RNA, 20078 nt, Homo sapiens
acgugauccacccgccucggccucccaaaguuuuuggauuacaggugugagccaccucgcccgguccuaucucucuuucuucucuuucucccucucacuuuguuucucuucucucucucucucccgccuccuucccccgucuccccucccuuccccccaccgcccucuucauagcugagccuguccggcagugcggcggauguacggaugauucaguggcuggcaggaagcccgcccugcccgcccgccagugucagugguguuggcaucagcuugggcaggugugcgggcucaggauggggcggccguggugaggaacccuggacucucagguaagccuuucccaggggugccucaguccucaggcugucccccaucccccaggagcuccuggccccacuggguggggugggaagaggccuggaugccuggcgcccccucccgcagccccacucucacccuggcaccaggcucuguggcacuucaggggucaguuuguuucugggcuucuggccacucucuugcccucgccuuccccuguccagccuguguagccuugggacaucccaggguggucccaucauugccagagacuggugaaguaaguggccgagagccaaaacaguggcugcccuggccugggagccucgguuuccucauccgugaaaugggacuguaacccccuacacaggucaggggaaaacggugggauuacaggccagggcccaggucuugccccaggucaggugaagaacccccacugccucccugcccagcccccuaccuggcccucaacucugucccugggaccagggcugcucaggccccuccugcacccgcccgccucccucucucccucccagcuaggcucauuugaagcccagaguuauuuggaaaaagcaacaggaccagccgggcacgguggcucaaccuguaaucccagcauuuggggaggccaaggcgggaggaucauuugaagucaggagcuggagaccagccugagcaacauagugagacucccaucucuuuaaaaaauaaaaauaaaaaaauauaauuaaaaacuaaaugaaaaaaccaacagaccccagagcagaguccaguggauaaagccauccagggcuucaagccaggcugcccccuccccaaccccaguguccccaaccacagcucagcucggagaaggcugggagaaccggcaggguggucucgagcguccuuccaggcgggauucagacacuguagcuccuccagcccagccccgagaacuuccccgaagccagcucuuggcaaucguuguucauaugaaaacugcccacuucccuuuagugcuauuuuggccucugcagaaccguggucuguggcagcccccacuccccaccccgcccagcccugccggccccugggggccucagaggguccacccuccgcucccuccaccucagcccaccugcuuucagaaccuggaugggagagugaaagugagagcgagacagagacacaaagggagacagagacagagagagagcacagaauuuuuuuaaacggagucucacucuguuguccaggcuggagugcaguggcgugaucucggcucacugcaaccuccaccucccagguucaagcaguucuccugccuuacccuuccaaguagcuggggacuacaggcacgugcuaccacaccuggcuaauuuuuuauuuuuuauuuauuuuuuauuuuuuggagacagucuugcucugucucccaggcugggagugcaguggugcaaucuuggcucacugcaagcuccaccucccggguacaugccauucuccugccucagccucccgaguagcugagacuagaggcgccugccaccacgaccggcuaauuuuuuguauuuuuaguagagacgggguuucgccauguuagccaggauggucucaaucuccugacuuugugaucugccugccucggccucccaaagugcugggauuacaggugugagccaccgugccuggccuaauuuuuuauuuuuaguagagacaggguuucaccauguuggccaggcuggucuugaacuccugaccucagaugauuugcccgccucagccucccaaaguguugggauuacaggugugaacuaccgcacccggccaacagcgcaggauguauucagucugggggcagacacaugacuguuuguuaaauuucauuuuuuguuuuuagagauggggucuugcucugucacccaggcuggaguucaguggugugaucuuggcucacugcagcuuccaacuccugggcucaagcaauucucuugccucagugucccaaguagcuggaaccacaggcaugugccacugcgccugccuaauuuuuucauuuuuuuguagagacagggccuuguuacaucguccaugcuggucucgaacuccuggccucaagcgauccuccugucucggccucccaguguugagauuacaggcgucagccaccacgcccagccugaucccauuuuauuuauucauuuauuuaauuuauuauuauuauuauuauuauuuugagauggagucucacucugucucccaugcuggagugcacuggcgugaucucagcucacugcaacucacugccuccugaguucaagugauucucaugccucagccucccaaguagcuggaauuacaggcuugcaccuccacgccuggcuaauuuuuguauuucuaguagaaacaggguuucaccauguuggccaagcuggucucaaacucaagugauccuccugucucagccucccaaaguauugggauuacaggugugagucccuguacccagcccgaccucauuuuauagaugagaaaacugaggcggggggcucucaggcagaggcuagauuuggucccaugagcccuccugcaagacaaguugcuccaaccucacaagccugagaugaacuugggccaugcuggagggguuggggguacaccccggguugggggcacugaggcaaggagaguuucgaggagggagaagggcagugcccaggcgggccauggggaagagagagcagagcuuuccucggacaaccucccggggugacgugggucgugccagucacacggcucagaaauucacuuguucccacugacucacuuggcuuuuggggagaggccugguggcuucucugugaugcgccucuuacagaggcucagggccgcauggagauucccugucaucuuaccgcagggauuugggaaguccagagagguccugagacuuguccaaagccacacagcuuucaagggggacagcccagguccugguggaccucagggggaucccaaggcaggagguaggcagccuggagcuccuccauuauuauuauuauuauuauugagauagaguuucgcucuuguugcccaggcuggauggagugcaguggcgugaucucagcucacugcaaccuccaccuccuugguucaagcaauucucugccucagccuccugaguagcugggauuacaggcgcccaccaccacaccuggcuaauuuuuuguauucuuuuuuaguagacacaggguuucaccaucuuggccaggcuggucuugaacuccugaccucaugaaccacccgccucagccucccaaaguguugggauuacaggcaugagccacugugcccggccauuuuuuuuuuuuuuuuuuuuugagauggagucucgcucuguugcccaggcuggagugcaguggcaugaucucggcccacugcaaccuccaccuccuagguucaagugauucucuugccucagacuccugauuagcugggaucacaggcgugugccaccacacccggcuaauuuuuguauuuuuaguagagaugggguuucaccauguuggucaggcuagucucgaacucccgaccucgugaucugcccgccuuggccucccaaagugcugggauuacaggcgugagccaccacgcccugcuggagcuccucccuuuuaaguccuguuuacugcuccaagccucaccuuccccagcugugggauggggagaagcccuccucacugguggccagggugggaagaacacggcgggugggggagaguggacacucgggaguguuggcuccacaaaugcccaccauacucaaccccuucagagaccccaccacccucaacucuguccccagccaucuccagggggccaggucuccuuauuauuauuuuuugaaacggagucucacucuguugcccaggcuggagugcaguagcaugaucacagcucacugcagccauauauauguauauauauauauauaugaaaaaauauauauaaauauauauauaugaaaaaauauauauaaauauauauaugaaaauauauauauaaauauauauaugaaaauauauauaaauauauauaugaaaauauauauaugaaaauauauauaaauauauauaugaaaauauauaugaaaauauauauaugaaaauauauaugaaaauauauauauaaauauauauauaugaaaauauauauauaaauauauauaugaaaauauauauauaaauauauauaugaaaauauauauauaaauauauauauaugaaaauauauauauaaauauauauauaugaaaauauauauauaaauauauauauaugaaaauauauauauaaauauauauauaugaaaauauauauauaaauauauauaugaaaauauauauauaaauauauauauaugaaaauauauauauaaauauauauauaugaaaauauauauaaauauauauaugaauauauauauauauauaugaaaauauauauauaugaaaauauauauauaaauauauauaugaaaauauauauaaauauauauaugaauauauauauauauauaugaaaauauauauauaugaaaauauauauauaaauauauauaugaaaauaauauauauaaauauauauaaauauauauaaaaauauaaauauauauaaaaauauauaaauauauauauauaaacauauauauauaaauauauauauauauauuuuuuuuuuuuuuuguauuuuuuuuguagagauggaauuucaccguguugccuaggcuggucuggagcucuugaucucaagcgauccucccugccucggccucccaacgugcugggauuauaggcgugagccaccgcuccuggccagggucuguuccuaguugcaacaguucuuggaaacccacucgagagggccacgccuccauucaccaggccacgguggguggugugcguauguuuugcugaggccuggucaucacgcuguggcuccaaggcugggaccagccacagaccgagaagccggucaggugccagccagagauucagggcucccucccucugaacauccugucuuuagcccauccuuggcaucccagcucaugucaucccagccaccugcagcagugcccuagggccccaucccucugcggaucaugcucuugggccaccuccuccaagaagccuucccugaccucccuccucccagcucccaccacaggcagaaucugggcuugcaguuguuucaggaauggaagccccauucccagguccuggggggaccccaaggcaggaggugggcagagagggguccugcgaagcauagaggagcccugaguugcucuggggugggcgagggcuuccgggugcgucugcgugagugguggccacagacugucaccuccaggagccaggguggguuuacuggaggcaacccacuguggguugaugggcagagccaggguuaggggcaggacacuggggccugaaucccaucuuuccacuuagcagacgugagcucucuggccucaguuucucgauuugugaaaugcagugaaccucguccucaaagggcaguugucuagauuaagcgaggcuguguguagggcugugugcgugcacauggggcugucuugugggcccccagaaccuuccagcacuuaucaagggugaagauggcccacagggcagagguguugguuuggggucacauggggugaacaggacugguucuguccuugcccagugcaggagcggggaggggaggugguguuuccgcagccuaggcucagguauggggcuguccgagcacagugggggugugggguaggauuccugaaaaaggggccccuugcucacgggcaccucccauuucagcaucacaagaggcaacaccaggagccaacaugagcucggggacugaacugcuguggcccggagcagcgcugcuggugcuguuggggguggcagccagucugugugugcgcugcucacgcccagguaagcgggggucucggggacgugauggggagaagguguggacagugcaucucagaggcccucucaggcccagacguggcuguggucagaagagguggucagaugaaccucgugaugugaccccugaccccuaaacugcccccugaagacaauggucaggugcacccgagggcuuuggcuuugcugggucaacugugguaucucgagccagagagauugccccagacgagggaggggaggcgagguugccuguggcauccacuuuucuagccucuccucuucuaaaaaagggugagcaaauacccuuuuuucuuuuuuuuggacagagucuugcucuggucucccaggcuggagggcagugaugcaaucuuggcucacuguaacauccaacucucggguugaagcgauucuccugccucaacccccugaguagcugggacuacaggugccugccaccaugccuggcuaauuuuuguguuuuuaguagagacgggguuuccccauguuggccaggcuggucacgaacugcugaccucaugugauccucccgccucggcccaaagugcuggaauuacaggagggagccaccacaccuggucccaaauauucuuuaauaucagguggccggugaugauugacaguuuggcccccaaguccugucugaguccugcuggagacaagacauggcggggggugucugaccucaggucgcagcugcucccagacccuuugcuaauccuggccuuuucuugcaggugcaaagaggucagagaaaaucuaccagcagagaagucugugaguugccucgaugucccuagccugguguauucaugugcccugggcauggacguccucaagggaauuccuagcaccccauccuucaccccuucacucacaccuccuccgugccaaguucuagugggucccuagccaucagagaagggagagaaaguguccaggggcuguccaggcccugcuguagcuuggguuagggagggcuuugggaggcggggacgccugggcuguggggcuagccacucuucagcuugccugugaaccccuccagaaguccaggcaucuggccaggcacgaugguucacaccuguaaucccagcacuuugggaggccaaggcagguggaucaccugaggucaggaguuugagaccagccuggccaacauggugaaaccucauuucuacuaaaauacaaaaaugagcugggcgugguggugggucccucuacucccagcuacucuggaggcugaggcagcaggaucacuugaacccaggagguggagguugcagagagccgagauugugccacugcacuccagccugggcaaaaaagcaagauuccgucucagaaaagaaaaaaagaaaagaaaaaaaaaauagagguccaccaggcaccuguguccucagccucccuuugaccccaauccccaggggcuaguccgcucuccccuugcaaugcaagagacagagaacccggcacagggugaaaugugaacguugucggagacuccccuggaaaaaacugccggagcucaggggaggaugugggcaagucccucgggggaccagggaaggacugugagaaagacccagggaagggcaguggguucgacacugcagacuggggcugaaacccagaacaacccaggcacaugggcaguggccacagguguccuuugauuaagagaauggcugugggcccaggaaaccuuggagguccaugugcacccccgagcagucacucaugacccacacacgcacacccgcacacacauccuuccucauuuccuuuugcaacugaaaaaccacagugagauuugaaaauagaaucuucccauccuugcucaucgugggccaggguuagaccuuucugggucuuucuggccacguggcuuucuggccgccugcaaccucccccgaugccccccaugcccuugacuccucggacacuuccccucuccccucaggcccugcccacccccagcccccugauugaucuuagagccauagauggucagggccagacucagcguccccaugugggagguggaggggagcuguuuggucuucucccuggaaugccugugccugccucuccaucugucaccucgguugggcucagucccaccagccugcaugaagcgacugcugugagcacaggcuccguuccucuguugcuucucccaggaagccacgucugacugacucucuccuguggauuuaggguaucucuccuaaaucaggucacccugagccccagucuucaaggagcuuggaaggcugggccagguacccauucugguucagaggaggagcccccaaaccugcuuuaauaaugagcuaauccacuccauuaucuguaauggcagcuuccauuuucaagagcaccucaugguccaagauggcagcuggggugccggcccucaucucugcauucccagcagcaggaagaaagaaugaacaaggauacaaagggugucucccaguugccagugcccccguuuaaaaagauuuauuggaaauaucaacaaccuuggcuugaaucucauagaccagagcuuaauccauggccacacuuuggugcaaggaaggcuaggaauagucuauuauuuauuucuuuauuuauuuagagauggagccacauuuacuuuuguucaggcuggagugcaguagaaugaucuuggcucacugcaaccucugccuccuggcuucaagcgauucuccugucucagccucccgaguagcugggauuacaggcaugcgccaccaugcccagcuaauuuuuguauuuuuaguagagacgggguuuucuccauguuggucaggcuggucuugaacucccaaccucaggugauucgccugccuuggccucccaaagcccugggauuacaggugugagccaccaugccgggucuagagugugugcuuuuuuuuuuuuuuuuuuuuuuuuuuuuuuuuuuuuuugagacggagucucgcucugucgcccaggccagacugcggacugcaguggugcaaucucggcucacugcaagcuccgcuucccggguucacgccauucuccugccucagccucccgaguagcugggacuacaggcgcccgccaccgcgcccggcuaauuuuuuguauuuuuaguagagacggggugagugugugcuuuuuuaaggaauugcaaacgcucccugggaccagcaggugggaggcagccucaucgucacuccuggcugaaauaauuuaccccaagucauugcugggucccugagcaccugccuucauucacccucaugccccagaaucucagggcuaccuccacagcccuguccacagaccccuccugacccgucuccaggggccugggacccaccggcaggauguggcccuguugaggccaugucagggaugggucuggcugagagccgggcuccagcccagggcccugugugaggguugggcacccagugcacggaggggccagagaauggggauagcauggggagccgugagaaugaggccugaaagggcagcaguuccuccccacugucgccccaguccgucccucugcuuucccuccucaucccugccugucccucccuccugucccuguguucuugggcugugggaguccaggcccaggcucagcacagcccaugcauuuccaggcgugaggaccaacagagcuuuacggggucccggaccuacuccugugagucuccaaguguccccggguugggcucuggguugggggugucccuaucaaguuaucucgguccccauugaccugagaccguggccaggccugauguggggggaugauggggugagggggcugggcuagcugggggcccagccaacaccccacuucuugcccuuuguaguggucgggcaggcauggccaggaccccuggcggacauggcacccacaagguaggucacagucccccaggaagugacaagaaugaaaguccuggagguccucaccuggugagcccaggucaagaccucccucccuccccgagucccagagcuccagggcucagcuaugaaggccccacaagggguauggggggauguguccuggggggccucuccccuacagccccuccuuuaacucccuccuucccccucccugcaggaaggacaagcuguugcaauucuaccccagccuggagggugaguggcacagggcagggacagggacaggccuagccaagcugggacuaagacaggcgaaaaccccaugggacaggcgucgugcagugggggcugcggggccaggcgaggccuccccaggagagacacacaggcuggggcagggcaggcuccuggaaucggccuggcagggggagggugcacacucgcacaugccccacugaggggacagggagcacugcaaaggcucagacacgggaaauagcuggcccugccuugggcugcagcacccgagcugggugcaaagcaggggccaggggagaaagcaauuagcugggucuuucuuccagauccagcaucuuccagguaccagaacuucagcaaagguagguaggcuccuggagaaagggggaggccauggugggggccacacccaggggcucaggcccaauucucgccuccucccgcaggaagcagacacgggucggaggaagccuacaugugagugaccuugauccuguccccccugccucgccucucccccugccccaccucucccccugccccaccucucccccugccccaccugccugccacagcccugggcuuccugguccaggaaccaccucuugcacuagaacgaggcauccagguuccccuccuucuccuggcaggcaggcauugggcgacacuguugucucuuagguaacccuggguuugggggacuggacuuugcccugcucugggacacagagugucaggggcgggggauagagacucauucagcaucacccagucaaagacaagcuacaggacacccagaaucccucggggguguugcaucaucucacagaugggcaaacgauggggaauggccuaaggucacauagcaagguggcucaccaggugcgguggcucaugccuguaaucccaggacuuugggaggccaaggcaggcagaucaccugaggccaggaguucaagaccagccucgccaacauggugaaaccucaucucuacuaaaaauaaaaaauuagccaggcaugguggugcgugccuguaaucccagcuacucgggaggcugaugcaggagaaucgcuugaaccugggaggcugagguugcagugagccgagaucaugccacuguacuccagccugggugacagagacucugucucaaaaaaaaaaaaaaaaaaaaaaaaaaaaaguggcuccagccccugguggcucaggggucccaggaagugggggugggggaaucagagaggagauccuggcagacccccauggcccccaagaggagcaauggugggagcagcccuggccucaccgcccccuuauggagcccccaacccgaucuccagccugcccugaaaccuguguuguauauguuuucuuggccagagaccccauugccauggaguauuacaacugggggcgguucucgaagcccccagaaggugaggcgaaggacaaagccggagguggaggaaguggugugggagcucagggcagaagccauaccuccaggcaggagaggaggcugggccuggguucggguaaaucggcagagccgguuggguggacagaaggaggcuggugcugcaggcgggggccaagaagggauagggggcgggcgggucagcgugggagagcugugggcacagggcgugggagagaggagugggccacagggcagggaacuagagggcuggcuuggggagguggggggaggccagguccuugucaacgaggacugagcaucuucuccugaccccagaagguaccugggauggugaucccugcaggcucugaggccaccagaaaccuggucgcugaaugccuuugcuuuauaggaagggcaacugagaggccgggugugguggcucaccccuguaaucccagcacuuugggaggcuaagguggguggaucaccugaggucaggaguucaagaccaguguggccaacauggugaaaccccaucucuacaaaaauacaaaaaaaaaaaaaaaaaaaaauuagccaggcaugguggcacaugccuguaaucccagcuacuugggaggcugagacaggagaauugcuugaacccgggaggcggaggcugcagugagccaagaucgcaccauugcacuccagccugggcaacagagugagacuccaucucaaaaaaaaaaaaaauccccccaaaaaagggcaacugaggacucagggugggcagugccugcugagaggugcaugggccugcgguuugaauccagcuccaugaccuggcuccugccuggaccauacuggguaggaccaugguguugggggguccucuucugccccccaccacugccaccuccauuuuuuuuuugagacacagccuugcucugucacccagguugaguacaaugucacgaucuugguucacugcaaccuccgccucccggguucaagcgauuuuccugccucagccucccgaguagcugagauuacaggcgccugccaccacgccuggcuaauuuuuuguauuuuuaguagagacaggguuucaccauauuggccaggcuggucuugaacuccugaccucaggugauccgcccgccuuggccucccaaagugcugggauuacaggcaugagccaccccgccaggcuggcagugcucauuucuuaggacccccaacaucacugauggauuuuggguggggcaucagucagagcccagcuuccccauuacaaggccaagauggggugccaggcgcugaggugccauacucagccuggguccccgagcaaagcauccucagccugcccugcccuaucuggaagaguccagccccuucccggcaguggcucuagggagagcuccugauuauagagaugaaccccugaggcugccccugccucccucccucucuccagccacccggcaugggccugaauugcagcccccgcagaguacccccuccagagugcauauggaggggaucucagaagacagaggcuggacacagugacucacgccuguaaucccaacauuuugggaagauugccuaagcuuagggguucaagaccagccugggcaacacagcgagauccucucuacaaacaauuuuaaaaguuagcugggcgugguggugcaugccuguaguuccagcuacucaggaggcugcgggguaggaagaucguuugagccgggaguuggaggcuacagugagcugacuuugccagugcucuccagccugggugacagagcaagaccgucucaacaagaaacaaagaagacagaggagcucagggcucagggaagagcaugcaggggcaccaggccagcacccauuaggaagcucauccagaagaaggcuugaggucccgggggacccagagggcuagggcuuggcggaagagguccccugcaaagggaaggcaggacagagcgggaggaugagccaggcuuugcagggucugcccacacccccgugcccacuccucucucuccugcagaugaugaugccaauuccuacgagaaugugcucauuugcaagcagaaaaccacagagacaggugaggcugcccagccagaggcaggcuggggcugggagcagcaggccuccuuggccaggugccccugcacuccccacugcucaaaggccgcccccacuuugaagccugaaggcucucggauccccagguaccuuucgguagagccuugccccuacuauccucggaggcagcucuauuggcuccuggugccucugugggacugagccaaggggggccuauucucccucucugcaggugcccagcaggagggcauagguggccucugcagaggggaccucagccugucacuggcccugaagacuggccccacuucuggucucugucccucugccuccccggaagaagaugaggaaucugaggauuaucagaacucagcauccauccaucaguggcgcgaguccaggaaggucauggguagguggccgggagaagaggcagggugguccacuuagggcaggcuugagggacuggccuggaagggcaggcugaaagugggcuucccuccagccaguccagcuaaccccgcagugaugccugggugcaggagcagcugcagagaccuugaaccacacaggacggcccuuggcagccgcccagccuccaggguggggucagguccucccgggcaggccgccccauccagcugcaugcauggaguaacgcauucaccugcucucacagcaggacgaucuccggcaaaucccagagacaggacagacacacaccgccaggaccugucgggcguggcauuucccgcgggcuguuuuguggagucugggggucugagucugggggagcagucaugggugucuccaugugaaccacucgaugaccugucugcccgcugguccacagggcaacuccagagagaagcauccccuggcccggugggaagcccagacgaggaggacggggaaccggauuacgugaauggggagguggcagccacagaagccuagggcagaccaagaagaaagguacagccccugcucuccagcugccgugggccaaggauuggaggucuugccaagcugcaggacccccaauccaagggaacagccgagaguguggguggaggggccauggugggggcuacagggugcacccaugggugcuccaagagggcagcuuggcgacucuguuccucuguucuggccaggggcgucaggcagggaauucuggugacuucaggggcaaagaagugggcaccgggugggucucccaacuccacugcauccuccuggcugcgaccuuggaccaagugacaaccucccagaacuuaguuccucacuuggugcccaccucucagagaagacaucgcacacacggccgggcacgguggcucacgccuguaaucccggcacuuugggaggccgaggcaggcagaucaccugaggucacgaguucgagaccagccuggccaacauggugaaacuucaucucuacuaaaaacacaaaaaauuagccaggcaugguggugggugccuguagucccaguuaguugggaggcugaggcaggagaaucauuugaacccugaaggcggagguugcggugaguuaagaucacaugcacucaacccugggugacagagcgagacuccgucucaauaaauaaauaaaaaaacagacauugcacacaaagccucagcccagcaggcacucggucaaugcuggaaacagacaggaggcagggacguugggaaauguaacaguggcugagacgcgcugaggagccaccgcaggccagugagauggugcggcgcuaagcgcucacacgugcaccaucucuuagcacccaaagccacagagcaguuaagccaccugcccaaggccacaucuugaaguaaggggaggaggagauggaauccccaguggucagacaucagacaucaaagccuaggcugggucuacugcuugggaagcacgauggacccccagagggccuugaaggcugcccaaaguccccaucugggagacccaggccgucaucucagcgagcaggcuggaggguggaaaccacagugaaccuggguggucaagagucagccccagaggcaggugcaggaguuugagccaaaugugcagagccccacgucauucauucaaccaguauccacugggccccugcuacgggcaaguccugcucuaggugcugggaacaccaacauaaagaacagcaaaccccugaccccuuagaacuugcauucugguaggagagagaaaacagauagggcuggacacagcggucaugccuauaaaucccagcacuucgggaggcugaggcgggaggauccuuugagccucugaguuugaggccagccugggcaacauagcaagaccucucucucuacaaaaacuuuuuuuuuuuuuuuuugagacagaguaucacugucacucaggcuggagugcaguggcgccaucucggcucacugcaaccuccaccuccuggguucaagcgauucucgugccucagccuuccaaguagcugggauuacaggcacacgccaccauguccagccucuauaaaaacauuuaaaauuagccaggcauggugguggaugcccuagagucccacugacuugggaggcugaggugggaagaucacuugagccugggaggucaagguugcaaugagccaugguugcugcagugagcuguggucgugccacugcacucaagccugggcaacagagcaagaccccaucucaaaaaaaaaauuuaaaaauuagcugggcauagugguguguaccuguagucccagcuacuugggaggcugaggcaggaggaucgcuugagcccaggaguucaaggcuacagugagcuaugauuguaccacuguacagccaggaugacagagugagacccugucaaaacaacaacaacaacaagaaaacagauaagaagacauggcauguucacuggugguaagucuggcagagagaaacaaaacagggaagcggggcaggaaguagugugggguugugggcaagacgcaguguugcaauuuaaggaaggcggcuagggaagccuuucagagcucccuuccucaccccaucugggggaaggacauccaggcagaggggacaacagaggccccaggguggagugagccccacaggucugagcaaagccaggggccagggaggagcaggugaggggaaacuaguggaggucgaggccguugguggggaggcugaccaggcagggccagcacuugggguuuuacugcaugagaugggagggagggagggagauagaaagguuguuuuuucuuuuuuuuuuuuuuucguuccugucgcccaggcugaagugcaauggugcaaucuuggcucacugcaaacuccgccuccuggguucaagcgaugcuccugccucagccucccgaguagcugcgauuacaggugucugccaccacacccggccaauuuguauuuauuuuauuuuauuuuguuuuuugagagggagucucgcucugucacccaggcuggagugcaguggcgugaucucggcucacugcaaccucugccuccuggguucagguuucucuugccucagccucccgaguagcugggauuacaggcacacgccacaacaccuggcuaauuuuuguauuuuuaguagagaugggguuucaccauguuggccaggcuggucucaaacuccugaccuaaagugaucggcccaccucagccuccccaagugcugggauuacaggcaugagcuaccaugccuggcuaaugggaagguuuuguacaaagacuggcuggauguuucuaauucaauuuuucuggcuguugggcagacaaauggguacugggagaguggguacaggaagcccaggaaggacccaggcacuggugccaucugggcaagggguggcagcaguggagacagggguaggcaacauggugaaacgcugucucuacauaauauacaaaaauuugccagguguaguggcgcauacguguagucccagcuacucggagguugaggcgggaggauagcuugagucuaggagguugagcugcugugugagcugugauugcaccacugcacuccagccugggccacagagcaagacgcugucucaaaacaaaaacaaaaagaagaggccaggcgcaguggcucacgccuguaaucccagcacuuugggaggcugaggcaggcugaucaccugaggucaggaguucgagaccauccugggcaacauggggaaaccccaucucuacuaaaaauacaaaaauuagccaggugugguggcgugugccuguaaucccagcuacucgggaggcugaggcacgagaaucacuugaaccuggaaggaggagguugcagugagcuaagaucgcaccauugcacuccagccugggcaacuacgucuuaaaaaaaaaaaaaaaaaaaaaaaaaaaaaagccaggcgcgguggcucacgccuguaaucccagcacuuugggaggcugaggcgggcggaucacaaggucaggagaucgagaccauccuggcuaacacagugaaaccccgucucuacuaaaaauacaaaaaauuagccgggcaugguggcaggcgccuguagucccagcuacuugggaggcugaggcaagagaauggcgugaacccgggaggcagagcuugcagugagccgagaucacgccacugcacuccagccugggagacagagcaagacucugucucaaaaacacaaaaacaaacaaacaaaaugggccaggcgugguggcucacgccuguaaucccagcacuuugggaagccgaggugggcggaucacgaggucaggagaucgagaccauccuggcuaacauggugaaacccugucucuacuaaaaauacaaaaaaaaaaaaaaaaaauuagcugggcgugguggcguagucccagcuacuugggaggcugaggcaggagaauggcgugaaccugagaggcggagcuugcagugagccgagaucgcgccaccgcacuccagccugggugacagagugagacuccaucucaaaaaaaaaaaaagaaacccaguuauugaugugcggcuucuguucucagccaggaggcaggcucaaugguguccccaaaccagugguuaugguucucaggaacaaaauacugaucaaggcaaaccuccuucuacaaacuuuccucuucauuuaaggagccaaggcaaagagggaccacugugcucauggacccaucgcugccuuccaaggaccauuucccagagcuacucaacuuuuaagccccugccaugguugcuccuggaaggagaaccagccacccugaggaccaccuggccaugcgugcacagccugggaaaagacaguuacucacgggagcugcaggcccgucaccaagcccucucccgacccaggcuuuguggggcaggcaccugguaccaaggguaacccggcuccugguauggacggaugcgcaggauuuaggauaagcugucacccaguccccauaacaaaaccacuguccaacacugguaucuguguucuuuugugcuaugaauuuggauuccuaauugcuauuguugguugcugggguuuuaaaugauugauaagcuuguacaguuaacuuauagagggggagccauauuuaacauucuggauuucagaguagagauuucuguguugucuccuagaaagcauuacauguaguuuauuucagcauccuuguuggguggggcccuggcucucuuccccuuuggugggaccuccccuuucuuugggcuucaguucacucaggaagaaaugaggcugucgccaucuuuaugugcuuccaguggaaaugucacuugcuacagacaauagugcaugagagucuagagaaguagugaccagaacagggcagaguagguccccuccauggcccugaauccuccucugcuccagggcuggccucugcagagcugauuaaacaguguugugacugucucaugggaagagcuggggcccagagggaccuugagucagaaauguugccagaaaaaguaucuccuccaaccaaaacaucucaauaaaaccauuuuaguugaaaagca

SEQ ID NO: 191548 - RNA, 9737 nt, Homo sapiens
gcgcucuaacggccaggcccagccgcuugaggcuccccaacggccaggccgcgcccccgcgugcgugcgcggcccggcagagccgugcgggcgcccgcguacucacuagcugagguggcagugguuccaccaacauggagcucucgcagaugucggagcucauggggcugucgguguugcuugggcugcuggcccugauggcgacggcggcgguagcgcggggguggcugcgcgcgggggaggagaggagcggccggcccgccuguaaguggggccgggucgggugggggcggcccgcggugucccggcucccggccuccucgugguccgaccugcgguuugggcccgcggcugguggggcccggcgacuccaugggccucaguuucuccucugguaacgugagcuucgcuuccagagacggggacccgccuugccggguuaggcgcaccuccuggggcgggacuggcuccaaccugggccccuuacugcggcuuucucuguggccgaggccaggccguccccgggguggccaggagagcaccguaaacucuucagccugcuccguggccgcgaucucggaaaaagcaccaauucugugaugugcagcagcauuuacugggcaucuaugacccugugauaggcuuuggggucuuuuucuguaaggaguccaguaaaggagaaguacaucuguauuaugaacaccuaaauauguaagugaaaaacacggugaaauaaguuucacugaggccaggcgaaguggcucacgccuguauucccagcacuuugggaggccgaggcagggagaucgcuugagcccaggaguuugggaccagccugagcaacauagcaagaccccaucucuacgcaaaauuagcugggugugguugugcacgccccuguagucccagcuccaugggaggccgaggcaggagggugucgugaguccaggaauucaaggcugcagugaguugugauagaucgcgccacuguacuucagccugggugacggcaagagccugucucugaaaaguuucauagaagagguuaguacuagaaaugggaaacaccagagagucagugggcagcccugcucuuuuuauuuauuuuucagacagaguuucgcucuucuugcccaggcuggagugcaguggcacaaucuuggcucguugcaacuuccgccugccagguucaagcgauucuucugccucugccucccgaguagcugggacuacaggcacacaccaccacgccuggcuaauuuuuguauauuuaguagacgggguuucgccacguuggucaggcuggucucgaacgccugaucucaggugauccacucguccuggccuccaaaagugcugagauuacaggcgugaaccacugugcccggccagcccugcauuuuuuuuuuuuuuuuuuuugcagggggacggaguuuugcucugucgcccaaucuggagucuaguggcgggaucucggcucacugcaagcuccgccucuggguucacgccauucuccugccucagccuccugaguagcugggacuacaggcguccgacaccacacccggcuaauuuuuuguauuuuuugaguagagacgggguuucacuguguuagccaggauggucucaaucuccuaaccucuugugauccaccugccucggccucccaaagugcugggauuacaggcgugagccacccugccuggccgaguccuguucuuuuaugggggaggugguuguuagggaaaucauuacugagaauagggggcacaugagguaguguggggucucaaaggaugguucuagaagaagaguuugccagaaggccaaggaaaaaagacauuccugccaauggcaauacccgagaaggcaaggaguccccaaacagcauuugguaugacuuaagugugaggaggggggcuuguuagacaugccuggagagaaggaagcagaggacagauuguggcuguguuuguuugcagggcccaggagcuuuuuuccuguuggaauuggggagcaucugcagucauuuaccacaugccagcuuugugacucaauuaaguaucuuuuacaaaagugacuggcuccacucccccgcacaggacucaacagauguugacuucucauccccgaguucuuucagguacuggagugcaguggugcgaucuuggcuuacugcaaccucuaccuccuggguucaagugauucuccugccucagccuccugaguagcugggauuacaggcgccugccaccacgcccggcuaauuuuuguauuuuuaguagagacgggguuucaccauguuggccagacugguggaacuccugggcaucaagaugauccagcugccgggccgggcauggugacucacgccuguaaucccagcacuuugggaggccgaagcgggcaggucacaaggucaggagaucgagacugaggcaacagagcgagacucuguaucaaacaaaaaaaaaaaaugauccagcagcugccucagccucccaaagcgcugggauuacaggcaugagccaccgcacccggccuccauagagccuuuaaugcuuguguucgguacuuuugcuugucacuuuguagauaucucauccaauucaaucucccuuauuuuuauuuauuuauuuauuuauuuauuuugagacagaaucucacucugucgccuaggcuggaauacaguggcacgaucacugcauuugaacuccugggcucaagcaauuuucccuccucagccuccgaauagcugggaccacaggcgcacaccaccaugcccagcuaauuaaaguuuucuguagagauggggugucacuauguuacccaggcuggucucgaacuccugagcucaagcaauccucccaucucagccuaccaaaaugcugggaucacaggcaugagccaccgcccccaguucucaaccucucuuuaagaaaaccaaggcugggccggacacaguggcucacgccuauaaucccagcacuuugggaggccaaggcaggcagaucacuugaggugaggaguuggagacaagccuggcccacauggugaaaccccaucucuacuaaaaaaacaaaaaaauuggggccaggugccauggcucacgccuguaauccuagcacuuugggaggccgaggcggguggaucacaaggucaggagauugagaccauucuggcuaauguggugaaaccccacaucuacuaaaaauacaaaaaaaaauuagccgggcaugguggcgggcgccuguagucccagcuacuugggaggcugaggcaggagaauggcgugaacccgggaggcagagcuugcagugagcugagaucacgccacugcacuccagccugggugacagagcgagacuccaucugaaaaaaaaaaaaaaaauuagcuggauaugguggugcacgcccaugaucccagcuacuuggaaggcugaggcacaagaauugcuugaaccugggaggcagaggcuacagugagcggagaucacgccacugcacuccagccugggcgacagagcaagacucugucuccaaaaaaaagaaagaaagaaaagaaaaaaaaaaccaagguccagagcaauucacuaacuuacccaaagcagggccgcuagagaugguugugcacauuacucccuacauagggaugucuggccaaggauccacacuccacuggccgugcuguguacccgcccagcagcaucacccaacccagagagugcgccuuuuccacucuacaugaaggugcucuguggacuuacuguaaacagccuccucaguagucagucaguaguagagacagaauccaaacccaggucugauuccaaagccucuguuuuguuucuguuuucuguuuguuuuuuuuugagacagggucuugcucugucacucaggauggaaugcaguaguguugugaucauagcuuacugcagccucgaacuccugggcucaaaugauccaaagcauugggauuacaggcaugagccaccauacccagccagccaaagccucuguuuuugcccauaucacacucauucuccuccagaagacaagggccauaucugguuaaucuccugcuguuccacucaaugccuggcucaucauaggugggcaguaaaugcuuaucagugaguaacuggagaacaacauggcccuuccuuauaggccaaaaagcaaauggauuuccaccugacaaaucuucgggauccaagaagcagaaacaauaucagcggauucggaaggagaagccucaacaacacaacuucacccaccgccuccuggcugcagcucugaagguacgugggguaccuggcacagcgugcacccugagacucagccccacaggcuuuuccucuggaguauuccaugcauguuacaggcucuccugccucugaucagaaucagcgggggugcuuaauucuguccccucucaucgcagcccaaucucagcuugcuguuaauccaggccacagggccccaucuccccggcuccagguuuggcuuccccaucucccccaggagcuccuauugacacuuccugccacccuuccccuagagccacagcgggaacauaucuugcauggacuuuagcagcaauggcaaauaccuggcuaccugugcagaugaucgcaccauccgcaucuggagcaccaaggacuuccugcagcgagagcaccgcagcaugagagccaacguggagcuggaccacgccacccuggugcgcuucagcccugacugcaggugggacaagacggagccucagguuugccugcagaggccuagucccaggcuuuggccuucccauaucugcuuugagguagugaggagggaccuggacccagggccucccuuggggugccagaaagagcauccacauaguuugcgcgcugccuggggcucccuggagaucugggcugcuauacagcaaggaaacagggggaggucucuuccuaccuggaaauaccuuggccuggcuuccagaugagccuuaguuucuaaacccuagagagaaacuaaaggagccaaagcuaucagaaucuuaccuuuugaggaguuuuaugagauuuggaaccaggggcuuaaguuuuaaggcuagacuguggggcaugaggagagaucuugacuuccccgagaacccagcacaggaccuggaacacagagccucuuuguccagugagagcgugacuugucugcugccugucucuagagccuucaucgucuggcuggccaacggggacacccuccgugucuucaagaugaccaagcgggaggaugggggcuacaccuucacagccaccccagaggacuucccuaaaaagcacaaggcgccugucaucgacauuggcauugcuaacacagguaagaggcauucagaggguggcgccugcccaaagcaugaaggaaagauccaguucuauuuccucaaugaguuaaugcugccugaaaguucugcucaaccugagaggaacaaggggucccuggcucugaacagccuggcucugugcuccccuggagucccugggccacaccaggucccuagggaagguggggaagggccacagucuucagcagaguccuuaucuguagugacccuuggccugggaggagacauguauacuucgggcagcagaggccuuguaagugucuuuggagagugacaguuggucaggucacugcccgugacccacaucacucccuucccgcucagggaaguuuaucaugacugccuccagugacaccacuguccucaucuggagccugaagggucaagugcugucuaccaucaacaccaaccagaugaacaacacacacgcugcuguaucucccuguggcaggugggcaaggagggguauuggcgucugggaccacgagaggcuggggcuggggagcaggcacagaacagagagccagcuucaucgcgugggaagagcauacgggguggggucaggaacccgagcuucaagucucagcucuccccacuugcaguagugggauuucaugcaggucgccccauguccuuagucgcuauuucuucaucuucaguguuuuuguuuuuuagaaaauuagucucacucugucacccaggcuggagcacaguggugcgaucauagcucacugcagccucaaacuccuggguuguagcuauucucccagcucagccuccugaguagucaggacuauaggcaugugccacuguacucagcuaauuuuuguuuuuuguuuguuuguuuguugagacgguuucacccucgcccaggcaggagugcaguggcgcaaucacagcucacuguagccuugacuucccaggcucagaccauccucccaccuuagccucccgaguagcugggacuacaggcgugcacuaccacaccuggcuaauuuuuguauuuuuuguugagauggggucuuacuauguugcccaggcugguccugaacuccuggccucaagugauccucuugccucgaccucccaaagugguagaauuacaggcgugagccacugugccaagccaccuuugggcggggauguuacauaucuuagaacaaggcuagaagauaaacugaggucacauacauaaaagaacuuuuuuguugugguuguuuguuuguuuuuugagauggaguuucgcucuuguugcuuagguuggagugcaauggcaggaucuuggcucaccacaaccuccgucucccggguucaagcgauucuccugccucagccucccccaaguagcugggauuacaggcaugcaccaccaugcccagcuaauuuuuuauuuuuaguagaggugagguuucuccauguuggucaggcuggucucaaacugucggaccuuaggugagcugcccgccugggccucccaaagugcugggauuacagguaugagccaccacacccggccuuuuuuuuuuuuuuuuucugagacagucucacucuguugcccaggcuggagugcaguggugcaaucucaaucucagcucacugcaaccuccaccuaccagguucaagugauucucccaccucagccuucccaguaggugggacuacaggcaugcgccaccacgccuggcuaauuuuguauuuuuaguagagaugagguuucaccauguuggccaggcuggucucgaacuccugaccucaggugauccacccaccucggccucccaaagugcugggaugacaggcgugagccaccgcgcccggccaaaauaacucuuuaaagguuuauauuauccagauaugaggauuaucaacuuucucaggaaagagauugagggguuuuacaggaacaacaugcuccgaaaaugaaguuuuaaaggcuucuggguuguauggcagauuuguagccucguguggcuucaccccagaugugaagguuugggaagucugcuuuggaaagaagggggaguuccaggagguggugcgagccuucgaacuaaagggccacuccgcggcugugcacucguuugcuuucuccaacgacucacggaggugagugaauccgcucugaugucugaccaguggcucuuggccccucuugacaaccaggguccuucugucuguuugugccauggcucugaagaggguggggugccuggcccucggcaggaagcugacuuagcuuccuagcuggagcugcucaaguugggccagugcuuacccugccaggguguguuggggcuugagcugugauuuucuguguugcaggauggcuucugucuccaaggaugguacauggaaacugugggacacagauguggaauacaagaagaagcaggaccccuacuugcugaagacaggccgcuuugaagaggcggcgggugccgcgccgugccgccuggcccucucccccaacgcccaggucuuggccuuggccaguggcaguaguauucaucucuacaauacccggcggggcgagaaggaggagugcuuugagcggguccauggcgaguguaucgccaacuuguccuuugacaucacuggccgcuuucuggccuccuguggggaccgggcggugcggcuguuucacaacacuccuggccaccgagccaugguggaggagaugcagggccaccugaagcgggccuccaacgagagcacccgccagaggcugcagcagcagcugacccaggcccaagagacccugaagagccugggugcccugaagaagugacucugggagggcccggcgcagaggauugaggaggagggaucuggccuccucauggcacugcugccaucuuuccucccagguggaagccuuucagaaggagucuccugguuuucuuacugguggcccugcuucuucccauugaaacuacucuugucuacuuaggucucucucuucuugcuggcugugacuccucccugacuaguggccaaggugcuuuucuuccucccaggcccaguggguggaaucuguccccaccuggcacugaggagaaugguagagaggagaggagagagagagagaaugugauuuuuggccuuguggcagcacauccucacacccaaagaaguuuguaaauguuccagaacaaccuagagaacaccugaguacuaagcagcaguuuugcaaggaugggagacugggauagcuucccaucacagaacuguguuccaucaaaaagacacuaagggauuuccuucugggccucaguucuauuuguaagauggagaauaauccucucugugaacuccuugcaaagaugauaugaggcuaagagaauaucaaguccccaggucuggaagaaaaguagaaaagaguaguacuauuguccaaugucaugaaagugguaaaagugggaaccagugugcuuugaaaccaaauuagaaacacauuccuugggaaggcaaaguuuucugggacuugaucauacauuuuauaugguugggacuucucucuucgggagaugauaucuuguuuaaggagaccucuuuucaguucaucaaguucaucagauauuugagugcccacucugugcccaaauaaauaugagcuggggauuaaauacgaauaagacaugguuucugccaucaaagauggcuggugggagagagagauacacccuuauuaagugcuuuguguuaguuuauucauagcuauuguuauauaugucaaggcaagagaggaccagagcaggacagaggcaauggguauugaaguugaagggguacauuugauaagagagucgguauugagaaguuuaaauuugugaauuugaaggcugcguggguguggcagguaagggaaaugagguaucugggaaggcuugaguguaggcaaauuuauucaucccaagucaaacucuugaucucucucacgaaaacuaugacccccccugguugccccugaccucucaauguuggaacaagccacaaccguggaguuauccuugaugacuccccauucauuaucccuucugucccaccaccacagcugucaucuguucaccagaacguucuuuugguuacacuccaugugacauccugaggcuguugcuucucuccagcuuuucuguuaccauccugguccuggcuacugucaccuagugggccacuauaauauggcuuccuaauggaucuuccugcuuccucuguugccucauuacuuuucuauauagcagaaugaucuuuugaaaaugugaaccagaucacauuauucccuaguuaaaaccccccaaggcuucccaucacacuuggaauaaaauccaaaagaauuuuucuaaaccaa

SEQ ID NO: 191549 - RNA, 6351 nt, Homo sapiens
gcuuuuugaccccggaaguccgggcgggcgccgagccgggugcguuuugccacagagccguaaaggcgcgcgggaacauggggcuguaugcugcagcugcaggcguguuggccggcguggagagccgccagggcucuaucaagggguugguguacuccagcaacuuccagguagcggaccugggcgcgaguaguagggguggggagugaggaacccgggguggggucggacgggcccggguggggucgggagguggggcccggcgaggagggccgggggagcccccacccagcuugucuuccucggccacacagaacgugaagcagcuguacgcgcuggugugcgaaacgcagcgcuacuccgccgugcuggaugcugugaucgccagcgccggccuccuccgugcggagaagaagcugcggccgcaccuggccaaggugaggggaggggagggacggggaagugaaccccgacggucagcgcuuugucaucuggucucagcucugcugccgugcacggcgggacuggagcaagucgcucaucugaaaugaguaugagccgaccuucccuggguuacgaauuaagaugggaugaaaaugcuuuaacuuugaguguuuugaaggauuaaauaaccgaaguacaaagugguaguggcggagacuguaaggaagucgggcguggcggcgcgcaccuguggucccagcuacucgggaggcugagggaggaggaucacuugagcccaggaggucgaagcugcagugagcuaugaucuggccacugcacuucagccugggcgacagagcuagaccccauucuaaaaagaaaacccaaacccacgaaaggguaauguuggcaagaaguugggugcagaggugucuacuggugaacaucgguggagaaagggucuaaggcugggaagcgagacgccagguuccgauccuguucuguaguuaauuucuggugugaucuuggauaagguaucccaccuguaucuugucaggugaucuguuuagccauuccauugccggggcuccauuagaguuaguucuaaggcauucaugcuucaugcuuagggcauuuuuguuuuugucuuuguucccucauucccaggugcuaguguaugaguuguuguugggaaagggcuuucgagggggugggggccgauggaaggcucuguugggccggcaccaggcgaggcucaaggcugaguuggcucggcucaagguucaucggggugugagccggaaugaggaccuguuggaagugggauccaggccugguccagguaagcuggaaggaguuggggggugggggaggcggggaacuuugcuccugccuacucacugcucauugcguccuacguagccucccagcugccucgauuugugcgugugaacacucucaagaccugcuccgaugauguaguugauuauuucaagagacaagguuucuccuaucagggucgggcuuccaggugagagcuuagagcccuggcuguccucaucuagggaggugucugggguauugggaagagaaguggcuggauaguugugacuuugcucucugggcuuucuuccuaccuuuccagcaguuuauccaucuccaagguuugucuuccugccaucccuuaaacaucgaacuccuaggagccucauccuacauucuucuugaucucuccguuuuuucucuagcuuuaacuccugccucccaccuggugauucucaccacccaguguagacuuccccucuugcauucuuaccuccucagguucauaugaacgcaccacagaugcuaacagucgcugcauuugucaucuuuccucucagacuuuacaccuaguacauccccaguuaaaucuaacagaugucaccaucuuccacccauuuggucaagccagaaacugagucauccuaggugcuuccuucuccucccuccaaucauuuacuccccuaccuugagcaucuuucucagcuccacuccuuucucucuuuuuuuuuuagacugagucucacucugucauccaagcuggagugcaguggcaugaucuuggcucacugccucccggguucaagcgaugcuccugccucagccuccugaguagcuggaauuagaggcucccaccaccaauguccagcuaauuuuuguauuugcaguagagaugagguuucaccauguuggccaugcuggucugaaacuccugaacucaggugaucugcccgccuuggucucccaaagugcucggauuacaggcgugagccaccacaucuggccuccacuccuuucucuucagccccucggacacugccuagguuaagcacucauuucuuauugggaugaccacaagaacuucccagacugguuucucugcuuccagacugucucacugcauuuuccuugagguugacuguaggaagcucuaaagccagaucugaugcuguuacuccucugcuaagcuuuuuuuuuuuuuuuuuuuuuuuuuuuugagacaaggguuuugcucuuguugcccaggcuggagugcaauggcgcaaucucggcucacugcaaccucugccuccuggguucaagcaauucuccugccucagccuccugaguagcugggauuacagggaugcagcaccacgcccggcuaauuuuguauuuuuaguagagacgggguuucuccauguuggucaggcuggucucgaggcuccugacuucaggugaucugcccgccucggccucccaaagugcugggauuacaggugugagucaccgugcccggccaugcuaagcccuuucuuggcuccacugugcugucccuccugcuuucucucagguccaucugccacggugcugcgugcaccagugugccagcaacaguggcuggucccugccccgugccuccuccacugggcucacaccugucucguuuuguccuucguuggcucugagaagcagccucugccccucucccuuucuccuacucuuuguaagauccucuuccuucugccucuaccauguugcuuggacaccaggguggaauagcagagaacggcugcuugcguuugaauuccagcucugccacuuugacagauuucugaacugagagaugugacucucuaggccuauuucugcaugggucggagagucggcgggacuccuuuacugaguuauagugaauguaguuuuaaccuaagcgccucacaugacuaacuccucauccaucaagaaugagcucagcucucaccucccugcauccccucaccccccuguaaaguaaacuuuuucugcuacucgggaggcugaggcaggagaauggcgugaacccgggagguggagcuugcagugagccgagaucgcgccacugcacuccagccugggcgacagagcgagacuccgucucaaaaaaaaaaaaaaaaaaaaguaaacuuuuuccaagguuaugcuucaacaggaauagcuaacauuuauuaauuugugccaaauaaguaucuugaauauauuggcucauugaauccccacaccuacuauuuuacagagaugccaguggggcuugagauugaaucauuugcccaggcucccacugcugguaaacaguagagggggcuccugacccaucagucuggcuugacaacccauucccucaacugcggauuccgcccaucucuagcuuaucacccuguugauuucuccauagcugugguaacauuuguugcaugaauggaccguugaaauggggccuggcagggagaaauucaggaaaugaaugaaugguucuucccuggcagccucgaugacuuacgagcccucaaggggaagcauuuucuccuggaccccuugaugccggagcugcugguguuucccgcccagacagaucugcaugaacacccacuguaccgggccggacaccucauucugcaggacaggguaggcaagaggaauagaaaagggaagaauguguaggcacgggaagggccuagccuggggucucuguuuaccuggcuccugugcucugccugccaggccagcugucucccagccaugcugcuggaccccccgccaggcucccaugucaucgaugccugugccgccccaggcaauaagaccagucacuuggcugcucuucugaagaaccaagggugagugccacaggaggaggaggaggacaugggguuugauucugugccuuucaguggguaaugaaggcugaaaggaugacuuucgcuuaagucuuucuugcugcaccaaagcaguucacgguauuugccccaagcuaagcuuuccccacugcaggugugagauguggaucccuuagcccuuggggcagagaccccaggccaguuaccucugacugugagcccuuuaaacguaggccguuucaauauuguguguccuggcuuaaccugcauguucugguuggcugugacaggcccuuagcugcuccaugcgugcucagcucaccccugcuuugcccuaggaagaucuuugccuuugaccuggaugccaagcggcuggcauccauggccacgcugcuggcccgggcuggcgucucuugcugugaacuggcugaggaggacuuccuggcggucucccccucggauccacgcuaccaugagguccacuacauccugcuggauccuuccugcaguggcucgggugagauggcgagaaagcguggccgagggacucgcagauccacagcagcuuagaccuggagucauuuguuuuggucuuacuucugacacuaaugggcuugggacccugggacaaaaguucuccucugugaagcgaggauuucaggacugagguagccugugaagcuauguaacagagacacucuuuuccuuagguaugccgagcagacagcuggaggagcccggggcaggcacaccuagcccggugcgucugcaugcccuggcaggguuccagcagcgagcccugugccacgcgcucacuuucccuucccugcagcggcucgucuacuccacgugcucccucugccaggaggagaaugaagacguggugcgagaugcgcugcagcagaacccgggcgccuucagguacagggcgggcgccagggucguggggagugggggacggggugagcugcucucuuacccagcauuggggccguuucucuugcaggcuagcucccgcccugccugccuggccccaccgaggccugagcacguucccgggugccgagcacugccuccgggccuccccugagaccacacucagcaguggcuucuucguugcuguaauugaacgggucgaggugccaaggugagugagugggggcgugcuugggaggcgcaggauggcaccggcacaucuaacaucuacacuucucuagcucagccucacaggccaaagcaucagcaccagaacgcacacccagcccagccccaaagagaaagaagagacagcaaagagccgcagccggugcuugcacaccgccuugcacauagcagaggcuccgggcugacuccuuccuggugggaaaggaagaugccuguccucuccguggaggacccugggcccucaccgcaggaagcaguuuggguuuugaaagguuauugggucccuuccuugggcuguguucuugcuggugagcaaaguguugccugcaaaaauaaaaugcagaacguacucuacgauagaucacaguuuuuuauucuuaaugucacaagcaggagaaaaaucucacauucauacuaaaaguuccaacuagacucaacaggaaugaagucucuauuuguaauggaaagucccagccucccgcugccguccagugcguguacuguacacauccacacucacacucacucaggguucccggaccggcuguccugccugcggaacugagguaaacuagcucaggugcugacacuaggagggucuaccuuacauaagguacagguagaagcuugauugcuaggcccaggcccacccagacccuccaauccuaacagguauuuaggcuugagguucacucccuccucagcugcacacgcagccagguauuaacgaggaucagagcuguucugaggggugggaaggagcagccccaccaccacucacucacccucagucacaucggggagggggcaccaguuacauuuacaucacauuauuuauaaaauaagaauuacauuucauauaacauggccagaaggagcucuagucccccaggaaagcugccggggacagcauuugagccucuucuuugcacaggcauaacuuaacuauacagcuaauuccuaguuaauagcauuuauacuuaaccaccucaaugaaccaagcuugaaggaauuuaaaaggcaauuuagcuuaaauacaaaaauaaauuuuuguuaaaaaacguuu

SEQ ID NO: 191550 - RNA, 6351 nt, Homo sapiens
aaacguuuuuuaacaaaaauuuauuuuuguauuuaagcuaaauugccuuuuaaauuccuucaagcuugguucauugaggugguuaaguauaaaugcuauuaacuaggaauuagcuguauaguuaaguuaugccugugcaaagaagaggcucaaaugcuguccccggcagcuuuccugggggacuagagcuccuucuggccauguuauaugaaauguaauucuuauuuuauaaauaaugugauguaaauguaacuggugcccccuccccgaugugacugagggugagugaguggugguggggcugcuccuucccaccccucagaacagcucugauccucguuaauaccuggcugcgugugcagcugaggagggagugaaccucaagccuaaauaccuguuaggauuggagggucugggugggccugggccuagcaaucaagcuucuaccuguaccuuauguaagguagacccuccuagugucagcaccugagcuaguuuaccucaguuccgcaggcaggacagccgguccgggaacccugagugagugugaguguggauguguacaguacacgcacuggacggcagcgggaggcugggacuuuccauuacaaauagagacuucauuccuguugagucuaguuggaacuuuuaguaugaaugugagauuuuucuccugcuugugacauuaagaauaaaaaacugugaucuaucguagaguacguucugcauuuuauuuuugcaggcaacacuuugcucaccagcaagaacacagcccaaggaagggacccaauaaccuuucaaaacccaaacugcuuccugcggugagggcccaggguccuccacggagaggacaggcaucuuccuuucccaccaggaaggagucagcccggagccucugcuaugugcaaggcggugugcaagcaccggcugcggcucuuugcugucucuucuuucucuuuggggcugggcugggugugcguucuggugcugaugcuuuggccugugaggcugagcuagagaaguguagauguuagaugugccggugccauccugcgccucccaagcacgcccccacucacucaccuuggcaccucgacccguucaauuacagcaacgaagaagccacugcugaguguggucucaggggaggcccggaggcagugcucggcacccgggaacgugcucaggccucgguggggccaggcaggcagggcgggagcuagccugcaagagaaacggccccaaugcuggguaagagagcagcucaccccgucccccacuccccacgacccuggcgcccgcccuguaccugaaggcgcccggguucugcugcagcgcaucucgcaccacgucuucauucuccuccuggcagagggagcacguggaguagacgagccgcugcagggaagggaaagugagcgcguggcacagggcucgcugcuggaacccugccagggcaugcagacgcaccgggcuaggugugccugccccgggcuccuccagcugucugcucggcauaccuaaggaaaagagugucucuguuacauagcuucacaggcuaccucaguccugaaauccucgcuucacagaggagaacuuuugucccagggucccaagcccauuagugucagaaguaagaccaaaacaaaugacuccaggucuaagcugcuguggaucugcgagucccucggccacgcuuucucgccaucucacccgagccacugcaggaaggauccagcaggauguaguggaccucaugguagcguggauccgagggggagaccgccaggaaguccuccucagccaguucacagcaagagacgccagcccgggccagcagcguggccauggaugccagccgcuuggcauccaggucaaaggcaaagaucuuccuagggcaaagcaggggugagcugagcacgcauggagcagcuaagggccugucacagccaaccagaacaugcagguuaagccaggacacacaauauugaaacggccuacguuuaaagggcucacagucagagguaacuggccuggggucucugccccaagggcuaagggauccacaucucacaccugcaguggggaaagcuuagcuuggggcaaauaccgugaacugcuuuggugcagcaagaaagacuuaagcgaaagucauccuuucagccuucauuacccacugaaaggcacagaaucaaaccccauguccuccuccuccuccuguggcacucacccuugguucuucagaagagcagccaagugacuggucuuauugccuggggcggcacaggcaucgaugacaugggagccuggcgggggguccagcagcauggcugggagacagcuggccuggcaggcagagcacaggagccagguaaacagagaccccaggcuaggcccuucccgugccuacacauucuucccuuuucuauuccucuugccuacccuguccugcagaaugagguguccggcccgguacaguggguguucaugcagaucugucugggcgggaaacaccagcagcuccggcaucaagggguccaggagaaaaugcuuccccuugagggcucguaagucaucgaggcugccagggaagaaccauucauucauuuccugaauuucucccugccaggccccauuucaacgguccauucaugcaacaaauguuaccacagcuauggagaaaucaacagggugauaagcuagagaugggcggaauccgcaguugagggaauggguugucaagccagacugaugggucaggagcccccucuacuguuuaccagcagugggagccugggcaaaugauucaaucucaagccccacuggcaucucuguaaaauaguagguguggggauucaaugagccaauauauucaagauacuuauuuggcacaaauuaauaaauguuagcuauuccuguugaagcauaaccuuggaaaaaguuuacuuuuuuuuuuuuuuuuuuuugagacggagucucgcucugucgcccaggcuggagugcaguggcgcgaucucggcucacugcaagcuccaccucccggguucacgccauucuccugccucagccucccgaguagcagaaaaaguuuacuuuacaggggggugaggggaugcagggaggugagagcugagcucauucuugauggaugaggaguuagucaugugaggcgcuuagguuaaaacuacauucacuauaacucaguaaaggagucccgccgacucuccgacccaugcagaaauaggccuagagagucacaucucucaguucagaaaucugucaaaguggcagagcuggaauucaaacgcaagcagccguucucugcuauuccacccugguguccaagcaacaugguagaggcagaaggaagaggaucuuacaaagaguaggagaaagggagaggggcagaggcugcuucucagagccaacgaaggacaaaacgagacaggugugagcccaguggaggaggcacggggcagggaccagccacuguugcuggcacacuggugcacgcagcaccguggcagauggaccugagagaaagcaggagggacagcacaguggagccaagaaagggcuuagcauggccgggcacggugacucacaccuguaaucccagcacuuugggaggccgaggcgggcagaucaccugaagucaggagccucgagaccagccugaccaacauggagaaaccccgucucuacuaaaaauacaaaauuagccgggcguggugcugcaucccuguaaucccagcuacucaggaggcugaggcaggagaauugcuugaacccaggaggcagagguugcagugagccgagauugcgccauugcacuccagccugggcaacaagagcaaaacccuugucucaaaaaaaaaaaaaaaaaaaaaaaaaaaagcuuagcagaggaguaacagcaucagaucuggcuuuagagcuuccuacagucaaccucaaggaaaaugcagugagacagucuggaagcagagaaaccagucugggaaguucuuguggucaucccaauaagaaaugagugcuuaaccuaggcaguguccgaggggcugaagagaaaggaguggaggccagaugugguggcucacgccuguaauccgagcacuuugggagaccaaggcgggcagaucaccugaguucaggaguuucagaccagcauggccaacauggugaaaccucaucucuacugcaaauacaaaaauuagcuggacauugguggugggagccucuaauuccagcuacucaggaggcugaggcaggagcaucgcuugaacccgggaggcagugagccaagaucaugccacugcacuccagcuuggaugacagagugagacucagucuaaaaaaaaaagagagaaaggaguggagcugagaaagaugcucaagguaggggaguaaaugauuggagggaggagaaggaagcaccuaggaugacucaguuucuggcuugaccaaauggguggaagauggugacaucuguuagauuuaacuggggauguacuagguguaaagucugagaggaaagaugacaaaugcagcgacuguuagcaucuguggugcguucauaugaaccugaggagguaagaaugcaagaggggaagucuacacuggguggugagaaucaccaggugggaggcaggaguuaaagcuagagaaaaaacggagagaucaagaagaauguaggaugaggcuccuaggaguucgauguuuaagggauggcaggaagacaaaccuuggagauggauaaacugcuggaaagguaggaagaaagcccagagagcaaagucacaacuauccagccacuucucuucccaauaccccagacaccucccuagaugaggacagccagggcucuaagcucucaccuggaagcccgacccugauaggagaaaccuugucucuugaaauaaucaacuacaucaucggagcaggucuugagaguguucacacgcacaaaucgaggcagcugggaggcuacguaggacgcaaugagcagugaguaggcaggagcaaaguuccccgccucccccaccccccaacuccuuccagcuuaccuggaccaggccuggaucccacuuccaacagguccucauuccggcucacaccccgaugaaccuugagccgagccaacucagccuugagccucgccuggugccggcccaacagagccuuccaucggcccccacccccucgaaagcccuuucccaacaacaacucauacacuagcaccugggaaugagggaacaaagacaaaaacaaaaaugcccuaagcaugaagcaugaaugccuuagaacuaacucuaauggagccccggcaauggaauggcuaaacagaucaccugacaagauacaggugggauaccuuauccaagaucacaccagaaauuaacuacagaacaggaucggaaccuggcgucucgcuucccagccuuagacccuuucuccaccgauguucaccaguagacaccucugcacccaacuucuugccaacauuacccuuucguggguuuggguuuucuuuuuagaauggggucuagcucugucgcccaggcugaagugcaguggccagaucauagcucacugcagcuucgaccuccugggcucaagugauccuccucccucagccucccgaguagcugggaccacaggugcgcgccgccacgcccgacuuccuuacagucuccgccacuaccacuuuguacuucgguuauuuaauccuucaaaacacucaaaguuaaagcauuuucaucccaucuuaauucguaacccagggaaggucggcucauacucauuucagaugagcgacuugcuccagucccgccgugcacggcagcagagcugagaccagaugacaaagcgcugaccgucgggguucacuuccccgucccuccccuccccucaccuuggccaggugcggccgcagcuucuucuccgcacggaggaggccggcgcuggcgaucacagcauccagcacggcggaguagcgcugcguuucgcacaccagcgcguacagcugcuucacguucuguguggccgaggaagacaagcugggugggggcucccccggcccuccucgccgggccccaccucccgaccccacccgggcccguccgaccccaccccggguuccucacuccccaccccuacuacucgcgcccagguccgcuaccuggaaguugcuggaguacaccaaccccuugauagagcccuggcggcucuccacgccggccaacacgccugcagcugcagcauacagccccauguucccgcgcgccuuuacggcucuguggcaaaacgcacccggcucggcgcccgcccggacuuccggggucaaaaagc

SEQ ID NO: 191551 - RNA, 69504 nt, Homo sapiens
uacgauagaucacaguuuuuuauucuuaaugucacaagcaggagaaaaaucucacauucauacuaaaaauuccaacuagacucaacaggaaugaagucucuauuuguaauggaaagucccagccucccgcugccguccaguguguguacuguacacauccacacucacucucacucaggguucccggaccggcuguccugccugcggaacugagguaaacaagcucagguacugacacuaggagggucuaccuuacauaagguacagguagaagcuugauugauugcuaggcccaggcccacccagacccuccaauccuaacagguauuuaggcuugagguucacucccuccucagcugcacacgcagccagguauaacacucgcccucagucacaacggggagggggcaccgguuacaucuacaucacauuauuuauaaaauaagaauuacauuucauauaacauggccagaaggagcucuagucccccaggaaagcugccggggacagcauuugagccucuucuuugcacaggcauaacuuaacuauacagcuaauuccuaguuaauagcauuuauacuuaaccaccucaaugaaccaagcuugaaggaauuuaaaaggcaauuuagcuuaaauacaaaaauaaauuuuuguuaaaaaacguuuaaauauuuuuuucuuuuaauuuagacacacgcauucauacuucucccaaagagguugggcgugacagcaaggcgcuugggccugggguaugugguuucagaaggacggaaggaaaggaugggcugcagagggcccuguuugggaaaaauaggauuuuaaaaauaugguucauuaauuuagguuuucuaacaucuacuuugggugacguagccuccagugaggucaguuaagugggacagaaaccgcagagggaagaggucuuugcuuccccugggcccauucucccuggcugccagcccuugaagucagaacaccaugggaaaauucaggagucggcacuuguagccgucaaguggugcuacuuuccacauucaauuagcgaggccccagaaaacuugaaacaggaaguccggcacuaccaacaugccgccacucauacaacucaacucuuccuccaaacucgauucaaagagcaauacacagagcgucagacaaaggaacacaggacaaggcuugaaacauacaauccuggagaggcagacgagggcccaauggggccaaaggguagcugggcgaggaggcagcugaagcagcggugggcauccugccugcuccaagagcuucucccuucaccccuggcucugccaggcuaacagucuugagccaccaagcucugaggggccaaacuggcagaggguuggagaugaaacauugauucaggcuuggcaggaagaaaacggcaggagcagcacccacuggggucuccaaggcaaagcuagauucaagggcauuuaaaaaggagggaauccugcaaggaaccggugagggacacagcagcaagaaauggggaaacagaguccccagaagggaccagaggaagagaaccacuucucacagcuaagccaagcaagauaaagcuuuagggauaacccauuucccaaaucccaucaggugcacaccaccgauccaggcgggcuggacccugcccccuccagcgacgacggcucucggggaaagguggaaggggcgccugccuaagggugcgcuaagcgggagucagggcagcggacacuauguacagguccuuaguucuccagccuccccaguggaacuguucaaguagaggucccgggcuuuggcccuccgcauccugcuuccccuucccugaggcuugugcuuccuccagaagggaaagggccccagggcugccacugcccccuggcggcugaagccagagauccgggguagguuugcuuuacgcagcuggaaggguccaaggcucuuucuagcacgugccaagguccagauuuagggaagggguggggggaacagggacaggggacaaaggcuacuuuuugcgggugugcugccuucgggccugcagucgcugucgagccccuggggucuuggaucccgcaccaauggaaaaugaaggggccgccgauccuggaaagauucaacaagaccucaucagggcagcugcuaccugagacucuggcucugggugcccaaaucucuggaaggccaggccaguaauaaaacacagggugccucaauagggcuuuccccgcugcgucagaaacacuguacgggaggagccuccugaaaugcaaacucccagagucucagagcgaggcccacgaauccauuuuuaccuggcuucccaugggaggcaaacuuccaccccggacagcuccucucugaucucugccauccaacucccaucccugggcugugcuguacuccuaacccgaaaugucuuuccugugcugaaccugaucuucacggggccucagagggccaggagccugccaccccacccaaccucuccucagacagacgagcagggccacaggguggcuugcugcuuaccgaacgguccaacaccaacaaagccuugggcgggugcugaagaugccccaaaggagaggcugcugcccgaugugcccacuccaggcgcagggguguucugaccaaagguggggguggcggugccuggaaugaagagaacagagagcuggccagugagcagagggcggaggcaggcgaggagccgggcaggagccugugcucugcagggcacuucccacgggacccucagccccacuucugcuucuggggcacuccuccaucagcagcugagccagacaaccgagucuucaugccuggugccccagcucagccugcuucucccacccgcuaauggccacgccagggcagagaaaaagccccccugccccgcagccaccucgugggccuccugaccaucgcugcagaggggaguacucuggggcccccgccuccuagcguaccuggguuggcuaccuccucuguucaggccuuuucccccuagccaccguccccuccccucugaagccugguuuguccguccugugucuuuugugaugccccgugguccccucccuuccccggccuugcccugacuggcucuggcugccugcccgaugcccucucuggcagccccucugcagggauggcugcucucagggcuuggccuccggcccggacaaggggaagcucccugugcucccacgcugcuuccacacaguuucucuuccuucccuaaauaccguaacucagguucaaaucacuuuaaucugccauguccucaugucaccugucaacugccaggucacucccugauucacagaggacccuuggcucacuggcuuccuccccaucaccacucacggugacuucgcccugugaggcugacugaugguccucucagccccucggcccugccacccccaugaccuccucuccccgaccccugccaccacuccugcagccacacugucaccacaacugcuccggcucccgaaucuccugcaggcaccaccccuccugcagcugacuucacccgcucuccacuccugcacccccugagcugcaucggggcacugacccgcugccccuccugcugugcuugcuggggucuccacagccggguggcaccagcuguccgcugaccuuagaucuauacccagugucgcugggaaacacacgccaugcuaacuggccucacuuuaacuucacaaucacaauuuuccagcccacaaacugccuggaaacugaucacacuuuuuaauaugauguuccuuucccccacuguccaaaaugacuauuucaaaagaccccuuuuuuauacacuuuaucccgaccuucccucucccagauuuucucuccuacuucacgaagcaaacagaagccaugggaucuacauucaucuuccacacgggaggaaccaucacugcauccuucugccugauucugcaaugguuuuccugaacacuuaagacccaaacacccaacccuggccacaaacaauccuugccucuuggccuccuuccacaccacugcuuuagcuccugcccuccugccaugcuugucuuuguucugcucuucaacauaccaaacauguuucugccucugggccuuugcaugcgccauccugggccugaaaggcauguccacuugugcugugcccacccccaccccacccccauauucagcuuacgcuugagacagucuugcucugucaccuaggccagaguacaguguggcaugaucuucgcucacugccaccuccaccuccuggguugaaacauucuucugccucagccucccgagcagcugggauuacagguggguaccaccaugcccggcuaauuuuuugguauuuuuaguagagacaggguuucgccaaguugcccaggcuggucuugaacuccuguccucaagugauccacccuccuuggccucccaaaauauugggauuacaagcaugagccacugcgcccaaccuucagcuuacaauuguuaaguacucagaaggccuuugaccaguuaaauccacaauggcuccuccagucauuacuacguuagcaaaacauguaucaugcccuggcaucucacugaguucuauauucagugccugucucuucacugccacagcauaagcuccccgagaccacaggcuucacaggcacagcuuuucaguguccggcccgguagcccaaguccacgccccuccuuaccuccaaacacagguuugcucucaguugugcugcccacguugaaggcaaacggugugcucuggccgguggugcccagggcguucugaccuaagcccccugugaaggggguggagguggcugugcucccacucuguccugcuccaaagcugaaagcuccggugguggcgcuggagccugggguggccacguugaucccaaagcucccacugccagcgggggcugccgaacccccaaacgugaagggugaugguguugugcugccaaacaccgagcugcugcucccgcugcuggcggucugggugguggcuccaaagccggagcugguggcugcaccgaaggagaagacagcaguggagccgccaaaggcgggcugugagcuggcgggagcgccgaaggcggaagccguggcuuucaauccaaacgccgagugcguggcaccgccaaagguaggcuggaugggcguaggcacgugcgcaggcacgaucuugaucguggacgcaggugcaggugugggugcaguagccggggccggggcugcagaguuuccaaaagugaaagagcugccaaagcuggggguaagggcuggcuuggcggcccccgguggcugccccucagcggccccaaaugcgggcuggggguuggcucccggauaugaugggagcggggacuuggcgcuugagccaaagggaauguugaacgugggggugcucguguuacugaacgucagagugggcuggcugcugguggccggggcggagguggcgagggugcugccaaaaccacuaaagucggcagcgcugcugcugguggccguuggcacggcagugggcagggacuggcugaagguggugacuguggugguugugggcaaggcaggagguuugccaaacuggaauauggagcccauggccggggugaagcuggcagcagaggccuggggcgccccgaagaggaaaggcugugaggcggcaguggcggugcuggucgugguacucacacugcugcugcucacacuguuuaugccaaagccaaacgcaggcuucgaagcagagucuguggauggacuggcagaggugaugggagccacagcagagguggcgcuggccaggccagugaagagcggggcaguuguggugggagcaguggcgggaguaguugucugcuugaagaagggagcaggcaagggcacagaugcagguggccccaugcugcuaaagacaggcuggaaggucggggcuguggugcugguggucguggggagggaggagcuggagggcgcuguggcugugacugaagggccaggcgguguggggccuuccuucucacucuuggguggagccgugaaaaugggcuugaacaugggagaugcugaagaugcagcaggggcggcagggcuggaaggugagguguucuguguuccaaacaggaagcuuugcuugggggcgggggacggggcagauguggcuugggguuugguagccgucucugcuugaaggguuggaggugccuuggugucaguggcugguaccauggauggagcagggaucagccccagcaaaguggucggggguuuggagucaaaggaggggcuggggagcagcccuggcggcccugacugugauaaacccagcggggguaggaggcugggugucuuuggaggugagagggccucagugguugcugcuccagcagauucuggaagaagaauagaaaaugugaaauuggaauaaacacuucaaagaugaugguauucaguauuucagcguccuccccaugccuaccacagagccugggauccaagagucagucaauaaacucagcuaagucuacacuacaggccuguacaguaaaucaaggaaguguucauuauuuccaccucacagaucaucagacagaaggggauaaaauggggccuaaaugggggccuaauguguagagacuaagacaguccaauugucugaacucugaaguucacguaugaaucuagauauacuuuauuugccuacuaagcucaccugccaggcgcuaagagcacacaacuaugaauggggaagucucugcccuugagcagggagggugcguacgaaccccagguuaccgucugauaaagaggugugcgcgcgcagugccgugaaggccugggccgggaacaccagcagcccucaaagugcuggagggaaaggaagcaguguuguucuggaccaguaguucugacaggcaaggauauccugaccacgccaccacauucacacuucagaggugcugcaccgggaagaucauucucaucugacagaugaggaaggcgaggcucagggcagcuaagccaggcuucagauccugagcgucgcagcaccccuucucuaacacuuccugaugugggcuccggcgcuguuaaacguaggcccgcuccggugugcugagccagggugcguucggccugcagagcaaucuccagcgacugacaggcacgacgcccuuauuccaacccaagccggggaugcugcucagaaggcuggauccacggccccacuccagcucaccugggcaggguggcaggcucgggggagucugcaucuucuucaagcucucuaacaguggguuggugcuuggggccaggagggagguggguggggaggcaguugcagcagcaggcaggguaaagguaaaugaaggcugagugguagguggggucucagugacagaguucgaggcagcaucuaagaaagaaagaaaggugaagcaguccuggcuugucugggacuucuuuccacaugccugucggagagcaggcucucagcacagcucauggaggaaugucugcccuaaauugcaguggucccugcuguccaguucccgugaagaccaacacggauaucucaggugagaaagaccacaagaaaacauggaacucuacuucggauuuucccagagaaacccauuuuuccaaacaccaaaauaaaaccaaagaaaacagacaccugaaaccucucgagagugcaacgaucugugcuccuuaccacucuuguccuccaaggccugguugaaccacuguaaugaagccuucuucucuaagucuagguccucggcagugaucgaauagccaagcuggggagguggaggcuaccaaagagaaaaagaagaagucaggccaaucagaaaaaacgggaaggcugggcgugguggcuaacgccgguaaucucagcacucugggaggccaagccagcuggaucacuugaggucaggaguuugaggcuggccuggccaacauggugaaaccccaucucuacuaaaaauacaaaaaauuagucaggcgugguagcaagcgccuguaaucccagcuacuugggaggcugaggcaggagaauugcuugaacucaggaggcagagguuacgguuagccaaaaucgagccacugaacuccagccugggugacagagggauguugucucaaaaaacaaaaacaaaaauaaguuagaaaaaaaaccagaagaaacuuguccuuagcguuccuaagacuuaggagagcuaagccggggagggcaggaguagauggacaagaccauaccaaggucagcuguuccccucgccgagaaggcagcagcugaacuuuccgcuuacgcugcccagagcugccagguguagacugagaauucgaguuuuguuucuuccuugggguuguaucugcagcuaaagaaagaaaucaagacucguuugcuuccuucccucuuccagaaauggaugguugugucuacccacuucgcauuucacacugaguuuucaaugaugguaucucugaaaagauucaaucuucuaugguuugguugcuuggaugguguuuguaagauuaaggcgcgcacacaaaccgcuuacugugcaguaauuacugggaucacccacaggugacucaaacugagcuuaccucuauccaaucguuagcccccaucuguagccuuucucccucaucagacuauaaacuucugaaggagaggaaaucucucucuuuguaucuaacaugccuuagacauagcaaugcucaagaccuuuuuucaauagguauuaaucucuacauccuccacaaauaccuccaccaccaacagcagccccucauccuggcucagcaaccuacccuuuucucccugggacuccuugucugcugccaauggaguugaagaacuggaaugaugacacagcucuucuucucuguugggaaaaaaggaacaauuuagucuagaaagacuucuuggcugaaguauuaaauaauuucucacacccuccuaacuaccaaguggccaacaucuaaaacaaccaucauuuaagaucucaguaugccaggauaaaaaaagucaacaggaaauuccaacagaaugaagggaggcuguucacagaggccaugaagacaguuuuugucuuaaaacaagcacaaacaauaaucuucaaaccuuacuuacaaccuaccaagucccugggaguucuagacacagaugugaucccugagggaguggcauuccagccaacugcaagcaccuaggggaucagcucgagucaagaaccugaaggcgacugcccgcugacuugacucucucugcucuccacucugcauggccucugugcuugcacccgaucccucaugcuggagugggaggcgacagccagaggccacuggagucaguauccaagacuguagggaugauaguuguucaggugggugcugcauugucccucucagggacuuaguuucuuugauucuccaagucacagcagcacaaagccuaagagccagguucguuucccaccuuuccucacccccuucuguccacguagcaaaugaaaacugcaggagaaugccgaauaccuuauuuucuuugcuggccucuccggugucugggagcgggaugaggcugggcuagagaagggugaugaacuggggccauuucucuuccagagcuaaaaaucaagagggacaugacugagccugcugauaacuuagcaucugacccucaacaugacaaagucucuuuuuaagugacuaaaaaaauauuuuuuaugguuaaaugguuagucaugccuguaaucccagcaugcugggaggccaaggugggaggauugcuugagcccaggaguuugagaccagccuggguaacauagcgagacccccgucucuacaaaaaauugaaaaaucaguuggguguggugguuugcaucuguggucccaacuacucaggaggcugcagugagcugagauugccccacugcacuccagccugggugacagagugagacccugucucaaaaaaaaaaaaaaaaaaaaaaaaauagaaaaugaaaaugaaaaaaauuuguuugugaagaaagaccccugaaaagaaagucaacugccaguauuaauuaugaaagcaaaaaaagaaaagucuauaaaaguaauggaaugugaauaaagguagaagggauggacacacuuuugcauauauuagccucaguaaugaagagccaggacacauucaaaccugugccagacugucuacggaaaggauacaaguaaauuaaagaagacaacccaguaaacuaauuuagucuugcuuccauuaaauuuucgauuuuucauuuaguaacuucauuuuaaaaauacgcugucauggccaggcgugguggcucacgccuguaaucccagcacuuugggaggccaagggggguggaucacgaggucaggagauggagaccaucuuggcuaacacagugaaaucccaucucuacuaaaaauacaaaaaaauacaaaaaauuagcugggcgugguggcgggugcuuguagucccagcuacucgggaggcugaggcaggagaauggcguaaaccuggggggcggagcuugaagugagccaagaucgugccacugcacuccagccugggugacagagugagacucugucucaaaaagaaacaaaaaacaaaaacaaaaacaaaaaaagcacugucauaauauuuaugacuuuugcaacaacgauggcauuuaucaucaugugaugauuauccauacaucugccucuuccaccaggugaguucuugacagcaaagaugguguuuucaucucugcuuccuccacagaccagcagcaaaguagauggcacagagcggacacugcaaauagucucguaagugcugagccuaauuacaaagccacuaaacugucaccucagaccgucuuuccuacuugaaaagcugcuagugauuucuuacccaguaccagcuacaucauauaaguacaaacaggaagccaacaagcuuaauaaguacaaacaggaagccaagcuuaauaagaguucaaaaagggaaaagaggaagcuucagacaagugguaagcagcagaacaguucagugaggccaucaucaggaagccgggcccaggaggagcuugagaagacugcucacggcaauaacaguugaaguuacgcucaaacagcaagaaaggccagagcacaaugguuuaaaaaacaugggauuacaggcauauaaaagagcagaauacaaaaacucaucaaagggauccaaggauugaauauauaagcggcauuuucaaucacuucagaucccugacacuaccucgcugguucucacacgacggcucaucagucaccuguggaacuuuuuuuuuuuuugagacggagccuugcucugucaccaggcuggagugcaguggcacgaucucaccucacugcaaccuccgccucccugguucaagcgauucuccugccucagccuccugaguagcugggacuacaggagcaugccaccacagccggcuaauuuuuguaucuuuaguagagaugggguuucaccauguuggccaggauggucuugaucucuugaccucgugaucugcccgccuuggccucccaaagcacuaggauuacaggugugagccaccacgcuuagccaccuguggaacuuuaaaagcacauagauggccaagugcaguggcucaugccuguaauccuagcacuuugggagacugaggcaggagaacugcuugagcccaggaguuucagaccagccugggcaacacagaaagacccuaucuguaguuaaaguaauaaaauuaaaacaaaaccauaaaccuugcauuuuuguucacaaugugcuccagacacugagggauacacaucacugagcaagcaagggucagaaaugccaaaggggccggaugagguggcucacgccuguaaucccagcacuucaggaggcugaggcaggaggaucaccugaggucaggaguucgagaacaguguggccaacauggugaaaccucaucucuacuagaaauacaaaaauuagccaggugugguggugcaugccuguaaucccaacacuuugggaggccaaggugggaggaucacuugagcccaagaguuuugagaccagccuaggcaauauagugaggucucuucaaggaaaaaaaaaaaaaaagccaaaggugacuguaaugauuagcuaggacuggaagacaacuggucaacugguuuaacaauuaggggaaaaaaguuauuacuccucuacuucauugacuguacguacacacucauuucagauauaacaagacaaggauguuuauuauuaugucuauucaacucaaaguccuagccaagugcaguaagacauaaacagaauaagacugcagagggaaggaaaaacucauuaucauagacaugaguguauguacuaaaauccuaaagaacauacagauuuagcaaacuuucugaauacaaaaucaguuguauuucuagacaccagcacagccaaucacauuuugaagacacuauuuauaauagcaucaaaaccauauaccuagggccaggcacuguggcucaugccuauaaucccagcacucugggaagcagaggcagguggaucacuugaggucaggaguuugagaccagccuggccaacaaggugaaauccugucucuacuaaaacuccaaaauuagccaggugugguggcgcaugccuguaaucucggcuacuuggaacgcugaggcaggagaaucacuugaacccgggagguggagggugcagugagccgagauugugccacugcacuccagccugggcgacagagcgagacuccaucucacaaaacaaaacaaaaaccagauaccuagaaauaaaucuaauacaagagaaguaaaacuucuacagagaugaauuagagauaauguaaauaaaugaaagaggugggacauggugguucaugccuauaauuccagcacucagagaggccaaggugggaagacugcuugagcucaaaaguuugagaccagccuaggcaacauagugagaccuugucucuacuauaaguuuuuuaaaauuagcuagguguggugaugcaugccuguacucaaaaggcugaggcaggaggauugcuugagccugggauuucaaggcaguagugagcuaugaucaugccacugcacuccagccugggccacagagcaagaccccuugucucaaaaguuaaauaaagaaaugaaugacauuccauguucauagauuagaaguaaacaaggucaauauuauaacaauguuaacuccauccaaaguaaucaguagaugaaaggcaaucccaaucaguaucucaaaacuuuuuuuuguguguguggaaauugacaaguugaucuaaaaauuauaugaaaaugcaaaaggccaagaaacaagacaguccugaaaagaaaugagaaagggggacgacugacucuaucaagacuuaaaguauaaggguagggguaaaacaaagacugguacaaggguaguaagaaaaauaguccaauggaacaaaagaaagucuagaaauggacccacauauauacggacacuuaaauuagacaaaggcagugcugcagagaaauaaggaugguccuuucaauaaauguugcugagagaaauggguauuucuauaguaaaaaacaaacaaacaaacaaaaaaaacuaauuuugaucccaaccucacaccacacacaaaaaucaauuucagguggauuauggauuuacauaugaaaauauuaauaaaauaauaaagcuucuagaagguagcauagaagaaaauuaucaugaccuuagguuggacaggcaaagauuuccuaaauacuacacaaacuaugcuaacuacaaggaaguagaauggcaagagcaggacacuuuuguuguaacacauacaugacagagagcuuguaucuagaauauauaaaaagcauauucaaaucucugagaaaaagacaacuuaguagaaaagagccaagaggccaggcgcgguggcucaugccuguaaucccagaacuuugggagacugaggugggcagaucaugaggucaggagauugagaccauccuggcuaacauggugaaacccugucuuuacuaaaaauacaaaaaauuagcugggugugguggcaggugcccgcagucccagcuacucgggaggcugaggcaggagaauggcgugaacccgggaggcggagcuugcagugagcccagaucgcaucacugcacuccagccuggugacagagcgagacucugucucaaaaaaaaaaaaaaaaaaaaaaaaaagagccaagaaauuugaacaggcaucucacaaaagaggcuauacaaauagccaauaaacaguugguauuucaguaaucagggaaaugcaaauuaaaaccacaaugaaauauuacuucacacuuagcagaauggcuaaagagacuggcaauaccaaguguuggugaggauauggaacaacauaaauaaaaaucucauauacugcugguaagaauauaaaccgggcugggugcaguggcucacgccuguaaucccagcacuuugggaggccaaggcaguuggaucaccugagguugggaguuugagaccagccugaccaacaugcagaaaccccaucuccacuaaaaauacaaaauuugcugggcgugguggugcaugcguguggucccagcuacucgggaggcugaggcagaagaaucacuugaacccaggagguggagguugccaugagccaagauugugccauugcauuccagccugggcaacaagagugaaacuccgucucaaaaaaaaaaaaaaaaaaaaaaaagaauauaaacugaaacacucccuuuaauacauugcuuagcagcugggcgcaguggcucaugccuguaaucccagcauuuuggaaggcuaaagugggcagguuacuuaaggucaggaguuugagaccagccuggccaacaugguaaaacuccaucucuauuaaaaguuuuaaaauguagcucagugugguggugcaugccuguaaucucagcuauuugggaggcugaggcaugagaaucacuugaacccaggaggcagagguugcagugagugccaauacggugccacugcacuguagcuguaaucccagcacuuugggaggcagaggccucaccugagguuaggaguucgagaccagacugaccaauauagugaaaccuugucucuacuaaaaauacaaaaauuuguugggcacaguggcaugcgccugcaccuauagucccagcuacuagggaggcugaggcagcagaauagcugaacccaggagguggagguugcagugagccgagaucacgccacuacacuccagccugggugacagagcgagaaucugucucaaaaaaaaaaaaaaaaagguuagcaauaucuacuaaaagugaacguacaaauacuuuauguauaccgaaagacuuagacaauuaucuauagcaauauuauguauaauagcuccaaacuggaaacccaaauguccaauggcagaauggauaaauuaacugugguuauauucccagugcggaacaguauauacaucaaugacaaugaauuaccuacugcuaugugcaugaauguggacacaucucacaaguaaaauguuaagucaaacaccaaagaaugcauacucuauuuccaucuauauaaaauucaaaaacaggguacacuauaaaaggugcuaauaagaaggaaaggagaagcaugauggggagugggcaggagggagguuucuggugaugaaaauguuuuauuacuugaccugaguggugguuacaauuuguuuuucuguguauuauacucuaguaaaaaaggccaucuaaagaaugaggcaaauuacacgauacaaaaugcuaugcaagauguaauggauaaaagagaaaagaagaugcuuuuuaaaaagcaaauaugcugugacccugcuauguagaacagucaaaaaauucuggguauuaucuguguuugcacacaguaaaaauguuaacaauggguaccuacuggauggagacucggaucgcugggacagaggaauuuuacuuuuuuacuuaaaaaagccaaaaccaggaaagguaauauuugcacguuaccgauucuaacaauaagaauguacaguagacugggcacgguggcucacagcuguaaucccagcacuuugggaggccagggcggguggaaucacgaggugaagaguucaagaccagcauggccaacaugaugaaacccugucucuacuaaaaauacaaaaaauuagcugggcgugguggccagagccuguaaucccaacuacuugggaggcugaggcaagagaaucgcuugaacccaggaggcggagauugcagugagcugagaucgcaccgcugcacucuagccccagcgacagugugagacucugucucaaaaaaaaaaaaaaaaaaaaaaaaaaaagaauguacaguaaaaauuuccuuuuuaucucaauaacaauuaccaguuucuaauauauccuguaagaauuauuuuaugcauauuaaaauauauuuauuuauuuaucuauuuuugagauggagucucgcucugucgcccaggcuggaguguaguggcgcggucucugcuuacugcaagcuccgccucccggguucacgccauucuccugccucagccucccuaguagcugggacuacaggugcccgccaccacgcccagcuaauuuuuaaaaaauauuccuaauagaggcgggguuucaccauguuagccaggauagucuuaaucaccugaccuggugaucugcccaccucagucucccaaagugcugggauuacaggcgugagccacugugccuggccaaaagauuuuuaaaagcccaaauaauagaggauacuauacaauucugacccuuguuuuuuauauaauuccuuugagaucauucucaugaguacgucuucaguugccuuauucuuuuucauaguuacauaguauauuucaacuuacaccaauacuguaaguuauucaaccagcucccugaaaagauaacauguagauuguuuccaagcugcuguuauuaaaacaauguuacauuaaauccuuguauccauuucccaguauguguguaggauaacuuccuaaagguaaagcugcuugaucaaagggugcguguaucucuuauguagacaauuccugccacgcagcccucuagagagcuguaccaacugacacucccacuagcaacgugugaggagacuguuucuuguaacacugcacuucuauuuuacauucaaaacuuugcuucauuuggaauagguuucucuacuauaggaaaaacucuugaacgugagauuuggcugguagcccuucagaaaaauggguaaaggauaugaacuaagacucacggaaacagaacugaaaauaaucauucaacaugugaacagaugaucaaacuacucauaagagacaaaaauuaaauacuauuuuuuuuuuuuuuaagauggagucucacucuguuguccaggcuggagggcaguggcaugaggucggcucacuugaccuccgccuuccagggucgagcaguucuccugccucagccuccuaaguagcugggauuauaggcacacgccaccacaccugguuaaauuuuuuguauuuuuaguagagaugggguuuugccauguuggucaggcuggucucaaacuccugaucgcaggugauccaccugccuuggcuucccaaagugcugggauuacaagagugagccacgguggcgcucagcuagcuuuuuuuuuuuuuuuuugagacagagucucacuauguugcccaggcuggagugcaguggcgcuaucucugcucacugcagccugugccuccuggguuccugagauucuccugccucagcgucccgaguagcugggauuacaggcgugcaccaccaugcccagcuaauuuuuauauuuuuaguagagacaggauuucaccauguuggccaggauggucucgaacucaggugaucugccugccucggacucucaaagugcugggauuacaggcgugagccuccaugcccauccuagauacuauuuuuuaccugucaaauugguaaaagcccagagcuacaauaaccaaaucugcuggugaggccagggagaaauggucccuuucauucaauacugaggggaaugcugagugguacaugcccuguagggggauuuaacaauacccagcaaaaucacaugcgcauuuaacccuugaccggaaucugacuucuagaaauuuuuccagaggcaaaacugccaagggugaaaggacauaugaacaaauguauucuuugcagcauuauuugugauagcagaagacugaaacaacccaacguuugucaauagaggacuagaguaccuaugcaguuguaagaccaaagaugaguuucuguguacugcuauggaaugacgucaacugucuauuaugugaaaaagcaagguucaaaucuauauauacugucuacuaccuuaaauguuagaagguggcaguuuucagauacacugauacgcauaccguuuaaaaaagaacaacaaaggauaaucaaaaaauaauaaaaauggagaggaaggaaaaauguagaguggaaagggauggaaauugaauuuuugaguguaucuuguuuuagcguauuuuuuucaaacaacaaguauuuuauguaauuuaaaauagaacuauuucaaaaaggaaaacauagaaaucccuguaacuuucaaacauacugaacaaacgaaccucacuguauauaaaguugguguacccaaaggacaauuaacauuacuuuaaaacaugauauauugauuacaugucccuaggauucacagagggauauaaagaccaaaugaaucacaauucuuaaacugacuucagcagucuuaauaaugacaguguuaauaaugacacugauauugcuauuuugaaauugcauggccaggcaugguggcucacaccuguaaucccagcacuuugggaggccaagguggguggaucaccugaggucaugaguuccaggccagccuggccaacauguugaaaccuugugucaaacuaaaaauacaaaaauuagcugggcgugguggccagagccuguaaucccagcuacuugggaggcugaggcaggagaaucgcuugaauucaggaagcagagauugcagugagccaaggucgcaccacugcgcuccagcguggggaacagaguaagacuccgucucaaaaaaaaaaaaaagaaauugcauguacuaggaucaaaguaauuauaaaccaacauuuuugguguaauacauaaaaauauaaaaucaaauagauuacauaaaaaauccugccaccauaaauuugaauuuggaauauuaugaauuaauucuuuacauuccucuuucuagaggaucugucuaucuuaucucuccuaaaacuuagacuguagucucuacaguucuaacuggaagaaaccaaagcuuuuugaagaaacaaccaacuucaguauaggcuaaaaauggacuuugggaaggugggcaaaaagcaaugaagcuaucugucgaagacugcugggaucaaaauaaaggauacaggagccaguuuggcucccauaguccaaagcuggaaaaguuugcuuaucaaaaauaauaacuagauauuaaauaauauuaagguuaauaauuuaagagggguaaugguauuaugguuauuaauguucauuuauaugacucagagccuucugggcugaugaacucaucucaaaauuuuccuugucucaaaaacguuucuccuuacaugcuuuacaucuuuuugucuggcugcuguauacuggauacccacuuacugacagccacuguaauaggugcuuuuuaaauauuacccucaaucauugcaacagcacuucagagauaagaaaaagagauguuaugugauugucugcccaagaccuuauagcuacuagaugucagagccaagcauuuuuuuccuuuucuuugagacacagucucgcucuguugcacaggcuagucuugaacuccugggcucaagagguucucccaccuugaucucccaaagugaugggauuacaggcaugagccaucccgcccagccucagagccaagauuugaaucuaagucuguccagcagcaaagccugcucuguuccuuauacuaugcaauaauccccuuuccaaaaaaucaugaccacuuguuuaaaaacccugcgcucaauucuaaaugccuauaaaucucuuuuaugacccaauacaagcuggacucagucuaccuuucgaaucacccucuguccguuuaucuacaucacagcucugucucgaaucagcucgcacacaugcacugcuuuacauuccgggcuuucuacuccguucugcuggccuauauugaucacucaaugaucuguauuuucuauuaguuagagacaauccuaauguccaacagauagaaggugauuaguaaacuuuugcuaaccaauuacuuuauuuaaaaaaauuucuuuaaagauucuuuuguacagacaaggucucacuauauugcccaggcugguuuugaacuccugggcucaagcaauccucccgcuuuggccuuccaaagugcugggauuacauggcuaagcuaccaugucuggcccuaaucaaugaaugaacgcugggaauucaugccccccacauuacaagagcuguacuuguaccugugagaugccucgaguggagcuguaggaacugguaauggcauugcggcuggagcuagggaugccacuuguguaagcgccugucaaggagcucauggaagagcuucgggaucucuuauucaaguggucaucugagcucugagaauugaggccucucuucagagacccaggccuaauaaaagagaagacaguuagaugcuuuauugaaggcaacauucuuuuacgauuucauccacggucaugacaucuuucuuaauaacaugaagggaagagaauaaugcuuuuaauuuuuacugcuaacaaucuggccaaaucuaucugacaaagucaguaagaaaagccaaauauuuaaaacuuaaauguaugauuuauagaauauucuggaaaaugcauaccuaucuacagugacagaagacagaucaguggaugccuggggacacggguggaacuaaagagagggauuacaggcaugugggaacuuuuggaggucauggauguucauuaucuuaguggugggaugguuccacagguguaugcgugucaaaaugucacaugcuuuaaacaaguacaguuaugucaauuauaccucaacaaagcuguuaaaaaaaaaucagaguuaagaggaacccaucauuuuucuaaaccuccaauggaaacagaaaucuccuaugcaucuuuccuguaggacagucauccaaccuguuacaauauagacaacgcucuccuagagugacccacgucaaccaugaaccaguuuauucucacaguggauuacaauguauuuccucuaacuuucacccacggauccuauuugaagucaaacagagcaaguuauuucgcuucuuucaagggacaguccuuugguuuuuuggagaccauuguccuucccucacuuauuucuuuauuccuccugagauuuuucuccucuggguuaauacuuccauaccuccaaaaccccaucauccaccaccaccccucugggcuguugcaaaucuccuuaacaucuucguugcuucacugggaaugaauuuccguuuguguacauccucccucgcagugcaguacgcugaucugaccacagugcuccacggacagugagcagaacuacggaaggcaggaauaccugccucauucuagucuuucuucuaacagcacagaccaggagcacuuuagcuuuccugguggccacaucacacugcugacucagaugagguaucuaaguuauccuaagucuuuccacacagacuuuugagccacuuuccuuuccacccaauucuuccuccaauuuguuuuuaaacugacauguagaaauuaaacauuuaaguuucauacugucuuauccgcugcacaaacuuugcaauccuucuguguaugugcuugguuauuaaauauauuuauaaaaccucuagucucagcauauuucauccauauuaaugcaagaacauuaaaaggaauuagacagaaggcaguuaauugugacaaguuacucagaauauuccuaauuucaaagacaugaaccugaacuaauuaagcaaugcaaaaaacaaagaggaaaaucuauagggcaacagcucugaucaggccuuuuuccaaacaguugguauuucaucuggauggacucgcacuuacuuaggcacaaaagaagcggggacuccacuggccaccaggggcucaaaugcugaauguccacugccacugcuaucauggcgccugcgacaaaucaaaaaagucucaaaugaaaugacaugacuuuguuugucccuuuaaaguguauucucacauuucugggaccuuauacuaucucuauggagcacagauuccaugcuagaccagaaaaugguuguuuaaaaucccuaaguuucugaaagguaaauuuuuuuuuuucagacagaguuucacucuuguugcccaggcuggagugcaauagcacaaucuuggcucacugcaacaaaccucugccucccggguucaaccaauucuccugccucagccuccagcgcagcugggacuacaaguaugcaccaccacaccuggcuaauuucuuaauuuuuuguacaggcgagggcucccuauguugcccaggcuggucuugagcuccuggguuccagcgauccucccaccuuggccugucaaaguguuaggaguacaggcaugcaccaccauacccagccuuauaaaaugguguuucccucaagagucccaugagagcagagauuuugucuuguccacugcucuauccacaguacuugcaguagggucucauacacagugggugcucaguaaaugcucacccacuucaacuucuuuucuuucuguaauuagaaaacuauuccauuuucauuagguuauuuuacaaaccacauaaggaauuuuuuuuuuuuuuuuuugagacagucucgcucugucacccaggcuagagugcacuggcauggucucggcucgcugcaaccuccgccuccuggguucaagcaguucuccugucucagccucuggaguagcugggacuacaggcacccaccaccacauccagcuaauuuuuguauuuuuaguagagacgggguuucaccauguuggccaggcuggucucgaacuccugaccucaggugauccacccgccucggccucucaaggugcugggauuauaggcgugagccaccuugcccugccaggaaauugguuuuaaucucauuauugauaaaacuaccaaacucuaguuuucauuuuucuuucccaagcauuuccuucagcacaauuaagacacuagaacuggugggccgggcgccguggcucaagccuguaaucccagcacuuugggaggccaaggugggcggaucacgaggucaggaguuugagaccauccuggccaauauggugagacccugucucuacuaaaaauacaaaaaaauuagcugggcaugguggcgggcgccuguagucccagcuacucggggggcugaggcaggagaauggcaugaaccugggaggcugagcuugcagugagcugagaucgggccacugcacuccagccugggggacagagacagacuccaacucaaaaaaaaaaaaaaaagacacuagaacuggugguuacccaaauaacugaacaccacaaaauuccgaccggaagacuuagagccuucuuucuugaaaauaaacuuuuaacacguuucuacagaagcaugaggcuaacauggcuaauagcugucagcuuaucucugcuacucacagaaaagguaaauuaugacaucgaucuaaccugugccuugaaaugaacagcauuaaaacccuuguuauuagguucucucaugaaagccaaagaaggaggccuaugaaggcucacaaacuggacguggccucuguaucuuuacgggaaugucuacaucucaucccauagggguccaagcgggaaacuggcuuaguacucuccugagccuguuaccuucuuuuauuuuccuggccaucaaggaauauuuggucuucuuccuccacuguccuuuucuucuucuucucuuugagggcacucaguacagucuccuuugcacaugggucuggggcauuacuugauggugacgacaguguugagcugauuaucugcucuggucuauaaugaaagacaagauucuagccguaagauauuuuaauucccaugccauaucagaaacggaaaucagaagcuaaccaacaggccaaaguauaauuuauacacucacaacaguuccccuuagcaaguaaagcuacuuuuucguuaacggcaaaaagugaaaaacaaacgguuuuacuagaauuugguauuucucauucaaacaagcagauucguccuuucuuuuuugcguuguagucauguugucacaggaacaacuggagaagaauaaaguggacacgaaaagggagaguauucuuccaacgauaauacucacaucgcagaacgugaaaaucuucugucaggaggggcgauccucacagucacugggcuacacaccauccuggaguugcgaggggacagcacagccuucuugugauaaccauuccagcacacugugggaaguacccccggacaggaauacugggucugauggaucggauagcgucuucgagguguuauuacaaaccgaucugguaaagucccacgaucccugcagagaaugcgagacaaaucauggaaacaaaguauaaaagaaugucaaaauuuuagacgguuaaaaacccaccaguuaagacauuuuccaaagaacuuaaaucucuuucuacgcaacacagaacacguuguuuuuauggcaacuuuccccuauuccaucuaagagcagagagugacagcugcuuaacagcugccucaacaauggauugcaacaauuugagagggaaaaucuaaaucuagacuaaaucuagacugcacuaaaauucggggaguuuuuagaacuggaaagaagggaaucguuuuggcaacacaucucacaccaagagucagaggccaggagacggcuggcacacaccaagguguuaaggagggcaaaaccacacacaauucccuucggauuugaugaaaaugcaaaucggauuuaaaagucaaguccucgauuucaagccagccgagccagaggaugaucugggaaaaucagcgcaucucaccguggggaaggccucccggagggucggagaagaggaguggggagagagggguaaaaguggugaacgcgaugggucggcggggagggcgguguggagcgcggcgccgggcgggcgggugggcggcggccaggccuauuccgcagguccuggcccuccggagcgggggcgggcugcggcggcccgggcuugcccagguaacugcccaugaggagcaguucggcagggucagguccuucgagcaggguccgcggcucuaggagguuuccguuggcugucgacuuggccggaggcgaagcgaacaguguucgccgaugucgcgccuucugaacgaaggaggacaaggggcgcgaaccucggggcucgcggcucaguccccaccaggccgcgguaguccccacggccagccaggccagcgcagccgcagcaggcacgagguacaguaggaggccgaccagcgacaggccgagaagcgccgccccggccggcccgccgcagccccggccccggccgucccugacacucgcuaucggccgccgccgcucgccugcuccagccgccgcagccgccggagacaucgcggcuccgcgccgcggaggagacuuaaauaucccagcgugcaccgcgccacgcgucgcgucaucgcgcgcccgccacgucaugcgcgcgcgacucggggagacgcuacagcccggcagcucccgagacacagcuguuuuggaaaaugcugccugccuucaacgccuguuucugacucuugcgguuuccugcauggcucccagcgagacgaucccguccgggaucccauccggcucccauccggaggcgaucccgugaaaggaucgcguccaaaauaaaaggacccgagaccuaugcuuauguaauuccuaauccgugaucuuuucuaggggcugaacuccccuccagcacagccuguuaccaggugcuuuucacaaacgccacuggcggcugaguuuucccccccacuuccauuucuacuuuacaaguugauaacgugggacgauuaccuaccaaauuucacaucauggcccagauaucggguggauuuugaggcucugugaucgauuuauaccuaugcuaaaguuaucggucugagaaaguagauuagugguugccuagggcuaaggaguggguuuggggguggggaauagaaaaugacugcuuauggguauaggcuuucucguagcagcauaaacauaguuuaaaauuagauuguguuggcgguugcaccacccuaugaacuguaugguuugugaauuauaucuuaauaaagcuguuuaaaaagucugguagucugccaauacacuuugguguaguuaaguuuccucagacauucauucauugauuuauucauuccauuguuuauauacauuaaaaagauuaagggggaaaauagaggaucucugaucuuuauaagcucuguuuaguaaggaagauguguaaguaaaagauugcaauucaauguuaucagugugauaacgggaacaaaaaaagaggccagacgcaguggcucaugccuguauucccagcacuucgaaggcggaggcgggcggaucaccugaggucaggaguucaagaccggccugaccaauauggugaaaccccgucucuacuaaaaauacaaaaauuagcugggcaugguggcgcgugccuguagucccagcuacucgggaggcugagacaggagaauugcuugaguccgggagguggagguugcagugagccgagaucaugccacugcacacuccagccuggacgacagagcgaguccaucucaaaaaaaaaaaaaaaaaaaaaaaaguugugauaaaggggaaggaaggcagggaagugcuccuggagcugagaggucuggcagguucaaggaagaugaaggagcacugugcagaaguccagagauggaauuguucaguaucgcuggagauuaggguguuuuggggauagaaaaguuggaaagguauagaugccucuggggcaacucagagagaugagaagaaggugcaguuuggguuccagauccuccccaacccagugccaaaguaauucuucuauuuaauauacugugacuucacauaagacuuaauuugaaaaaaaaaggggggggggcggaggggggacuguguugcuuaagaaaaaaaucucaguaucaguagacuagugggacaaaagccaggcugcccuggguugaacagugacuggaaggugaagaaauggaggcagugacugcagacucccuacucaagaaaccuggguaacaggggaagaagaaacauagugucuaggucaguaggggcucuuugaacuauuguguguggcuggaguuaaguggaggagcuacacauaaaagccgucaggguacagauguccugaaaccaagcaagaugacugagaauuaauguaaauagagagguccauagccugagcccucggggcacuccuguguuuagagguaaagagaugaauacacaaagggcacaagucauguaggaaauauagauaaauaugacuacauuaaaaguuaguacuucugggccgggagugauggcuuacacauaaucuagcacauuuggagacgaggcugguggauugcuuugagcucaggaguucgagaccagccuaggcaacaugguaaaacccagucucuacuaaaaaaaaacacaaaaauuugccuggugugguggcaugugccuguaguacuacucaggaggcugaggcuggagaaucgcuugaacccagaaggcagagguugcacugagcugagaucgcaccacugcacuccagccugggcaacagagugagaucacacacacacaaaaaguuaacacuucuguaugggaaaagacaagauacacaucuaaaagacaagccaagacugggaaaaacaacguaacacauauaaccaaaagaggauucauaaguagaauuuauaaagaacuccaaagaaucaauaacaaaaagaugacccaauuuuuaaaaaggacaauugauauaaaaaagcuaucgaaugggaaacacaaauaccuaauaauauauacauaugugcauauacguacauacacauauacauuuaaccucacuaguaaucuaggaaagacuaacaauauuuugcacucauuuauacacuagaaaaauuaauuuaacaagaucaagucuuagcauggaugugaaacaaacagaacucaugccguuguggauauaugaaacaguacaauuuggaaagcaauuuggcaauaacuaguaaaaaauaagggugaagaaguauguauccuauaaacccgcaaucccauucuggguagauagucacugaagcauuauuuguaucacagacaaugugaacacacuucauggguaaugucuaucaacacaaggaugggcaaacugguauaauucauauaauaaaauacuauaaagcagcugaaaauuaauccuuccagcugcagguuaguccucccaccauaaacaacuguagacauggacaaaauguauugauuaauaaauuuguuaaaaaaaaaucuggcagucugcugauccagacuuugguuuaacucaugcugugguggauauauaaaacaguacaacuuggcaacuacuuucaggcagaggacaacaggaagcaaaagacugaucccuaaguguaaggaaacuugugagaugagccccaaagucaccuaguuccucuaccuggggaucguuucccaacugcagugcagagagcuggagucugagcacaguagggagaucccgcugggcugaagaggcagagaugaggaggcagagaucaggcugagacagcugaaauggcagagaaauggggcagaaaaaagaaaggagggcacuaugcaaagagggaguucuagaaaucuaugcaugacgcaaacccacggcugaaggcuggagugauggguaauuucaugugucaacuugaagggaccauggggugcacagauacuugguuaaacauuuauuuauggguguaucuauaaaggcauuucuggaugagauggucuuuuauuuauuuacuuauuuuuauuuuuugagauggcguguugcucuugucgcccagguuggaguguaguggugcgaucucagcucacugcaaccucugccucccagguucaagcgauucuccugccucagccucaguggaguagcugggauuauaggcacccaccaccacaccuggcuacauuuuuguauuuuuaguagagacuggguuucaccauguuggacaggcuggucucaaacugcugaccucaggugaucugccugccucagccucucaaaguacugggauuauaggcaugagccacugugcccagccucuuuauuuuuuuguagagaugggggucgccacaaaucagacuggaaaaacucacaauuuauagggcucuguguggaguacucaagcaccccaggaaugggaaagaaucagucuuagauugagcauugcuuuggacccaccuaaugaaucaucaaaacaagaccugaaaggauccaacuuuccaaugaucuuaaauacaucccaaaacaaagcucaagaaaauguauauaggaauaaaaaauuggcugggcgcgguggcucacgccuguaaucccagcacuuuggggggccgagguggguggaucaugaggucaggagaucgagaccauccuggcuaccacggugaaacgccaucucuauuaaaauacaaaaaauuagccaggcaugguggcgggcgccuguagucccagcuacucgggaggcugaggcaagagaauggcaugaacccgggaggcggagcuugcaguuagccgauauggcgccacugcacuccagccugggcaacagagcgagacuccgucucaaaaaaaaaaaaaaaaaaaaaaaaaaaaaugaccauuacucaacaagguaaaaucuccaaugucuggcauccuggcauccuauuacuaggcauauaaauaagcaagaaaacacagcccauaauaacaaccaaucaauccuuauuuugauccaaaccaaccccaaacugacacauauuaaaaugaacagagaaagacauuaacauuaauuuuaacuauaucccauauguuuacaaaguugagauauggaaaaauauuagaagaaauaauggccaaaaauuuuccaaauguaaugaaaaauauaaacccacagaccugaagcucaaugucaaguacaagaaauacaaagaaaacuguaacaaaucacauaaucaaauugcucaaaaccaaugauauagaucaaauccugaaggcagcugggaaaauaguacauguuauuuuacacaggaacaaagauaagaaugauaccaaauuucuugccagaaauagugcaagugagagacaacagcagugcaacuugaucuuuaaagugcugaaggcaaaaacugcaaaccuagaauuuuaugcccaaugaaaauauauuuuaagaaaguuaaauaaacauauuuucagacacauaaaagcugggagacacuuugagaggcugagcugggcagauugcuugagccccagaguucgagaacagccugggcaacauagugagacccugucucuaaaaaaaaaaacaaaaauuaggccaggagcaguggcucacgccuguaaucccagcacuuugggaggccgaggcaggcggaucacgaggucaggagaucgagaccauccuggcuaacacggugaaaccccgucucuacuaaaaauacaaaaaaauuaaccaggcgugguggcaggcgccuguagucccagcugcucgggaggcugaggcaggagaauggugugaacccaggagguggagcuugcagugagccgagaucgcgccacugcacuccagccugggcgacagagcuagacuccgucucaaaaaaaaaaaaaaaaccaaccaaacaaacaaacaaaacacaaaaauuagcuaagcguaguggcacaugccuggagucucaguuacuugggaggcugagcugggagguucacuugagccuggggguuuccuugagccugggaggucgaggcuccagugagccauaauugugccacugcauuccagccuggguaacagagcgagacucugucucaaacaaauaaauaaaaagcugaaagaauucaucaccaacaaacacaguaagaaauguuaacggauguccuucaggcagaagaaaaauaccaaauggaaaucuggaucuacacaaaggaaugaaaggcauugaaaaugguaacuacauauauuuauaugugccuguuuuuccuuauuauuuaaaucucuuuaaaauauaauugaggacugauaucagcaaaagggcagaguagacagcuccaagcucccaucacccaacagaaacagaaaaaaaaaaaaaaaaaaggccaggcgcagugguucacaccuauaaucccagcacuuugggaggccgaggcagguggaucaccugaggucaggaguuugagaccagacugaccaacauggugaaaccccaucucuacuaaaaauacaaaauuagccaagugugguggcacaugccuguaaucccagcuacucgggagggugaggcaggagaaucgcuugaacggggaggcggagguugcagugagccgagauggcgccacugcacuccagccugggcaacaagagugaaacucugucucaaaaaaaaaaaaccaaauaauuauuagaaacaacucugaaaaacagccaaagccuuacaacaaccaaaugaaugcugaaucaagaaaaaggcaacuuaaaaaggaaagguagaaaaccuuuguggcaauguuuuuuaagagacaggaucuugcucuguugcccaggcuggaaugcaguggugugauuguggcucacucuacccuugaacuccugggcucaagugauucucucaccucagccuuccaagcagcugggacugcaggcgugagccaccgcaccuggcuucuacgggagucuugaagacagaaggcugcauucgcaguguggggccucuuggcauuccacagggacggggcggaccuuaccuucaaauuacugguaaaucugcuaucgcacgucugagggcuacugagggaaugauguagacgccugucuauuugcuggaaacucacugaggcuggaaaaguggugagcauugcucaaaaacauugcaaggcaaacaaucuacacaggacuggggcaaaaccugacaguugagacucacaacacuccacuguucucucucuuuuuuuuuuuuuuuuugagacugagucucacucugucacccaggcuggagugcaguggcacaaucucggcucacugcaagcuccaccucccggguucaugccauucuccugccucagccucccgaguagcugagacuauaggcgcccgcugccacgccuggcuaauuuuuuuguauuuuuuaauagagacaggguuucaccguguuagccaggauggucucgaucuccugaccucguguuccacccacccgcagccucccaaagugcugggauuacaggugugagcuaccaugcccggcaacaguaggggaaagagcugaguuccauucucugguguccuuaaagaacaggaagaaaugccagggauggccaggcacgguggcucaugccuauaaucccagcacuuugggaggcugaggcaggcagaucgccugaaguuaggaguucgagaccagccuggccaacauggccaggcccgucucuacuaaaaauacaaaaauuagccaggcgugguggcaggugccuguaaucccagcuauuaggaaggcugaggcaggagaaucgcuugaacccaggagguggagguugagugagccgagaucgugccacugcacucuagccuggagacagagcaugacuccaucucaaaaaaacacaaaagaaacaagcagaaaugccagagacgugcagagaaaaggucacaugaagacacagcaagaaggcagcuaucugcaagccaaugagagaacacucugaagaagucagcccugcuggcaccuugaucuuugacuucuggcuucuagaacugugagaaaauaacuuccagcuguugaagccauggucuguggcauuuugcuaugguagcccgagcaaacuaauagagacuuccuaaauccgagaaggaaagcuggggagaauuccucugagaaagcaggaaagcuggggagaauuccucugagaaagcaggaaagcuggggagaauuccucugagaaagcaggaaagcuggggagaauuccucuaggaaagcagggcagucacaagcacucaguuguuacacgggcuuugcccagggcaggaugcuugcucagaaacaccugacaaagaccuaaguuuucaccuuggccugaucacgagggucagugcaggccuagcuaagugcugaaggaaagcuguggugcaaaggcaaacuucaaagacugggagagguacuuucuuccauuuuuagcuccuaguauucaaggaaaucucuuaucaaaaugugagcugaacacaugcuaaaagaaucagagacuucagugaccacacaugaaaaugauaaaucuuugcacaaauaguuuggaagucacuaaacguauguacuacuacagccuucaaugauuaaaaacagacacacucacaaauacauagcaaauaaaaugagaagaaucaucuaaaugccagaguuacuaccuugcaauauucaaauguccguguuucaaugacaaucacaaaucaugcaaagacaagggaacguauucaaaguaacaaaauaaauugauggaaaucagcccuuaggaagcccagauauuggacuuagcagacaaagacuuuuuaaaaacucuauaaaucgugaaggaccucuucaaggagaacuacaaaccacugcucaaggaaauaagagaguacacaaacaaauggaaacacauuccaugcucauggauaggaagaaucaguauugugaaaauggcuauacuacccaaaguaauuuacagauucaaugcuauucccaacaagcuacugacugucuucacagaauuagaaaaaacuaccuuaaauuucauaugaaaccaaaaacgagcccauauagccaagacgauacuaagcaaaaagaacaaagguggaggcauaacgcuaccugacuucaaacuacacuacaaggcuacuguaaccaaaacagcaugguacugguaccaaaacagauauauagcaauggaacagaacagagaccucagaaauaacaccacacaucuacaaccaucugaucuucgacaaaccugacaaaaacaagcaauggggaaaggauucucuauuuaauggugcugggaagacuggcuagccauauacagaaaacugaaacuggaccccuuccuuaacaccuuauaaaaaauuaacucaagauggauuaaagacuuaaauguaaaauccaaaaccauaaaaauccuagaagaaaaccuacgcaauaccauucaggacauaggcaugggcaaagucuucaugacuagaacaccaaaagcaauugcaacaaaagccaaaauugacaaaugggaucuaauuaaacuaaagagcuucugcauagcaaaagaaacuagcauccaagugaacaggcagccuacagaacgagagaaaauuuuugcaaucuacccaucugacaaaggucagauccagaaucuuguauauucuuguagauccagaaacgacaaggaacuuaaacaaauuuaccagaaaaaaccaauuaaccccaucaaaaagugggcaaagcgccaggcacgauggcucacgucuguaaucacagcacuuugggaggccaaggcagguggaucaccugagcucaggaguucaagacuaaaaauacaaaaauuacugaauuacucuacuaaaaauauaaaaauuagccuggcaugguggugggcaccuauaaucucagcuacuugggaggcugaggcaggagaaucucuugaacccaggaggaggagguuguaguaggccgagaucgcgcugcugcauuccagccugggugacagagugagacuccgccucaaaaaacaaaaaggcugggugcaguggcucacaccuguaaucccagugcuuugggaggccaaggcaggcggaucaccugaggucaggaguucaagaccagccuggccaacauggggaaaucccaucucuacuaaaaauacaaaaaauuuagcuggguguaguggugcacaccuguaaucccagcuacuagggaggaugaggcagaagaaucacuugaaccugggaggugggaggcagaggaggagccgagaucgcgccacuugccuaggcgagugagacucaucucaaaaacaaacaaaaaaacagugcauguuggcuaguuuguuaaucaauauuaguuaguuauuagcuccgaauagaugucaguuaauaugguaggcacugaugacguauucaugacacaaagcuggucccaaugcuagaaugaucuuuguucgagauccagguugcugcugccacuagagggcagccgaagcucaucuguaauggcacaguaaugguuaaccccaacaaucuaacauuaccagggaagaacuguccugaagggcaaaguaccaagcuaccuaaaguuuguauugauucucucaagacuguugcuaacaaaaugguaaaaugggucaaguuuguguuuggaaccccuagccucucaucucuucacccucuucccugaagagguggagggaauaauacagguaccaccuguaaguaaaaaguguggcagaaacagucaguugcaucucucaccaacaggugggucaggguggggagggagaggagauuccuggagaggaacggaucaagcuaggaagcacagaacugcaggccagagacaacucuggaagcagaaacaggugugugcuuccaggcgcacagacaccaacuguaugacacccacaccuucuacucacaaacucacuauugacggugcaccaccaccugcuuugugcaacacaggaaacaccaauaaacacuggagacagugucaggccaggcaugguggcucacaccugugcucccagcacuuugggaggcugagguaggaggaucgcuugaggccagaaguucaagaccauccucagcaauacagagagacccuaucucuacaaaaaguuaaaaaaaaaaaaaaaaaaagauacaggccaggcguggugguucacgccuauaaucucagcacuuugggaggcugaggcaggcggaucaccugagguccggaguuugagaccagccuaaccaaccuggagaaaccccaacucugcuaaaaauacaaaauuagcugggcauaguggcgcaugccuguaaucucagcugcuugggaggcugaggcaggagaaucgcuugaaccugggaggcagagguuguggugagccgagaucaugccaucgcacuccagccugggcaacaagagcaaaacucggacucaaaaaaaaaaaaaaaagacacagucucauuccuuaaugaguauaaagaaguaaaguguuucaguuacuaauugcauaagaaaccaaucuaaaacauaguggcaaaaaacaaucauuaucaucagggauucugugauuccaacaggccuggcuugucucugguccacacgacauguggggccucagcugggaagacauggagucuuaagugugaucaaugggagggggcuggaaucauuuagaggcaucuucauucacaaaaccaggagcugauacuggcugucagccaggacuucaacugaccugugggcuggaaccuguccauguggccccucgcagucuccccauuugggcugguuugggcuucaucacaguccggcagcuuacuucuaagggcaagcauuccaugacaacacagcagaaaggcaugacauuuuuacagugcagccuggcuaucucauagcgucgcuucuguccuacuuuauuuauuggucagggcaaucacaaagaugugcacaggcucaaggaaaagagacauacccccgaccacgcgauggaagaagugacaaggucauguuaugagaggagugugugggaugggagauagggcuguggccaccugcagaaaauagcaucugccacaggcugucauggaagcgcaggauggggauuuagccuaccugaggggucagucagcaaaggccucugggacgaagugagaucuucggcugaggaugugaggggcuaaaaggagacugaggaagagucucagggagaggaaucaaugagacuggauuccagagagaggcuggugaguuggaugguuugcuucaguaugaugacaauacagagggcaaggagacuggugcaggaggagagagaaggugccaugugcucuggguggcgcucugugccggacccccuuagaagaggagcagccuccagucagcggugucccaggaacacagaggcuggagaggacaauggcagccaaucccugcucccaaucuggugacaguagggaaaagcugcauggucuagauccacucugcucccuggccccaguauagaagaucaaauucaaucugcccaaucuuauccagauaaaguaaaggaagacuggaaaaaagaacuaauccaaagcuccaucugcccaugacuuucucugcugaugccggaggcagcuauggauaaagagauggcacacggcaugucccgacgcaguggagguggggagacccugcaacuccacagggaaagagugaaguugcugccaccugggcaucagcuauucucugcucuucugccucauccucaauucagaccaugauggagcugauuuuccuccauuuuauaccuuggauugaauggucucgagcugcuggucuugucuccauagucacauccaagaggucugucuuucaaauaaaugcuguguaucaauguacaguguauauaauuaauguaugauaucagacuaaauuauagauaagacaagagaugaaauuagaguuaaguagggacccgaugacgaagagccuuguaaaucagggagagucugguucaugugcuucuccagacacaauuucaacacggcuguaggcauguaccacugaugacacggacacugaauuacccgccgugcuggucuguggcucucaaguuuugcucauucugcuucugcgggaaaugccuugaugcaccuugggaaaacucacuuagaucuuuuuuugagauggagucucgcucugucgccaggcuggaguacaguggcgcgaucucggcucacugcaacuucugccucccagguucaagcgauuccccugccucagucucccaaguagcugggacuacaggcaugcaccaccaugcccggcuaauuuuguguguguauuuuaguggagaugggguuucaccauguuggccaggauggucucgaucuccugacuucaugauccgcccgcuuuggccucccaaagugcugggauuacaggugcgagccaccgcaccgggccagaaaacccacuuaucuuuuaagauucagcccaacugucaccaccucugggaaccuguccucagccccaaacauauggccacccucccuuugggguccccgcucgcccgugucuauuuucauuacauuccuaucaguuuacugcacugugcugcguaucuaccgugucuauuuucauugcauuccuaucaguuuacugcacugugcugugugucuauuucucccacucuggccugugggcucuuugaagacaugggcuguaucucgccuaucuuuugaucccucacauaggauauggugcauggcgagcacucacuaaaggugugcagaguacugcaugaggaaaaacuucauccaggccaggcgcaguggcucaugccuguacucccagcacuuugggaggccaaagagggaggacagcuugagcccaagaguucaagauuagccugggcaacauagcagagaucucgucuguaccaaaacaacaacaacaacuagcugggcaugguggcgugaaccuguagucccagcuacucaggaggcugaggcaggaggaucccuugaacccaggaagucaacgcugcagugagguaugaucgcuccacugcacuccagccugggugacagaguacaacccugcucuuaaaaaaauagaaaguucauuuauaaacagaagugaacaggaaucugacucuuguacuuuggugggaguuuggguuaucuuuuacuugaggcugaggcuaugucaaaacuagggauauaacaacaagcaccauguaccgagugcugcuucugugccacaggcucuccuacaugcuugccacacauucgucuauuucauccucccaauaguccuacuccauguccagcaaggagugaaaaggcugaggcgagucacagggagaagagggccccagugaacagacgaaaugaggaagaagaucuggagaggucgcacgagccagagcgcaaaggcacaguggcugcggugcaggcucuuuagcaaggugcuuugggcuggaaaugggguuuuacugccuguugcgagaugggacaugagacacaaucaacaugcaaauggguaggauguuucaucacacggaagcaaaauguauugccgcuaaaaugagaaguaacacccuaaaaguuaucaagacaacaauuuucaaugccaaauguuguuuccaguuccauaggagauggaauaagcacacccauuacauuucucuucuaauuacaacuaaaaccccuguucaaaauacaugaagcagcugggcacaguggcucaugccuguaaucccagcacucugggaggccgaggcaggugaaucaccugaggucaggaguuugagaccagccuggccaacauggugaaacccgaccucuacugcuaauacaaacaugagcugggcaugguggcaggcgccuguaaucccagcuacucaggaggcugaggcaggagaacugcuugaacccaggagguggagacuguauugagcuaagauugcaccacugcacuccagccugggcaacagagccagacuauuucaauuaaaaauaaauaaauaaauaaauaaauaaauaaauaaauaaauaaauaaauacaugaagcaacgauccaaucaaucaaaccaacaaauucuggaaagguagagaagagaagggcugacccaguggugaguucccagggugguuugaugguuuguucuuuggccuccuauauacccugucuuaucuguuacagcggagucuacaaccaggaaaucccagugcccccuucaucccccaacccccacaaaaggagccucaucuuucgagccaaaugacagcgaagagggcggcccugcgggacagugcccuuuugacuacacacacccuacucuaggaaaacagccugaaaaaagcugcaccuuccccugccccagauacuguagacacuguggaacaaagaccuguugacccuccccaccuugggccaacacaagcagagguggcaucucuccccucuccaccaagcacuggcaagacuguguggaagggcccugcugaccauccacaaccugcacaagacugaaccacaguaacaagguggcaccccauccucucucaaagacagugaggagcuagaagcaaggacucuccaacccauuucccguuccccgucccacccaccgcagaauacuccucucuaauccuaauauaacgucguguacauuucuguuacauucggauuaaagacaaguucuguuuaauaauaacuccaagaacaguugauauauauuuuuuuucuuuuagaacaggagugaaaguuuauuaaaaagcuuuaaagcaguaaagaaaggaaggaagggaaggaaaguacacuuggaagaaggccaaacccaguuuucauauuuuauuuucgcauugaaaaucagucagauuuacuucagccucaaaaguguguuuauguaaaauuaaaugagcacuagcagcaagcugcacuuuuuuuuucccaaaugggaaacggguuaaauauguguaggaaguccugggccaugcccuccaagugcccaugugugaaaacaaccaggaucaacacagcaaaagcucugagagcucaacggcaauguggaauacucugagguuucaaacuggccuccagggcugggugcgguggcucaugccuguaaucccaacacugugggaggccgagaugggaggaacacuugagcccaggaguucaagaucagccugggcaacagagugagaccuugucucuacuaaauauaaaaaaucagcugggcgugguaguguguaccucuggucccagcuacucaagaggcugaggaggaggagugauugagucugggagauuacagcugcagugagcuaugacugggccauugcacuccagccagggcaacagagcaagacccugucuccaaacaacaacaaaaacaaaaacaaauuggccucuggguugcacaaaggugggggaggccagaggagcucugcaaaagcuuugaaaacuaaauugaucuuagaaccagagcccugcuggccacagaaagugcauccugaaucuaaacagguugagugccugcuaauacagaauauuuaaacaggaacuacagucucauaacauaacacucaaaguguccaggauaaaauuaaaacuuacuccucauacuaagaaccagaaaaauccgaacccagaaaaauuacuccucauacuaaaaaccagaaaaaaucugaaugaggaaagacaauuaacacuaagaugacaaagauauuggaauuauugcauagggauuuuagaugagcuaucuuauaaauggcccaagaaguaauuaugaacacucucgaaacacacugaaaaauauaacgucucauugaagauauacggaagaacuacauuguaauuuuagaacuagaaauuacaauaacuaaguaaaaaacucaaugggugaacucaauagcagaauggagauacaacagagaaaaaaauuagugaccuugaugauagagcagcagaaaugauucaaucuguaucgugacaaucuugccauaagaaaaaaaauuacguagaaauaaucccauuugaccaacagagagaaaauaaauagaaaaaaaaacugaacaaugagacaacagcaaaagcucuaacauucaugucacugaauucccagaaggagaggaaaaagagugcagugcccaaaaaacaucugaagaggccgggcgcgguggcucaugccuguaaucccagcacuuugggaagcugaggcaggaggaucacuugaggucaggagcucaagaccagccuggucaacauggugaaaccccaucucuacuaaaaauauaaaaauuagccaggcaugguggugcaugccugcaaucccagcuacucgggaggcugaggcaggagaaucacuugaaccagggagguggagguugcagugagcugagaucacaccagugcacuccagccugggcgauggagugagacucugucucaaaaaaaaaaaaaaaaaaaaagaaagaaaugaagaaaaauccagagagauuuuuuuucagaagaaaaaguauaaaaauuaaauuaaaaaagagaaauuuaaaaaagcaguaagaggguaaauaucugggugaauauaaucucgaguuuaaaaauuauauuugaugggcaaaagcaaaaccauaacauuaucucagugguucucaaugaauguagaggugauauucaagacaacaauaccauaaagaagggcagaggggccuagaaagcaguagaguuucuacauuccacuugaauuggcaaaagguugauacuagccaaugaucauaaguauguauaauauaaucucuacagccaccuauaaaauccuauacaaaaauauauacuaaauggcauacugaauugauuuagcacggcauaugaaguuaaauggcauacuaagaaaugucuaaguaccccauaaaaaggcaagaaaagggaaacagguauaaaaaaacccagagggaacaaguagaaaauagauaauaaaaacccguccaaaauuaaauauaaaucuucuaaacacagcaaucaaaaagguuguuggaaucuguuuuuuuaaaaaugacucauggccaagugugguagcuuaugccuauaaucccagcacauuagggggccgaggcggagggaaucacuugagcucaggaguuugagaccagccugggcaugauagcgagaccccaucuccacaaaaagaauaagaaaaaaaaagauuagccaggcaugguggcacauaccuauagucccagcuacucgggaggcugaggugagagaaucacucaagcccaggaggucaaggcugcagugggccgugacugcaccacugcacuccagccaacagaguaagacucugucucaauaaauaaauaaauaucaauagucacauaagauggcagaguaggaagcuguaguguagagaucagucccuucacuaaagcaaccacugagcuagaaagagugauuggaaucagcucuuuuggaauucugaaacaugaccaggaacuccuaacaaccagagacauacuuaaacaaugaagagagaggcugcugaucuucacgagugaguggcaugugccaaccagccaacacucccccauuccugagccugaguuccugaagcagcuggcugaugccagggcgagcagcggaacucuguccuccaaaaccauggguucugcaccuugguggguccaaugggucucugaggaccagcccggaugcuugccuugguuuauuuggcccucucagcaacaguggcuuccccagggacauccuucagaagauuuuaucaaagagacaaaauccuccucugccccaccccauuuaaagccaucuauuuaaggaaauccauguuagguggcuggcugacugcagagauaaugaaacaaauuucagugaccacacaagcacaaggaagaaacacuuugcaaaaauaguuuggaaaaguaacaaaaggggagcuucagaccucaacaagcaaaacccagcaaucccaggugacugagagaaucacauuuugagggucauuacauuguaacacuuaaaaugcaacguucucaacaaaaaaccacaaaauauacaaagaaacaggaaauaggaagcuuagaccauucacaggaaaaaaacagcaaagaaaaucagcaaacaauacaauaacugaacaccaucaucgaccaauggaaccuaacugacauuuacaggagacuucacacacuaacagcaggguacacauucuuugcccauggaagauucagcaagauuuaccagaaccugggucauaaaacaaauguuuuucugagauggagucucuuucugucgcccaggcuggagugcagaggugcaaucggcuuacugcaaccuccgccuccuggguucaagcaauuuuccugccucagcuuccaaguagcugggauuacaggcaugcaccaccacgccuggcuaauuuuuguguuuuucagacaggguuuugccauguuggccaggcuggucucaaacuccugaccucaggugaucuaccugccucggccucccaaagugaugggauuacaggugugagccaccaugcccggccaaaacaaaucuuaagaaauguaaaauaacugaaaucauacaaaauacguucugugacuguaaaauaauuaaacuaaaucaauuuuaaaaagaaaccagaaaaucucuaaacacauggaaauuaaauacacuucuaaauaauucaugggucaaagagugagucgcaagggaaacuggaaaacauauugaauuauguaaaagugaaaauauaacauguugacugguaucagcaaaaauggcagaguagguaucuccaaguccccauccccccacagaaacauugauaaaccaagcaaaacugucugaaucaacuucaugagaacuguagaaaaauaaucaaagguuuacaauaaccagaucaucugauguggcucuuuguccccaagcacaucucauccugaauuguaauccccaggggucaaggagggaccugguggaaggugacuggaucacgggcgcgguucgcccuaugcuguucucgugauagugagggaguucucacgagaucugaugguuuuuaaguggcaguuuccccugcacucuccccucucuccugccagccagugaagaggguacuugcuucuuguuagcuuuccaccaugauuguaagucuccugaggccuccccagccaaguggaacugugagucaauuaaaccuccuuucuuuauaaauuacccaggcucaggcaguucuuuccagcagugugaaaacugacuaauacuccaaaugaacacugaaucaagaaaaaagcaacuucaaaaugguaggaaaacuggguuauuuuacuugcccuugccccacaaccuuccaugguucagugggaaccuugaagauggcagcccacauucccagugugguuucugguauugaaggcagcagagcagaccuuauucucaaagcauuuuguuuucccguucucagcugccugagggcugccaaaagaacugauacagggcagcugccuuuguuucaccuaacccagaacucacacagggcagaaaaguggcuacacagaggguauuccuugaaaacacuguaaaucaaaugcauacccugcugaugccuaggcaaaagauuacaguugaggcaaacuauaggugugcugacagcaugggagaagaagcuguggagaguuucuaugggaaauuuggguacugaaauucggaccugcccuuguguacuauggaauuucaguagccaugcacaugcugagugcagagcacauucucagaauagaccugagaaaggaugcugagcuuucaucuguggcuccucuccauccucccugcaggcagggaguaaagccuagggcaaagcuguacacagacugggccgggugcgguggcucacgccuguaaucccagcacuuugggaggcugaggcggguagaucacuugaggccaggaguuugagaccagccuggccaacauagugaaaccccgucucuacuaaaaaauacaaaaguaagccgggugugguggaaaauuagccagguguggugacacaagccuguaaucccugcuacucaggaugcucaggcagagaaucacuugaaccugggaggcagaggcugcagugagccaagaucgugccauuguacuucagccuaggcgacagggcaagacuccaccucaaaaaaauaaauaaaaaguuguacacagacuggcuaagcccugaaggacugcuccagugccccagcacaguggcaauccacaaagauggaaagagcuggguuuuucuuuuuuuuuuuuuuuuuuuuaccuuuggcaucuggcauucaaggaaaucucuguuaaaacacuaguugaacacaagcuaacggcagagagacuuucagagaccgcacauguaaaagaagacacacuuugcaaaaauguuuagaaagucacugaacaaacagcuacagcccacagcaaaagcaaacccaggggugguggggaggauaaaauaauuuccaguuaccccauuauaauacucaaaaugucugauuuccuuuuuugagacggagucuuagcucugucauccagacuggagggcaguggugcgaucucggcucacugcaaccuccaccucccugguucaagcaauuccccugccucaaccuccugaguagcugggauuauaggggcaugcuaccaugucugacuguuuuuggauuuuuaguagagaugggauuucaccauguuggccagacugguccugaacuucugaccucaggcaaucugcccaccucggccucccaaaagugcugggauuacaggcgugaggcaccacgccuggacucuuuuuuucuuuuuaauuuuacuuuuucuuuuuuuggggaaaagggauuagaggugugagucacugugccugacuccaauuuucaaaaaaaaauuacaaaccaugcagugacauuaagagaguacagcccauucacaaaagaaacaaauugucuuuaaggaagcacagacauugaaaguacuagacaaagacuuuaaaucagcugucugaaaucugcucaaaaagcuaaaagaaacgaugaauaaagaguuaaaggauacaaggagaacaaugucucaacaaaugcagaacaucaauaaagaaauagaaaauauuauagacaggugaggggcaguggcucaugccuguaauuccagcacuuugggaggcugaggcgggcagaucaccuggggccaggauuugaagaccagccucagcaacauggcgaaacccccucucuacaaaaaaugcaaacaaucagccaagugugguggcaugcgccuguagucccagccacuugggaggcugaggugggagaauugccugagcaugagaagucaaggcugcagugagccaagauugcaccacugcacuccagccugggugacagagugagacccugucucaauaaaagaauuuauuauagacaaacuaaagcuuagagaaaaaaagaaaggaaaaaaauagaaauuauugaaaggaaucaaagucugaagcugaaaaguauacaaaaauuagccaggcaugguggcgggcaccuguaaucccagcuacucgagaggcugagacaggagaauugcuugaacccaggagacagagguugcagugagccaagaucgcaccauugcacuccagccugggugacaagaacgaaacuccaucucaaaaaaaaaaacaaaaaaaaaaaaaaguauagaaauggaaaugaaaaauucaccagacuauuucgaauucauuagagcagauggaagagagagucauugaacacaugaagacagguagaugaaacuauccugucuacaguucuuuuuuuuuuuuuuggauggaguuucacucuuguugucuaagcuggggugcaauggcgugaucucggcucauugaaaccucugccuaccggguucaagcaauucuccugccucagccucccaaguagcugggauuacaggcaugcgccaccaugcccggcuauuuuuguauuuuuaguagagauugggguuucaccauguuggccagacuggucuugaacuccugaccucaggugaucugcucgccuuggccucccaaagugcugggauuauaagcgugagacaccgugcccagccugaauuguaacacuuuaaaaugguauguggacugggugugguggcucaugccuauaaucccagcaccuugggaggcugagguaggaggaucgcuugagaccuggaguucaagaccagucuggcaacacagugagaucccaucucuacaaaaaaaaaaauaaaaaaguagccugaguccggccuggcacaguggcucacaccuguaaucccagcacuuugggaggcugaggcggguggaucaugcggucaggaguucgagaccagccuggccaagauggugaaaccccgucucuacugaaaagacaaaaauuagccgggcaugguggcaggcacuuguaaucccagcuacucuggaggcugagguaggagagucgcuuguaccugggagguggagguugcagugagccaagauugugccacugcacuccagccugggccacagagcaagacuccaucucaaaaaaaaaaaaaaaaauuagccugaguccuagcuacucaggaugaggugggaggauugcuugagcccaggaauucaaggcugcagagagcuauacucacaccacugcacuccagcacaggcaacagagugacacccugucucaaaaaaaaaaaaaaaaaaaaaaaaaaaaaaggugugugacuuucgccucaauuaaaaaaaauaaaacauauaaaaaccugucagcugggcaugguggugcauaccuguagucccaaguauuugagagacuguggugggaggauuccuggagcccaggaguuugaggcuucaaugagcugugauugcaccacugcagucugaccugggcaacaaagggagaugccaucucuuaaaaaaaaaacgucaaauccugugagaugcagccaaaguaaacuuuagguaaauucauagcccuaaaugcuuagagaagaagcaauaaaaaaaaaaaaaaucuuaagaaucugagcuuccauuuuaagaaacuagaaaaagaagagcaaaauaaccacaaaacaagcagaaagaaggaaauagaauuaauauaagagcaggcugggagggguggcucacaccucuagucccaacacuuugggaggcugaggugggcagaucucuuaaggccaggaguucaacaccagccuggccaacaugguaaaccuccaucucuacuaaaaauacaaaaauuagccaggcgugauugcaugugccuauaauccuaguuacucccaagcugagguaggagaaucgcuugaacccaggagguggagguugcagugagccaagauugugccacugcacuccagccugggugacagagcaagacuccaucucaaaaaauaaaaauuaaaaaaaaaaaaauguaagaguagaaaucagugaaguuaaaauagaaacauuuaaaaaaucaauuaaaccaaauguuggcucuucgaaaagaucaauuaaaaauaagaaaucccuagccagacuaaucaaagaaaaaaaaaaagcaaagagagaggaugcaaaugaccagcaucaggaauaaaagggaggcuauuagcacagacccugcaugcaucaaaaugagauuaaauauuacaaacaaaucuaggcacccagcucucacccucauuuuuuauaagugggaaaaagacccagagaucaaaugacucacucaaaaugacagucaaugacagagcagggccuggggccuuaggacugauuauccaaaugccaucagagaacgagcuaaaucagaagcaccuagugagcuuuuaaaaaauaauucuccagggcacaaccccugagauucugauucaguagguuuuggagugaugccuaauauucugaaaaugccaaaagcucaacagaugguucucuugcuuggccaguuuuagaaaaugcagugucccauauuaccaccuucacucauaugacgacuguagagaaaaucaaaaaaucuggugcucaaguauguuuaaauuuaauguaaagcaccgggcgugguggcucacgccuguaaucccagcacuuugggaggcugagguggguggaucacgaggucaggagauugagaccauccuggcuaacacagugaaaccccaucacuacuaaaaauacaaaaaaauuagccgggugugguggcacaugccuguagucccagcuacuugggaggcugaggcaggagaauggugugaacccuggaggcggagcuugcagugagccgagaaugcgccacugcacuccagccugggcgacagagcgagauucugucucaaaaaaaaaaaaaaaaaaaaaaaauguaauauaaagcaggcggaauaaauccugugauggugaccgggugaaugcucuugagagaaaucauaaucuggaauacccgucucugacauuucccauggcaguuaacauuuuuccacuuuauucaaauacacauuuauuugucaaauauuugcuggguaccacucugugcuagguauuggggauacagucauuugcaucacaaagucccugcucaguguaauaagcacucauugagcaccuaccuaugugugaggaacugugcuaggggguaucagaaacacacaaaauaggccgggcacuguggcucaugccuguaaucccagcacuuugggaggccaaggugggcagaucaccuggggucaggaguuugagaccagccugaccaacaugaugaaaccccaucacuacuaaaaauacaaaaaaauuagccagguguaguggugggugccuauaauccccagcuacucaggggcugaggccggagaauugcuugaacugaggaggcagaaguugcagugagcugagauggcacaacugcaccccaaccugggcaacagagacucugucuaaaaaaaaaaaaaaaaaaaaaaaaagaaaagaaaagaaaaagaaacgcagaaacacaaaauaaaacugagccucuccucucaaagaacucacccacuccagucggagacaaacuauacaacgccuucccagguaucucaucccguuucuuaaguccaaauucuguuuccacauugaagacuccagcuuuuuuuuuuuuuuuuuuuuuuuugagacagucucacucugucgcccaggcuggagugcaguggugcaaucucggcucacugcaaccucuaccucccagguucaagugauucuccugccucagccuccugaguaccugggauuacaugcgcccaccaccacaccuggcuaauuuuuuguauuuuuaguagagacaggauuucgccauguuggccaggcugggcucacacucccaaccucaggugauccacccaccuuggccucccaaaguguugggauuacaggcgugagccaacacgccugacugacuccagcauuuuuaucuucaucucaaucucaucccuaaacucaaaaccaacauaugcaacugccuacuugauguuuccauuuggauaucuaacuaacaccucaaacuuaacaugugcaaagccaggugcagugggucaugccuauaaucccaacacuuugggaggucaagacgggaggaucgcuugagcccaggaguuugagaccagccugggcaacuuagugagaccccaucugucuauuuauuuuuaaaacauuaaaaauuguuuucaaagaaaaaaauaaaccuaacacgugcaagaccaaauucccaauuucgcacucucccaccaaacugguuucucccgcagucuuugccaacucaauaaauaacaacuccauucuuaaaguucacguaacaaaaauccuggagucauccuugacuccucucuuucucuuacacacugcaugcaaagcaucugcaaaucuuuugggucuacuuucuuuuuuuuuuuuuuccuagacagggucuugcucuguugcccaggcuggagugcaguggcgugaucacagcucacugcagccaugacuucccaggcuaaagcgauucucucaccucagccucccaagucccugggacuacaggcaugcacuaccaaacccagcuaauuuuuuauuuuuuuagagacagggucuugcuauguuucccaggcuagccuugaucuccugggcucaagugauccuccugccuuggccucccaaagugcucagauuacaggccugagccaccacaccuggccaggucuacuuucaaaauacauccugcaugugaccacuucuaucugcagcugccucucucauccauaccucuggcuuguuuugccuggagugcugccuuauaaccaggaccccuguuuugaccagaguucuccuaugaacuguucucaacagagaggccagagagaucuuuuuaaaaacacuaaguugaaucucauuaguccucuguucaaccugcaaagauucccauuuuauucagaguaaaagacaauccuuaugauccucaccaaggcaugacaugacucccuacucccucuuggaucucaacucucuccaccuuugccuuugcugaacuucgcuccagccucauuggcuuuuucugcuguucuaaacaugccaugcauacuccucucuggaaugcuguuccuuuggagguaagcauggcugucucuccaccuccuucagcucucuaaguaucuuaucagugaguccuuucucaaccaccuuauaaaaaguaaucacuucccacucccaaggaacuuuuuuccccucacaguaauugucaccauuugacacauauauuuuauuugguuuauuauuguuacuuuuugagacagugucuugcucuguugcccaggauggaguacaguggcacaaucucggcucacugcaaccuuagccucccagguucaagcuauuucuggcuaauuuuuguauuuuuaguagagacgggguuucgccauguuacccaggcuggucucgaacuccugaccucggccucccaaagugcuaggguuacaggcaugagccaccacgcccggccuugacacauauauuuuaguguccaucuuuuccugcaauaaaguguauaauuauuaggguaacguguucaguucacugucuuauucccagugcuuaacaguggcaggcaaauaguuaaugaucaguacauauuuugugaaugaaugugacauguucuaauagaaguaggaaaugaacacuucgugggauggguaaacagugggagucauggccaaaaauaguuuagaauggaucauuuacugcaaugguuuucaagcacuuuucuuucuuucuuuuuuuacagaaucaggguaucacucuugcccaggcuggagugcagugguacaaucauagcucacugcaaccugagaacucugagcucaagcaauccucuuuuaccucaacauucccaaguagcugggacuacaggugcgugccaccaugcccagcuaauuuaacuuuuuuucuuuuuuuugagaaagggucucacccugucacccaggcuggagugcaguggcacuaucacagcccacugcagccuugaccuccugggcucaagcaauccucccaccucagccuccugaauagcugggacuacaagugcaugccaccacuucuggcuaauuuuuaaauuuuuuuauagaaauggggucucccuauguugcccaggcugaccucgaacuccugggcucaagugaucugcccaccucgaccacucaaagugcugggauuacaggcauaagccaccaugcccaguccagcauauauauauauuuuuaaacuggaacucauuuuuuuaaauggaagcacaaucugaaaaaggaauaaaacccaaagauugacaacgggcuagaaaaccagaaauccccaauucagcuucuuccccucacucuccccuuugaacucaugaugcgucucaaagcccagcuugaaagccacagaucuagagcuuggauggcauucuaaugagcuaagcaucuaaaccgaccacaguugggagccacugaaaguuuuugagcagguaaaugauagauugauugauuuauucauuuugagacagucuugcucugucacccaggcuggaguauaguggcgcgaucucagcucacugcagccucugccuccuggguucaagugauucuccugccucagccucuggaguagcugggauuacaggcgugcaccaccacgccuggcuaauuuuucuauauuuaguagagacggguuggccaggguggucucgaacuccugaccucagguaauccaccugccuccaccucccacagugcugggauuacaggugugagccaccaugcccggccgagaccuugacucuuaaaaaacacaaaacgggggcagggggagggggcagcacagaacagaaacagaacuuuggggaacagagacacggcgccgaguugagcagaaaccagggcagaagcaccaggcagagauggaagacugacuuucaucgaaggagugggauccugggacccaagggagugggagcacaguaaguagggaugaagauggcgaaagcacgaccugccagagcgcuugcugacgagccacacuccacaccuacuacgcgcugucacgugcuugacaaaacccgacacacaacgcacaacgcuaaaguuuauugcucaacaaugcaaauacaguuaacauuaccguacacuuaaaaaugguuaagaugguaaauuguauguuacguuuuuguuuuuugagauggagucuggcucugucgcccaggcuggagugcagcggugugaucuccgcucacugcaagcucugccucccggguucaggccauucucuugccucagccucccaaguagcugggacugcaggcgcccaccaccacgcccggcuaauuuuuuuguauuuuuaguagagacgggguuucaccguguuugccaggauggucucgaucuccugaccucgugauccgcccaccucggccucccaaagugcugggauuacaggcaugagccaccgugccuggccauguuacguguuuuuuuaaccacaauuuaaaauuaaaugaagggggcugggugcaguggcucacgccuguaaucccagcacuuugggaagcugaggugggcagaucacaaggccaagaguucaacagagaacuccuggccaacagacugaaaccccgucucuacuaaaaauacaaaaauaggccgggcgugauggugcaugccuguaaucucagcuacucgggaggcugaggcacaagaaucacuugaaucugggaggcagagguuaucgugagccaagauugugccacugcacuccagccucagugacagagugagacucugucucaauaaauaaguaggcugggcacaguggcucaggccuguaauccuagcacuuugagaggcugaggcagguggaucacaaggucaggaguuagagaccagccugaccaauauggugaaaccccgucucuacuaaaaauauaaaaauuagccaggcaugguggugugcaccuguaaucccagcuacuuugggaggcugaggcaggagaaucgcuugaaccugggagacagaggcugcagugagccgagaucaugccauugcacuccagccugggugacaagagcgagacacuaucucaaaauggaaggaaggaagggagggagggaggaagggagggagggaagagaggaagaaaggaagggaaaauauguauuaucucagcaaguaaaaugcagaugaaggaaaaggacaaugaucauuugaauggaagauggauccacuguaauccagguaugggagaauacugaacacgaaugucaaaagaaacagaaugugcugacgaucugcaaggcauuucacagaagacaaagaacacaaaccauggagagaagacuagcacaaucaaauagugggaggugaggaagguagacagaauucaugauuuuggaaucugcacaguuuaucaucagacauucugagaaagaaggaagugaacuaucucacugguacugcuauauugucaaguaaaauauucaacuagguuaaaagugucagacauaucaauuuggaggcaagcugcaaaaauacacaggaaaaaaggucuuagaaguugagauuagauaaacucuuuuacgggauacaaagaaaaccaaaaaaguggaaaauggguucuaagaggacacuccugaaaaggcaagaaaaggaaccgacauucacuuaugaaauucacacuuccugaaugucuacuauggacagagcaugauuccaguuauggggaaggggaaaugaacacacagacaggucacaaaugagcauuggggaaagaggggaaagcugagggagcgcuacaucaucacaucaacugagcauggacuuggggaaauaagguacaccacaagcugugacucaauucacaagcacagguggaggacgagguuuugguaucugaaugccuaaagaaauaaauaaaaucgagggcagaaaauaaguccaagguuuuuuuuuguuuguuuguuuguuuuuuuuuuuguuuuuuuugagacggagucucgcucugucgcccaggcuggagugcaguggcgggaucucggcucacugcaagcuccgccucccguguucacgccauucuccugccucagccucccaaguagcugggacuacaggcgcccgccacuacguccggcuaauuuuuuguauuuuuaguagagacgggguuucaccguuuuagccgggauggucucgaucuccugaccuugugauccgcccgccucggccuccuaaagugcugggauuacaggcguuagccaccgcgcccggccaaguccaagguauuuuuaaagcaaggaaggaaagaaaauggaagauaaaaagaaugaacauaaaagucucaaguuaauuuuuaugucagacuucugaaugccccaaaaugaaacaauucuguaaggccgggagcaguggcucaggacuguaaucucagcacuuggggaggcugagguggguggaucacuugaggccaggaguucaagaccagcauggccaacauggugaaacccugucucuacuaaaaauacaaaaauuagccaggcuugguggcaugugccugaaaucccagcuacucaggaggcugaggaaggagaaucgcuugaaccugggaggugaugguugcagugagcugagaucauaccagugcacaucagccugggugacagaacaagacuccgucuccaaaaaccaaacaaaaaaacaaacagcccacaacaauucucuaauggcgagggaguaaauaagugaccgauaaugcuggaggaagaggaagugaauggguccccaguauagguuagaaugaaaaaaucccuaccaauguaaaucaaauauaaaauaaacaaaagaguucauguaugugugcgggaaggaaagugauauuuggggguugggagguguuacugaggguaccgaauacauauaaacaacucuuuagucacucccaaaggucugggaugagcauuuuuuaacauuugauacucuacuaacuuaccaggacuauguugacauggaaauucaccucccguuauccacagcuccucucccugcuccaacuuaaugaugacguuuggcuuggugauaucauaucuuguuaaugggaaaagaagaaggacuugggcaaguugcucggcuucagaaucuccgaaguacaagauguugccaccucauaagcugcauaacagaaaugcuccauuuuuuaccuuaucaaaguuagaaccuuucaaugaagaauaauauaaacacugcagcuagugcccacaaggaauuaaaugguguugccacuuauuucuucaaacucaagcauaaaaccccauucaacugagagcauucagaaagcaagcuauccucacccaaggaaacuagauggcuguaguucuccaacaucacauccccguauguuaucuucucaucaggguccaguugccgccacuccuccugggugaaauccacagccacaucuuugaaugacacuggccccuguaauggcaacaugaucagaauugggagauauggaaaagggauagggggauaacauuuuacaaagcucacuggugaaguuaaccaugaacauuguacaccuuauuuuauguuacagauuauggaagggaaaucauauuggaaacacauauccuuugggguccuuuauauauauacaaaaauaaaaagccaaaacacaacugagcuccuauuuugcaacugaacugaguuuuggggauaugagaugagugaaacaccaugccugcucucagaaagcagacaaccuaauaaggagauaaacauguaaacaaacacaagcauuuuacuccuugucacuucuuuuagucuucuuugcugccaggcgcuccccuucuccgggaccuccucauguuggagugcccaccacucaguuccuggucuucuucuuccuaacucacugcucuggggcucucaccuaguuucagcuccuuguucuuuuggcucuuuuauucucauagccaguggccucuggcuaucugcaugacugauuuuaucucaaacaucucaaucucacagcaauaaauauucguuaaaugaaugaaugcccaaagcuguuauuagaguaaugcagacaaggugcagaaugauuuaacaaaagaggaucaaauuauuuuaacuuuaugccaucagauuaggcuucacagacucaguuaacuugaaguccuuaaagaugaauuguguauucuaugggaugaaggggaggaagaauaugaugagguguaaaaguaccaauggcaaacaugaagcagcuucaauuuuuaagagguuggggcugggcaugguggcucaugccuauaauccuagcacuuugggaggacgagaugggaagaucguuugagcucaggaguucgagaccagguugggcaacauaguaagaaccuuaucucugcuaaaaauaaaauuuuuuuaaaaaauuggcugggcaucauggcacaugccuguaguuccagcuacuugggaggcuaaggcaggaggauggcuugagccugggaggucaaggcuacagugagcugugaaugcaacacugcacuccagccuaggcaacagagcgagaccuugucucaaaaaaaaaaaaaaagaaaaaugcaaagcuccugggcuccagcaauccaccugccuuggccucccaaaguauugggauuacaggcuugagccagcaugcccugcccaaacuugcaguuuagaaaaaggaagugcccaguaagcauguugcauuauccuguuauuuauaaagaacauaucaacaagggguucaaacccagugauacagcuaggaccauguagaucccaagagauagcagaggcagagcugcuaggcuggugggcugagaaacuaaagcagaacauccaagcuuauccacaggcaggccaaaggagcugauaaaaucaccgagagagaguaauaacuuucuggguuaaguuaguccagaaggcaaggaggugguggggguuagaagacugaucgaccaauaaauaacauaaaauuacaugucaauaccacuuacaucaauacaaauacccaaaaugaaacauaaccaaacaaaauccaguaccagauuaaaaacauaauauacaacagacaaauaggacuuauuccaacaauauagacuaguuuaauauuuggaaaucuauuaauaugauaagccacuauaacacagcaaagaagaaaaaucuuguauccaugaagauacuugaaaaagcuugacagaaaaagcugauuuaaaaaaacaaacuaaagaaaauagaaacugauggauacuucauuaacaucaauauuauauacacaaauauaaauauuacacccuaauaugccauaguacguaugauaugugacauauguauuucaauuacacacaagcacauauauacaguuugcguguauacacacacacacacacacacacacacacacacacacucuuaugccucagucuucucgguccgaaagucaggauuuuacuuaacagggaaaaacuacauaucuucccacuaagaucaagaacaagguauuaauaaaaugcucauuaucuacaauuagagaagagaaaacaauuagaggaauauaacuaagaaaaaguaaaagugcuugggcacgguggcucacgccuguaaucccaacacuuuagaaggccgaggcgggcagaucaccugaggucaggaguucaagaccagccuggucaacauggugaaacccuaucucuacuaaaaauccaaaaacaacaacaaaauuaguuguaguauuaaggucaacuuaauaauacagagauaccaguuucccuaaauuacuuuauaaauaugcaaucccaauaaaaauaccaaaaagcuuuuuccuggaacuagauaagcugacacuacaguucauaugagguggaagaaaaucaaaaauagcucagggaaaaaaaaauuuggacauggauaaaacuggacccaggccaggugugguggcucaugccuguaaucccagcacucuggaaagcugaggcagaaggauugcuugaggccaggagcuugagaccagccuuggcaacauagcaagacccugucucuacaaagaaaaaaauauauauauuagaaaaaacauauagacagagacaugaggacuucugcccucaggugugauaaauuaacaaguacuggauauacccuccaaccugaaacagcacacaccaaagaacaacaaaaucaaaaacagaaagaaaaauaaaacaagaacauauacgaaagcaaugauuuguuuuuuuguuuuuguuuuuguuuuuuguuuuuugagaugaagucucgcucuugucuuccaggcuggggugcaauggcacaaucuuggcucacugcaaccucugucucccggguuccagcaauucuucugccucagccucccgaguagcugggauuacaggcgugcaccagcaugcccggcuaauuuuuauauuuuuaguagagaugggguuucaccauguuggccaggcuggucuugaacuccugaccucgugauccgcccaccuuagccuuguuguuguugcugugauuacagguaugagccaccacgccugggcugaagcagugguuuucaaggcacugauuaucaggcaguagaguuaucuaugagugaugggaaauaaacaaggugaaccaaucaacuucugccuugagcguuuccaggccauggagcagggaagaagaaccgaggcagaugugaggagaaagaguugugggaugggaaaaugggcaggaaauuacaacccauaaggaagaaaagaaucaguccaucaaaacuggcccagaauugacacagaguucacaaccggcacagagcacugagagaguucaucguucuauuccaaauguucaaaaaaaucaagacaggcaagauguaaaaaagacccacgcuaaccuucuacagauaguacaauaucugagaugaaaauuauacuggaaaagaugaacagcaucauggaaaaaagagauuagugaauauaaagacagcaacagaaguuacauaaaaugaaacagagaaaaaagaauuaaaagcaaauaaagagcaacaguguguugugggaaaauuucaaguggccuaauauacaggcaacaagaaucaauggaggggaggugguggguacuugaagagauaaugauaaaaauguuccccaagugaugacaccauaaacccaagauccaagaaguucaaugauccccaaaacagaaacaugaaaaaaaugauaccaugacauauugcaaucaaauuguccaaaacuagugauaaaaaguuuaaaacaauaaggggggaagaaaaaaagacauguuauauauaggggaacaaacaugaguaugagaucagauuucucuuagaaaaaaauguaagcaggaagacaacagagaaacauauuuaaagcacuguggagaaaaauccagcaaaaacaccuuuaaaagcaaagacacaaugaagacauuugcagacauauaauaauucaucaucaacuagaagaaauguuacagaaaguccuucaggcagaaguaaaaugacagcaaauaaaaauuuagauuuacacaaaggaaugaagaguaccagaaaugguaacuguguauuuucucucauuacuuaaaucucuuuaaaagauaccugggccaagugugguggcucacaccuguaaucccagcacuuugggcggcugaggcagaugggugaccugaggucaggaguucgagaccagccuggccaacauggcgaaaccucgucucuacuaaaaauacaaaaauuagccgggcgugauggugggugucuguaaucccagcuacccaggaggcugaggcaggagaaucacuugaacccaggaggcagagguugcagugggccaagauagcaccccugcacuccagccugggggacagagugagacucugucucaaaauaaauaaauaaauaaauaaauaaauaaauaaauacaguuuaauuaacaacaacguaauagauaguguguggcacugauaccaccuguaaaaauaaaaugaacaacgguguaaagaccaagaggagagaaauggaaguguccuauuguaagcuucucuuauucuaggaaaaauggauauuacuuaagaauaaacuaugacaauuaaaguugcauacuauaaauucuaacucacuaaaauaacaaaacagugugauagcuaaaaacccaacaaaagacauaaaguagaaucauaaaaaauucucaacuaaucaaaaggaaggaagacaaacagagacauuuuaaaaagaaacaaagaagaugagacuaaaagaaagcaaagacaacggacuauaaccuaacucguuuuaucaauaaucacauuacauguaaacgguuuauacauccccaauuaugagacagaaauagacugaugaaaacaagcaagauccaaauuuugcugccuguaagaaauaauacuuuagauauaaagaugcaaauagguuaaaaguaaaaggauggaauaagauauaccaugcauguauuacucaaaagaaugcuacauaaauaacaaaguacauuucacagccuggaauauuagcagggauaaggaaggccauuuuacaaagugguuaauuaaucaacaggacguaauaaccuugaacauuuauguaucuaauauaacacauaaagcaaaaagugguaaaauugcaaagagaaacagaaccacaacugcagcagauuucaauccccucucccccacaauugauacaagugggcacacaaucaacaaggauauaguacaccugaacaacacaaccaaccaacuugaucucauuaacauuuaucaaucacuccacccaaccagagcagaacaagccaucuucucaggcaugcacagaauuuucccaagacagauccuguucugagccauaaauuuaagagguuccauguagcauuccagacaaaaauucacagucuaaaucuaaucaugaagaaagaucagggaaaccuaaauuuaaagacuucuauaaaaucauuggccuguauucuucaaauguuauaauggcacuguggaacaaauccguauuaaacagacuuaaaaagcaugaaaacuaaaggcaauuaacaguccuagacugaaucuucuaccaaaaauuaaaaauugcuauaaaggaaauuauugggaaauuggcaaaacuggaaaaugaacuauaguuuagauaaaaguauuaaaucaaugauaaauuuccugaauucaauuacugugcuauggauauuuaauauaauauucuugauuuuaugagcuguaaucuaaaacuuuauaggguaaagaggcaugacacguuauacccacucucaaauaguucaaaaaauauauauauauauauaaauauauauauauacacauacguauauaggcauauaaaugauuaaugugggaaaauguuaagaaugaaguaucugaacaaaaggaaguaucugggauuucuuuguaaaauccuugcaauuuuucugaaaaucugaaaugauuucaaaauaaaaugcuaaauagaaaauaaugcuaucaaauauauauguauauauuugcuaucaaacauauauuauauguauauauuugcuaucauauauaucaaauauauuucaaaaggacucagaaaccaacuuaaagggauuccgucuggccaaagauggaaccacuuaauuuucaaaaagaaucacaacuucuauguacugaaauauuuacuaucuguuuaaacccaugagcucaugaugguaacaaaacaaaauacccuccugcuuaaaagccuacucaauauuuuagaaacugucuuuccugcaugaauuacauaaacaaauagagaauagaaauuuaucuuuagaaaaguauucuaggccagccgugguggcucaugccuauaaucccaacacugggagguuaaagaagaggaucacuugagcccaguucaagaccagccugggcaacauagagaaaccugucucuacuaaaaauuaaaaaaucagcugggcauuguggcauaugacuauacucccagcuacuugggaggcugaagugggaggaucacuugagcacaggaguuugaggcugcagugagccauaaacgugccagccuaggcgacagagugagacucugucuccaaaaaaagaaaagaaaaguauuuuggcuaguaaauaaagaagaaaugguagaauuagcagaucaccauuuugccuccccuaaugaaggcaaaucacagcaauaguaaaucacagcaauaaucaagucaauaguucuuaacuucacaaaaacaaagaagguaacacgugccuccagaaguagacaaaugccacguaugguauaguugugugaaaagaacugaacauaaaccugauuagacuuccagaucaaacuaccaauuuuaccaagacauacaagauauuuuuaaaaaaugugcuaaaggugaaacaaggguaacauaauccaaacugaggauaaccaacccaguuucuucaaaacaaugagcacgcaggagacauacuaugggaacuauuaaaagauuuaacccaacugccacauguauuaagaaagacaguauuauggguuauuccuagccccuuuuaaaaagauuccuuauuggucaggugugguggcuuacaccuguaauccuaccacuuugggaggcuaaagugaaaggacugcuugaggccaggaguuugagaccagccugagcaauacagugagaauacauuucuaggccgggagcaguggcucacgccuauaauccuagcacuuugggacaccgaggcgggcagacugccugagcucaggaguucgacaugcaugacacggugaaagccagucucuacuaaaauacaaaaaaaauuagcgagguguggcagcgugcaccuguagucccagcuaggcgggaggcugaggcaagaggaucgugugggcccgggagauugagguugcagugaguugugaucacgucucuacacuccagccugggugacagagcaagacccuaucucaaaaaaagaaaaaaagaaacaaaacaaaacagacuucaccauuuaaagacaaacaaauacuuacagaugaaucuuuuuaaaagccaagaaaagagagacuccauggagaaaauaucaguuuggaaguaacggaugucaaaggcagacaaaggguacugugaggaaggggcuaggaaaugcccacuggauuugacugcaauuaaaucacuggucaccuuuacugacugacuuagcaaagugaaaaggacaaaacgaaaacacggagaagugaaaugagaaacagaaaugaggaaaucuucacaagagaguaacuguuuguauuguuugcugugcaacccgaacaaaaagacgaacaaauauuugacggaugaucacgucauucauuccccccaugaucuaggacucaacaguaaaaacagaauuguuuacuuggaucacgauauuuccgucccuggaaaaauuauaugcaccaaguucuccuugggcagcaggcccucugcuuacauaagcaccaagaauaagccauaaguuacaguaauuuaaugguuguuguuaggaaagcuauccacaauuauaucaacuugaaugaagaaauuuuuccaagucccagaaaaucuuuuaaguccacaaguaacaaaacugguuucuccuuauaaucaaugcaaacgaugucauggauggugauaugguuucggugugugucgccucccaaaucucauguucaauuguaauccccaauguucccucuuccuccugcucuggugauggaagaugcacccacuuucccuucaccuuucacuugacuguaaguuuccugaggacuccucagccacgcuuccuaugauagagccugcagacgugagccaauuaaaccucuuuucuuuauaaauuacccagucuugguuauuucucuauagcagugugagaauggacuaauacagauggcauuuuccuuuugugaugacugccaagaguaucaguccuaggugcggcucaauuucaacagccuuaaaauauacuacccauacauacaagcuucacaaaucauuuuuggugcugaucugccacacuaacuauauuuuacaggauaaugucuauuuccacauucccauuuuaaaguaugaauccuggcugggcucgguggcucaugccuguaaucccagcacuuugggaggcugaggcgggaggaucaccugaggucaggaguuugagaccaaccuggccaacauagugaaaccccaucucuucuaaaaauacaaaaaauuagcugggcaugguggcccacgccuguaaucccugcuacucaggaggcugaggcaggagaaucacuugaacccaggagguggagguugcagugaagcgagaucaugccacugcacugcagccugggcaacagagcaagacuccaucucaaaaaaaagaaaaaaaaaaguaugaauccuuacaaaccucuuaaaaugcaucauaaaauaaaguugaggaacauauacacaagcaggaaaacucaccugcaauguguucauuuucugcugcucuuggaaacaugcagagacuguggcugauagaccuagaggggcagaagcaggucacugaagucaugagggcuccggccugcaaaggcagaaaucaccugcauaagaaccgcaaaagaaagcucaauaggcuaacacccugugaacacucaaccugcaaacacucagaagggucuaaaagagugauacaggguuucaccauguuggccaggcuggucucaaauucuggccucaagugauccgccugccugggccaacauggcaaaaccccgucucuacuuaaaaauaacaaaaaaaauuagccaggcauagagucacaugccuguagucccagcuacucaggaggcugaggcacgagaauccuuugaaccugggagguggaaguugcagugagccgagaccacgcuguugcauuccagacugggugagagacacugucucaaaaaaaaaaaaaaaaaaaaaaagagugauaggggaagcaugcgccuguaacucuaagauaaucagguaguaauuagaugaguuagacucucauggguaacaugacuccuuuuacaaauagucugccaucaucaucaaauacaaggcgcaaaaagaaaaaaaauucccauuauacggcucauguuuuuugugguuuguugguugagacagggucucaaucugccacccaggcuggagugcaguggugcauucacggcucucugcagccucgaccuccugggcuccauccauccucccacuucagccuccugaguagcugggaccacagaugcaucccagcaugccuggcgacuuuuguauuuuuuguagucaggguguccccauguugucuaggcuggucucuaacuccuggucucaagggauacucuugcccuagccccgcaaaaugcucggauuacaggugugagccacugcaucccgcccgcauuuucuuauugucucuuuaaacugcuuaaaauaaaauaagccauaggaauugaguaugugagcucucagaaaugaaaugaauguguauaaaauaugguuuuguuucuaaauuaucuaacugaacuugguuauugcugcaccuaauaaucuucuauuaagaaaacuaggauacgggagaaauaacacuggccugggagauaagucuccuggguucuacuaugagcagcucuacccacaaagccggugaccuggucaagucacccaccuaaggcccagucucuuccccuagcaacugaggcagcagcagagaaucccugcagacuguuccugcauuacuacgauucucccagggcaggucuaaggggggggaucagcagacacuuaagugagagaauagaagugcugacggacguuuagaggcggucgaaaucuggagcacggagaggaggaggaaggacuguuagggguuagcggggaguggagacgacguccgcagcugaggguggugacacccuccacgccuccguaagccucguccucccagaucuucccaugcagcaccuguucggugcagccggacccugcccucaaacccaacacaugucucuccggcaagcaaucgggacccucccucugccccacacucaaagguccccaacacaaggugacuucacccaggcccuucucgcuccgggcccaaaaacccaagacuuacccuccuggggcuccgcagccucugccccacggcucccgagaggccggggcgggcugcugucgcuggcgcgcgcgucugcucgcgagguccccuccuguccaccucaccaaggcuguucugcucccgaggggcccgggccgggccuacggggcaaauccaggcggguguccuucucggggcccagauccgccucccuggggcucccggccccucuggccccagcgccgccggcuccgggguucacgcucgggggucccagcucgagccucuacccggcccgcgcgaacccugggccgcacagcucccgcccgccuaggugcugguccgggcggucagcauccagccccgcagacucggugauucucguccacuagaagccaaagccugggaacgagagcaagcgaugaccugaagaggcacaggaagcg

SEQ ID NO: 191552 - RNA, 1920 nt, Homo sapiens
auggcaggccugaugaccauaguaaccagccuucuguuccuuggugucugugcccaccacaucaucccuacggguaagaccuccgacaggaugcaguuccaagggcauggcugggauggcacaguggggggugcaggacugaccagccuggggcuggagggaagcgcuggggaaaggguggcccagugaauggacuggcgguguuuggugcaggguucaagcuccagcucugaggcccagagccaaggggaggcugggaaaagacguggcucuucucucucuccucuucuaggcucuguggucauccccucucccugcugcauguucuuuguuuccaagagaauuccugagaaccgaguggucagcuaccagcuguccagcaggagcacaugccucaaggcaggagugauguagguauccuucaugggcacguggcaggagaggggugggggcaggugcaacuccagggucccugagaagcaaggucagccagccccagcucugugcaucccuggagaagucaccuccccucucugguccucaacuuccuugcccauaaaacuaggaggaggauauauuuauuuuuuuaauuucauuuuucuuuuuaggagauagggucuugcucugucacccaagcuggagugcaguggcacgaucauagcucauugcauugcagccucaaccuccugggcucaagugauccucccaucucagccucccaaaguggugcuaggauuacggccaugaaccaccacacccagccaggaggaggauuuuuuuuuuuuccccugagacagagucucuaucacccaagcuggagugcagugguacgaucuuggcucacugcaaccuccgccucccagguucaagcaauucucaugccucagccucccgaguagcugggauuacagguacgcaccaccaugcccggcuaauuuuuguauuuuuaggagagacaggguuucaccauguugaccaggcuggucucgaacuucugaccugaagugaucugcccaucucagccuuccaaagugcugggauuacaggcgugauccaccaggagaaggauuuagauucaauaucuacugagcaccaaauauauaacaagucacuauucaggggcacaagacaauaucuuaucuaauucucucaacaauucuaugggguagcgaugauuguucccauuuuacagaggacagcugaggcucaggaagguaacuugcucaaggucacgugggcugacaugugucuguccuccaaauagcuucauaaguaguaacugugaacucauuuuguaaacagaggcaugaaauagaaauacaauaagaaggccacgugcaguggcuuacaucugcaaucucagugcuuugggaggcugaggcaggaggguugcuuaaggccaggaguuuaagaccagccuaggcaacauagugagacuccguuucugcaaaaaaauaaaaaaaauuagcugggcaugguggcauguuccuguagucccagcuacucaggaggcuaaggcgggaggacagcuugagccugggaauuugaggcugcagugaguuaugaucgccacuuuauugcagccuggacaacagagugagacccugugucaaaaaaugaagaugacaucaucucagcaacuugcaaggaagccuuacugucucugggcguccacaucccccccgccaugaaguggaguggcccaaggucccugucgaccucagcugauccccugucccuuucuuccacagcuucaccaccaagaagggccagcaguucuguggcgaccccaagcaggaguggguccagagguacaugaagaaccuggacgccaagcagaagaaggcuuccccuagggccagggcaguggcugucaagggcccuguccagagauauccuggcaaccaaaccaccugcuaa

SEQ ID NO: 191553 - RNA, 9928 nt, Homo sapiens
gcaggucagaggcuguuucuuuauacaaaggcagacaacauggacaccucagcaugcugcugcaguucaugggggcccaucccaccgcuucuggggagaggaaucggggugggggcgcccgcagcaggggagagacacuacacaggccugggaccgccaagcacaccagcugcgagcuccugaagggcagacacauggacacacggacacugaaaccacgagcacggcacagccacagggaggaaugguggagcuggggacagacaucggcagcuacugccaacugcugcccucuucugccacgaguuccuuggcgaggagccuuguccguguuacuaaagagccacgugacuuuaucugauggcagaacgucucgcuuucugcaucuguaagcugggccaguacaccguacuccacagggcugccgugaguacagaugagacugaaacaggggcauugaucaaaguacccaacacagagccuggcacauagagguguucaauaaguaacuuuugucaggagacucuuagggaggaccuucagaaggccaagugagaugacuucccuagaaauucucucagggcauggggacccuggaggacuccuuggagccugcagccccuggugugcccaaggccccagaauacaccgugccagggcuguucacaggcguggggggcuggaugcccagggaggugcccgcagaagcuggguagacacuggaggaggugggguuuggaccaaagugguucugcacauagcacaggccggaggcaggcugguacggaggcaaggugggcaugugcccgggggugcaggagggccaggaggccagcuucugaccacuggcgugcugcgucugggacacaggguggcuuggggacaggugaggguggcagcucugugugggguaggagccaggcaccggguucagucuggaauggaacaagagagaaaaugguccuucagcgagucuuggcaaggucauggcaucuugugcuugagguugcccccgcuuucuaguacaacaugccuuggauguuuucugugacuugcucuaaguaccaagugggagaaagguuaaccucaaccaaucagaccacagaugcccagggaggguggggccaguugcaguccugcagcaagggaguuguaugaaaggacacuggaccugccacugagaccaccggaggggugaccugcucacagcagcuucuaaaccagauggagcguugggaccaggucacagcugccagugccuguguggcuggcucgacaauucugcccaaagagaacggauucaggcugggcaugguggcucacaccugcaaucccagcacuuugggaggccaaggcggguggaucaucugaggucaggaguucgagacuagccuggccaacaugaugaaacccggucucuacuaaaaauuaaaaaaaaaaaauuagccaggugugguggcaggcgccuguagucccagcuacucagaaggcugaggcaggagaaucgcuugaaccugggaggcagagguugcagugagccaagauugugccacugcacuccagccugggugacagagcaagacucugucucaaaaaaaaaaauuguuuuuuuuuuuuuuuaauuagccaggucugguggcauaugcuucuagucccagguacuuaagaggcugagguaggaggacugcuuaaacccagaaguuugaggcugcagugaguuaugacugugccacugcacuccagccuaggcaacagagcaagaccauguguaaaaaaaaaaaaaaaaaaaaaauuaucuaucaacaagagccucugaggagacaagcuguccaaacggccaucuugcugacaaaauaaacaugcgugucaugacauggcccuggacccacugucaggcugccugaaacacaauauucugagugucugcagcaggcaccagaccugagggacuggacuccaugucacguggggaacacagaaggaacaccaucuuccucuuaaacccuaagaucugccugucacagugaggcaggaucagaccuggcacuggguguggcagugucugugaggcugauugcaauucagcauggaagaacucuuuuuuuuuuuuuuugagacggagucucgcucuuuugcccaggcuggagugcaguggcgcgaucucggcucacugcaagcuccaccucccagguucacaccauucuccuggcucagccucccgaguagcugggacuacaggugcccaccaccgcacauggccaauuuuuuguauuuuuaguagagaugggguuucaccguguuagccaggauggucucgaucuccugaucucgugauccacccgcaucagccucccaaagugcugggauuacaggugugagccaccgcgcccggcccuucagcauggaagaacuuucucaucagggccagucuuggagagugagcucuuguaugugagauacagcuggagaccaccaucagcuauuacagaggggauuccuuggugacagacaguucuccagauucaaugagaacaacuaaaacccacaaaacaccuaguccuaaauguacagucucccccacauugagaccccaggaauuacuugccugaagcaauaaugcggugaguccgcauuucuguuuucccagcagcccuccuggccuuuuagaaaaauaguccaagggcucugagcuguugacagcugggagcaccucuuggaagaagcucuaagggcagcuuccuauucaacaaaaaccccacauccaggccagcgugcaggggaaaauuuacuccacagcugguggcgggccaaaaagggccaaggaccaagcaccuugccuucugauacacuuuggauguuuccucugcuccaaaucaugugcugaaauggaucuuuagccggguauaguggcacgcgccuauaauuccaaguacuugggaggcugagacaggagaaucacuugaacccaggagguggagguugcagugagcugagaucacgccacugcacuccagccugggccacagagugagacuccauuucaaaaaaaaagaaacgugauucccaguguuccagcacuagagguggagcucagugggaggcgucugggucacgggggcagaccuugcgugaguggcuuggcuucuuccccguaguaaugaguucucccucugaguuuagguaagagcuggguguuuaagagcccagcaccucccucccucucucaauguguggugccgccuccccuugcccuaugauuggaagcugccugaggccggugccaugauccuaguguagccuacgaagccaugagccaaauaaaccucuuuucuuauaaaugacccaggcucagguauuucuuuauagcaauacaaaauggaugaacacgccuuucccagcgagcuccuuuuuuggggggaggaccacugaaggaaagaaaaaauccuacacugugaggucucagcauggacagaaaccagcggagaacucagaggcaggaggcacugggaacaggggagagggagggagguggccuccuaagcaggggacgugcuuccagauggccccucuccugacucuguuaccuggaaacagagugggugagaaagacccuugucuucuuugggccuccucuauaaaaugaagcagccaggccacacaagcucuggcggcuuaccagcacuuuccaucugugaguuaaucagccaacuggaaaacaguaaaccucaccagaaaaccugggcugggccaccuccuaagcagccuaguuggcuguguggacugucugcaccuuuuuuuuuuuuuuuuucuugggagacagugucuugcucugucaaccaggcuggagugcuguggugugaucucggugcacugcaaccuccaccucccagguucgagugauucuccugccucagccuccugaguagcugggauuacaggcaaccaccaccacgcuuggauaauuuuuguauuuuuagcagagaugggguuucaucacguuggccaggcucgucucaaauuccugaccuuauaugaucugcccaccuuggccucccaaagugcugggauuacaggcgugagccaucgcacccagcccuaucugcacuuaucgaggcuauugugugucacagcccaggcugaccugcagcagguaugugucuaaugucaauuagaugggggcccuccugcccagccuaucuacaagucacucaggaucacauguuaaguguccucaaaugccuucccuuuccugcuguugcuacuucagaagcaguugugcagaauccagaaugcucagaagacaucugugcauuauuuuccaaucugccgcaccucauuucuuuaucacuuacggcaauaaaccagccacacccucugcaugcccuggaguugcuuuaauaauaagguuaggccaggcucaguggcucacaccuguaaucccaguacuuugagaaaucaaggaaggauggauugagaccaggaguuugagaccagccuugguaacacaguggagacccugucccuacaaaaaauuuaaguuagcuaggcaugaugguaugugccuguagucucaguuacuugggaggcugaggugggaggaucacuugaguccacgagugugaggcuguagcgggcuaugaucauaccacugcaauccagccugggcaacagggcaagacccuguccucaaauaaaaaaaagaauaaaaaaacagaauaagauuugacagcauuuggccgggggcaguggcucacgccuguaaucccagcacuuugggaggccgaggcagguaaaucacaaggucaggaguucgagaccagccuggccaacauggugaaaccccaucucuacuaaaaauacaaaaaaauuagcuggauguaguggugggcaccuguaaucccagacacugaggagacugaggcagaagaaucacuugaaccugaagcagagguugcagugagccgagauugugccacugcacuacagccugggugacagagugagacuccgucucaaaaaaaaaaaauaauuuuuuuuuuaaaaaagauuuaacagcacuuaagaguucugucacuuacuuccggcucugggcugcccuccucucggcugaagacccugagacguacuugaacacggauauccuccucaucaggcugaaggggaaggucugaucgagcuucagugccacucgcucugagaggucgauggaauagcaguaggugaggccaucugagguuggcguguuaagugaaacuggaggcagcaaagggaggagggccgaacacuccccggggagaacacagguucccacucacucuacagaagccuucaugcuuagcacgcugcacacucuggcuggaguuugcagcucaggggaaacccagagccaaagguuuguuuuuuuuuuugagauggagucucacucuagcagcccaggcuggagugcaguggugugaucuuggcucacugcaagcuccgccucccagaucacaccauucuccugccucagccuccagaguagcugggacuacaggugcccgucaccacacccagcuaauuuuuguauuuucaguagagacaguguuucaccauauuggcuaggcuggucuuaaacuccugaccucgugaucugccugccucagccucccaaagugcuaguauuacaggcgugagccacugcgccugaccccagagccaaagguuucuacucacugugccucaccgggaaugaaugcgcccagcagcaggggguauuaaugcugucccuucuccuacacccaugugugccaccacuugcacccuucuagccacugcagucagucagaagccaggacaugccucugcugguguagcaggauaaggcaggaggcuguaccaguaucauccugagggacuaacaccucguccuuuuaucucaaauagagggcaccugccucagugcgaccaugugagcuucaugugggccucucuggcugugcuuccuccauacccugucaccauccccagcaacuuggugguauccuggucgucugaccuaagucacccaccacugauuaggcagccacaaagauucagccuuugaauaaaggcuaugcuagacucucccgaaaagagcuuagaaacaaaccucaaguuucaagccaaucuucaaguaaguuaaccgccuaucagaacaaaagucaacauuuuuuaaaggaaaacaacaaaaucuagagccccuaauacagcauucagugucuagcauaaaauaaaaaauuaccagauaugaaaaaaaaaguaaaaaaaaauuaugaucagauaugacucggccacgguggcucacaccuguaauccuagcacuuugggaggccacgguggguagaucaccugagaccaggaguucaagaccagccugggcaacauggugaaacccugugucuacuaaaaagaaaauauaaaaauuagccggguguaguggugcacaccuguagucccagcuacucagggggcugaggcaggauugcuugagcccaggaggcagagguugcagugaguugagauccugccacugcacuccagccugggugacagagacucuguuucgaaaaaauacaaaguaagcccaauuuuaucuacuugacaccccagacccuccagccugguucacccuuugacaugcguuguucuauagcucucugcuaggaaggauacaggccagcccgauggacagcccgcagacauuacugaggaaagaggucuggggaaugagccacgaggcacccagcaggagccacggaaccaggacugagggcacaaccaugccaaacaccagggcccgccucauccgagaacggacgguggugacucccagcauggcaaaggccacuggggugaaaccucuggcauccuccacuucccccagcuuugacagugaugacacagccucgaaugacaggaagaugauagcggagaagauggcgaagaucacggugaagaagcaguggcggacggugcccacgguucucucgaaauugccagcaaagcgccagaugaugauagcgccgcagagcagggagaugggauucucguagacaaagauguagguuaccagccuguaaacugcagagggagucggguuagaggccuggcggcggguugcucccaggagggaagccagguuauaagccgccuaggaaaggcagagagccccccuccgugacagagaagugagagccagugagucgcagcaggaggcaauacaagcagugcguucaacaaugaaggacccagagccucaaaggagaggcaugaauaucuaaucccuacacuuccccaggccuggugcaacucuuagcgguaacugacuuccagagggaaaaaaauaauacuuuucgguagagggcagucucugaauuuguaaagugcuuuauaauccuuuuucagguuuucauacugaccuaccucacugggcaguuugaggguuaauuaaguguaacagcuucgggguggauugagugggugucacuuaacacucugugugccagucuccucugcuguaauccugaccccuccuuccauaguggcuguucagaggaagaaaaaagggaccaugaauuauuuugcagcuguaagaauuauaacacuaucauuaacaauaaagauuauagaaauuauaagucuccucagaaagugcuuauccgaucucacagguaaacugaugcuuuauauguaauaagacaucaaagaauccuccuuuuccuuuuuuuaaauuuuuauuuguagagacaaagucuugcuacguugcccaggcuagccuugaacuccuggccuccagugauccuccugccuugaauucccaaagugcugaaacuacacauacgaaccaucauuccuggccuuuuauuuuucuaaaagcaguuaucgccaggcaugguggcucacaccuguaaucccagcauuuugggaggcuuagguggaaggaucacuugagcccaggaguucaagaccagccuagguaacauagugagacccccgucuuuaaaaaaaauuuaaaaauuagucaggugugaugauguguacuuguagucccagcuacuugggaggcugaggcaggaggcucgcuugauuccaggaguugaacgcugcagugagcuaugauugcaucucugcacuccagccuggguaagacgaagacccuaucucuaaaaaaauuuuagaagugguuaucucuuaaguauuuuuaugucccugcaugcccaaauacgacuaaacucaaggagagagaccaaagaacugaugguaauauuggacuugggagucuaaagacuuggaguggaaucuuggcucuauuacauccaggcuggcugaguuuaaucaugucacagguccucuaggcgucaguuuccucacuguaaaguaacaagaguuagauugaggacuucaaaggucccuuacgucucuaacgcucacauauccacgaaacccacacccagggaagcagugaaccccagaaagugggagguuaagguuagguuggcauuuugcuucugucugugagguggugcuauguauaccuaggguggggggaacaguuuuagauuggaguggggaagcaggcuauggaaccauauaccucagucuggccaucaccagaggcuucauuaucugaagaguacuucauuauuuguugaguauuuccaaaacugaaauuccaaguauaaacaugaaaagauucuagaagcaacuguacaugauuuggagauuaucuacccgaaggcucuaguuccaaaacaucacagaauaaaaaaaaaaauauagauuccuaucucaauugcaugacgcaacagcucugcgauucucugcaugaaaccucaaucuuaucuagauaacgggccaauaacagguccuacgucaugggauccuugugaggguuaaacgaaauuaauacauaucagugugugugcuuugcaaaacagcaggagauaugcaaauuuccuguguuccucucgagaaaaugaggaagacacggagacuaggaaugucuuucaggaauggauguuuauacuuaauuggucugcaaaauuucucuccccuagagaaaaacaaacacuucucuccaaaggcagaagacacccugguacccccaugagcugggaauggcagucaagauuaagauacagaugaaaaagcagaagaaauuccaaaucucaagagggcaggacguuuauagggcuuauagggguuuguggauaaaguccaauugucgugauguaggugagagaaaaacguuuuucaguggggcuuaggccuaaagcagacguagguguguaugugaaaugggagggggagacgaaaaaucuuuacccuuggagagcgagcauggauuugcuagcgaauggauuuggggccuuaaccagucugguggcgacagggaagggaacaaauucggguagggaagggauuacagugaugacgaagauggggucugcagacaaagguguggaacacggagagcaagagacggugcuggaggucgguccuccggggggcgggcauggugaugaggaccgagacagggggagacuggcggugaggccugaaggggcgagucccggaggcuagagcccaggaaccggcaaagucggaggacaaggacucgccccgcgaucccggcccgccccugcucaccuugccaguugcgaagggccucggacuucagcgugaggcccgagggcgccaggggcugcugcagcaggaacaggcgaggcccggaaaccagcagcgagagcagcgcagugaagaagguggcggauggcaccucgggacacaagcaccagcugcgacacccgggccccgaggccgccauggccgccgucguucccgcgccccgccucgacgccggcugccgguccucugcuccuuccgccuccucgcggcaguuucccuuggc

SEQ ID NO: 191554 - RNA, 18538 nt, Homo sapiens
uuacagaagggaccuugaaaaauaaaaucaaggacggcuuuuauugaugcgcccacagagccacccacaauuuggaaggcaugaugaugucaauacaguaaucaucaccaaagcaaauuaaaauacaaaguuuaucugcaacggcuuugcagugacaugaugccuucauaaauuaaggaaacuggccacccgucacagcggcucacuucagggucuucacgaaaucuucccccuucuugauggaggccuucagcucggggauggcauccgagaucaucuucuccucaaaagaggagacuuugccgaugcccagguucuucucgaugcccuuuuucugagggagaugggaacauguuaaaaugaaguuuccaggaaagugcuuguuagagaaaccccgaccugucgcuccaucagcccugccgaggagucucucuacacaugcggguucugggugccuugcuggggacgccuugcugagcaggugggugggacugagcugcggucaggagugcgaggcucagagccagagggugccaggcaggggucccagcacugugauugucuaggcagguacccuggacaaugacugaccuuccaaauguguuuccuuagcuauaaaacaagcaccauccaccuucgugaacacgaggacaaugcgacaagcaccuggacgccaggaacucaaucaucaggaacacuucaccguauucuccccaacagagccuguuucuggguucuugucucuccccgcagguugguaaaggacugaaaacauugucacagucaccugaaucaggugucacuaaguagguaaaugucugacauuggcaaaaacaggcaucucugccaccgucucaccugcagaaacugagcacaguuuguguggcaacagccucaguccucaccucaacucaauucccuccuacugcuuccccuggcucaagggccuaugagaaccgggugcgucucaccugcaggcccugccauuccauacaccugcaccgacauggggacagaacuauaccaucgagugccugucucucaccaaggccuggggccauagcugaaggaucuuucuguaucggagcaucucugagaaagguccugggguggcccagugagccauauuacuuucuggccacgugaugaaggcaaccacacaucugccucauuucugcccacaggugagaaauggaaacucggcuugaggggguaugaguaagaccuaaggguuucuguuugcugaagacucaggcugucuggauggggcacacucucgaagaggaauugggccuggccgccccccgcagucagaacaagaugaacaaggagcgacagggagguguucaggcgggguagggaggccucccugggcugccuggagauggagugucuuaucagucaauacuccugcagcugcugggcacccgcugucaaacugcagggaaggagacccacuugcugggagguucacccuucacagucugugauccucccagcucuuuuuucucgggugugcguccacccuugaaaacaacagcacucgccaggcaggcacaugagcuuacugcauaaagggccagggagagcuccugaggcuuaagcaaagggaacgcccccuuauuccacagucagaaggacccacgccuggauacguaccccaagcagcagcgguguggagaaguagguacauuccguuuccugugacuuaacgaaggaacauuccacaacaccuuccuuuccauucauugcauccacaagggagaagacaaagcgggcgccggcauacgccauggagaggguggcagagccuaggggggcacagacaggucagccuggcuggugccacaaacgugacgcccaggugagccggccccgccagccaagacaccugcacaccuuccagccugacaguggagaauuucagucagcaccccgauuucuuguuacuuauacaugaaugguguagaauugacucugccacccucaaaaaugacucucaaccccacaaagcaggccgagcugcccucucacacagggauuuuccaccaggcaacugcaaaucaacacugaaaaggaucguccaugcccagggacaagcagcauuucuccccaacccugagcucucgcagggccucacuggcacccagccccggggcugccugagacucuaccugcuccggcuuuagccuugaccaccuccgugccggccuccuggauccgcccagugagugcugucagcugguccuggggaaaguccaccuugggggugcacugcaagccaagccaugggaucagugaguggcuuccggcccaugaccccagacccacugccucccacccccacuauucccgaccucuccucucccucccaucaccagggcaugggaaagguuuucuauaaagaagaaaaagaaaaccuuuauagaaaaaugacaugcuauucugggcacacugccuaugggguagcccugcuccacaaggagcagcaaaaaaauaauaauaaaaagauaaaaaaaaaaaagacgaagugaaaucaacucuguugggaaguguggugaguccccuacucauuuguuuuuugaggccagggucuggcucugucgcccaggcuucaguggugcaucauagcucgcugcagccucaaccucccaggcucaagcaauccucccgcuuuggccucccaaaugcugggauuacagguaugagccacuguguccagcccuggacucauuuuugaaaaaagcaccucgcccgcuccggccuaaccaguaacccggugagguucccaacagugguucuccuugcgugcuggagcugggcccugagcagcuuccacccacauucgcuccaggacugacaccgcccugcagcagaggggcggggcugccuacaacaggagcccuuccaaaaccuggcacguggccaggccuucuccagucuaccgggaucaccucaaagcagggccugguaaagggaauccugaccucgaagccccucacagggucauaugcguguaccugagagaucagggggaugauggucuucccagcauggccaccaaugacagggacguugacucgagcuggauccaaacccuggugaccaaaguaugaagcuggaugaguuaacaagcucuuucacuguaaaacaugucacagcugcccacagccccaacacuggaaaagccccccagaacucaggguggaacagagccagcuaggaggaggcccuguccagccccugcugcgcuuggaucuccugccacggugccccaaaaggcugagcaugagcgccagcaggugccgugagggcuugccgccgucuggcgaggccaucgcaaguccuuccuucauagugagcauuugugcccacuguggaugggcaugggaggaugcugccuccuguggaggccccccccgggccuggcauccucuuucccagagccggcuccacuccccaugcacaagcccagacuccucccuacacagaacaauccaaguucccuuuucuucaggccccacagaacaaaauucaaauccauuccaggauacccaugaguuagaagucugccaccucaaacagugauugggacagaaagaacaaacugacuccuauggcuccaaacagcacaguucaaggcugccucauuucuuaaacuggagguaccacacccccaagaaucugugaaccagguuuuuguuuuauuuuuugagacagggucucuaucccccaggcuggaguguaguggcacaaucuuggauggcugcaaccucugccuccuggacucaaugauccucccaccucagccucccaaguaccaaacaccuccacacccaaucuauguuuuuuaaauguuuuguacagaugggguguugccauguugcccaggcugguccugaacucccgggcucaagccauccuccugcguuggcuucccaaagugcugggauuccaggcaugcaccacugcgcccggcugaaccaaguauuucuuaaaacggacaauaaccuggugggaguaaugguagcgagggaacagccaccugccccgauggccauggccacugaagagcccaguccuagguuggaaaaugagccuggucugggagagggaggaucagccucacgcacgggaaaaguaggaucagcuucauggagccgggagccaaagauccgagaggcuuagcuuggugguguauaagcacacacgugcgggcacugcacggucaccagggacguggggcugaagggacacagcccugcuuuccagaggcuugcccucaaauacaagacuccuagaaauguauguuccaauggugcaugcuaagacgggggacaaggcgacuuugcagcaaacgggaacaaggcauuggccugggagguccuggagccacguugaaagggaauauggugggugagaggaugagggaggaaccagccaucggaaguuuaaggauugauaugcauucuugauaugauccaggaaauuuccagaaugucaggcagccagggguaaugacaguccacuucacuguuggaggugggggacgggaucucccaagggccaagguacccuguccccaacucuaacagugaagcuucaaggcugagauaggacugccuaacaggacuuucugugaggacagaggagccauauguggccauggagcaucuuaaaugugguuuguguggcagagggauauaguuuuaauguuauuuaaccauaaauagccaaauguagcuaguggcagcuauggugcagggcaggacuagggccuggggugugcccagcccugagagcccacgagaaugaacucuguugccuccaggacgccaggggcugcgccucuggaggugggaggugggauccugccuguuguguccacuuccguacugcggcaaucccgggggccucuggacauacaccugcgcucaccugcucacucaaacuguuuuuuuuuuuuuuuuaaagagacagggucuugcucugucacgcaggcuggagcgcaguggcgcaaucacagcucauugcagucuugaacuccuggguucaagcaaccaucccaccucagccucccaaagugcugggaugacagccgugagccacugugccaggcuuaaacugucucuucgauucaagugucucucccauuccauggaacucuaaggccuggggccaugccuuuugaaacucugugacccccacaccuguaacagagucccacuaccaggcccucggguacgugcugccaugucuguuacaguggggcaucucuaacuccucagaagcagaugugccugucacucgggaguaaaacggaggccaagggugcugcgggugcacuuccuaccaugccgcacguauaaccuccaaucugccaucagaacaaaaaggccugaagcucaagagaaauacuuuuuggggccaaaggaagugguucugcuggcuccacaauggaagcaagucgaaagcaggcugugcaaagcacuaaggacuccaggcccggcacuggcaccaaaccaagccgagcucaagccacacccagcagcucagucuccguccagcggcccuagggucaggcaccuggccaggccuggacucuccagggugagcuaccacgggcaacccaaaaaagucagugccagggaccagggccaacaacaauucugauaccucaggacuucuggcacuuuccucaguucuucauguuugcuaauuuucccacccuuuaucuaguggccaacagguaaauccucccaggaccaguuuucaggggcaaggagaaaggggaggacugggggagccccguccaaguccagccacugagaagcccaaagaaggugugaacccacagugcucuuggcgagaaggaagacagcgagagccgggagacagacacuggccagaguagaugccuguugggccgagugccuggaacccacaggaaacacaggggcugcuuccaucaagagggcgagcucuaaaaacauuuaaaaccccaaagugacacgugaccugggcaugccuucaugucuuccacgcccguaaaugagcacggguggcgggagaaguucagaaaggucaccugagcaacacccacgccgcccuuaccuucagcucugcaacaaagguguuggcucugacgauguccagggucgucacgccgaagauuuuguugggguuguacacuccaugcuucuugaaaacuucugcugugauggggaugguggaauuaaccuaggacauccaacagacaggcauggcuugcccuggguuccgagagcagggccaagccacagcaggaaaagggcuuuuugucagaccuucccaaaggucuaacuaguccaaagaugccacauuaaacugcccugucugauaacucuguacuggcaagccaccugccagaaaggacaggccgcaccaugugaacaaagaaacccuuugcuguagaggaugcuucuucccuugguggcccuucagcuaucaacugaaaugugugaugaugccuccauggaucaccuucugcucggccgggacucacagcugcagggccacuccugaugggacagcagugcacagcggcugugugcuccaaggaagcagguccacuggcagcucagucccucugugcuaugacccugggcaggucacccuaacucccugggacccguuuuuuucuucuguaagugggggaaacgacaaccucaugaagucauaaauacuaaaugacuucacacacggcgagugcugaacacgucacccgggacgccagaagaugacagaauggccagguuucuauuaggcacugguuagcuccccaacaaagggaauagcagcucucuauuugugacccaccacccugaggagcuucuggggaacgcaggacccuuagaggccaggagcacgagcucugcaugccugcuggcauccaugccucucagugacaucauggucccugccccuucaccccaauugauccucauccucagacaccaggacccaggcuccgccaggaaggagcagugagguggcugcuguuaaaugagcacaaggcccugcaggucaagcuggggaaccauggccgcccucucagugaggacgcagcacucaacguuuccgagaguaagcagcuaccugcaaaaaccagugaguggggccugggguggcuguguguguguccgcgacugugugugaaugaggaaauggggacaacaggggaccaggaauggaaauccugaguagaaugcagauagucccaccuuauccaugguuucacuuucugcuguguuaauuaccagcagucaguugaggucugaaauuauuacacggaagauuucagaaauaaagaauucauggguuuuaaacuggcugggcgcaguggcucaugccuguaaucccagcacucugggagagugaggcgggaggaucaccugagguugguuguuugagaccagccucaccaacauggcgaaauccugucucuacuaaaaguacaaaaauuagcugggcauaguggcaugcaccuguaaucccagcuacucaggaggcugaggcagaagaaucgcuugaaccugggaggcagaggcugcaguaagccaaggucgcaccacugcacacuggccugggcgacagagccaaaaacaaacaaacaaaaaaacugcaugccauccugaguagcaggaugaacucuggcuccaucccgcccaggacaggggucaacccuuugcccagcauacccaugcgucuacaccaccugccugagucacuuaggagccauuuugguuaucagaucagcuguugagggaucaugaugcuuguguuccaguugccuuauuuuacuuuacaauggccccaaagcgcaagaguagugaugcuggcaauuuggagaaacagaaaccagagaagccauuaaguacuucccuuaagcgagaagguggaaguuccugacuaaagggaaagaaauaacuuuuauuauaguaucuuguugugauuguuuuacuaugaguuguuguuguuaaucucuuacugugccuaguuuaugcauuaacuuaucacaggugugcaugccuaggaaaacacaugguauauacaggguucaguauacacaugguauauacaggguucaggguucaggcaccuacugggcucuuggaacauacuuuuccggcuaaguaggagcuacugugucaaaaagggaaucaagagaccaccacaaucacggcugaaaggagccuugagaauggacuucucuucagguggggaaacuaaagcagagagagacguggucugcccacagcacaaggcuggcugugacaacccucauucaguucaugcuggaaggaguccuuaggaagugcacggacgggccucugcuuagugcacccgaccucuccauuucagccccuucaucuguguauccccccauccccccagcacaucagcagccuuugcugcaaaccgugagcuuuucacgcacugucagcaccuaaacaccugccauagcugcaagagccgggugcugccacacucaccggauuggcaaugacgcagaucauggcuuccgggcagugcugggcacaggcagcggucaggguggccacaaucguggcauugguguugaacaggucgucccgggucaugccuggaaaugauccaauaugagauguuaacagagaacaccacaaauuuccagacaggcagcaugugcugagcgccagcuguuacaggaaauuuagccacucaagguccccguuucaagucagucccucuugcaggguaaaugauccagcaugaugagugccagaagcgaggucugcauggguggagcaggggaggacaacaucugagaaggaccgucgagguuuauuaagaacccccaagguagagugggacugagaagagggaagggcguccgugcacagaggcacaggggaacggcaagacgacuuugaucccaggccaacaaagagaugugaccuuuaccccacaggaaaggggagcuggugacauuuuuccuacaacaaagcaaccagauuaaauccauuuuuaauaggaaauggauuuaauccccacaucuucacguggggagguaccagacaaggcuuucaaacacaaaccuggcuuucuggggacuccagccggaauaacuaccacaucacaaccuuucaggcagucaggcagcuguucagguccgagguagccuagaacaaacaccccacaagagaaaugucaccguuucugauucagagaggccuggaaaguucagcccuggccuuaaggccaacuaauggccucgagaaaggcuagaagcccugccuguaacgugacuuccuucuguugacgacuacugcccugcgagcugacaauucccguggcaggaacccuccccuucuacccugcuuuccccagccucuccuugcccaggccccagcuagaaugggucagcccuccagguuuccacaaaagcgaacugagccacugcuugucuucauccuacucgugagcauuguaagucacacuuggccuccaguuagaaugagaggagcugcucauuccccaucaccacaauccugaugaaaacuccuuuuuuuuuuuuuugagagggagucuugcucugucacccaggcuggagugcaguggugugaucuuggcucacugcaaccuccaccucccggcuucaugugauucuccuguuucagccuccucaguagcugggauuacaggcaugguccaccacauuuggcuaauuuuuguauuuuuaguagagaagggguuucaccagguuggcaaggcugguuuugaacucuugaacucaagugauccacccaccuuggccucccaaaguacugggauuacaggagugacccacugugccagcccaaacuccuugaucagaaggcacugaaggccaggaaagaaaacguccugugcugaaagacucuaaauauuacuauuucguuuacuccuaucaucugaaggaaaaaguauguuuucaaagauuucagggaaauuugcuacaauauccaaaaucugcuucgaucuugacuuuuuccuuaaugcaggagccuucuuaacccgaauauacagcccaaaagaaaaugggcaacccauucagagaacucuggaaggugcacgaacauaaaauuugccaggcagccuccccagcuguucacaccaacuuaagacucauguaaacaccaucagacacgguaucgcauacgcugucagaggggaaagaaaucaguagaaucuuucuggacagcaauuuggaacuuuauaguaaaagcuuugaaauauucauaccuacuaauucuguguuuagaacucuaagacuucaacaagauguaaagauaaagauacguacugcaacuuacauuaauauauuuauauuuacagaagcaaacaggaaacagccaauggucaacagcagagcuaucauaaaugauaaauuacagcuuuaagaauaauuuuaucaagaauucgggcugggcgcaguugcucaugccuguaaucccagcacuuugggaggccgagguagguggaucauuugaggucaggaguucuagaccagccuggccaacauggugaaaccccaucucuacuaaaaacacaaaaauuagcugggcaugguguugcacaccuguggucccagcuacucgggagguugaggcaggagaaucacuugaacccaagauggggagguugcaguaagccaagauugugccacuguauuccaucugggacacagaggaagacauggucucaaaaaaaaaaaaaaaauuuggugacaugcaaaaauguugauacauugugaagguuaaauaagcagcauauauaaauaugcauauuuaugaaauuuuuuuuuuuuuuuuuggaaacagugucucacuaucucaccuaggcugaagugcagugguguaaucagggcucacuguagccucaaccuccugagcucaaguaauccucccaccucagccucccaaguagcugggaccacaggugugcacuaucacgcccagcuaauuuuuggacuuuuuguugagauaggggucucgccauguugccugggcuggucuugaacuccuggacucaagcaauccuccugacuuggccucccaaagugcugggauuacagguauaagccacugcacuaaguccagugaaucauuuuccagacaacauuuacugaauauccgacacugccuuccacagacggggagguuucccaaagaggccgugcuuuuugagaagcuggcaagauaacccugggguggagggaagguggcccgcagcugagaccaccaccuuacuguccccaaauccucaccagagguugcugacacuucccucuuccccauccucauacuacuuuucaaauuagaaaaaguagaaaaugggaugauuaggcuaccucacauuucuaaaagacaccgcuguuucaauuuuuauagacgccaagucuaaaaggguguaaucacuuguaaaauuuaaauuuaaaacagagaaacccccgucucuaaacauuuaguuucaucuaagaaucuuacucaaaacucgaauccuggccuacuggggacaggaagcaagucuccagggucagcgcgcccaguaccuuucacagcggcuuuggucucgauguggcucagaucugcggccacuccgggugugugcgcgauaucauagagggucaggcggcucaccaaggggcuguucuucaggagaagugaaaguggcugcccgaugccuccagaggccccuagcacagcuacuuuagcauuguucuaaaaagaggcacagagaaaggacucuuaggaggaaaugagcaugaaaaggauucacaugguauccuauaauguugcacugggccucuuuuuacugcaguugccaaagcaagauacaaucauuguauuuguaacagucucauucuggaagaauucaggaccuucauuccaaagguccacuuucaaauggggagaauuuaugucuguagagucugugauacucaggguacuucaaaacccuccugaaagaugaagaacaagcuggacuccaucaggcagcuggacugguaacagcagccuucccuucaaccugcagcuuuauaaacuauaaacacacacugagugccuagcaacaggcccucccgguaacugagguugcaggaagaucccugcuggcucuguaggagacagguaaugagaugcauuaggagcagggagaacacugucacagaagccccuugugcaagagggcagaugggguugcggcaaucaacucccugcagggguggggaaucagagaagauucauccaggcagcaaacuuguggcuggagccucaggcaggacaaggagcugccuaacaagagguggaagggguuacguacguugcgaaagacuccaacccuccuggugagucagaucugucaucucgggcuccaguaucucacacugguucuccagccuaggugugcaucagagccaccugcugagcuaaugaagcccacucaggacuaggcuccuggaagcgggauggggcuuaggccuuggcauuuuugccauuuuccccagaugauuuugauaccaaacaguuugagaaucacuguuucauaccaggcuaaucagaagaacaggcagcaaaguagcagcuggcccugggcauuucagcuuggaacaguuaggaaagugauggggugaaagugacccggccccgcauccagcaaucacucccguuauucgaaggcacucuuccccucuaggucucacucaaggucugaccaaaauuacagccauacccagggagcuuguuucugaucuaaacucacaaaugagaagcacagccgaucccuggcaggcaggcaggcaggcagcuaccagugagggaagaggcaaacaaaguggcagacacgggaacucucggcaccguguguggucaucuggggccugacagcaucacugcacagucuucuacaguagcugaggccagcuaauaacaggcuuugguuaucagaaaccaaaacccaacaaaccaaaauccgaaucaagacgcuuacccaguggguuucugcucaggaaauuaaacuguggaagcauauacaaccaacauuugaauucaaacagguuuuugaguuucaaguuggugcuuuaaaggugaaccccuggcugccuggaaacuugaaccugucagacccgcucagaaccugaggucgggcaggcucagccucacccacuucuggaucuucagcucucacucccacaucuugugugagucucagggacucccaaaucccagcucugcauucccaguucuguuaggcguuccauggguuccacaaacucaacuguccauuuauccugccccccucccuccaucccuggucccaaauggcacuuguguucacuaaauguaaacuucuagaaccaucuucugccaccuccuucuuaucagagacaucaagucaggacaugaagaacuuggcagcucaaccacccucccaacccgcuccuccucuucauucuauuccguuaucuaacuuagguacucagcaacaccuccaaagcaugcuuucccaaaaucaaagucuuaaucauuucacucucgugcucaggcuggcauggugguaugcaccuguagucccagcuacucagaaggcugaggugggaggaucacuugagcccaggaguugaggcugccgugagccaugauggcgccauugcauuccagccugggaaacagagcaagauuccaucucuuuaaaaaaauaucuucugggcugggcgugguggcucacaccuguaaucccagcacucugagaggccgagguggaucaccuuaagucaggacuuugagaccagcuuggccaacauggcaaaaccccaucucuacuaauaauaaaaaaaauuagccagacaugguggcgcgcaccgguaauccuagcuacucagaaggcugagacaggagaaucgcuugaacccaggaggagaucacaccacugcacuccagccugggugacagaccaacagucuaucucaaaaaaaaaaaaaaaaaaaucuuccaaagcuuucaugccuccaucacucagccagggcagugguuccacaggggaguggccaagacaaucccaccaggguggaggaugaaacugcugcaaugaguguaucuuuuuuuuuuuuuuuuuuuuugagauagggucucccucucucacccaggcuggagugcaguggugcgaucuuggcucacugcaaccucugcauuuucgguucaagccauccuccccaccuuagcuguagcugggacuacagguacacaccacucauuuuguagaaaugagguuuugccacacugcccaggcuggucucaaacuucugagcucaagugcugggauuauagguguaagcuaccaugcccagacugucucuaucuuuaucuaacaaagaauuaaucucuaccaagaaauggaccgaccugugcccucgcuagggugcuuaaauggaugggucccauguguacauaaggugaacacaacaugggggagggaggggaagaagacugccucacugguuucuuugcuuucacuuugucaaggugaugucacuguuuguauauuacaggaugucaccaacuuaauuuuuacaaaaccacaauccuuaaguaguauaaucuuuacaugcuuugcaaugagaugaaaaucuuugguggcccggagguuagaucaugaucuccuugucaaagagcugucuuccagacccgcugaccuuugcuggguggcagaguggcuaucaacagcacacugcuuggcaacuguguugaaaaccgacauauguuaacacugccuucauuuauaaguuuuaacacuuuauaacguguuaugguuuguuuuaaaauuucuacuugaguuuauauuguaauguauauauuaguacauauaccuauaaguaaauacauuggggcuaugugcuuccuacgcuuuuacuguuaaagauacaggauccagcuaggcgugguggcucacgcguuuaauccuagcacuuugggaggcugagaugggcgcaucaccugaggucgggaguuugagaccagccugaccaacauggagaaacccugucucuacuaaaaauacaaaauuagccaggcaugguggcgcaugccuguaaucccagcuacucggaaggcugaggcaggagaauggcuugaaccugggaggcggagguugcggugagcugagaucgcaccauugcacuccagccugggcaacaagagcggaacuccgucucaaaaaaaaaaaaaaaaaaaauccaaagucuggagaccacugcaccaugggcucaagcccaucuuucuuucugcuuucaucagcugccuucucaacaaugucgcuuguaugcccaacaggcauuuuaaauugaacauaugaaaaacugagauccuggccgggugugguggcucacgucuauaaucccaguaccuugggaggccaagacagguggaucaccugaggucaggaguuugagaccagccuggccaacauggcgaaaccccaucucuacugaaaauacaaaaaaaaauuaguugggcgugguggcagcaccuguaaucccagcuacucaggaggcugaggugagagaaccacuugaacccaggaggcggaggcugcagugagccgagaucacgccacuguacuccagccugggcaacagagcgagacucucaguaaauaaauaaaaacugaacuccugauaucuucucccugguuaaacccacucucuucuauaagucuugccuauuucagcccaacuccaaggcccaaaaccuuggugucauccccgaccccuuaucuaaucacacaucagcaaauccuucugguaccaucaaugaauacccagaauucaaucauuucuuaccaccugcaccuagauaaccacaaugaacuccuaaccuaccuuucucucacuccuaagaccaucuuguuaaaauggaaggaagagcaagucauuacgcagcugaaaacccucaacuggccgccccauuucugagaaaauaccaaaguuuuacaaggccuguucuguuaccuccacugccuucucuggaacuacccuagccucauuuucucaaaccuucaaggcaugccccaugcuucuccaagggcucucagcuacauccugagacauaucccuuaccugcaauacucuuuccauaugaugugaucucugcuuccuucagacuuuacucaaacaucucacucugcgugaggccuacccuggcugauguaaaacugcuacccucggcugggagugguggcucacgccuguaaucccagcacuuugggaggccaaggaggguggaucacuuaaggccaggaguuugagaccagccuggccaacauggugaaaccccaucucuacuaaaacuacaaaaauuacccagcugucguagcccuugccugugauucccaccuacucgggaggaugaggcaggaggauagcuugagcccaagaguugguugcagugagccaagauggcgccacugcacuccauccugggcaacagagugggacucugucagguccauccuggccaacauggugaaaccccaucucuacuaaaaacacaaaaauuagcugggcacgguggugcgcgccuguagucccagcuauucgggaggcugaggcaggagaaucgcuccaaccugggagguggaggcugcagugaaccgagaucacgccacugcacuccagccugucgacagggcgaggcacugcaucaaaaaaaguaaauaaaauugguacccucuucccuaacacaagcacccuacaauccccauuuuucuugcauguucaucacuauuuuaagauacuuuauaaugaguggggcaauaaguaaaauaucuaguaauuuccgugagagcagggacuucuguguuuuguucaccgcuguauuuccaguaccuagcucaauaaauaugucggauaucugaagguccuaccaaaacucaaccucucccuggacaccccuguccucucuuugguuggcugccccucccccacaccucaucccuccuguccuguuuacucauucccuaagaccuucaucgccuccaccuguccuaaguuuacucauucccuaagaccuucaucgcuuccaccuguccuaaguuuacucauuccugucccauaucaagugucacuucucacuuaucuugguauccccugcagcacccagcauaguuguuggcaagcacagguacuuaauguacuuaucuguauacagcugggcccccacuucaccgcagcgcaaaagcauuugguacauucaacuuacaaugggguugccugugggaacccauugcaaguugaaaauacacaaaguuaaacucgccuuuugacuuaggauauuaccaacuugcgauggguaugggaaguagccaucaauccaggagcauuuguauuuauuuuucaaaugaacuggauguacaggaaacucgagaacuucgaugauaaauuuggauuccccuuuaaaauuaccucccucuugggcgucguaauuaaaaggcaaugcgagcaccuccuggguucucaaaauuagguuuaauuagauucaccugguaaaaaugcggacccccccccccccccccgcagucuuaagcuucuucaaugaacccagacgucuguuuuuuauuagcuuucuggugauucugacacacugcagaguuuaagaaccaccauucuagaagauggcuaaaaauagccuaggcuccuaggcuuaaguggucgcgggccaagucaagcacuguuaagacaccuggcggcaggcucaguccgcccacagcaggagagauccuccaaaaagguuaagaggaagccgucuucaggucagaagcgcugaauucuaauccucuggccaaaugacuguaacccuggcccaguucucuagccucgguuuguccauacuauggaauuaggaaguauacgauuucuuuuauucacgcacaacucacacggaugcugcaaggagauuagcuacgucaaagcaauggaacgcugcagaaaaaaacguaaguuuacuuucagaugcagagcccugguuucccaaccuugaaggcgugcaagccaagagcagguccucugggaaaucugggagaccugggggaacccugacaaauggaccggcccuggagcgggacuaccucgcccccuuuuccccggcuuucucccccgcaccuccaggccagugucagggccugccccgggcgccacagucuccagccagugccgggcaucccugcgguccaggcuggccuggagagggucagagcugcccgcgaaccggggacgcacguggcccgggccggggggccuccgccugcaggccgccccucgucuggccuaccugggccgaggugcugaagcugcggcggagagcagcgcuggcaggccgggcgagggcggagagcauggcuggagcgggaggggcaccgacuggcaggcacaggagcuggugacggggaagugacuccaacgaccuccacacugcccagcgcc

SEQ ID NO: 191555 - RNA, 8655 nt, Homo sapiens
cacggccgcgccugcgcacuggccacgcggacggcgcgauggcggcggcugccgccgagacccccgaaguccuucgggaaugcgguugcaagggcauccggaccugucugaucugcgagcggcagcgcggcagugacccgcccugggagcugcccccagcgguaaggggugggagaggggccgcgcccacaaacgucgcucugcaucuggggaaacugagguccagcuuggccaugauaggggccgggaucgaagccugugagggacccuuacgguaggggugaugcagggugaggagaugagggcuuuaaggagcgggcuugggaguggggaaggagcuggaacguggguggguucgauuacaggucaccucggggacucuggggggaucugccuguaaaccucgacguagccucucgggucuggcgcugggagcuucacgggccugcagggagaugacacggaaagggucgaucgagggugcugaauaccaguccaacggugccugaaggccguggacugcaaugggcaaggagacagugaauuccaguuaacuaacgaaaaggaacucaaggaucgcugcaacccaggagcuggaggcugcagugagcuaugaucgagccaccucacuucagccugggcgacagagcgagacucugucucacaaaaagaaaauaaauaaaaaaagaaaaagaacucagcgccuuugggcuggcauggaaggacugugguugguugcaagggcauuccaacccagaaaacugcgugggguaggaagguggauuggugaugccucaggugagagagaugaggcuggagagguuguggggggggggaggucugaucacagaugcuccccggugcaucagcugagcaggcuggacuugucccaaaggcccuggagagcucuugaaggguuuuaaaggagugaugaagucaaaugugaauuuuagaaagauccugggaagggaacgggcagauaugaagguguggaggcugguaagccagugaagacugccccaacguccaugguaaaagugcccaagguccuauggaaacagcauggcaugccucaugaauuaaacauagaauuacccaugauccgcaauccugcuucuggguauauauccaaaggaacuaaaagcagggucuggaagagauauuugcacacccauguucauauucacgacauuauucaugacagcccaaagauggaagcaaaccaagcaucuaucaagauaccugggccggguucaguggcucacgccuguaaucccagcacuuugggaggcugaggugggcagaucaccugaggucaggaguuugagaccugccuggcuaacauggcgaaacccugccucuacuaaaauuacaaaaacuugccgggcuuggugaggcacaucuguaaucccagcuacucgggaggcugaggcaggagaaucgcuugaacccaggaggcagagguugcagugagccaagaucgcaccacugcacuccagcucaggugacagagcaagacuccuucucaaaaaaaaaaaaaaaaaaaaaaaaagagaugacuugauccacaaaauguggugcauacacauaguagaauacuauucagccuuaaaaaggaaggacaggccgggcacaguggcucacaccuguaauuccagcacuuugggagaccgaggcaggcagauugccagagcccaggaguuugagaccagcaugggcaacauggugaaaucccaccucuacaaaaaaauuaaccauacauggugacacguaccuguagucccagcuacccaggaggcugaggugggaggguugcuugagccugggaggucaaggcugcagugagcugugaucacgccacugcacuccagcuugggcaacauagugagacccugucucaaaaaaaaaaaaaaaaaaaaggacauuuugacauauguuacagcauggacgaaccuuggggacacgaugcuaaguuaaggaagcagucacagaagacaaauacugcaugauuccuguugugugagcuacguaggguagucacagggacagaaaguagaaggguuguugccaagggcucaggaaggggagauggggaccuguuguuuaauagggaaagaguuucaguuuugcaagaugaaaaaguucugaaugguggugacggcuguacaacaauaugaaugaacuuaagaguuuuaauuuguggaaggggccaggugcgguggcucaugccuauaaucccagcccuuugggaggcugaggcaggaggcucgccugagucuaggaguuugagaccagcuuggacaacauagcaagacccugucucuacaaaaaauuuaaaaauuagcuaggugugguggugugugcuuguagucccaguuacuugggaggcugaggugggaggauugccugagcccaggaggucaaggcugcagugagcugugagcgccacuacacuccagccugagugacagagcgagacccugccucaaacaaaaaaaaagaaaagaaaaaaauugcggaaagucugacccguuccaguggccauguggaggugacaucuucccaacccgauggcuauggaacaaggagagugagguauccaggaucucagggcacuggggcaguuccucacuggcuuuccagccuccacccuucauaucugccccuccccccuccagaucuuucuaaaauucacauuugaccucgucacuccuuuaaaacccuucaagagcgcuccauggccuuucggacaaguccagccugcucagccgacacacgggggacucccaguuuuaauguuucccgugggagggccccaggagcaggaggagauagugccaaucucaggaggggucugagcuggagucgguggcuggaaguaaagcauuggaaggggcugaggucccuggagggaagaacagagaaagacagcggcccacagugaguggcagcccagggugugaggagccuggagauggaagaggaagaggagacaggccacagagcccagggcugaguucugguggccuccgaaguccucacugggugacuccggccagaaccuccacaccuccugcccaugauaguuaugguaccuuccucuuggggcuguccuggggaugaaacuagauaauccauguaaaauguucagugccacagaugcaaauacuggcuauuucauuggcgaaacucuuuuuuaaaaauuuacuauuggcugggcauggugguucacgccuguaaucccagcacuuugggaggccaaggcgggaggaucacaaggucaggaguucaagaccauccuggucaacauggugaaaccucgucucuacuaaaauacaagaaaaaaauuagcugggcaugguggcgcgcaccuguagucccagcuacucgggagguugaggcaggagaaucgcuugaacccaggagguagagguugcagugagccgagaucgugccacugcacuccaguucuggugacagagcgagacuccaucucaaacaaacaaacaaacaaacaaaaaguauuauuauuauuuucaagauggggucucacugugucacccaggcugguguccacuagcacgaucuuggcucacugcaaucuccaccucccggguucaagggauucuccugccucagccaccugaguagcugggauuacaggcaugcaccacgacgcccggcuaguuuuuguauuuuuaauagagacgggguuuugccauguuggccaggcuggucuugaacuccugaccccaggugaucaguccaccuuggccucccaaaguguugggauuacaggugugagccaccgugccuggccugguuucuagacuuucuuuagcaugggggaacccuuagaguaccgccaggccucgggguugguggcagagcagagagggacauggggugggaguugagugacagcccaggguaugaggauugaggggugaugcugggucuggaaaggugcccugaggacaagagugaggagaagggagguugggacacugaggagcucaacugaacgcucagcucuguagggaaguuggcugcccuccuaggugacccucacgcuggugauaggcacgggccaaccccugggacaccgggguggcaucagcaaagaccuaaagagauuagggugcacagauucaagguagucaggcaguuuggggccuccuggaagcagcugaggagaugggagugcaggaggugcuguccagccucgggcugguuccuuaacuuugcugagccuccuuuguaaaauggagaaggaaaaacauguuguacaaacccuucucuuuuacaggggaggaaagugagaaaggaaaccaaucaaauucguguuagcucaagagggcugcgggccuuccccggucagccuggggcagaggcucugccugcaccucccccuagacuccagcugccuuccacaguguccugaggggaggaaugagccaucagagggucuccugagggcacacaagugccaggggcugccauggcuccaggaugugucuuuccuuuuuuuuuuuucuuuuuuuuuuuuugagacagggucuugcuuuguuguccaggcuggagugcaguagcgcgaccauggcucacuguagccucaaccuccugggcucaaaugauccucccgccucagccuccugaguagcugaaaugacaagugcgcucugccacacccggcuaauuuuuauuuaaacuuuuuuuuuuuuuuugagucucacucugucgcccaggcuggagugcaguggugccaucuuggcucacugcaaccucugccuucuggguuuaagcaauucuccagcuucagccuccugaguagcugggauuacaggcaccugccaccaugccuggcuaauuuuuguauuuuuaguagagaugggguuucaccauguuggccaggcuggucuugaacuccugaccucaggugauccacccaccucggccucccaaagugcuggaauuacaggcgugagccaccgcaccuggccuguuuuaacuuuucguagggaccgggucucgcuguguugcccagccuguggacuuguguuucuuuugcagaaaacauaccguuucauuuacugcuccgacaccggcugggccgugggcacagaggagucugacuuugagggcugggccuuccccuucccaggagugaugcugaucgaggacuuugugacccgggaggaagaagccgaguuggugcggcucauggaccgugaccccuggaagcucucccagucuggacggaggaagcagguagaccggcccugagcucauggggguugcugggcugcgcugaggagacagcccuacugcugggggccaucccccuccuugcagccacaccccucaaaccuccaggguugguagugggcgaguuccccagaccuuggggcugugggcagccagacucgcugcaggacguguguccgaugggcagaggugcaccugggcaccccaucucccugugauaugcgcuccugggcucucugccccucuguagcuggcuuggugguggugaaggcaccccauucucccaagcugcaggcgcccccaccucccauugucaccauccguguccugucuccucacacgcauucccaccuucccccuccccgggcccgccgcucccuccaacuccuuccccaccuguguccaaacauccccgggugcccccucucccuucauuguagguuuuuuuuuuuuuuuuuuuugagacagagucucgcucugccacccaggcuggaguacaguggcaugaccugaacucacugcaaccucugcuucccggguucaagccauucuucuggcucagccucccaaguagcugggacuacaggugcccaccaccaugcccagcuaauucuuguacuguuaguggagacgggguuucaccauguugaccaggcuggucucgaacuccugacaagugauccgcccgccucagccucccaaagugcugggauuacaggcgugagccaccgcgcccagccccauucuuuugugacauccuguuggauguugguacauuucauuuccucauucaucugucgauggacauuggcguuguugucacuuuuuggcuguugugaacauuuguguacagguuuuuuuuuuuuuuuugagacagggucucgcucugucgcccagacuggagugcaauaugugauauuggcucaccgcagccuugaccccccaggcucuagcgauccuccuaccucagccuccugaguagcugaaacuaaggcaugugccaccaagcccagauaauuauuauuauuauuauuuugagacagggugucucauucugucucccaagcuggaguacgguggcucagucuccacucaccgcagccucaaccuccugagcuccaacaguccucucaccucagccuccuaaguagcuggaacuaaggccugugccaccacaucugucuaauuuuuguuuuguuacuagagacagaguuuugcuguguugcccaggcuggucuggaacuccugggcucaaacgauccaccugccugggccucccaaaguguuaggaugauaggcgugagccaccaugcccagccuaauuuuuaaauuucuuguagagaggaggucucacuuuguugcccagacuggucucaaacuccuggccucaagagcucccuccgccucagccuuccaaagcgcugggauuacaggcaugcaccaccaugcccggccauuugcugucacuucugucuccuugagucugccuccuccugcuucaccuccaugaagccagggggcuuuugcuugccugggucacuaugacugaauucuucccaccuagucugugguagacaucuucguaaacucagacaccucauguccucuuugucuucauccuucaggacuauggccccaaagucaacuuucggaaacagaagcuaaagaccgagggcuucugcggccuccccagcuucagccgggagguggugcggaggaugggccucuacccggggcuggagggcuuccggcccgucgagcagugcaaccuggacuacugccccgagcggggcucugccauugacccccaccuggacgacgccuggcuguggggggagcggcuggucagccucaaccuccugucccccaccgugcuguccaugugucgggaggcgcccgggagccugcuccucugcucggccccgucggcugccccggaggccuugguggacagcgugauagcacccagccggucggugcuaugccaggagguggagguggccauccccuuacccgcccgcucccugcugguccucaccggggcggcacggcaccaguggaagcaugccauccaccgcagacacaucgaggcccgccgcgucugcgucacuuuccgggagcugucggcugaguuuggcccuggagggaggcagcaagagcugggccaggaacugcugcggaucgcccucuccuuccagggaagacccgugugaaccgccuccuuggcuccagacuugacugaucccgggauugaaaugaggagcacagaacagggccuccugcaacucacgggguuucaagagaagauggcugaccccugaugcugugagcagugugagcccugcccaggagcagguuuugaugggaacguaccuccaggcagcccccuuccaccuggaccguggccacacuuuuuugguuauuuaguuugucacagucuuggggacaugggaucauuugagcuuaaaaaauacugggggccgggcacaguggcucacaccuguaauccuaacacuuugggaggcugaggugggcggaucacuugaugccaggaguucgagaccagccuggccaacacggugaaaacccgucucuacaaaaacuacaaaaauuagccggguguggugacucacagccguaaucccagcuacucgggaggcuaaggugggagaauugcuugaaccugggaggcggagguugcagugagccaagaucacgccacugcacuccagccucggugacagagcaagacuguuuugaaaaaaaaaaaaaaugggaacauuuuaaaugauuuucaccuuuauuaugcaucuauuuucaugggguuucccgauaucucacuguccagucccuucauuuggggaauguguuggauuagggaacaggguugaagauuugaaguuuagacuaaagagcugggaacagcuucagagucaggcucagccugacucaugcuugacacccccacgcccagggaggguugggggaugugaggagggcagggaaaucugagagccuccuuccagccccauaacgcuguuaacaaguaggaaaaauuaaagcucccggccaggcgcggugacucacaccuguaauccgaguacuuugcggggcucaggugggaggauugcuugaggccagccugggcaacauagugagacccccaucucuacaaaaaauacaaacauuagcugggcgucugggcaugguggcacacaccuguagucccagcuacucgaaaggcugaggcgggaggauggcuuuaccaccaugucaaggcugcagugagcucaugaucauaccacugcacuuaacuuggcaacagagcaagacccugucccuaaaauaaauaaaaggaaaacaaaaaaagcuccucaccucccacua

SEQ ID NO: 191556 - RNA, 5479 nt, Homo sapiens
uucccaagccacagccccguuuuauuuacacucaucccaaagcacaugauggggcugaaggacgaaucucaggggagcagaaauuagcugaaggccacagaggauagagacggggggcagggggagaacagggaaaggacagcgaggauggacaggcccuccuggagcguucuccgugggcucccgcgucuccuucaggauuuggacuuggacacagcaaguccgaugaguccggccagucccgccacacccagggccaugccucccacgauggccaugcccacgaguccaucuggggaaggaaagggacagugucaggagcccggccccugcggaaacccugaccguccccuuccgccagcccugccccucaacagaggcacaccccuaccuggagucgcagggcaaggggcucuaagaacuggaagggguggggcugaggggcugccuggagggguucauuuacagagagaccaaagugcccaggcguggggaagagcggggcugaacaaaggggccgaggcugucaccuuucuucauggccuugucaaugagccgcuccaguuccuuggccugguuguucuggggcucugucugcagcaacccgcggacguacuuuaaggccuucucguauuccugcgcucggggaaacgcgcacgcgucauacacaccgcaguguuuuuuuguuuguuuguuuuuuaauaagagacggggucuugcucuguugcccacgcuggacggcagcgucgcaaucacagcccacugcaaccucaaacucccaggcucaagcaguccucccgccucagccuccugaguagccgggauuacaggcgugagccacugggccggcuacaccucaguauccaccacucccccugcccacgugaagggccuucccuucuucagcccugggggcuccucccucgaccuccacccacucccucccuccagccccaccccacggaguagaguccacaaacaaccccaacucugcgggagauaacagcgcaaggcuugggccugcacccagucucuugacgucaccuuccuccccacccccucgccacucugaucuucccucggaguccucaucugacaccgcucugcaccucugcaccccuucagccuucccgcuguccagggcuccacccuggaggacacaguaagaagguccugcagccccagaggagggugaagggaacgggguccccaccucaccuugagccgguaguuccccacggccagguagaagacguaaucccgcuguuccuccuugcucccuuugggcagcagcucuggggaggggcagagaagagggugagaaaugcuucuuuccuaauacuuuccuaauacugugucccagaggccccuuccacucucugaaugccucugugauccugggagggucacaguccuaagccucccuuucagcuccagucacucccagcacccuagccagagcucugggacagggugaaccccagcugugccaacaccccagugacagaacaugccuuuuaucaguauuacagucaacugguccauccaacugaaaugaggaaaucggggcccuggagaagccaaaggcagcgugacucaguuuuggcaucugcugugguauuuuuuuucagacggaguuucacucgucgcccaggcugcggugcaauggcgugaucucggcucacugcaaccuucgccuccuggguucaagcgauucuccugccucgguuucccgagcagcuggaauuacaggugcccgccaccacgccuggcuaauuuuuguauuuucaguagagauggaguuucaccauguuggccaggcuggucucaaacuccugaccucaagugaucugccugcccuggccucccaaagugcugccguugugguuuuaacuaaacugccugcuguacaauuauuguuuaaaaaaaaaaaaguuaggacucccucccccuuuaaaaaaaucagcucaaaacucaccuucaaucagccuuccccgaagaccccaccugacuuugucuuccuuccuuuuuuuuuuuuuuuuuuuuuuuuuuaaagagacagggugggccgugagccguagcucaugacuauaaucccagcacuuugggaagcugagccgggcggaucaccugaggucgggaguuugagaccagccugaccaacauggagaaaccccgucucuacuaaaaauacaaaauuagccgggcguguuggcacaugccuguaaucccagcuguucgggaggcuggggcagcagaauugcuugaaugcgguaggcagagguugcggugagccaagauugcaccauugcacacucagucucgggaaaaaaaaaacaaaaaacggagacagggucucgcucugucacuccagucuggagcacaguagcauguccauggcucacugcagccucaaacuccuggggucagugauccuccugccucagccucccaaguagcugggacuauaagcacacaccaccaugccuggcuaauuuaaacaucuuuguuacacagacaggccagguggucucaaauuccugacuucaagccauccucuggccuuggccucccaaagugcugagauuacaggcaugagccacagugccuggccccaccugacuuucuuaauucagagacuucccagaggauaacuguacuguaugcacuagaauuuguugcuaaauaauucugcagguguuuauaaaucuuccugucuguacuguuuucucaacuagacuggcaacacuuagagaggcuguuucuucuacaccuacacccugcuguagaauaaaccugaaaaucugaauugccgaaguagacaaacauaggguaaaauuauuuguaucuuuuaagaaagagucuuauuuuuauaguuuuuuuuuuuuuuuuuuugagacggagucucacuguguugcccaggcuggagugcaauggcgugaucuuggcucacugcaaccucugucucccgaguucaagugauucuccugccucagccuacugcguagcugggauuaaaggugugcgccaccaggcccagcuaauuuuuguauuuuuaguagagacaggguuucaccauguugauuaggcuggucucgaaccccugaccucgugauccgccugcccuggccucccaaggugcugggauuacaggugugagccacugugccuggccauuuuuauagauuuucaauaggcauccuuugcuaacacagucagcauucuguauucauagauucaacgaaccauggaucaaaaauacucagaaaaaaaaaaaagauaguugcaucuguauugaacaugaacagaccuuuuuuucuugccauuauucccuaaacaauacaguauacuauuuacacagcauuuacauuguauuugguauuauaaguaaucuacagaugauuuaaaguauaugggagaaggugcacagguuacauguaaauaccaugcgauuuuauauacgggacuuggguggcuauugguaucugugggggugggguuccuagaaccaaucccccauggcuacagagggauggcuguacacugacugugugcuuauaaaugauuauuugaacacaaggagcuacagagaaacuaagugguuaaguauuguggccucugacaaaugaugacccaccuaaaaccaauaggaaauaggguucccauccaaaaagcacuaucuggcuggacgagguggcucacaccuguaaucccaacacugugggaggccgaggugggcagaucaccugaggucaggaguuagagaccagccugaccaacauggugaaacccuaucucuacaaaaaauacaaaaauuagcugggcgugguagugggcaccuguaaucccagcuacucaggauguugaugcaggagaauugcuugaaccgggagguggugguugcagugagcugagacagcgccacuguacuccagccugggggacagagcaagacuccgucucaaacaaaaacaaaaaacaaaaagcacuaucugcucacaauuuuguaggacaguccucuguaccucuuccaugccacaaaagauucucaauagcugcuaagcaacacgguggugguguuggggggaagggcaugggccuaggucucacaaaacaggagcuucuagucccaauucagccauuaacugauuaguugggugaccucaagucacuuucccagaucaagacaguccugggggaacugacaugcuacacucugucuggcaaaacaauggugggcgguaaguagccaaaaguucacugggagacgucaagcuaaguauagcccuuggugcaguaaaucuaccggagacaacucagaggugccuggacuacggggcccacaucgcagagcagcccagauggcagcgggaaagggagaguacagcgccucacccucgagcagcacgaugccuuuacggaugucaucauuguacuugcuccgcaccaggcaccaggcguacucaaacugcgugcucuuggacaccgagccugcugccuucucagacugaaauuucuuuucaaacuucugccacaggggaggaaaggaaucauuuagaaauguagggcgucaaccauucucuaucuggacaugccaucucccuggcucugccccuuucccucgcaggucucgguaucuggcaccccagcuucugcuaucuccaugcccgggacccaggcuuucggcuccuccgggccugcgggccagcucuugggacagaggcccccggucuccccuccccgcggcgguaccgagcggagaugccaccugguggcagcuccaggcaccgcucccggagcagcugaccccggcggccgaacaguaaacacgcugucagaacugcucaacagcccacgcgguccucauuugaggcugcuggccccauccugccccacccugccgggccuggaccuuuuauuguccaggaauagaaguagugccuaccuccuagagcuacaaagacugagaucuggcaugcgaugccuuagcaccgugccggacgcaguaauaggugacaccuuaugauggucacuguauuccuccaccgcuggaggagcgcccugagcucacagcuccugcaugaucccagaucccgucagucuaaccacggucgggcuccaggcccguagucugagguguggggggcucaggacacuacaacucccaggagccucugcggcauagcaggcccuccgggcaggagccaggcgcuguggaggcugccgggagccguaguucggcuucccucggccaagccgaugccgggaggaggguucggccccuaccugacucuccucaggacccgcccuccgaccuucccuuucccucuguccgggccaggccucaccagcagguccuccacagacaccagcucguucagcacggccuccauggccacugcccccgcgagccucacacuacagucuacugugccacagucuccauggcccaguggcaggggcggagaaccacuuccgg

SEQ ID NO: 191557 - RNA, 6487 nt, Homo sapiens
ggcggcgacagggagggaggaagccuaggaguccgccgcgggacggaggccugggggaacugggaguucagcuuucugcagagggccacuaggaaccucggauugcccacggaagccagccacuuucuuugacaguccagcccaccuccucuucugcccggagaagcuccaggggcugccuuugugaucacagcaucuucacaaggaccaaaggaaaauaagauuucuuguaagaacaccgugaccacaucuuuaaaaugacccauuucguggcucccacaagauuuacaccuccacacugaggccggaagugguuuugccccuauaaaacauggcgaaaagcuuucuugucuccaaggaaacgccacguaaugagucaaagcuguggcgcacgcgcagaaguacaagcuaccggaagugauggcgccccuacuaaagccuugggguuaguacgcgugcgcagcaguuucuuccgacaguuguguugugccaaugguggagaagaaaacuucggguaugugagcccccgcgguucgcccccuuccccuucccaagucaguccuagaauuuucuuaccuagucauuccucuuuuuuggucucgcucuuucgccuaggcuggagugcaguggcauagucauagcucacugcagccucgauuuccugggaucaaaccauccucccaccucagccuccggaguggcuggaacugcaagcaugaggccccacgccugguuaauuuuuaauuuguuauguggugacgggcucucgcuauguugcccagguuggucuccaacucuuggccucaaagcgauccuccugcgugggccuuccaaagugcugggauuacaggcgugagcugccgcgcccggccccagcuauuccucguaaaucccuuccucagcccucggguccuggcguugacccuucauucacguuuuauuggugccugcuccaagccgggcgcuggggaugaagaggagaaagaccccucuuauccaagcauuggcuuuuucuggaaggggggcagaaacgcagaccuaacacuguauuuuacugugauuugugauuugugcuauggcagagggaagcacagcgccugggaacagggagacguggcaucuagcccagguucugggaggcaggggacugugaaagcuugaaggaaaaaugaaaaagcuugaauugagucuugaaagucuaguuaggguuucucucagugggaaccucacgugcaaaggcagugaagcaagaaaaagcaagucgcuuaggaagccaaguucacaguuuggaucuuacagaguaauaagaaaggaucgaaggcuggggaaagguuacauuuugaaaggcauuauacacacugcccaggaguuugaacucuguagggaaacacuggagagccagcaaagacuuuuuuuuuuuagacagagucuugcucugucacccaggcuggaaugcagugguucuauauaacucacugcagccucaaccucccaugcucaagugauucuuccaccucagccaccugaguagguggaacuacaggugggugcaggccaccaugcugggcuaguuuuuauauuuuuuguugagaugggugucucacuauguugcccaggcuggucuugaacuccugagcucaugugauccuccugccucggccuuccaaaaugcuaggauuacaaguaugagccacugcgcuuggcccuuuuaguuuuucuuucuuucuuuuuuuuucuuuuugagacggagucuugcucugucccccaggcuggagugcaguggcgcaaucucgguucacugcaagcucugccucccggguucacaccauucucuggccucagcuucuggaguagcugggacuacaggcgcccgccaccacacccagcuuaucuuuuguauuuuuaguagagacaggguuucaccauguuagccaggauggucuugaucuccugaccucgugauccacccgccucggccccccaaaaugcuagaauuacaggcaugagccacugcgcuuggcccucucaguuuuucaaaggcaucgcagucucccagccaucaguuuuuucauguuggccucaaggucugaaauaccccgcugucuccccuagccaggucauucaccaguuaggccuuaaccuagacuuaccuucuucugggaagucuucccugacuacuccaaggccagguuggguguuucuguccugggcucugcagcacuuuauacuuccguauccuagccuacuccaugcuguacuuacuguguuuguuucauuaaucauuuguguuugccacuggacuguaagcuuuggcaucccuaaaaccuagagcacugccuggcauuuggaggggagacagaguaguacagugaucauaaucauauuuuuuuuuguuugguugguuuuggguuuuuuuuuuuuuuuuuuuuuuuuugaaacagggucuugcucugucacccaggcuggagugcaguggcacaaacacagcucacugcagccuugagcuccugggcucaagcaauccuugcgccucagccuccugaauagcugggacuacaggugugucccacuacaccuggcuaauuuuuguauuuuuuuuguagaaacaugguuuugccauguugcccaggcuggccucgaacucccgcgcucaaacaauccacccaccuuggccucccaaagugcugagauaacaggcaugagccacugcgccuggcaaggucaugcuuuuugaugcuggguaguucuuugacuccugaccuggccacuuguuagcuaugugaacuuuggacacauuucuuaaucucugaauguugguaaauuggggaugaugauacugucccauacagcuguuguaaggguuaaaugguucaaguguugcaaagagcugagcacgugccuggcucauaguaaguguccaacaagugauagcuacuggggcugcugcuguuauuauuaugcuuaacaggugguuaaugaauaaagagauauauuaugcaaaauuaucagaaucuggcaaacagcugauaaggcaaugaggaaagagguuuuuuguuuuuuguuuuugagacagggucucucucuguugcccaggcuggaaugcaauggcgcgaucucagcucgcugcaaccuccaccucccggguucaagcgauucuugugccucagccucccgcguagcugggauuacaggcaugugccaccacacccugcuaauuuuuguauuuuuaguagagacaugguuucaccacguuggucaggcuggucucgaacuccugaccugaagugaugagcccaccucagccucccaaagugcugggauugcaggggugagccacuauguccagccgaggaaagagguuuaaaauaacuucuagguuucugguuuggaugucugcauagacgguuccauuugcguagagagaaucugcaggagaagcagacuuggaugggaauuuuuuuuuuuuuuugaguugcaguguccacagggccagugggugauuucuuuuuuccuucuuucuuuuuuuuuuuuuuuggagacagucuugcuuugucacucaggcuggagugguggcgcgaucacggcuugcugcacacugcagccucaaccucccgggcccauguaguccucccaccgcagccucccaaguaacugggacuacaggcaugugcaaccacgccuggcuuauuuuuuaauuuuuuguagagaugggguuuggcuaugcugcccaggcugguuucuaacuccuggcaucaagcgauccuuuggccucccaaagugcugagauuacaggcgugcgccaccacacccggccucaccaggcgcuggcugcauggccaguucuggagcccgggagcagguucuguguugagggagucacucugggagucauuugcuugugggugaucaucagagcccuuuguuuggagucaaaaucccaggaagagugcauagacugagcagagaagagggccagccaccuccauagaggcagggagagcagccgagcuggagccggaggauuccuggacauggagaaggccugcaguuuugucaaggaagcaagcaaagggucucuuucuacucgaugaagguagucggcaccgccacaggguggacagggcucagguccaaggaggaggaggaaggcacacuggagccgcucuggggcccagagcguggguggguggucccccaggaugaccaggcaggugucagauuuugggguucaaggagaggaugggaggugaaaaagugacacaucacgugaguugcugugaaggagaaggagcugugaagccgaguagacacaugagcgucgccagcucuuugauggaaagugccgguugaggaggagggguugaagaugggagagggagggaaugggcuggaggugaaggcucggggucaguggugggacuuggggcgcuccagggcaggggugugcccacuuggcaucacguuuguggguagguggccuggaagaugagcguauccaagcauggguggccccugguuccuuugagguaggaggugagaugcugagugugagggccauguguauugagggcccaggacagccuggaagccccagggcgcugugaccuccccagucagcagugagcugucuccaggccggggcucacuggcugggacugggauugagaggaaggcggagaaaacaggcaggagaaacugaaagggucucagcuggcgggacaggaagugugggcccagggcuuggcccgggaggagacaaggggaccaagggcuuggcaauggggaugagaucagagagcugcagcuuccaccccgggugccuuccucgcccugcccagagcggcggccacacugcucuuucuuggaagcccuguaacuuugcgugcccugcuccauccaguucgcucccaggaccccgggcagcggcgggugcuggaccgggcugcccggcagcgucgcaucaaccggcagcuggaggcccuggagaaugacaacuuccaggaugacccccacgcgggacucccucagcucggcaagagacugccucaguuugaugacgaugcggacacuggugaggcggauggaggaggaagcgggggaugggacugagaggagggcgggagaguccgcccaacucaggcugugggaggacccaggagcuccuggugccucugccagugacuggcucccauggcugugagcaaccacacccccuuucugugccucaguuuccucucguguaugugaaauaaacaagagagacuggauaagcucugacacgaagccuuaggcuugggggcauggaggugacugucagcugggauuggagaauugggguggagggcagaggcugguagcgaggggccgacuuagagccaggagggcagggccaggugugguggcucacgccuguaaucccagcauuugggaggcugaggugggcggaucacuugaggucaggaguucaagaccagccuggccaacauggugaaaccccaucucuacuaaaaauacaaaaacaaaauuagccaggcauggugguggacaccuguaaucccagcuacucaggaggccaaggcaagaaaaucacuugaacccaggagauggagguugcagugagucaagaucgcaccacugcacuccagccugggugacagagugagacugucucaaaaagaaccaggagggcacaugggcauggggagugaugaaccagagaaagcugcugucuuucugggcaagugccaagcaacggaucacccuugaccccuaggaaagaaaaagaagaaaacccgaggugaucauuuuaaacuucgcuuccgaaaaaacuuucaggcccuguuggaggagcaggugagaggagggucggccugggaggaccccacagggaaggggugagccuggcccgggcagguguucgcugcgugggugggcggaggaguucuagagccggccccuugucucugcagaacuugaguguggccgagggcccuaacuaccugacggccugugcgggacccccaucgcggccccagcgccccuucugugcugucuguggcuucccaucccccuacaccugugucagcugcggugcccgguacugcacugugcgcugucuggggacccaccaggagaccaggugagcaugagaccugcuguccacucccacucccuccuucccacagccuccccagaccucucuccccucauccuggcuuccccucugucugcaggugucugaaguggacugugugagccugggcauucccagagaggaagggccgcugugcacugcccggccuucagaaagacagaauuucaucacccaaugcagggggagcucuuccuggaccaagggaggagccgcucauucacccaacaaaacugugucuuaucugccaggaaagaccagccucacuccugggaacugucuggcagguaggcugggccccccagugcuguuagaauaaaaagccucgugccggaa

SEQ ID NO: 191558 - RNA, 24957 nt, Homo sapiens
uuccagcgcagcucagccccugcccggcccggcccgcccggcuccgcgccgcagucucccucccucccgcuccguccccgcucgggcucccaccauccccgcccgcgaggagagcacucggcccggcggcgcgagcagagccacuccagggagggggggagaccgcgagcggccggcucagcccccgccacccggggcgggaccccgaggccccggagggaccccaacuccagccacgucuugcugcgcgcccgcccggcgcggccacugccagcacgcuccgggcccgccgcccgcgcgcgcggcacagacgcggggccacacuuggcgccgccgcccggugccccgcacgcucgcaugggcccgcgcugagggccccgacgaggagucccgcgcggaguaucggcguccacccgcccagggagagucagaccugggggggcgagggccccccaaacucaguucggauccuacccgagugaggcggcgccauggagcuccgggugcugcucugcugggcuucguuggccgcagcuuuggaaggugaguuuccuugcgggggggggcgcaccccgucacuccugggaccucccccccaacaucugggccucggaguggaggggccggccucugacuaccccuacccgggcacugcagucccaaacacuucggaccgauagugcuggaacgggaggggggcggggaagaggcgcccgacggguaguggaguuuucuuuuguuugggaaagagauggagucuggcuacgacccgggacauuccccugcccgggcuccccgaacucucacugcugauuacauacgccccuggcugccuuuccuuuccucccuaccccacuauucaaaacuaucugcaaaguuucugucccagucccaccucccgccguacaugagggaagguuucuggagaagcaacagcagacaaggcacaacuuuucgugcuaggcccuaaaacgacccccagcgccaauuccuuagcgaucacaccuugauccuccaguuccacacuccugcaacaggauggccuccuuugcauucacacagcaaacccccaaaccgcucucccgcccacugcuccugccccugguauaggguggcuccuugguuucuacaggcugcaccccaucccuuuaaaugcggucuagaccccggccccaggugagucccgggcuucccuugagaccuaggagcggguagaaacugaccuacacagcccccagguagaaacugaccuacacagcccccacaucgcccuaacuaacccagucuaucucccaccuccuggucucuccaagcauuucuuuggccauggaucgcugucccuccugguccccuaaagggggagccaagagcccuagaaacucuccugugucccuaauguccuuucagugagcugccaacaccccccuuucucugucugguaugaaagugguuauggggcgguaggcuaugagggacucccaaagggaaggauucagcggcguuagaaaaacccucucccccuggcugggcaggacugcccugggcuggggaucaaaggcuaggugugggguugggagugaggggaggcuugcccagcucagagaacggagaagggggaacaaaaaccaugaacgaggggaagaggaaggccaaagggguggaaaaaccacgaggacgagguguggugagaaggaaagacgcaaagaggaaauggugauugugacaccuauuaccugaguguuuccaagcaccaggccugugcugagcgccuuacaaauauuaauuucacccauccagcaacgcuaaggguggugcuauuauugcccccauuuuucagaugaggaggcuggggcuuaguuaagguuaaguaguuuauccaaggcccugugccgcgaggaacagcgagaaguggaggccgaaagcgaaggagagauagugacugucagaaagagaaacggagguggacagagaguggaggagagauaggugagagacaugcgaacugacagaucaaagcguggcugcagcugagcugggacgcagaaagggagccugcgcuugcucugggcugcggacagcccgaggcagagacaguguguaaauuggagacaggaaaacacuaucccggcuggaacaauggaggguggagacggcagccucuauccacccccuucccagaacccgggcauccuguccccagugagcagggcugucucuugccacccauggggaccuugcgccucucaccucaggcuggcuggcuucccaucugaccccuagcuggaggacaucauuugguccccaggaagaggcugccucacccacccucuuucucuucucuccugcagcucccauggggugggagccagguguucuggcuccccucuccacccuucccagcgcccaaugccccccacauugccggcccccgaggggauuccuguacccucccuccuccacucuccacugccaggggcugugcaguuuuuccuaauccccccccuuccuccagugccuguccccucccccgaugauccgagccaagccagguguguucaccccucccauucauaccgccccccagaaucuccuccccucugccuucccauaaccaaauccagaugugaggccucggcgggagccugggaacccuagcaucccgaccuccagugcuuccugaucagggcacucguggggagggagguacugggaugggggccagggcuaugccccaggcacggagcgcucccuucaaggagggaaggacgggguguuuggucugaaagcagagaggggucuuggacagggaaugaaauugugggguagagaggcugauucugggacuuaggggaggaaacguggaggcugagacaagagguuccccucccacaccagcagccucugcucgugggggucaggaccagggcgcagcucucauuuuaacccuuucugagcugccgccccuucuccccguacauuuugaucucccucccuccuccagggaggccuagaucugggguaucccaagggagccccaugccuaccagauguugggggugggguuggcacuuagcagaagaggccagaaaucaggcgggugcagagggcagggcuugcuccccucuuggccccccaacuccucuagcucagagcuaagaggauccaccugccucgguucccagggaucuggucuuccugaccucccucccccaccccaggcacugacucugucucucugucugucucagagacccugcugaacacaaaauuggaaacugcugaucugaagugggugacauucccucagguggacgggcaggugagagcugcacccaggagcuggagcucuggagggaaacugagggaggagagggcgccugugccgccugcuuucugugugccacuccucuccccuguccccccagaugacagcagccccagcagugucgucugagcccuucucagaggcgcccuccucgcaguaccagcagccccccuuucucagucccucucacuuuauaggauucaccccaugcagcccucucccuggcggcuccccagcccccuugcugaccuccuucucugcacagugggaggaacugagcggccuggaugaggaacagcacagcgugcgcaccuacgaagugugugacgugcagcgugccccgggccaggcccacuggcuucgcacagguugggucccacggcggggcgccguccacguguacgccacgcugcgcuucaccaugcucgagugccugucccugccucgggcugggcgcuccugcaaggagaccuucaccgucuucuacuaugagagcgaugcggacacggccacggcccucacgccagccuggauggagaaccccuacaucaagguaccugggugcccccagggcucagccacagccaaggugggauuccagccagcaggcccguggccuggagggcagccgauguaguugcgaggccucuggcccgcgcgcugggggcuggaagcaggaggcuuaggucuggggagggaagggggugaucuucugggcggaggagcagaauauacgggggcugccuggcccggcccccagggaggcccaagggucaggcuucuccuccagucaccucaaccacccuaccccacugugcuccagccacacugaguuucucccauucccugacugcaccuggcugguuuccagcucaagacuuugcagcggugaugucuccaccugggggccucucugccucucacaccccuacuugucuucggaguuccagcucccgagaucuugccugugccaccuuggcugacucucuccucccuacaauccugcauaccucuguccaccugccugucucggcacucauuuuacuuuauuuauuuuucuuuuauaucuauauuuuuaaagcggggucuucuacguuacccaggcuggucucuaacuccugggcucaagagauuucucccaccucggccuccuaaagugcugggauuauaggcaugaggcacuacgcccggccucaugguacuuuauaacuuccccaggauucauucaucgcugucuccuugacucugaggucaaggccuggcauggcgucagugucaguaaauguuuguagaacgagugaauaaaaagggggagaggugcaggccagaggccgggcauaucgcaggagcuuugcaaggcugaauggacagugugggggccugcagaaagugugcccuggggaagguggagggaagauucuggaacgggaaccaaggagguccgggagggugagcugggaagaacacaacaguccgcuggguccucagggaguggggacagcagcggugugccucccccccgccggcagguggacacgguggccgcggagcaucucacccggaagcgcccuggggccgaggccaccgggaaggugaaugucaagacgcugcgucugggaccgcucagcaaggcuggcuucuaccuggccuuccaggaccagggugccugcauggcccugcuaucccugcaccucuucuacaaaaagugcgcccagcugacugugaaccugacucgauucccggagacugugccucgggagcugguugugcccguggccgguagcugcgugguggaugccguccccgccccuggccccagccccagccucuacugccgugaggauggccagugggccgaacagccggucacgggcugcagcugugcuccgggguucgaggcagcugaggggaacaccaagugccgaggugagagcuggagcuuccccugcgacugcugcucauccgggggagaguccugaacuccacucaggacccacuucuuaaguuuccauuuuguauaguuagauguugaaauggaggcuugcucugucacccaggcuggagugcaguggcacaaucucugcucaacugcaaccuuugccucccgggucccuguucaagcaguucuccugccucagccucgugaguagcugggacuacaggcacacgccaccacgcccggcuaauuuuuguauuuuaguagagacgggguuucgccauguuggccaggcuggucucgaacuccugaccugaagugauuugcccgccucggccucccaaagugcugggauuacaggcgugcgucaccacacccagcuggaaaaaaaaaagacuuuauuuucaccugaaauucauuaauuuccacuugaaauuccaccugcaguuguagcaggaccugacacuugggccccauggaaaucacagguauugccugacacagugguucaugcccauagugccagcacuuugagaugccaaggugggaggaucacuugagcccaggaguucgagaucagccugggugacagagcaagaccccgucucuaaaaaaaauuuuuuuuuuuuuuucaagacagagucuugcucugucgcccaggcuggagugcaguggugcgaucucggcucacugcaagcuccgccucccaaguuaacaccauucuccugccucagccucccgaguagcugggacuacaggccccgccaccacgcccggcuaauuucuuguauuuuuaguagagauggaguuucaccguguuagccaggauggucucgaucuccugaccucaugaucugcccgccuuggccucccaaagugcugggauuacaggugugagccaccacacccggauuacaaaaacuuuuuagauaauuaucugggcgaccugccugaccaacauggagaaacccugucucuacuaaaaauacaaaauuagccggacaugguggcgcaugccuguaaucccagcuacuugggaggcugaggcaggagaaucauuugaacccaggaagcagagguugcgguaagccgagaucaugccacugcacuccggucugggagugcacuccaacaagaaggaguuucgcucuuuuugcccaggcuggagugcaguggugggaucucagcucaccgcaaccuccaccucccggguucaggcgauucuccugccucagccucccaaggaguagcugggauuauagguaugcaucgucacacccggcuacuuuuguauuuuuaguagaggcagguuuccaccauguuggccaggcuggucuugaacucaagugaucugcccucuuuggccuccuucucaggaaaaaaaaaaaaucacagguauuuacaggccauuccaagugccaaaagauuguuuuugcucauggugacuucaguaucacagauguuaggagacuugcugcuauauguuaagaaagaagcacaaauguugcuguagcccaaacuuuuuuccucauguuucauugcauuucagcuuaauugguuucccugguauuccuauguauuuuguggagugcuuuuaaaaucauaaguuggaguagaggucuuucugugggcuucaccagacugccgagaucagggucgaaacaggugaggaccccuucucuggagagagucuccuuucuccucuaagaggaaagguuuugagaucuuuuguccauuuucccaccuuagcacuucaucagccuuaaaagaagcuggaauuuuuuuuuuuuuuuuuggagaugggaucucgauauguugcccaggcuggucuugaaccccuuggcucaagcgauccuccagccucagccucccaaagugcugggauucgaggcaugagccaccgagcccaccgugcagauggauguuuuugugcaugcuuuugaugaaugcuuucucucucucagccugugcccagggcaccuucaagccccugucaggagaaggguccugccagccaugcccagccaauagccacucuaacaccauuggaucagccgucugccagugccgcgucggguacuuccgggcacgcacagacccccggggugcacccugcaccaguaagugaccagcacccaggugcaguucacuggggaggggucacagaccucugagguggacccucacauggcccccauccucccugggcuucuucccuuugucccuggcaugcuugucccuagcccggaggaacauguggagcccacugucuccaaggcaagaguccagcauggcugcuggugccuccauugcccucuccccaccaccgcagagcaggucggccucugccugacucccuggucuccugcagccccuccuucggcuccgcggagcgugguuucccgccugaacggcuccucccugcaccuggaauggagugccccccuggagucugguggccgagaggaccucaccuacgcccuccgcugccgggagugccgacccggaggcuccugugcgcccugcgggggagaccugacuuuugaccccggcccccgggaccugguggagcccuggguggugguucgagggcuacguccugacuucaccuauaccuuugaggucacugcauugaacgggguauccuccuuagccacggggcccgucccauuugagccugucaaugucaccacugaccgagagggugagacuugggggcuggggcggcugguggucuggcgggagagaugucacugagggccugaaggggagaggcaggggcugugaaguuggguaccccggaagugugaggggcuaaggcuuugggggcaagaggcagaaagagggcaauggcugggcgcaguggcucacgccuguaaucccagcacuuucagaggcugagacaggcggaucacuugagcccuggaguucaagaccagccuggguaacauaggaagaucucucuacaaaaaauaaaaauauuagccaggcgagguggugcaugccuguggucccagcuacucaagaggcugaggcaggaggauugcuugagcccaggagucggaggcugcagugagcuaugaucgcaccgcugcaugccagccugggugacagagcagugugagauccucucucaaaauaaaugaauaagaaagagagggugaggagcucguaaagcugggcuggagaguuaaguacaggaaggcccccagugggacuggggccagagagaaucagaaggaauucucgaaacagccagggggaaauugagacaaguguagccagcagaggaaguguuggaaaagauaagggacauggccaggcugaucacaaggucaggaguucaagacuagccuggccaacguggugaaaccccaugucuacuaaaaauaaaaaaauuagccaggcaugguggugggcaccuguaauccacuugggaagcaaccagaagaauugcuugaacccaggaggcggagguugcaguaagcugagacugcgccacugcacuccagccugggugauagagcacgacuccgucucgaaaaaaaaaauuuuuuuuaaguuaagggacagagcuaccaugcacaaggguucccugugucucugccucucacaguaccuccugcagugucugacauccgggugacgcgguccucacccagcagcuugagccuggccugggcuguuccccgggcacccaguggggcugugcuggacuacgaggucaaauaccaugagaagguaaggccaucccccagcccuggggugggugggcaauggguugugcucuccuggcugggacaccuggguugcaggcaccuggcaggcauuugaauuccagcucugccauggauucccugggcagccuuggguaagccccuuggccugucugagccucagacucuucaucuauaaaauaguuacuguaauaguuaccagcagcuggacacaguggcugagguugggugcgguggcucacgccuguaauaccaagcacuuugggaggcugaggcgggcagaaugcuugagccuaggaguuugagaccagccugggcaacauggugaaacuucaucucuauaaaaaacuuaaaaugggccgggcgcgguagcuuacgccuguaaucccagcacuuugggaggccgaggugggcggaucacaaggucaggaguaucgagaccauccuggcuaacacggugaaaccccaucucuacuaaaaauacaaaaaauuagccaggcgcgguggcaggcgccuguagucccagcuacucgggaggcugaggcaggagaauggcgugaacccaggaggcggagcuugcagugagccgagauagcgccacugcaguccggccugggcgaaagaacaagacucugucuccaaaaaaaaaaaaaaaaaaaaaaaacgcaaaaaauacuuaaaaugaaaaaaauuagacugggcacaguggcucaugccuguaaucccggcacuuugggaggccgagguggguagaacaccuggggugaagaguucgagaccagccuggccaacaaggugaaauccccgucucuacuacaaauagcaaaaucagcugaguguguuggcgggccccuguaaucccagcuacucaggaggcugagacaggagaaucacuggaacccaagugauucucgacuugaggucgaggcugcagugagucguguuugcaccauugcauuccagccugagaaagugagaccuugucuuaaaaaaaaggaaugauauuaugaauacagcacauggcuugcaugcguaaguucucccaaaggccucaccaguugcaaggcaggcuagugaugggaguggagggcgagggaaggaggcaggaagagcaacaggaacuuggguucccgggugacggccaccccacuaccucucccggacagggcgccgagggucccagcagcgugcgguuccugaagacgucagaaaaccgggcagagcugcgggggcugaagcggggagccagcuaccuggugcagguacgggcgcgcucugaggccggcuacgggcccuucggccaggaacaucacagccagacccaacuggauggugagccuggggaagggggugaggguggggguuggaaagacccccaaaguuccugggaagaccccaggucuccaaagucccaucaucuuuuuuuuuuuuuuuuuuuuuugagauggagucuugcucugucccucaggcuggagugcaguggcaccaucuccgcucacugcaaccuccgccucccggauucaagccauucuccugccucagccucccgaguagcugggauuacaggcgccugccaccgcgccuggccgauuuuuuguauuuuuaguagagacggggcuucaccgcguuggccaggcuggucucgaacuccugaccuugugauucgcccgccucggccucccgaagugcugggauuacaggcaugagccacugcacccggucaaaguccuaucuucauguccuucuuccuguggaucacauggcaugcccuagagaggagagaacguaagaugucgaaaccaaaaccaacagcugaguuuugugaagucuggccugcuucacucuguacccccaggcuggagcgcaguugcucgaucaaagcucacugcacagccaggcacaguggcucacccuguaaccccagcacuuugggaggcugaagcaggaggaucacuugaggucaggaguucgagaccagucugaccagcauggugaaaccgcgucucuacuaaaaauauagaaguuagcugagcgugguggugcacaccuguaaucccagcuacucgggaggcugaggcaggagaaucgcuugaaccugggagguggagguugcagugagcugagauugugccagugcacuccagccugggcaacagagcaagacucugucucaaaaaaaaaaaagcucaccgcaggcuugacuuuuagcaacaaccugaccccugagcuccccauuccccauccaacaaaaugggaauaucaugaagcuuccugcagggcuuugaggauuggagguaacagguuauuuuuaauaugcuaggccaguggcuuucuuuuuucuuucacauuuuuuuuuuugagacggagucucacucuguugcccaggcuggagugcgguggcgcgaucucagcucaccgcaagcuccaccuccuggucucgaucugcugaccuccugauccacccgccucggcuucccgaaaugcugggacugcuggcgugagccaccacgcccggccuaacuuuuucuuuuuuuuaagagacacggucuuuuuuaucacccaggcuggagugcgguggcaccaucauagcucauugcagccuacaacucccgagcucaaccaauccuuccaccuuagccucccaaguagcuggggcuauaggcaugugcuaccgugcucaacuaaauuuuuuuuuauguuuuguugagacaguuucccuauguugcccaggcuggucucaaauuccugaccucgagcaauccucccgcaucggccucccaaagugcugggauuacaggcaugagccgccacacccagcauuggaccaguggcuuucuaaaccuuguaauuuucuguaauagcuuuacugaaauacaguuccccugccauacaauuugccuguucaaaguguacaaucgaugacuuuugauacauucacagaauugugcagucaccaccacaaguaauuuugggacauuuucagcacccucaaaagagacccuauagcccuuagccaucaccccccacccagaucuuucuguugccuuagucccuggcaagcacuaacccacuuucugucuugaaaucuuccaguguggucuuuugugacuguucaccgagcagaauguuuucaagguuuauguauguuguaguauauauccguggguuuuuuugguugugguuuguuuuuuguuuguuuuggaaacagggucucgcucugucacccaggcuggagugcagugguucaauuacagcucacugcagccucaaccucccaggcucaagugauccucccaccucagccucccaagcagcugggacuguaggcaugagccaccaugcccagcuaauuuuuuuugguauuuuuuguaaagacaggguuucaccauguuucccaggcuggucucgaacuccugagcucaggcaauccacccaccucagccucccaaagugcugugauuacaggcaugagccacuggaccuggccuguuuuuuguuuuuguuuugaacacacgauuuugcuuugucacccaggcuggaauguaauggucugaucauagugcauugcagccucaaacuccugggcucaagcgauccuccuaccucagccuccugaguaucugggaccacacgugcucaccaccaugcuuggcuaauuauuauuauuuuuugauagagacggggucuugcuauguuucccaggcuggucuugaacaccuggccucacacaauccucccaccucaguaucucagagugcugggauuacaggcaugagccacugcuccuggccaauauuucauuucuuuuuauggagacguaauaaucaguuguauggaaauagcugauuuuguuuuuuauuguaucuuuuggugaacauuucaauuguaucgacuuuuuggauaaaaaccugaaaauguuucaccuuuagaacguuucauugaauggagauuuuuuuguggacucugguauuuauacuagaaccaaaucaaaaccacucuggcggcugggcaugccuaggcugguuugagacuagccuguccaaccuggugaaagcccaucucuacuaaaaauacacaaauuagccgagcauggugguacacaccuguaaucccagcuacucaggaggcugaggcaggagaaucgcagaacccgggaggcggagauugcagugagcugagauugcgccacugcacuccagccugggcgacagagugagacugcgucucaaaaaaacaaacaaaaaauuacucuggcaguaagaaaagauuucgaaacuuccucccuugcccugagguacuucagaggagccugcuggccccugggggagaguuugaaacccacuguuuguucccugaccuugccugcuuguguccucucccuccaccuguccccuguacuggggaccuguucucaggagaucacaguucauugcucaaagccggggcuggggccuccuacaggaccaucaguuucuccugaucagcagccuuuccuuccgcagagagcgagggcuggcgggagcagcuggcccugauugcgggcacggcagucgugggugugguccugguccugguggucauuguggucgcaguucucugccucagguaagggcucugacacccagaggccccuggaagcccucaguugauggccaccugccugggugcuacaggacaagccuuucuggcuguccccagccucuuuuuacuugaaaucuucuccaaucccugcuccuuccuuuggugugugugccucauaaagaugugugacucaguuuaccuuuuguuccuuucccaucggcuacaggaagcagagcaaugggagagaagcagaauauucggacaaacacggacaguaucucaucggacaugguggguugcccuaauuugaugggaauaggggcuuggggccgggugugguggcuccuaucuauaaucccagcacuuugggaggcagaggugggcagaucacuugaggucaggaguucgagaccagccuggccaacauguugaaacuccaucucuauaaaaaauacaucagucagccaggcaugguggugggcaccuguaaucccagcuacucaggaggcugaggcagaagaaucauuuuaacccgggaggcggagauugcagugagccaagaucgcgccacugcgcuccaggccugggugacagagcgagacuccaucucaggaaaaaaaaaaaaaaaaaaaaaaaccacggagacagggguuuggggcuaaaagcuaugagccgagccuccgaguccagugggaguuaauucccagcugacggggcccugccugauuucucagguacuaaggucuacaucgaccccuucacuuaugaagacccuaaugaggcugugagggaauuugcaaaagagaucgaugucuccuacgucaagauugaagaggugauuggugcaggugagagccgaaggcugcccgggcaccugggaacgaagcgggggugggcagggccacacuggagcgggagagcugaugaccucugcguccuuguuugaaggugaguuuggcgaggugugccgggggcggcucaaggccccagggaagaaggagagcuguguggcaaucaagacccugaaggguggcuacacggagcggcagcggcgugaguuucugagcgaggccuccaucaugggccaguucgagcaccccaauaucauccgccuggagggcguggucaccaacagcaugcccgucaugauucucacagaguucauggagaacggcgcccuggacuccuuccugcgggugagcacccucccuggcuucugcggccacccggaguucccacuuacacccagaggccacuuggguuaagaagccaggacagacagugggucccaggucaccuccuccagccuuuuccucuugggcuaagcccugguccucugccuuuucuuuuuuuuaagacagagccucgcucugucgcccaggcuggagugcaguggcgcgaucucggcucauugcugucuccaccuccaggguucaagcgauucuccugccucagucucccaaguagcugguacuauaggcaugcaccaccaugcugacuaauuuuuguauuuuuaguagacacaggguuucaccauguaggccaggcugguaucaaacuccugaccucaagugaucuccccaccucagccucccaaagugcugguauuacaggugugaggcaccacgccuggccagcccucugccuuuaauuuucccucugggaaaggcugggcuccugggaccuuccuuucccacugccccauacagcugaagguugucauuccuucuuuuuuuuuuuaauuuuguuuuaauugaauuuuuuuuuuuugagauggaguuucacucuuguugcccaggccggagugcaauggcaagaucuuggcucaccgcaaccuccgccucccagguucaagcgauucuccugccuuagccuccccaguagcugggauuauaggcaugugccaccacgcuugacuaauuuuguauuuuuaguagagacggggguuucucuguguuggucaggcuggucucgaacucccgaccucaggugauccgccugccucggccucccaaagugcugggauuacagacgugagccaccgcgcccggccaauuuuuuuuuuuuuuuuuuaagacagagucucacucuguccucuaggcuggagugcaguggugcauucauagcucacuguagccuugaccuccugggcucaagugauccucccgccucagccuccugaguagcuggaacuacacucauguaccaccaugcucagcaaauuuuuaaaauuuuuuguagagacaggaucucgauagguugcccaggcuggucugaacuccuggccucaagcgagccucccuccucagccucccacagcacugggauugcaggcaugagccacugugccuggccugucauuccuucuuuugacaaauauuuacugagugcuuucuacgcaccggucauccucccaguccccaggaauaaagcuauacacacggcaaacuggauuucuccucuuggggagcagagggucuaauggggcagggggacugaaaauuagcaaguaaauagacaggcuuuuuaaaaaaguaaacaaaucauuucaaaugugaaaaaaagcaaacgggguccuucaugcagauguggcuagagaggaaagagaacugcuuaauuuauuuggucacuuuaccagauuuuacugacuuuuuuuuuuuuuuuaacuuuauuaagcuuuucuuuuuucuugagauggaguuuccaucugucacccaggcuggagugcaguggugcguucuuggcucaccgcaacguccaccuccuggguucaagugauucuccugccucagccuccugaguagcuuggaauugcauggcaugcaccaccauacccagcugauguuuguauuuuuaguagagacaggguuucaucauguugcccaggcuggucuugaacuccugggcucaagugauccacccaucucggccccucaaagugcugggauuacaggcaugagccaccaugccuggccuaggcaucuuuuuaaaaaaaucaaaacauuuuucuauguagcaaaauaacauugcauugaacagaguuauagcgauucccuagcgucauugaauacccaguugauuuucacguuucucuaguuguucuaaagauguccuucacugcugcuuuauuccaaccaggauccaguucaagaccgggcuuuguaccugguuauuauauauauuuuauuuauuuauuuuagaaacaaggucuugcccuuucgcccaguuuagagugcaguggugcaaucauagcucacugcagccuccaaacuccuuggcucaggugauccuccugccucagccuccuggguagcuggaacuacaggugcacaccaccacaccuggcuaauuuuuaaauuuuuuacggagaugggggucucgcuauguugcccaggcuggucucaaacuccuggacucaagcgauccucccuccuuaaccucucaaagugcugggauuacaggcgugagccaccacgccugcugauuauuauauuuucgagccucucuaaaucuugagcaguuccucaugaugacacugacacacugaaggguuaggucccuuguccgccugaaugucuugauuucuggauuuaugaaauucuucuuaugggaucauuuagcuugucucucuguauuuccuguaagagaagcucuaucugaugugggguuuuuuugguuuuguuuguuuguuuuuugagauggaguccugcugucgcccaggcuggagugcaguggcacaaucucggcucacugcaaccuccgccuccuggguucaagagauucuucugccucagccuccugaguagcugggacuacaggcgagugccaccaugcccagcuaauuuuuguauuuuuaguagagacaggguuucaccauauuggccaggauggucucgaacuucugaccucgugaucugcccaccaccucagccucccacagugcugggauuacaggcaugagccacuaugcccggcuaauuuuuguauuuuuaguagagacagggcuucgccauguuggccaggcugaucugaaaccccuggccucaagccauccacccuccuuggccucccaaagugcugggauuaaacgcgugagccaccgugccuggucgaagagacagaaagggucuuaaagguucagugacacacaccuguaaucccagcacuuugggaagcugaggcugguggaucacucgaggccaggaguuagagaucacccugggcaacauggugaaaccccgucucuacacaaaauacaaaaaugggcagagcaugauggugcauaucuguagucccagcuacucgggaggcugaggcgggaggaucacuuaagccugggagaucgaggcuguagugagccaucauugcacuacugcauuccagccugggcgaucccaucucuuaaaaagagagagagaugggaagaccagcacaggugaaacuggugaacagaggagagaugguagaugcugcauugggcagugugacgggaacccgcuggagggcuuuggcaggagaguaguuuaagaggaucccagcugggcacaguggcucacacuugugaucccagcacuuggggaggccggggcagguggaucacuugaggucaggaguucgagaccagccuggccaacauggugaaacccugucuguacuaaaaauacaaaaaccagccaggcaugguggugcaccccuguaaucccagcuacucaggagacuaagacaggagaaucgcuugaacucaggaggcagagguugcagugagccaagaucacgccacuuuacuccagccugggcaguagagcgagacuccaucucaaaaaaauaaauaaauaaaaagaccucuuugcugggugcuagggagcaagagcaggagcugggagaggccugcagcagaagccuguugccagcauccaggccguggggugaagggaaggguuuggauuugggacaugucuuggaagcaucaccagcagaacuugcugauggauuggaaguggcuggugagggagaaaagggggucaaaggaaacucugaggucuauacccugaccaucuggcaaguggugguguugccacaaacugagcggggaguagggcaggugcaggucuggaggauggauucaaaauucaguuuuuggagucuaugucccugguucuguagggcugcagauggucugccaaaucuuagcggaacccagaauacgggauuuguuuacugucugugacuuguugguuucccuggugagagcaaacucuuuaaaggucaagguugggcuucagaccuugguuuuugcaccgaucauuggucauacugcaguuccucacucuucucuugcaaauccauacacagcuaguccaagagagcugaacagcuuugugguuggaucagcaccaauguaucuccaccuguagacggguugcucaggugacucaugccuguaaucccagcaccuugggaggccaaggugggaagauugcuugaggccaggaguuggagacaagccugggaaacacagugagaccccauaucuaccaaaaaaaccccuuuguuuuaauuagccaggugcaguggugugcaccuauagucccagcuacuaaggaggcugaggcagaaggaucauuugagcccaggaguuuaaggcugcggugaaccaugaucgugccacugcacuccaaccugggggaaagaaagagaccuugucucuaaaaaaacuaaaaaacagaaaagcauuuguugaguauuuccuggguauaaagcaguguaccagguuaaauggaaggaaaaguugaaauaauuuuucaacucauaauccgauugggagagacugaaugcuuaccauugaagcaggaaccauuguaagcaauguguugugauacuguagcaagagcugagaaaacuugggaaaagagaaaggaggaaggcucaccugagggaguuggggggcuugcccuacaggugaguugugaggugggucuggaagugacagaugcaguuuaggaaguggacgggaggcuggguacggugacucaacaucuguaaucccagugcuuugggagacccaggcggaaggaucgcuucaggccaggaguuaaagaccagccugggcaacauagugggaaccuaucucuacuaaaaauuaaaaaauuauccaggcauaauggcacaugccuauuguuccagcuacucaggaggcuugccugagcccaggagguugaggcugcagugagcuaugauggcaccacugcacuccagccugggcgacagaacaagacccugucucuaaaaaaaaaagauguggaugggagggggaacggugggugggcuguccucaccaagcccccacccuaucugcucuccagcuaaacgacggacaguucacagucauccagcucgugggcaugcugcggggcaucgccucgggcaugcgguaccuugccgagaugagcuacguccaccgagaccuggcugcucgcaacauccuagucaacagcaaccucgucugcaaagugucugacuuuggccuuucccgauuccuggaggagaacucuuccgaucccaccuacacgagcucccugguaaugcuggggguaauacugggugugagcuucuuagggccaggugggcagggcagguuggaaaggugggaggcugaggguuuggcagcccugcuccagggagaggauacaggagcaggcuguggguggggggacagucagcuccaggaagccgacuuccagaugucuaggaaaauaacaguuggauaaccugggcaacauagcaagaccccaucucuacaaaaaaauuaaaagauuagccaggcgcaguggcaugcaccuguagucccagcuacuugggagguugaggcaggaggauugcuuaagcccaggaguuggaggcugcagugagcuaugaaugugccacuguacugcagacugggcgacagagcaagacccugucucaaaagaacaguggccaggugugguggcucacgccuguaaauccagcacuuugggaggcugaggcaggaggaucgccugaggucaggaguucgagaccagccuggccaacaugggaaaacccugucgcuacuaaaaauacaaaauuagcugaggguggugguacacgccuguaauccgagcuacucaggaggcugagguaggagaaccaguugaacccgggaggcggaguuucagugagccaagaucgcaccacugcacuccaaccugggcaaacagaguuggagaguaggaggcuuggggccugagcuagggggaaaaagcagaggcaggugggggacuggggggcagugugcugggucuggugagucccucagugagucccccagcucaccuuuucuccuuuuucugcagggaggaaagauucccauccgauggacugccccggaggccauugccuuccggaaguucacuuccgccagugaugccuggaguuacgggauugugaugugggaggugaugucauuuggggagaggccguacugggacaugagcaaucaggacguaagugucccgugguccuaccaagcuuuccucgaguguucucucaccugggauuuggggugaaggguggguucccagagagucaucacugcuggguucuugagaccauggagaugacaaaaaggagaauugaucuuuguaucaaagaguugagauacagggccaggccuaguggcucaagccuguaaucccagcacuuugggaggccaaggugggcagaucaccuaagguuaggaguucaagaccagccuggccaacauggugaaaccccgucucuaaaaaaauacaaaaaauuagcccagcaugaugggcgggugccuguaaucccagcuacucaggaggcugagacaggauaaucgcuugaacccaggaacagagguugcagugagcugagaucacgccauugcuuuccagccugggcaacugagcgagacucugucuuaauaaauaaauaaaagaguuggguacagcauauuugggucgcagaaggaugcagagauggagggcaggguugagagguaacaugucuguaucauagcccaagagcugcuggggccuucagccacagagagcuucaacuccggcuaggaggauuccuggaucuguuauuuuuuggggggcuguggcuccuauccuaccaucuuccaagucaccauuuccugggccuguuagcaucuuugcuuuuccuggacagccucacccagagcuucuuccccucuuuccaggugaucaaugccauugaacaggacuaccggcugcccccgcccccagacugucccaccucccuccaccagcucaugcuggacuguuggcagaaagaccggaaugcccggccccgcuucccccagguggucagcgcccuggacaagaugauccggaaccccgccagccucaaaaucguggcccgggagaauggcgggugaggacugcagagaaugggcccuccuucccgcucucugcccccacuccuugcccagaaguguccguucauugguguugggugggagggccucuguccgccucugcaaggcuggguuccaccuccucccccggaccugggccugguacucagcauuccuccccauccuugcccccuagggccucacacccucuccuggaccagcggcagccucacuacucagcuuuuggcucugugggcgaguggcuucgggccaucaaaaugggaagauacgaagaaaguuucgcagccgcuggcuuuggcuccuucgagcuggucagccagaucucugcugaguaagcaguggcaggagcuggaguggggcugggagagcggggcagcuggagucaggcccacggggucuccaggggcuuuuggggucagcuucgggugccaaugcugucuucuugcacugcgcucaugccaugccuagaagggccccagaggagcagucacagccccauggagcugaggacccaaggacucuuuggggccagccugcccgccucaccuccuccugccaucacagcccugggccaucgcgcuuccgccucucacuucuagcuaucuuugugcaucuaucugcauuccaggcccggcucucacgguaacaaugugucaacucggguucucuuuuuccaaccauaaaaggagaagauugggcuagguuuuggagauccucuucagcuuuuaugugaaaugguuuuaugauuccuugccucccaaaggcugcguauccccacuuggccuuugucugcuacucccccuuucugccuucccguuccucucccaagaucuccucucaccccagguugaauaacagaaauagaaggaauagaaaucugaaggccgggcaugguggcucaugccuguaaugccagcacuuugggaggccgaggugggcagaucacuugagguuaggaguucgagaccauuguggacaacuuggugaaaccuuaugucuacuaaaaauacaaaaauuagcugggcaugguggugcgugccuguaauaccagcuacugaggaggcugaggcaggagaaucgcuugaacccgggagguggagguugcagugagccgagaucgcaccacugcacuccagccuggaugacagagugaaauuccaucucaaaaaaaaaaaaaaaaaaaaaaaagaaaugugaaggccaggugguggcucacgccuguaaucucagcacuuugggaggcucagguggaccgauugcuugagcccaggaguuugagagcagccuggccaaaauagcaaaaccccaucucuacaaaacaaaaacaaaaaaauuagcugggcaugguggugcgugccuguggucccagcuacucaggaggcuagagccagagggucucaggccagucugccccugccccacggggccugggcacaucccucccuaauucuucccagccucucucugacccagggggccuccucucccuuuuuuccccuuaucucagccuccagccaucagcaaccuccucuuccucuccacccagcucuuccucucccacuucggccuuuucuuucucacacuccauuucccucuacggcaaucugugcagccucuucccccagucucauuuugcgggcuuuucucucuuuucuuuccuucccuggcacccaagccaaaggcccugccucuggccuccagcccuacccccuucugcgguugcacagaaggauggcugcccagcucuuaaaaaaacugcccgggaacuguugacaucuguucucccucccccgcuggcuuuucugauuggcuuacaauccugaggcuaggaccgucucaggagccaagagaggagagcggccacagggaaccuagggucucaccaagcucuccuuuccuucugcagggaccugcuccgaaucggagucacucuggcgggacaccagaagaaaaucuuggccaguguccagcacaugaagucccaggccaagccgggaaccccgggugggacaggaggaccggccccgcaguacugaccugcaggaacuccccaccccagggacaccgccuccccauuuuccggggcagaguggggacucacagaggcccccagcccugugccccgcuggauugcacuuugagcccguggggugaggaguuggcaauuuggagagacaggauuuggggguucugccauaauaggaggggaaaaucaccccccagccaccucggggaacuccagaccaagggugagggcgccuuucccucaggacugggugugaccagaggaaaaggaagugcccaacaucucccagccuccccaggugccccccucaccuugaugggugcguucccgcagaccaaagagagugugacucccuugccagcuccagagugggggggcugucccagggggcaagaaggggugucagggcccagugacaaaaucauugggguuuguagucccaacuugcugcugucaccaccaaacucaaucauuuuuuucccuuguaaaugccccucccccagcugcugccuucauauugaagguuuuugaguuuuguuuuuggucuuaauuuuucuccccguucccuuuuuguuucuucguuuuguuuuucuaccguccuugucauaacuuuguguuggagggaaccuguuucacuauggccuccuuugcccaaguugaaacaggggcccaucaucaugucuguuuccagaacagugccuuggucaucccacauccccggaccccgccugggacccccaagcuguguccuaugaagggguguggggugagguagugaaaagggcgguaguuggugguggaacccagaaacggacgccggugcuuggagggguucuuaaauuauauuuaaaaaaguaacuuuuuguauaaauaaaagaaaaugggacgugucccagcuccaggggu

SEQ ID NO: 191559 - RNA, 5430 nt, Homo sapiens
acuggcgggcgggaucccuccgcucuggggaggcagcgcuggcggcggggcuggggccacugaggaaauccauccgcgccgccgccgccgccgccgccgccgccgccgccgccuccgccgcggaggaagacagcgccgcccgcgcaccgccagcgaccuccgccgcagagucccaccgccacagguaccuucgcuggcaaaaggaguccucucgccccccagccccaauuucccccaggggaaccucucuuccuucggucucccggggcuggccuccugggagcggacguaacuccccagaccuccgcucccuuccccucuugcccggucgcucccaaacccggaaggggaacuggggaacccucgccccccaccgugcgugcgcuuccccgcaccaucagcgaaguuuuugcccgaccccagaccccagcccagccccgacugccucuugcucccucggaaguuggggggcuaaauuccgggcuuccucuaggccccgccccgcccccuuuccccaccgccacccucccgccugcccccggggagcaccccucguguccuccacugucgcaccccugccggcccucgccuugcacaacuccaaaaucggggagaagcaggcaaggccgcgcgccacccuuccuuucgucuccacccuacccacgauuugggugcugcccgugguuucuggccccacucgccgaaacuggagcccucggcgcccuauucccuuuacagauccucaccccaagcccagcucccaggcgcccgccccccgcccagcuuucuuuuaggcaaaauggaggucguaggggcuggagggccaggcccacugcgcuucgcagcgccgcaccagcccgcgccuuccagcugccagauccagggacccucccgucacucuccugagccccgccagaccugcggaggcgguugcacccucauuucucuauggagcgccggcugcuauaucccuagagucugggggcugcugagggcccuggggggugauggggaccgagggcugagaacgucgcccccgcccccaguuucuuccuccagccgugcuuccuucugcccugggccuccggcggugccgccaggccugggcugcuaguagguggaagaggcuuugugcgggccuggggguuggguagaguaaggaguucugcccgcaccccccaucccccgauuuugagggucaccccuuggcacuggcguagaaagcugaacuuacaaggaggggaaaugucaguggggaagaggaacgcccugcgccugggggaagugggagcugggugggggacgccugggccggccaagugcaguguguacggccggaucgcacaggugucccgcgggcggggaaggacucaggcucccggagcggagccagccgggccccuggggcccgggcgccgagccugcgggcugggccccccggguguccagggcgccgcggccaggccgccuggggccgcccgcccgcgccugggagagagcaccuccgcgccucggggccggggaccucguugcggagccguaauuacucgagagcggcucccacgggcuuucugcgggcgcggcggggcgggcggucccugcgcuggagggagcagcggcucggggcugccuuccccgccgcugucacccccacccgcggcggacggcuaauggggcgcagccggaccggggauuauccggggugagccguccagaaccuauuagcgcccaaucggcuuuucccaaauccuguaaacagccacccgggccgguucuggggagggcgggaggcugggucgggcgggggcgauggggccggggguggggucacccacccuacaggucucugccguggaugcgguugccuuggcaacggggcuagggugggggcauuucaccaaugaggugcucucgguccgggugacgguugccuaggcaaccccacgaacagcccagcuuuccccucuggucucuccccccacccgccaccaucgaagcuggggguguguguggagggugugcgccuuguggggugaauuucaagaggcaccgccccuuuuaaaauuaggugcuuggagggcggugccugugcgggcuggggcagaagccaggucuguuuucgaagggacacccccgccccccccgccccaguuccugccgcggguguccugcccgggcuguguccgagggagggguuuccccugcgcuuccucuugcacuucccgcuccguuuccggggggcgggaggaagauuggggaagucggcucuuacucggcgacgucucuggugccggagacccugguugugcccggggacggcggccgcgccgccccuucccccuccccuugcuuaccccuuccgggccgcgcugcaaccccgccuuucuccccacuuccccggcggccucgggccugacgucagcccugcaucccccaggccucgggccagcggccaggagcugccucccccagcccccgucccgcggcccccagccgcccccaacccugccccacgggcccggcgccaugagugagcuggagcaacugagacaggaggccgagcagcuccggaaccagauccgggugagggccuggugcggggcgggcgauucauguguacaccgcccggugcccuggaccggguugggugaggguguuggugggggaagggggagggagggccccuuaauggcucagaaucugacccuguccacuccugucuucuguucucuucucucccuuuccuccccaaccugucuucucucgcgucucucuggcucugccaucccuuacaggaugcccgaaaagcauguggggacucaacacugacccaggugagggcacuugguggccagagcguaacuagggguugaaggggcaaggaucagaggccgcugcccucugcaguccugcugccugggccuccccgagcgcauucugucucuaccuccagaucacagcugggcuggacccaguggggagaauccagaugaggacccggaggacccuccgugggcaccuggcaaagaucuaugccaugcacugggggaccgacucaaggugugugugugugcgcgggcuggcgcugugggccgacuuucuagcaggccgugggagcagccucagaucuggcggaguaagcaggccaccaaaauacccagcguacgucuggaaaaacggugacucccagacauguccgccagaccuggacaggcaggaccaugcuggugagaacuugugggcugcagcuggagacugucucucagguggcucacgccuguaaucccagcacguggggaggccagggcaggaucacuugagcucaggaguuugagaccagccugggcaacauagugagacccuggcucuacuaaaaauugaaaaaugagcugggugugguggugcucaccuuguagucccagcuaugcgggggaggcugaggugggaggaucacuugagccuaggaguuccaggcugcagugagcugugauggugccacugcacuccagccugcacaacagagagagacccuaccuucucccacccaaagggaagggggugugucuuguuuucacgccacccuucugcucucccuacaccguuccccaccaggcugcuggucagcgccucccaggaugggaagcucaucaucugggacagcuacaccaccaacaagguaggguggcgcgggcugcgggguggggcagggccacagggcccuggcuggcucugaccccggcgcuuccccugcuccgcagguccacgccaucccgcugcgcuccuccuggguaaugaccugugccuacgcgcccucagggaacuuuguggccugugggggguuggacaacaucugcuccaucuacagccucaagacccgcgagggcaacgucagggucagccgggagcugccuggccacacuggugaggggccuggcccaguucgggcccuuuuugggguuggggggugcacugcccuccguguggagaccuggcugaccagcuccuuccccaggguaccugucguguugccgcuuccuggaugacaaccaaaucaucaccagcucuggggauaccaccuggugaggcucugccagggcugggcagucugggcaaacccacacuuccugccucaggggccaccgucccagugcucaacaugcagcaugcaccguagccucccucuccuggugggcgcuaagggggucagggagggaugcguccccuccccaccuaaggcucugagaagagccucccuggacccuuccacaggguugggcucacgugguggggcggggagaacagggacucuguucuucgcccugucucuuaucuuuucuuucuuccugucaccucuccagugcccugugggacauugagacaggccagcagacaguggguuuugcuggacacaguggggaugugaugucccugucccuggcccccgauggccgcacguuugugucaggcgccugugaugccucuaucaagcugugggacgugcgggauuccaugugccgacagaccuucaucggccaugaauccgacaucaaugcaguggcugugaguuuuggggcgagcuaggccaggcccuccccaccaggcucccggcccugcuccucacccucacccucaccccaucugggucccguguccugcaguucuuccccaacggcuacgccuucaccaccggcucugacgacgccacgugccgccucuucgaccugcgggccgaucaggagcuccucauguacucccaugacaacaucaucuguggcaucaccucuguugccuucucgcgcagcggacggcugcugcucgcuggcuacgacgacuucaacugcaacaucugggaugccaugaagggcgaccgugcaggugacagcuggggcccaggcugggugggcagggaccuggagcccaggcccaauggguucugacuucucucuucuucacaggaguccucgcuggccacgacaaccgcgugagcugccucggggucaccgacgauggcauggcuguggccacgggcuccugggacuccuuccucaagaucuggaacuaauggccccacccccacugggcccaggccaggaggggcccugcccaugcccacacuacaggccagggcugcggggcuggcgcaaucccagcccccuuccccgggccacggggccuugggucccugcccucccacccagguuugguuccucccggggcccccacuguggagauaagaaggggauggaaugggggaagaggaggagcaggaggcccucauccuucugcugcccugggguuggggccucaccccucuggagggccggaggcaggagguggaaaccccaggggcuggcuuuuuuaaaacugguuuuauuuuaauuuuuauuauauuuucaguuuuuccauaaaggagccaauuccaacucugua

SEQ ID NO: 191560 - RNA, 3240 nt, Homo sapiens
ggcggggccgaggcuggcgggcgcggggaaaauggcggcggcggcggcggcggcugcagcuacgaacgggaccggaggaagcagcgggauggagguggaugcagcagguaacgggccgugcggggguggcuuccggagaccuccuucagggguucguugaggccucccugugcucccgggagaagggaggagggcggagcagcaacaucuuucccugggauaaguuacgggaggaaaguguggcccgggcuccgccgucccccacugccaucuccagggaagaacguggggcccggacucucacccucucuccuuucccuccacccuuaguaguccccagcgugauggccugcggagugacugggaguguuuccgucgcucuccauccccuugucauucucaacaucucagaccacuggauccgcaugcgcucccaggaggggcggccugugcagggugaguguugggcauagacuccagucucuucuccuugcucaccucccccaggcaguggucuuuuccccuuccucuacuggagccaauucccccucccccaaaucaucguuuccccaauacaugguucccacugaucucagacccucaggucauagaaguuucuuuacccucaccuuuuccaugucauucucuuucccagugauuggggcucugauuggcaagcaggagggccgaaauaucgaggugaugaacuccuuugagcugcugucccacaccguggaagagaagauuaucauugacaaggaauauuauuacaccaaggaggagcagugugagaguggaauagauguggggaagaggagugggaguuaaaaaaaaaauguacaggguggggaagauggagaggguuggaaagaaacaggagaggagaccaagaacaggggagaaaaagugaagaguagcuggagagaucucagaaaaagaaaacguucagaguucuuucucaaaagaaagcaaaggaugagaggagacaggauagaagggaguaguuauucuaaacugagccaggauuugaggagggaggagagaagcuggugaaaauacaccaggagcuucacauugaggaaggaugguuuaaagaauuacuaugucaggccgggcucagugacucaugccucuaaucccagcacuuugggaggccgagguggguggaucaugaggucaggaguucaagaccagccuggcaaacauagugaaaccccaccucuacuaaaaauacaaaaauuagucuggcaugguggugcgugccuguagucccagcuacgcgggaugcugaggcaggagaauugcuugaaccugggaggcggagguuguggugagcugagaucaugccacugcacuccagccugggcaacagagcgagauuccgucucagaaaaaaaaaaaaaaagaauuacuauauguucuggccccuuccccucuaguuaaacagguguucaaggagcuggaguuucuggguugguauaccacaggggggccaccugaccccucggacauccacguccauaagcagguaugcaugcucacaccugugcaugcuggggcagagaauggagaaugaggggaaggagaaagguagggggcacugacuuccugugcauugucccucucuuccaggugugugagaucaucgagagcccccucuuucugaaguugaacccuaugaccaagcacacagaugugaguaauacuccaugccuacucugucaugauugucgcuauaccuuuuacugugugacacuccucuauuggggaaugccagaugccacuuaccagcugugacucuggcuuagucauuuaaucuccaaacugugaaaggagguaaucccuacuucauugguuucuugggaagaugagaggaaauguguaaaagcagcuagcccaaauguuggcauauaguguucagguuucuccgucuccuucacagcuuccugucagcguuuuugagucugucauugauauaaucaauggagagguaauacccuacccuucaacccucagauccugcucuuggccucuuuccugcuuuugauucucccuuuguggguuaccuugcccuguaggccacaaugcuguuugcugagcugaccuacacucuggccacagaggaagcggaacgcauugguguagaccacguagcccgaaugacagcaacaggcaguggagagaacuccacugguaauggaggggauuccuuggaagugggguuggaagguguggccacaucccgucucaaccuccuccuguccucauccccuugcaguggcugaacaccugauagcacagcacagcgccaucaagaugcugcacagccgcgucaagcucaucuuggaguacgucaaggccucugaagcggguaggacaggggcuucccuggcauucuuccucucccuccuggggaagugacagcauccaaacuaauguagucucuuuuugugccuuuaggagagguccccuuuaaucaugagauccugcgggaggccuaugcucugugucacugucucccggugcucagcacagacaaguucaagacagauuuuuaugaugugaguguaaaacccggauggggaggcggggcuuaugcugucacuuucacgugcaggacuggggacuguuguuccccgggcaugccacgagggaucccgaggaacugguccuuucuguucccucccagcaaugcaacgacguggggcucauggccuaccucggcaccaucaccaaaacgugcaacaccaugaaccaguuugugaacaaguucaauguccucuacgaccgacaaggcaucggcaggagaaugcgcgggcucuuuuucugaugaggguacuugaagggcugauggacaggggucaggcaacuaucccaaaggggagggcacuacacuuccuugagagaaaccgcugucauuaauaaaaggggagcagccccugagcaccccugcugguggcucuguccucuguuaggcaccacacugguuggucaacuuggauguucaucgaggcucauucuggccuugcucagaagcccuucugaugcucuucagugagggaggcacuaccauuugaagugaccccaugucagucacauggacuggucuuuagcaaaguccaaggcugccugcuuccaccuaaguggucucuguucuacacuuuaaugucacccucuacaucaucuuaccuagcccacccaaccuuauaaacaugauaauugacuacuuuccugagcuaa

SEQ ID NO: 191561 - RNA, 42416 nt, Homo sapiens
uaugguuugaaguggugaacauggauuuuucucggcuucacauguacaguccuccccagugugugccggagaacacgggcuacacguaugcgcucaggugagugugcaccugcacgugggguccuggccuugcaaugcccacucgcugucgcgguggcguggaccuuaacaggaacuccauaguacuaccgacuacaugcuguauuuugaaggugaaaaaaaauaauaaacuguaucuuauggcuuuagaggugguuuuuucuuacggcuuuaagguaaacugaaucuguucauccuggugacugggugguuagucaucgcacauggcuugcuggcuucgaccccacccaggugguugugauguugagaagaugucucuguggugaugccugguguuugugagaacguaucaguggcuugguauuuuuaaguuaacagaaauaaccuggaaaauuauuucccauuucaaaggaaacaucauagaacagcguugaagcucaggguuuugagaacacaacuuuugucugaggcggaguuuucugcuuuuauucauauuccgauccacugaaccaagacauuggagucugaagaggcgcugcccugccccuucugcuuucaguuuuccaaguagaaagagcgacugaaacgaaguuugcguuugaugacauuacgggucagcagcaagggaagguacacagcuagacgggcccggauuugaucagcagguuggaaaacuugugcacccagcagauguuuaaggcaccaggaaaaugcuuguguaauuuuuuucaguggcuuauccuuuuuuuuuuuuuucguuuuuuuggagacagagucucaccgucgcccaggcuagagugcaguggugcaaucucggcucacugcaacauccgccucccagauucaagcaguucuucugccucagccucuggaguagcugggauuacagacgugcgccaccacgcccagcuaauuuuuguauuuuuaauagagaugggguuucaccauguggaccaggccaaucucgagcuccugaccucaggugauccacccaccucggccucccaaagugcugggauuccaggcgugagccaccgugcccggucucaguggguuauccucuaaagggugaaaauguaauggaaacuguaagaaaauuagaaaauauuuuaagaaaaauacuuguuaccagcauuagucagagcucacauucgaugaucgaguuuuuaauucacaguucuagguccaucacacuuccauagcaacacacucuguuuucuaagaguccuguaguggugagaacagaacgggcaggccagcucaggggagacugcugcuuccuucagaccgugcagcaugaaacagugauuuguggucacuuauuuuugcuuuucugaccuauuuuaauagaguuuuuaaaaugccucuguuucuuuaccuugggagagcaacacuuaauuucacugaaauucacagccuuccuucagugagaccugugggcagaccucuguggcagcuggagugggaaaugcagagggaaggugggcaggggcuggccggagugguuguaggcugggcugggaauuuagacucuuggugggcaggggcuggcuggaugguguaggcugggcugggaauuuagacucuuggugggcaggggcuggccggaugguguaggcugggcugggaauuuagacucuuggugggcaggggcuggccggaugguguaggcugggcugggaauuuggacucucgggcacugggaacuccugaaaggauuuaaagguggggggcucucugagguugcugcaggauagaggucaggggcuguccaggagauggccggagugccucggggagguccagcucuggaucaggaccagagggaaggaccagccgccucaccugaguggaggcccguggagcacagccggagacuggaggugggggccucagggcuggucuggacaucagugccuggguccuccugguccugggcuggccucccgcagaccuugccaccucagcuggccggccuugcguuggguccuuacacucuucucugcuuccuuuccuuuggcuccucguagcccugaccucuuuucugaaaguuccccuugucuugcagcccuccccgcacagcuggaagguggagcggccguuccugauggcuuucugucuccaucacuacccuugucuugauucuuagcaauuucaguaaacacugaaaggauaguccagcauucuggccacucacuuucuuuaauuaaauuuuuuuucucuuuugggggccaggcgcaguggcucacgccuguaaucccagcacuuugggaggcugaggcggguggaucacuugagguaaagaguucgagaguagccuggccaacauggugaaaccccgucucuacuaaaaauacaaaaauuagcuggguguggugguaggcuccuguaaucccagcuacuugguaggcugaggcaggagaaucgcuugaacccaagagguggagguugcagugagcugagaucgcgccacugcaguccagccugggagacggugugaggcucugucucaaaaaguaaacaaaauaaaauuuuuuuucucuuuuggaaaaugauaauaugcagguugagagaauagugacaagcccauuugccggccacuggcuucgccagugaugcaugcgggucuuccgcccccacccagcacuucggagccucugcgacuggugcuucaguucacggguuccccagcccgcuguccugcaccaguggccuggcacucuccucacugggacagggugggcccgaacacuuacucucaacuuccccuggaacuucacuggauucuuuaaagccagucucuaaaagauaaugauauauuuaaaauaacccaaauaccacuaucaucccagucauuuaaaagggcuucuuaauguauuuagucaguguuccaauaucccagauccuugaauuuucucuuucacaauuaauuuuuuuuuaaauuagccuaaacaggauccucauguuacauugggugauuucccucuuaaaucucaaucuguaauucuugucaacugguaguuaagucuggaagugcagucauucuuugguuucuuucuucauuggcgugacucugugacagaugguguuacgggauguugcucccugucacagcuugagucugugcugucugacgugucuccucuguuagcgcugaggcugauggauguugucagcuugacccacccgcaguaaaauccagccauuggugaugguugccuugaacuucagggucagaggaggauguuucccggagcccucggaaccaacgugcugcugcccaugcucagauccaggggggcuggagacaugagggucccaccauccagccucucauggggguguuggcuguggaagccgaaagaagagaguuuccagaaugggggacuugucagcaggggcagaugcugcuggacaggcgggaagaaggggcaacucagccauggaggccggggggccuggcagaagccgcuucagagccuccacggggcaaggagcgagccgaaacuagccggcgcugcaaccugucggcugcugggggagguggagaggcguggcuuugaggggaaguuguuuuuuaccgugggcugagccaagcgugugucuagaugcugguggucaggagccaguagagaagcugaagauguaggagaacgaggaagggccuccugcagagagagaggagggaaggaggaacuccauccagagcacgcaggcuuggcucgggauuacuuuuccaucgcagcaggcaggaagggugugucaggguagaacaugaguaaacguaugaauaggugcauaggaauagauugauuaugcggaauuggcucauggaggcuggcaaggcccaagaucuucagguugaguuggcaaggggagacucagggcagccgaugguguaaguuccaggccaaguccagaggcccaagacccaggagaaccacgguauaguuccaguuugaaggucagcuggcucauggaagagcucauguucugguuugagucugaaggcaguuuguagcuggcguuccagguccaggcuguccagcaggaggagcuccuucuuacugaagccuucguguucuguccaggccuucagcugacuggagggcagucugcuuuccuaguguuuuaauuuaaauguuacugucauccagaaauaaccucacagauacacucagaauaauguuggagcaaauaucugagcgcccaaggcccagucagguugacacaugcagguaaccccugcagagggaaaggaugggcgcggucaaggaggaggcaguuuucugauggcaucuggcuuuucugggaagaaaaaugcagggcauuucugacagagaccgagagcuggagggaaggagguggugacgucagacguggggcggauggagggggucugagaaggccauugagggcugggcacacauggcccccgacgcauggauggccugaggaccuggggacugcgaaucaugacgcacucacaccugcaacauggugagcuugggagaaagcgucuaggcccacccuguccuggcagggagagugccaggcccccuggggcagcaggacagugggcuggggaacccucgugagcugaagcccugguugcggaggcucugaagugcuggggugagcaggguuccguggcuggaagagcuggggcgagccggggucuguggcuggagucggugucagggcacagccgucacacucugagcagcggucugaagcacgucagucucagacacguggacugugccgcuuuugguccggcuccccugagcugaguuaaccucgugugccuuugucgggcaggugcuguggguccagggaugcuugguaucugucucugguuuucaauuggagucaauuuuuuucaaucuuuugauacaaaguacaucuaaauaacacauuuuuaaaagaacagugcauaacuaaucagagagagacguuaaggccuaguggucuuaaaggugagaucucuuaucuucagaguuuuugucagucuugucuccuuguucuguuacuuaauucucucuaauccuagacuggagaccuccguuugaaauuuuauguucccccaaacauugcagaaaagguaauaaagugcuuuaauacgauagccuacugggcuguguugauuccugggauggugcugggccagcauccguguccuccugucuccacuggacacugguguccuccugcagggcucugggcauaccugucuguaggaaccauguuauggaugguggcuggguucacagguuuucuuaaacuagaaucacaauuguguaaaauauucugcuagaaacaaacccuucuugagaugacacugaaauucugucuggcuucauaacagucaucagcauucaacauagcuuagugcagucucucucuuguccccaccucagccucuaaguuaaagaagaaccucuuucuuaaauuguguguagugacucaaagcaguuuguauuaacuuacuguuggucaugaacguaugacagggucuagcucuguugcccaggcugaagugcaguggcacagucauagcucacugcagccucaaacucccaggcucacgcaauccuccugccuaggccucccuaagugcugggauugcaggcgugaaccacugugccuggcucaucuuuuuauuuaauuacauuaguugaauaauuauauggaagguauuggaagugacugucuuuuggucacaggcucaaagcaguugugaauugucugaagccuuuagauaaauucuaaauuuagaaggggagcauugacggcccgaucacuuggccuccucuccugcguggauucauucuacggcgcacugguguauuggauuaaaucucacguccgcguaguguugacgaggaaacacacucugauguguuuauagcaaggacguagguggggacucagggcucuagcauaugcccucaagcaguucuuagggugaguuguagacgcugggccccagcaucugggaaugugcuguccuacaucugaugugaaggaagaguggcuggggcagaugucaggagcccaugcuggcugaccugugugccaccguacguuugcuuuagagugagguugucacccaguaauaguugcucuugaaaauccacaguacauugcacuuucaguuuaugguuuguucauuuuguuucagaaugggggcuauaagcacugcuuaccucugaugagcuuuuuccuucuaguuccagcuauucuucagaugcucuggauuuugagacggagcacaaauuggacccuguauuugauucuccacggaugucccgccguaguuugcgccuggccacgacagcaugcacccugggggauggugaggcugugggugccgacagcggcaccagcagcgcugucucccugaagaaccgagcggccaggugagcaccgcugcacuuccucuccaucugaucucuaacaccaguuaaaaccaagcuuccauacuuuuuggucuguaaagccgcacccugucucgagcuuaaggauauguguguguaugugcguguacagacacacaaaccugucauauaaagugguaguuugcugcaaauaaagacugaaaggaacucuggaaucuguguggcuugucuaguauugauguucugcuguucuuguuucaaguucucuucgcuggugcacgccacgugcagugccagcacucaggucuggaagcuuugugguccuguggugggagcucagcuacagcuguccuaccacauguguaaagaggaaggaaucuuacagauuacacaugcugucguggacgaucuccguguccaguucauucuuuuuucuggagacggagucucgcucugucgcccaggguggaaugcaguggcacgaucucagcucacugccuccucugucucccggguucaagcgauucuacugcacgcagccuccugaguagcugggauuacaggcgcccgccaccacgccuggcaaauuuuccuuuuuuuuugagacagagucucacuucguugcccaggcuggaguacagugguggcgugaucuuggcucacugcagccucugccucccggguucaagagauucuccugccucagccucccgaguagcugggacuacaggcacccaccaccacgcccagcuaauuuuuguauuuuuaguagagacgcgguuuucaccauguuggccaggcuggucucgaacuccuggucucaggugauccgcccauugcagccucccaaagugcugcgauuacaggcgugagccacugcgcccggcccaguucauucuuuaggucuuuauuaaaaaucuguguguuaacugacaaauacauaaaguuuagguuauuuaccuauauuugcguucgucgaguucauuugaucucugaacucuccacgugcccacuucugugcagagaaggaacaaaagucuacaagaucuuugugccauuuagggauaauaaaagugacagcuuuauguugcucauguaagaauaagagcuuccguuccagucaucuuucucucgagaaggaagacgguggcuguuaagagcgauggcggaaugguugauggguggagaacugccugggaucugaacagccacucccagccgguggcuuccacaggcaccacagucaucuagggaguucacugcgcaaagaguucgauucccagccucacccuuggagaugcagggugugaguucaugaugcagcugaggaccagcagaucccauuggguagcuccgugucaagcacccaguuaccagggucgcacagcagcccagucuccgucucccaguggcguggagagcaagugugcugcagcuguacugccacgccgcgcucugccgcgccacgcuccuguggccgucguccucccucugccgggugucacugcugccuuuggccucccaagcuuccuucgaaggggaggaucuuguucaucguccuggguucccccuaccugacggugguaacauucacaggguguuuucaucugauggcuuuccuguugucauuuguggucaauaugaaugcagaaauuauuuuuugaccaucuauucuuuuuuuuuuuuuuuuuuuugaaacggagucucacucugucucccaggcuggagugcaguggugcaaucucgacucaccacaagcuccgccuccuggguucacgccauucuccugccucagccucccgaguagcugggacuacaggugcccgccaccaugccuggcuaauuuuuuguauuuuuaguagaggcgggguuucaccguguuagccaggauggucccgaucuccugaccucgugauccaccugucuuggucucccaaagugcugggauuacaggcaugagccacugcgccuggcccuuauauuuugagacagaguuucgcuuuuguugcccaggcuggagugcaauggcgcgaucuuggcucaccgcaaccucugccuuccagguucaagcgauucuccagccucagccucccgaguagcugggauugcaggcaugugccaccaugcccagcuaauuuuguauuuuuaguagagaugggguuucuccauguuggucaggcuggucuugaacucccgaccucaggugauccgccugccccagccucccaaagugcugggaugacaggugugagccgccguaccuggccuaugaccaccuauuuuuuuuuuuuuuuuugagccggagucuggcucugucacccaggcuggagugcaguggcgugaucucagaucacugcaaccucugucucccagguucacuccauucuccugccacagccucccgaguagcugaaacuacaggcgcccgccaacacgcccggcuaauuuuuuguauuuuaguagagaugggguuucaccguguuggccaggauggucucgaucuccugaccucgugauuugcccauuucggccucccaaaguacugggauuccaggugagagccaccgcgccuggccaugacuaccuauucuuguuguacuuaacacaauuccaucuuuaccagcaacuuagaaaucguuuuuagaaaaggggaggauuaaauuuauaaaucacagauguuuuuauuuucagaucuuuuuuauuucuaguuuauuuuagcuuuuaaccacuuggggucauggugcccaaaauaaccuggaaacuauuuuguguuuacaauuuuagagggaguucuuggaucccagcucaaaaauuccuuuuuuauauuaacaguugauucauuacagcagaaaaggcauaggaaaaugguuugccuuaaaaugcuguuuauucccagauuaagaguuuguguuggucaaauguaaucauuuuguauuugcuagaaaagaucuauaaacuugcuguuuuuuuuucuucuuagaacaacaaaacagcgcagaagcacaaacaaaucagcuuuuaguaucaaccacgugucaaggcaggucacguccucuggcgucagccacggcggcacugucagccugcaggaugcugugacucgacggccuccuguauuggacgagucuuggauucgugaacagaccacaguggaccacuucuggggugagucccugcgagacacagauugucccgccuacaguugggguguuucucagauuaugcuggggagaggggaggcgguggccagguugucgguuugcauggauuaugcuagggagagggaggcuguggccacauuguggguuugcugcgugacuggcugguaggagcaucaguuagguuccaggcuuguccucagacuugaucaggacgcuccuuggaagcugcuuccaugugcgccuugucggguggucauuggguuaugcuaacguguagugacuaguuccaauggggagaugaagcagcagguaguaaucuuauaacucuguuuuuauaaaugcauuacuuuuguaggauguuugaacaaagacaauccaaaaacuucaguguguuuccaagaaagcucuaagcagugaagcagccaggguuagagaguucuuagagaaugcugcagggugaggcacuggcgcucagacuuggcugacguggagucugggcagugggagccccagccuggcuggcgagagcauggggucccaaggcugugcauggagagggaagcaugguaaggggcgcccagccgcucaucugcauucgguuuauguucugguuggcccuuuugagacaauuagaagauccagauuaguuccagagaucacaugugcuaauuuugggaagccuugguauugguguuuguucuguuuugcucagcuagugagagugguuaccaggcaacagagaggcaucugcugcugcugaggcuugugccuugcugagcgggcugugagaagauagaugggcuuuccucuccuucccucauguucugcuuuccuccuuaggccaggugcugugugugcugccgucugucuguauuuucuucaaggauaagcuuucaccuucagucagaagaugguaucugcauauaucuggaggcauuuuaggaaauaaacugugaccagugccauaaugcugauuuauuaaccauuguaaccuuuacauuuuuuaauggguuuuguucuuauuugauaagcugagcucaacagcaaaaauguguguguguguguguuuuuuuuuuuaggucuugaugaugauggugaucuuaaagguaauuauuuuaguccuuuuaucuucauauacuuuucaaaauagaaguuuuaguuaaauaucugcagacugugauaaacagguuccaucuacuguuugaaaacuuuagguggaaauaaagcugccauucagggaaacggggaugugggagccgccgccgccaccgcgcacaacggcuucuccugcagcaacugcagcaugcuguccgagcgcaaggacgugcucacggcgcaccccgcggcccccgggcccgugucgagaguuuauucuagggacaggaaucaaaaauguaagucucaguccuuuaaaacucagaaaaagguguguuuuccaaauuuaauauuuccuuucuguaagucucagugucugcacuauuugucuuggagacuuaaaauuaucccuugaaagcauaagaaguacaccccaaaccagcuuuguccuuccuguccucuucuaguuuacauuuuaugugguuaguaauuuuguaccuaaaaguauuugaaauucuauaaauuuggacuugacgugagcaaaagaaaauuucuacguaagcgaaacuaauaaaacuacagucacuuucagaugcacaccuuuauuuuuauaaaacggcacagauguucacacauacugaaggaguggcuuugggacgcugcucuggucuguccugugaagagugguuaugccaguguucgugucgggaaaacauuucccguggucgcuagcccugugcuuauggugauggaggggccuucagagaaccuguaggucugggaaggacacacgugacucugguuuguucugggacagcagcagucacugcaggaaacccccugauguggacaugggcuucccucagaggcgacugggcaagagugugggugucaccgcggggggccuccuccugggccugcaggagagacagaaccacaggccccuuugcggcuuccaggcgggacugggauucccuggggggcugggauucugugcccuucaugacugccuggcccaggaucucucucaccugcagcaggaagaggcugggacccucggccgggccgggugcugccugguucucaagcccuuagcagcuuguccuucgagcucacguucugcugugccuggaggugcuggaagccucaggagggcagggccaggucugucuuauccacuccgagccuggcauugcccgggacguggggcguuuguccaguauuauucaaaugaccggacauaaugaaggauggcgacaggacgaaggcuucugcccuaagauuucucgcaucucguuuuuaccaucuugucuucguggcccucacuugugguugugucugcugugguguuauggacacugcuaguguuaauacagcacaauaagaaagugugaaaggggccgggaaagguggcgggagcggggcggcacguggguuccccucacagcacugugcacggugccugcuuggguuccuccauguggaccagcaccgcugagcggccacucugcgccaggcacuguucaugggugaucacggcagcccccuuauuacagacaagcaaacuggggcuuagccagcucaggaggcucgcagguaggugggggagccuggagcugaacccaggcgucugacccaggugcucccccuuagccaccugccuccaugagcacuuggcaccccagggccccgggggugcugcacgugagccguggcguagcuuaaucgacgcgcacaaggauuccguguauucaguguuuauugaggcuguguuuugaagcaugccauugauagguugaacauaacauuuuucuuagaauaaaagcacauuccauacacucuacuauggcagaauaaggagguucacagauaauugagagaagccaccgaaacgugcuguuuucugaaggucucccuacgcguguuguaguaaaugugugucucucugugacugacaguaugcuggcggucagggcccaagcucagccuugcguuugaguguaucuuuagauggaaaaggcguuggugugguguggauuguagcuucccgaaacucauggcgccuccccucggacgucggugucguggcgccuccccgcggaugucggucuuggguguuuugggggagaaaacaagccccauccuucccgcgggguuucugggcuucacgccugccuugcccucucagacaaaggccaggacuugugcggcccacacuaguguaucgcccuguauuagaguaaaacauguuuaucaaagaacauuggaaaaucagacacaaagaagaaaauaaaaaucaccuacaagcugccacaccagaaaaaaaaaacacacuuccagaaauuuccccucugcauacuuauagucagauugcaugaauuguuugcauaaucauauuuacuuaaaauaaguauagcuuuccuuaaguauaaauugucccuccacauuuuguuuguuuuuguuuuuuauguauguacuaaugguaauucucacuguaaagucuuucaguaguacagauaaaauaaguccuuuucccccacccaauccaucuccugggggaaccacugcuaaugauaauaguugagugggaauucuuacgcuuuuuaaaaugagguaaaauucagauaacaugaaaugaaccauuaacgugugcggcuugggagucguuggccuccccagugcugcguggcugucccgggguucucgucagccuccccggugcugcguggcugucccgggguucuccuaggcaccugcaggacugugcaguucuggcuuugucuuuccugaaaugccaucacgguguaugcacaguuuagcaucucuuuucauuuuguauguuaauugagguuaacuuuauucuuuuugaugccuguacaguuuuuuguuuguuuguuuguuuuuugagaugcagucuugcucuguugcccaggcuggaguacagugaugugaucucagcucacugcaaccuccaccucccgggcucaagcgauucuccugccucagccuccugaguagcugggacuacaggcgcccacuaccaugcccggcuaauuuuuguauuuuucguagagacgggguuccaccauguuggccaggcuggucuugaacuccugaccuugugauccgcccaccuuggccucccaaagugcugggauuacagggaugagucaccaugcccagcccaacacacauuguaucuuuuaaagugagagguggcacguaccuguagucccagcuacuugggaggcugagaggcaggaggauugcuugagcccaggagguugaggcugcagugagcugagaucauaccacugcacuucagccugggcgagagugagaccugucucaaauaaauaaauuaaaaaauaggcuggguacuguggcucaugccuguaaucccagaucuugugggaggcggaggugggaggaucacaugaggccuggaguuugagaccagccugggcaacauagcaagaccccaucucuaaaaaagcagaaacaaauuagcugggcaugguggcaugugccuguacuuccagcuacucaggaggcugaggugggaggaucgcuugagcucaggaggcuugagaccagccugggcaacacagugagacuucuucucaacaaaaaauacaaaacgucagcugggcaugguggccagcgccuguaaucccagcuacuugggcggcugaggcaggaggaucacuuaggcccagaguugaaggcugcagugagcuaugaucaugccccugcuaggccacagagcaagagcuuaucucuaaaaaaaauuaaaaauaaaaauaauaaauagcaaaggaggagauucuggugcuccagugucccauucuuaagcuggugggucagagguacgaagcaaauggcuguuuggcaguaucugaaugucguaguguaugugugaacagcauuggagugaaguggccacggcucggguacucuguagaugauugcuagugcgccagcggaguuggcggccuuccccuggggguuaccccgcaguccagucuccgggguccccuggggguuaccccgcagcgccgucuccgggauccccuggggguuacuccgcaguccaggcuccgggauccccuggggguuaccccgcagcgcccucucugggaucuccuggggguuacuccgcaguccagucuccgggauccccuggggguuaccccgcagcacccucuccgggauccccuggggguuacuccgcaguccagucuccgggguccccuggggguuaccccacagcgccgugcgccagcggaguuggcggccuuccccuggggguuaccccgcaguccagucuccgggguccccuggggguuaccccgcagcgccgugcgccagcggaguuggcagccuuccccuggggguuaccccgcaguccagucuccgggguccccuggggguuaccccgcagcgccgugcgccagcggaguuggcggccuuccccuggggguuaccccgcaguccagucuccgggguccccuggggguuaccccgcagcgccgugcgccagcggaguuggcggccuuccccuggggguuaccccgcaguccagucuccgggguccccuggggguuaccccgcagcgccgugcgccagcggaguuggcggccuuccccuggggguuaccccgcagcgccgucuccgggauccccuggggguuacuccacaguccagucuccgggauccccuggggguuaccccgcagcgcccucucugggaucuccuggggguuacuccgcaguccagucuccgggauccccuggggguuacucugcaguccagucuccgggauccccuggggguuaccccgcagcgcccucucugggaucuccuggggguuacuccgcaguacccucuccgggauccccuggggguuacuccgcaguccagucuccaggauccccuggggguuacucugcagcacccucuccgggauccccuggggguuacucugcaguccagucuucgggguacccuggggguugcuccgcagcacccucuccaggguccccuguccacugccagcugggcucuuccccaagugauuaucuuugguguccauucuaaaagugccugaaaugaauaauuuggcuaccugacuuaucaggaaguagauauuggcuuuaugggaagaaauaacgcauguucaugguuuuuuaauaggcggugcgucuuucuacgugaauaggauuuuguggcuggccagauacacugcaucaucuuuuucaucauuuuuaguucaacuuuuucaagugguuuuaaugaagcucaguuaugaaucagaaaauuacaaauugaaaacucaugaaucaaaagauugugaauccgaaagcuauaagucaaaaagccaugaaucaaaagguauuuaaauauuuuuucccuccuuuuuccaccaaucacacuuucgcaguggagaaagugcugugacuuuccucgccaggcgccucccucgcugccuccuccuguggucuuggugcuggcucucuccuggcuucccccucuggaucuugcaucccugggagcuuguggaacuuuucguuuguucugugugugguuugguucccucagagcugaucaguguugaaacaucuuuaaaguuauuucuuaaacaaaaaguuaaugugcucaacuuuugauuuuuauuaccuuuuuaaagcaaaaacuuuaccugagugguauuuagaaccuguuuuuucagaacuuuuuuucuuuuugagacggaguuucacucuuguugcccaggcuggagugcaguggugugaucucggcucaccgcaaccuccgccuccuggguucaagcgauucuccugccucagccucccaaguagcugggacuacaggcgcacgccaccacgcccggcuaauuuuuugcauuuuuacuaaaguagacaugggguuucaucauguuagccaagauggucuccaacuccugaccucgugaucgcccgccucagccucccaagugcugggauuacaggcuugagcaacugcgcccaacccagaacuauuuuaagcaggccaaucuuuguauuguuugggccacacacacgauucagccagagggugggggcccuuucacgucucuucucguggcccgggcccugucagcggcauucaccugugugguaggagccaucggcugugggaacucuguggaaguggcuagccuugcacauccucugaucauguugacuucaucagggugcgagaagcacuugagcuuggcgucggugaguucccuaagccucuuuugcguguguugcagcucaugccaguuacuaugggagaaugaaugugagagagguucucagagaggauggccaccucaguguaaauggggaagcgcuguguaaguauggcuucguuuuccugugggcgucggucguggaguuggucccacacgcugucauguuggguacuagcaguagagaaugaacggcccgugugacauggugguccucacugaugacgacgggcuguuggagcugcugcuuaagcccucaucacagaagcucauagccaccagaucgcauuugcuuugauuguugacugucucguguguaauugaguuucccaguuucuacagacugccauugcuaugcacggcugagauggacagaguuugcuugugaauccgccacacucacugccugucaccacaccugcaggcgacgacuguaagggcaagaggcaccucgacgcgcacacagccgcccacucgcagucgccacggcugcccggucgggcagggacccucuggcacaucugggcaugugcagguugucucucgccccgucuccgucucaucucgcccugucaccaugcuauuugugucuugugugguuugugcuuggaauucaagugcuuuaaagucuugcuguaaaaacugacaggaauaguauuaacuuugguuuaaaacagggugaaucucucucgaaaagcucccuuguaaauauuuuuuggaagcggagucucacucuguugcccaggcuggagugcaguggugcaaucuuggcucacugcagccuccaccuccagaguucaagcaauucuccugccacagccuccugaguagcugggacuacaggcgcacaccaccacacccagauaauuuuuuuguauuuuuaguagagacaggguuucacuguguuagccaggauggucucgauuuccugaccuagugaucugccugccucggccucccaaagugcuguuggcaucuuaaaaaaaaaguuaguuucaaaaauaauugucucaccugcuaaugaauaaacauaaagccauugauuuuucuuuuaaauucucauaagccauauuucuuugcaugucaaccauguuguaauuacauaguugcaggaauucacaagcagguguuaagucacugugaggagauagccacccacagugagaacuggaacaaaacuuacuuugggaggcugaggcggguggaucacuugaggccgggaguucaagaccagccuggccaauguagcaaaacccugucucuuaaauuaaaaaaaaaaaaaaacaaaaaaaaacuggaacaaaacagauuucaugagcaguuuccugcuuuuuguaaugugagguuugauacuaaguugauuguggcacauuccgucauccggcagugcuguguuaccauucugaaacacuguuucacuagaaaauauuagccuuuagaauaauguuaguuuuggucuuaauuauuuccucgccuagcacauaugaacugcaggugucuauggaauuucaaucugcuuuaaaauaugguaugaucuucccaauauaaauugugcuggcaccaauggccaauauuuguagggcggcuuccaaccuccgcccccugggguuuuuaggagauaucugcauuuuacaccugaaguaucugcaggcagaagugagugaaaacuauuaaaaaauagaacugagcuuuucaaauggucaugucagugcaauauugccagcacuuacaagaguuauuuggcuuuucauauuuuuugaggagacucuugacccaccgaugcaggcuuuggugaaguguguggcuugggcguccccaccgugcugucacugcagaggcuggucccuggcgucugucugaggccacacacgucuucccugcacagguuacuucuugcugcagauucugcgcaggaucggagcugugggccaggcuguguccaggacggcguggucggcccuuuggcuggccgugguugcuccagguggcuauuuuggguuucuguguugcguucucuccagagcuucuggcagcuaagcaccugcacucgauuuaccuaaccaaguaaaaaucucauuuaggcucucaugcuuugacccuuggcguaacgugucucguucuuuaugacguagcaauguuaacugacuguacuugcugcaugagcgcccuugguuucucugggguugggucugggggaaguccggcugccugaaugcccggugcagagaaugcauggaucuggggcuuccucuccugcauucuguccuguguguucaucagcaugauacguuacugccuugcuuccugccguggcgacuagcaucaccgaacuucuucaccuccagcuucaucuucaugugcuucuagcuuggccuucacagaaaugguccauuuaggagcuugguuuuccuaaaaacauuuccuuagaauguuugguguuuucucuuguagggaaggcagccucuggaguguucugguggcuggggauuggaugguaccaguuuguuacuuugauuucuuggcugaauguguuucuucuuaccagguaaggaaauggauaucaugucagcguggugcuuuaaggaaccaauuuugugccaauugcaggcucucauuugauuuguuauuuuguaaggauuuagcuuauauuuacauaguguuuguauauuuuacaaaagugcuuuuauauucuuauuuuucaaaccaaccugugagauaagaaaagcagauaucauuaaggaaaacaaaugugcagaggugaggcagcugggagggccugggcaggaugggggacccagguccaggcuucugcccugcugcaguucccaguggcaucagucaccucagaaggcugugauccgaaggggcagcgacucaggguagcucaggccauucccacagcaccagagaguugguaacguaggucucaaagacaccauuuuacaugaagguucuccugaaggcaucagaagccuuguagauaaaaccguaacugcuuuucuaauacuggggggguggauuuugcacaaaauuaucuagagggggaaaacagauuggugaacccugacuuucauuuuuucuaagucaaagguuuucauuguuacucccaggugccuucgaaacaucugcaaguuuuuagucuugcucaucccacucuuccuuuuacuagguaagucaaaucuggcugaguugccuccgauggcuaagcgguacacacauauguguaacuuaguggaaaaaaaugagcguguaaguccauguuuugagaagcgugguguaccugugugugugugguggcucuucucuuuuagcaggucucuccuuacggggccagggcaauuucuuuucguucuugcccguguugaacugggcaagcaugcauagaacacagcggguggaugacccccaggacguguuuaaacccacgacuucucgccugaagcagccucugcagguaagaggguagaaaggccucucagcuggcacugcacaugugaggucuucagggacguuccacacugcugugagccaggcacuucaguuggguguccuguuguaagaaguauuuuuaaaugucagauaagcaagucuuuggagcuccuuaaguguucuaggauaguucaaaugcacauuuaaaguacucucaugauucaguuaguuuuaauuuuaaaaacauaauaguauucaucacuguacaaaguacagaaaguauagagaagaaaaugagaagcacccauagucagccauguaaggaucaaaccugauacuccggguuucuguggauuccuccauucgugugccgugcgccccagagcuggcgucuugcuguaggacacuguuuggagguuuaacugacucugugcucaugcuuguuugacuaccugguuucauuucucucuugccauuucagggugacagugaggcuuuuccguggcauuggaugaguggcguggagcagcagguggccucucugucuggacagugccaccaccauggugagaaucuccgagagcugaccacuuugcuacagaagcugcaggcucggguggaccagauggaaggcggcgcugccgggccgucagcuucggucagagacgcugugggacagcccccgagggaggugggugcugccgggcuaccaggcuccauggugacaccaacgcgcuucugggugccauguucucuccuuuugggagacagaggggacaggagaggugccguugugaaaagggguugcccuuucuguucuuaguuguugagagcagugugccggagagggaguggguuucccgucgucugccgaugaccaggagcuguggguuccauagcgcacauggaaguggugggcgggagacuugugauaaccccaagcgggaaguccagcggucguggagaaccguggucuuuccuguccuguucuccagauugcccucuuaguggcaggucauggcgcucugucccugcagacaggacagccgcugagauggacacaaaccgucucgugugggucccagacgcacuucucggaggcagccugagaugcucccacccacugcagggaucgcguggggggacccaggaaccucugcuucagaggaugccuucucuugugaagaaaacagccgacagcuguucagaaccguugcgugaaaacugaacugugugugaauugaauuguguguggccugagcucacuuuagcacggauugagccuguucuuaagccgucuuccagcacgugccugugggugugaucauggcggcgacuggaacgcagagcagggcuucccuccgaggcggugcgcgcagcgucaaacgcucagcccccgagccucuagcucacguuugcgucugcacugccuaguggaggaugccgcuacucacauauggccguguacauuuauguucaucaacaccacacagaauuuuaaaaugcagguucucacucguauggucccaucucaggugcucaguagccaugaguggcuggugcugcccugcuggacagcacagaugcagcacgucccacgauggcccgaggggcgcuggauggcgugcuggagacggcgagggccuugggcucucacguggucuggugugucagugcacugggcucaggccuguggucccagcuacucaggaggccgaggcgggagggucaccugagcccaggagguggagacccauggcccaggcuggagugcaaccuuaaaauaaauauauauauaaauaaagaccucuggagccagggcugaaauaaggauauuguuaugaagcggauuauuccuuuaggguccgugccacauugcgaccacagauucucugauugucgguauuccguguagaaacgccuuggccugauuugccagguuuuuguugcuuaacuuucuccaucauuuguucacuccuucucuuuccuaagacugacuuuauggccuuucaccaagaacaugaagugcguaugucacacuuggaagauauucugggaaaacugagagaaaaaucugagguauuuauuuuugaccuuacgcuuuuuuaaaauaaaaagaaaaucaacuauggcuaauauuuuaaagcccuuuggucauuuaauguuccucuuuuuaggcuauuugcuguuuguuuuguguaaaauggaaagaaacacuuguucucugguguggcagcggcucuggggcucuaacauugaaucggguguguaacucacgcauccccgugucucucgagggcacagagcagggcugcacacgccaggaggugguucugccgauuccaggcggccucuggguucccauccagcucuuuccggcuccagggugcuuccucacugccacacacccaccuugcagugucuucagaggggggauaaaggaccugaaccuuuugacagacagcacuagcuuugggugggaaggccgggaccauuuguugcugggaaugccaggggagggacugggccucugugcugcccucagccauggggagucgggucgggcucagguuccggcucuuugugucucuggugcuugacacagagccuggcgugucacaugugcguguguguauugaacuaccuugagaaguguggugagccuaaggguuguauguagcacacccuuuugggaaucuugggacccacuccuggaccuuggacccugugagaucaggcagguuuaccugggagggagaggugggcugagaggagcaggcagaggcgagaauguacccgccugcgagggucugcggggcgccuccuccuguguccgccugagaaggucuguggggcgccuccuccucuguccacccgagagggucugcggggcgccuccuccucuguccgcccaagaggguccgcggggcgccuccuccuguguccgcccgagaaggucuguggggcgccuccuccucugucugccugcccugggccgggcuguggagaccuccauggagugagacuuggggcugacgcuggugcucagcguggugcugcugcggauggcacaggccagcacggcucagcuucaugugugccucugccgugucccuguccuucacguuuagaacacacucuggaggugugacagggagcugacucccaacccgggugcugguuacaggagcugcauguucugagcccgccaggccguucucaugugauuugugcuccuuucugcgcacacguaaugaagguuacuuugaaauguucaaugaacacuuccuaccugccacccacaggcagaucuggacuuugaauuaaaggggguauuccagauaaaucaauggaguuuuaaguaugugguuuuaugaaaaguuaauauauaacuuauguguuucaguagacuauuucucauacuuuuuaggccauccagaaggaacuagaacagaccaagcaaaaaacaaucagguaggaggauuuggaaaacauucacuuuugucuucggugugugugugugguuauguggagcggcagcagagugaugaaugggggacccggggccggccucccccgagggucaccugaaggcccugagguucgugccgacagacacuccugcugggcugcgugaggacagagggguccugcggggcuugccacaucccccuccacgcggcguggaccucuguaguuagcacucucaaaggugcuguccgcgccccugcugugacccggagggcuucaucuccaggguccuugcagggccaaccucagggaguaggucaaggcccauguugcagcccgugccauggugggugucagggugggcucugcaccgggccuccgcuggcaccguuggcaucuaggugggcgggguuacagcucagccucaucucugcugcugcuccuggacggcagucccugguggacaggacaccugcuuccagaaccaccggauuugugcugggcgugucacggugggccucuccgcguggcugucggcccugccgcccuuggaauccauggcacagccgggucccucugcaguuccuggggaagcuggcauuuugcuccucacucagggcggcuuucuuccacacgaccacugauuugccaaguccccuuaaguggggugcuugccucucacagguguucccaacauggcagcuuugucuuucuuacuucauuuuaugcacgcagcucguauuccccacagcccuccccgccuguagauucggcagccuuggcuugguugugguuucccgagguccccgcgucugcacucgggaggguccauccucuccugugccccauguuccucuucugugaggacaggugugagagcuggagcacgguuuucucuccuuccaaagcuuuuauuucaguaaaaaaguugcuuuaacguguuaauaugucaauccuaaaguguugaucugggaaugggcuuuuugagauaugaauuguuaguaucucaacaaguaugugugccuguaaagaccucaagugaucugccugccucagccccaaacuacugggcuuacaagcaugagccaccgcacccaguccagaaauaaaguuucuaaaugcuuaaaucguuuucagagagagcucucacucgccacugagaaacacugcuagcagcacuuuuguagauagccuccuugugcagugugaacauuuguauguuacagacauaaacugaugcagaagacaaccucucugggaacuguauuugaaacuggcauccaguuuccacguuaguguggcacaggaugacaucuguacaguugugacacccaggagugggaucggguuccccucagccuguguguagugugggaagcguauaggcugggaggcuugugugugacccauucucacuguuggauuccagugcgguuggugagcagcuccugcccacagucgagcaccuccagcuggagcuggaucagcuaaagucagagcuguccagcuggcgacacgugaagaccggcugugagacaguggaugccguacaagaaagagugagcuuucugcauguuuacuuuuuguuuuauaauagaaaguaaaagaaaacuugaauugaugacuuagguuuauuagcuguuuaauuuuuuauuuauuuauuuauuuuugaaaccgagucuugcuguggcacgcaggcuagacugcaguggcgcgaucucagcucacugcaggccaccuccaccugccggguucaagcgauucucccaccuuagccucccgaguagcugggacuacaggcaugugccacuaugcccggcuaauuuuuguauuuuuaguagaggugggguuucaccacaauggucaggcuggucucaaacuccugacuccaagugauccaucugcuucagcuucccaaaguccugggauuacaggccugagccacccaccaugccuggccuaaguuguuuaauuucaacucccuuuaaaaacuuuuuuuuuuuuuacuauaugugaacuuuuuaaauauuccaaaauaacuaauucagugcuccguagacuuccccguuccagcaccacugugcgucagcacccaccaugcgucuucccagucuccuugguaugcguccuuggugugcgugcagcccagggccagcacugacuuggggcuggguuguugcuguguaccuuucauuagauagacccacgcuguaccugcugcuugcucuguuucgugucgaaacauaucauagacauugcuucaaguccaucauccuuaggcagaggagaaaaucuagacauuuagagcugcuuaagaaugaaaacacaaucauuugauuggcagaagucaucaaagucagacaguagauugguaaaggcauuugcaauacgugugguaagauuaucucugaugugcagagagccccuauaauggguaggaagagaagcaguggugacagagaaagcaugcgauaggccgggcgccgcggcucacgccugugauuccagcacucuggaggccgaggugggcggaucaccugaggucagaaguucaagaccagccuggccaacauggugaaaccgcgucucuacuaaaaauacaaaauuagccgggugugguggugggugccuguaaucucagcuacuugguaggcugaggcaggacaauugcuugaacccaggagguggagguugcagcgagccaagaucgcgccacugcacuccagccugggugacagagcaagacuccgucucaaaaaaaaaaaaaaaagaaaaagaaaaagcaugucaccgugcuaucagggagcugaguccuacugaugggacuugcagauuacagcaggcucucaucuuuagucugcaggcccacgaggacgauggcugcuaucagcgcuggcugaggcagugggcuuuucccuggccaggaggacugucaucaacuacggccucugggggaaaaucuuaggauauuaaccagugacaaauacaugcacuuuuugaaaugagcaaccaugcccuugggaaucauccuacagaaauaaaggcaccaguacagaggccacacaggcaggagggucagcgcugggaaguguguguggggaggagugaggguagaaagcagcuacgugccauuguuagggggugugggcuagagaaggguguguccacacguggaaugugggagggcagcugugaugaacggucguguccuaggaggcuuugcccucuccuucacggucuguuguuacgaagcaagaagagaaagguauacacauauguguuugugugcuuagaaauaacaugggguguauuuagcuuacauaaagcuauaauuuagguucauuuauaugacuguuuucucaucagaccaaguuuguugauggcagggccucuccgaugcaccugugcgccucgcugcggggugcccggugggugcuugcgggauggacacgcaccuccagaggguguggacaugccccacuauguccuucagcuccuaggaugugggucgcacacaucccacgagcucaccuauuucuguucuuuuuaacaugguccugcauuauuggagggguuauuaaauuuaauaugaaggaaaacacugucacaaugacauucuagauuuugagaggauauauaauucuucugagguaucuaagauaauggacccgaacaguggaagugauuuaguuaaaauaggacauuuguguccgucugcuguuuuacuagguggacgugcaagucagagaaauggugaaacuccuguuuuccgaagaucagcaaggcgguucucuggaacagcugcugcagagguucucaucacaguuugugagcaaaggcgacuugcagacgaugcugcgagaccugcagcugcagauccugcggaacgucacccaccacguuuccgugaccaagcagcucccaaccucagaagccguggugucugcugugagcgaggcgggggcgucuggaauaacagaggcggugagucggcgagucggcggcaagagaugcuuacaguccauucugugcugagacugaagaccuagcugugagguguggauguugaugucuuguuuuaagaguggucuggcuggggugugcuuagcugacguaagugagaugagacgugccugggcagugccguguguggagggggcaccugugcggugagcuucagcucuugcugucagugucauuacugagcugcuucuugggaguucuuuauacuuugugaaucuuuuugucccaaagagcccaucugccugugugguggccacaccuucugcaguuccaugaaagucucuccguguauuagucuguucucaugcugggcaauuuagaaaggaucauugacucacaguugcacauggcugcagaagccucacagucaugggggaaggugaacgaggagcaaagucgugucuuauauggcagcagacaagagaguguaugcgagggaacucccuuuauaaaaccaucagaucucccgagacuaucacgagaacagcacgggagaaacccccaccaugacucaguuucccccacccgcucccugccacaaugugggaauuaugggagcugcaauucaagaugagaucugguugggacacagccaagcccuaucacucaguaauaccuaaauucccagaauuuccuguguuccaggcuugaaugcucauccuugcuuuauucguguuuuauggcaucugggggauuuuucugguucaaagauugaugguggccauggcugagaccugggggaagaggccucgugcccucccaucuccaucugauggccuuggcagucgggcgcaggacuggaguguggaguugacuucugccaugccuaggaacccuacauaguuuccguugagaagaugcucuaauguaagugucugguccucauccauggcacuaaaacccacgucucuccucuccuguucugguguuuggucuuccgucccucgugucuguccagcaagcacgugccaucgugaacagcgccuugaagcuguauucccaagauaagaccgggaugguggacuuugcucuggaaucugguggugaguaaauagacguucugauuacuaaguuagaugaucaccuguuagcaggggugugcacuugagaggcuguugccuaccccacuuccagcaguaaggacuccuaacuuuuaaacaucugagaaagggagcaugauucugggcaugacccugguguucuuucuuccuggccaguuguguuuggggggcacaaguucuccccuggaagggcugggggugcaugcuuguggcuaagucgagguucacagcacagaaagugugcucgacuguucacucucuccugugcugugaucggggauuguucagugccuucaggagagacucagcagugaccacacagcucuccccgagggcguccacucagcagcaagacagaccgagagcagaagcaggcuaagcagauggaaugaugggggcuguguuucaggaccucagagaaauacaaaggccgcuguggucgggguuugggaaacccugcaggggcacaagccuaggccagaccucuuggggcagaugcauuugaaaaucagcaucgcagcugaggaaaguccugggguccacacagcccacuccguggugaguggggcagcacaccuggaucagacacgagcauuuccgaaagaaccgugagaggagagcuagaccugcuucacguccgcucagggaaggugugcaccacaccuguuauggaaaucaaaaucuugguuuucugaauuuuuuaaauguaggauuugcaaauaggggcugggggacucacaucacucagaagaugcuguguucaguacacguuaguguguggaggggcuggagagccugcagggcaggagagauuucuaaaacccacgaugauguagggcuggguagggacucugccaugugguugcgcaggauccuaaucccauuaguacgggagcagcuggguuugauuucagucauuugccacccucugaguucuuucugugguggcugcagacugaagucgugauaaaaauggcuggauucuuccaaaugguagacagacaucaacaaggcuacuggugugaucgguguguguuuguuuaaaaugaccuuuuuagaauauuaagugcuuuuaguuauauauuuugaaauucagugauuuaggaagaaauuauuuuccauuaagaggcaucaauugacaugaaccauacaguuugggccgagagaugucauuuauucuuaaaacccuagugaauccuuacagguuuguguguaccucagaacacugguaauccugaugaggcugcaccgaagguuccauuauugaagaaaacauugauugacacuuugugaguuaguuaaaaagauaauucagugguuuagaaauucacaucucaaucagcuacauuaaaaucccaugguuuuccuguuuaaaacaucaguuucuggccgggcgcaguggcucacgucuguaaucccagcacuuuaggagaccaaggcaggcagaucacaaggucaggagauccuggcugacagggugaaaccccuucucuacuaaaaauacaaaaaauuagcugggugugguggugggcgccuguagucccagcuacuugggaggcuaaggcaggagaauggcgugaacccgggagguggagcuugcaguaagcugagaucgugccacugcacuccagccugggugacagagcgagacuccaucucaaaaacaaaaaacaaaaaaaccccaucaguuucugccucuccugccugugguucaccagugccagggccccuggagugccgcccucccgagcucgcccuugcugcccagcauucaccagcgccagggccccuggagugccgcccucccgagcucgcccuugcugcccggcguucaccagcgccagggccccuggagugccgcccucccgagcucgcccuugcugcccgggguugugugcugccuucacggccaacuugguuuuuguuucuuggggguuuuuuguccugcuuugacaacaacauucugccuguccuguauccuacuaagggccaaacuggacuuguuuuuuaugcuuccucuuauuauugagauguaauucacacaaaaauucagcguuuuuaaauguacagcuccguggcuauuaacauauucgcggugcagccaucaccacugccuuaccccagaaucuuucucaccccagcuagaaacccugugccgcaaguagccauccucacagccccagccuuuucacuguaauugguaauuauugugacggaaggucugcucuucagggccugagagcucaccugcugggugacaccaggcucaaucggaugcuuuauucuucauugagaaaaaccaacaaaaaguucauuuggaguagcucucucucuagcaguagugggggaaggccaguauuuuaagaauuucccaguuucaguaaguaaaaauuguguguccuaaagcaguuguaaacucuuaacacucaauuugagaaaguacaauuaauuaagaaaaggacuagucuaaaaguaggagguucuuuguauauguaaaaacuugagaaguuuaaaaacacuuuuuuuauccgaaaauuuuauuagcugguauuagauaauauccuucaucauuuucaaacuuauguauuuuaauggcuuaacuaauuaucuauuuuuuaauuuuuguggguacauaggugcacauauuuaugggguauauauuuugauacaggcaugcaaugugaaguaaguacaucaugaaaaaugggguacccauccccuccagcauuuauccuuugaguuacaaacaaaaauacucuaaguuauuuaaaaaugcacaauuaggccagguguaguggcucaugccuguaaucccagcacucugggaggcugaggcgggcagaucaccugagauugggaguuugagaccacccugaccaacauagagaaaccccgucucuacuaaaaaaaugcaaaaaaaaauuauccgggugugguggcacaugccuguaaucccagcuacucgggaggcugaggcaggagaaucgcuugaaccugggugguggagguuguguugagccgagaucguaccauugcacuccagccugggcaacaagagcaaaacuuuaucucaaaaaaaaaaaaaaaaaaagcacaaugaaguucacuacagucacccuguucugcuaucauaugguaggucuuaugcauucauuuuucguagagacaaagagucucgcucugucgcccaggcuggagugcaauggcgcaaucucggcucgccgcaaccucugccucccggcuucaagcaauucuccugccucagccucucgaguagcugggacuacaggggcgcgucaccacgcccggcuaauuuucauauuuuuaguagagauggaguuucaccauguuggucaggcuggucuggaacuccugaccucaggugauccacccaccucggccucccaaaguacugggauuacaggcgugagccacugcacucugccucauucuuuuuuucucuggacccauuaaccauccccacuuucccugagccccaacuccccuucccagucucugguaccacccuucuacccucucuguccaugaauucagugguuuugguuuuuaaauaagugagaacaugggauguuugucuuucuaugccuggcuuauuucacuuaacauagugaccucugguagccauccauguuuuugcaaaugacaggcucgcuguaucacccaggcuggagucagugacgugaucucggcucacuaccgguucaagcgauucuccugccucagccucccaaguagcugggauuacaggugcccgccaccaugcccggcuaauuuguguauuuuuagcagagaugggguuuugcuaugggguuggccaggcuggucuggaacuccugaccucaagugauccaccggccucggccucccaaagugcugggauuacaagcgugagccacugcaccuggccugcucucacuguuuuuuauggcugaauaguacuccauuguguauauguacgccauuuuccucaugcauucaucuguuaauggacauugagguugcuuccagaugugagcuacuguaaacaagcagugcugcacaaagauagaagugcaggucugccuucaguagacugccuuccuuucugucgggggugcacccaggaguggcauugccagaucauaugguagcucuguuuuuaguuuucuuggggaccuccaaaccacucuccauggugguuguacuaauuuccaucccaccaacagugcgugaggguucccuuucuccacauccucgccagcauuuguuacugccugucuuuaggauagaagccauuguaacuggggggagaagagaucuaauuguaguuuuuacuugcauuucucugaauaucagugaugucgagcacuuuucuuggaaacauuuuaauaaauccugaaguggugcaguacuauugcuuccaaaaugguggaacuggacacugagaccgaucugaacuuugcuuuaagguggcagcaucuugaguacucgcuguucugaaacuuacgaaaccaaaacggcgcugaugagucuguuugggaucccgcugugguacuucucgcaguccccgcgcguggucauccaggugaguggccgccgguggccggagcugcuccucuucagcauggacucgguuaguguucacgggucguagguccacagcuccauggaacuucguaagaugaacacgucuguggaacugguaccacaagaaguggcagcguucccacaccgaggaguccccgguguccccguguagccuccacgcuacacaucuguuggcuuggguuuagcgucacacagaugggaccguguggcacaugcugguccugucagccuuccucccucccucuuuuggguguuccagccaugguguugugaguggcagcuguuccugcucgggccgugggucuuccgucacgagaguggcagcugugcuuucucagguguugagagacaauagguggggaggcccuagcugucuggccucggcaugggccuucacccccccaucccuccggccuuugccccccgucuccccgggccuucucccccacugucuccccaccaucuccccguaccuucgcccccacugucuccccaccaucuccccgggccuucgcccccacugucuccccaccaucuccccgggccuucgcccccacugucuccccaccaucuccccgggccuucgcccccacugucuccccaccaucuccgugggccuucgccccccccccgccccccgucccaccgggccuucacccccaccgucucccugggccuucgcccaccccuccccgcccccuucucccugggccuucaguccccgucuccuggaccuucugcugugguccucguugugcacugcuuuucuguggcuucauuuaauacuuuauacuauuggcuguacaaguuuaaagcacuaaaggauggagaauuuaaauagauuuauuuugccucaauacucaaauccugccucauauucaugacauguuuugaagaaaaauccaauaauuacuuguauguggaacaacgccaagacggcuuucacuaggaaaacacaaguccagccugaaagaauucaugaagugccugugaccugacguugaggaucacaugggacugucgucaucaugaucucguccccaggcugccccggcggaacuguccggucagcgugacuguuuggcuuucugcagccaucagcaccgcacgggcucaccagcacuuugcuccugagggcacagccggagccccuccucacugcaggcagacgcagccucugcugccacgaagccacacagcccugcgcuuggcaugcggcugcuuuuucugugccagcucacgagugccaccggcacagucugugucaccuggcagggccaacagguuuucugcacaggguugccacaguguuccugcauggcgguccugcuccuggccauaacauccuucucacagggcuuggugauccugacccucccagaggagcucacuggccugcaguguugucagugugaugcugguggggaucugguggugagagcacagcauggcuucagugucuuagagacugagggagaggguggagcucagcccuccccuggcacaguucucucucagaaggaagugcacggucacuggaggggcagacuucauauaaaucaccaaucacugugcugggacuggacugagaaacugucggcuccugggaaguaaagagaauguuuacagaacauagggauagcagauauaagggaccagcucccaccccaggaccaagguggagccucgccagagcgucucuccagaccguugggcggaggguguggcccagcucacugaacgucagggagguugcuguggugccacacgguggaauguaccagcaugcugggaaagccugugcacaacagggugacucaccgggcguuuggcugcaacacccccaagagggguaccagggaaccucaguguccacccagcacccugagcuggcaagggcuaggcuuugggcuggcaaagggagagcaguucaaggcucagcuccgucuucacagcgcgguagaagacggcuugggggcugaggggcaguaaauccacagcuggcauagaggagaagccggcggguacgugcccaucguucaccaucucuucuaaacacgaaugaaaugcgugugucguccucacacacugaaggcaggcugcgugcacggucuccuccuccguugcgcacagcaacguggcugccugggcgcagcgucugcaacuugucagucagucccugugugugccuggggacgcugugcugcgaacagugcucuccggucacaucugcccugcaccuggaggugggggugcgaucgcaggccagaggcagaugugugcgcagcaggccgaccuugccaggcugugcuucuggggcugcaggcugcaccguggccggguuagguuagaacgugcauuuucccagggcaucagcagcugacccuugauguuggucggaugggggggcagugcugguucccugugguguuggucggaugggggggcagugcugguucccugugguguuggucggauuggggggcagugcugguucccugugguguuggucggaugggggggcagugcugguucucugugguguuggucggauggggggacagugcugguucccugugguguuggucggauuggggggcagugcugguucccugugguguuggucggauuggggggcagugcugguucccugugguguuggucggaugggggggcagugcugguucccugugguguuggucggaucggggggcagugcugguucucugugguguuggucggaugggggggcagugcugguucccugugguguuggucggaugggggggcagugcugguucccugugguguuggucggauggggggacagugcugguucccugugguguuggucggauggggggacagugcugguucccugugguguuggucggauggggggacagugcugguucccugugguggugucccuucuugcugugcaggguggagggcaucuugccacgaccaaggaccauugaccuucaccuuuucuuugaaguauguuguaugucucacccauuuuucuuuaagguucuggucguuuuaacuuuuauacaacauauggguuggagauaguggcccucugaggagugaauuacaaaugccuuucccagcuuaucuucggauuuugcucauggcaguuucuaccauguaaaacuuauuuuuaucucaguauaaucagucuuuccucuuccugcugcuaaguggguaagagcaugcucacacucugaguccucauguuuuuccuuuccccagccugacauuuaccccgguaacugcugggcauuuaaaggcucccagggguaccugguggugaggcucuccaugaugauccacccagccgccuucacucuggagcacaucccuaagacgcugucgccaacaggcaacaucagcagcgcccccaaggacuucgccgucuaugugagugcccuuggccgacccuccuccucccacaccuuccugggaguucccacagaugaaagcaagugacgugagcgcacuggggacggcugccucccgcugccccuccgcccucucucagauucgguguugaggggaacauuccagugcuuuucuagggaggguaacuuagaaauggcauauuaccugauguccauuuuacauacaguacuacacugaccaagguagacacgccuaagaauuuugcuccucaccgcccuugccaaguugccugugaaagguguucuggcaacuggaugacgugggagcagcuggcugacaagaggacugccaugaucccagccccagagaaacccaccauucauacugugguauuuucugguuucuucaccaugccuuuaaaaaauacaguugagccuggaaucccagcacugugggaggccaaggugggcggaucaccugaggucgggaguucgagaccagccuggccaagguggugaaaccgcgucucuacuaaaauauacaaaaaaaaaaaaaaaaugagccaggcuugguggcgcacgccuguaaucccagauaccugggaggcugaggcagaagaaucacuugauauaggagguggagguugccgugagcugagauccugccacugcacuccagccugggcaacagagugagacccugucuuuaaaaaaaaaaaaaaaaaauuacaguugagacaguaguguuuaugaagcuuuaaaauuuucauaaaguauuucauaaaaguauuuuugccuuuaaagaaaauuggccaggcgcuguggcucaugccuguaauccuagcacuuugggaggcugagguggguggaucaccugagguuaggaguucgagaccagccuggccaaaauggugaaacccugucucuacuaaaaauacaaaaguuagccaggcuuaugcgugccugucaucccagcuauucgggaggcugaggcaugaagaucacuugaacccaggaggcgguggucacagugagccaagauugagccccugcacuccagccugggcaacagagcaagacucugucucaaaaaaggaaaggaaaaaaaagaggaaauuguauuaugagcauuuuuccauggcagguacacucuuuguggccauccucaaguagcaucaaucccccguguuuaucuggccgcuucuccucucacugaguauuucuuucccuuuuccgcuucccugugugagcgucgcuccuuuacaccuucacuaauuaauucccguggacgagacacucacagguggcgucacgguuucagagggcagcagcauguuguacggccgagucggugcacuguguuacuagcauuuucuuuuuauuuucuuucuuuuuuuuuuuuuuuuuuuugagacggagucuuggucucguugcccaggcuggaaugcaguggcgcgauuucagcucaccacaaucuccgccucccggguucaagcgauucuccugccucagccucccaaguagcugggauuacaggcgcgugccaccacgcccggcuaauuuuuguguuuuuaguagagacgggguuucuccuuguugcucuggcuggucucgaacucccgaccucagcccucuuuuuaaaauuucugcuaacuugauaggugaaaaacaguaguuuauuuaaucugcauuucucuguauuucagaugcaugcugccuuuuuuguaaauucuagucuucuuuuuguucauuuaccuuuugggaucuuaguuuccuuaugaauauuugagcuuuuuaguauguaaauaauaaucaugugucauucuguuacagacauacuuuccauuguugcucuuaauuuuguauuaacacucagaugcccugagucuuucagagguuuuuauuuuuugagaccgagucucgcucugucaccaggcuggagugcaguggcacgaucucaguucacugcaauguccgccucccggguucaagcgauucuccugccucagccucccgaguagccgggaccacaggcgcccgccaccacaccuggcuaacuuuuuguaguuuuuaguagagacaggguuucaccauguuggccaggauggucucaaucuccugaccuucugauccacccaccucggccucccaaagugcugggauuacaggcgugagccacugugccccaccccguauuuuuauuucacuggugauuaucagaggcaguaguuacaucuacucacucgcuggaacuucuuccauagcauuucuuaucccuagaaguccuuucccauuucaaaauagauaugcaaauagucccuugugucuucugcuaguucucugacucggauaaaagauaagauagagcuuacuguucuaauaagugcacaguccaguggcguuaagcccagucacacuguugugcagccaucaccacugucaucuccagagcugcuccaucuucuagucugaaucucuguccccauugaacccugacuccccacaccccagcuuaggccggcacucgcucccuucugccugcucucuucccaaagucggucuucuguggccccuccuccugcuggugaggccucaucuccccgggcucagcaggugcuccagagcuuccacugugagugcugagggcagcagcugagcauggucuguguguccggcggggucacuucucugccacucauuaguguguccuguuuuggccucaguuuuccuaauguguauaacggggaaucgugcugaccucaggacaugucguggguuacaugaagcccucaacaaaacacaccccuuccuuccagggaaggccucgugacugccauggaggaaugaccuucucuuacugauguggagggaaacgguccuguuugcuuagugcuggcuguggaagggaacgguccucucugcucaguguuauuuuuccauucguucauaauuguguauggucuuguuuucagggauuagaaaaugaguaucaggaagaagggcagcuucugggacaguucacguaugaucaggauggggagucgcuccagauguuccaggcccugguaagaacugggacuggcacugccuggggucucugagucccacaacuucucgugacagcagggcccagcuggcaucaacagacuggaaagcagcgugaggaccauccuuugaaaaauguuaaccugcgcuuccuggcucugcguuaaugagccuuuccauggcuaauagcguucucaguuuuacccgugcuucaugcccugugauacauuacuuagaaggaucauauuuaaaaaguuaacuuccagcugggcgugguggcucacgucuguaaucccagcacuuugcggggccgaggcaggcggaucacgaggucaggaguucgagaccagccugaccaacauggcgaaacccggucucuacuaaaaauacaaaaaugagcugggcgugguggcgcacgccuguaaucccagcuacucaggaggcugaggcaggagaaucgcuugagcccgggagguggagcuugcagugagcugagaucgugccauuguacuccagccugggugacagggcaagacucugucucaacaacaacaacaaaagguuaauuuccaacucagcugcuuccugucagacgucauauuuggggaagugauuggacuugggguuauuaauaugaaauacauguguguguuuuucccaccuugauuucagaaaagacccgacgacacagcuuuccaaauaguggaacuucggauuuuuucuaacuggggccauccugaguauaccugucuguaucgguucagaguucauggcgaaccugucaagugaagacacuacucauuauuuuuguacauuuuuguauauacugggacagcgugaaacacuggaauccuucauggacgagggcauauacaaugaugggacagugccacacuccuucaauaaacguggcugcuggccagaggacgugagcgugugacgggcgccuuggcgccaccuguugggugcucacugccucugcaggugcagaggggucagcagcaggagaagcguguugaacacguggcucucagacacuccuuguuuuuaacgggaagcucuuugcauuugcauuuccucaacaaaggagcaaagcagaggaagcugagagucuggcguguucuugacgcuuuggucuucagccuugcacuggcucuucuaaaggacuuuuggagggcagauaauuucaucuguuaaauccaacacacauuucuuucagggaaaaacaaugucaccaaauuuucagaguucuaaacuccuuuccuucaagccggaauuuuccuuuuuucagcaccaguagguacuaagucuccagauggggaaauaacuaaaauguguuuuucugcuuuguucgcucuuacuucugaggaagguuuccagucaggacucgcuguaccaauauccauggaggaauaugggagcguuucgcucuccuuguaggcugaagucagucugacuugaaggggccugguuuggaucuaagcaaacacccagaugggguucucuggucucagcaaggcuuuuccuguugggagucacaguaaacagaaacccaaaaaucucaucuuggguguuuucagggcuuguuuugaguuuugcugaauagggagcgcaagacgcccugagccucccucucacugguggugauaagaggagccgucuggugugucagggucacgaacccguuacauuucaggacgauccuuuuuccuucagcagcauuucuuacuggcuguggcuggaaucugccuuuuaucacagcugucaccauucucacgugauucuugugagacucuuuuugguuauaauuacuauuuaauauuuagacuauuuuacugagcagacuuuauaaaugagauaucuacaaggcacuuaaaguguuacagauguuuuaccuuaagaauuauuuaaguuguguuggguuaagacaguuuucaguguaccguaaauguuguguuuucagaaaaagacaaaacgauggugcugacugguuuucuguauauugcacaacaguccucaaauacacugauguaugaaacuauucauacaucaagcagcauuuuuuucacucuccuuagaauuggaacuaugcaguuaaggcagauaaaauguacagauguuucauauauuacagguuacauauauaaaucaaaauuuccuauauaaaacugauuugggauuugggguggaaauauuuugaauauuaauuuauuuuuaaagaugcaagauaggacuuugugcaauguauuuuuguaaaugcuuuucaaaauaucugucuuugguagugcuucugcugcugccaccaaauugauaagaugcuauuaagagguuuaaauaaagaguuuuaauuuuuaaaagggcaugggauauaaacaguc

SEQ ID NO: 191562 - RNA, 7313 nt, Homo sapiens
gucggggcgcgcccggaaaccccaaggcccagacggcucucagauccgggggcugcggauaaauccccguaggccgcgggcagcgagauguugcguuccggugugggugugggugugccuccgacggcgucucggugccagugucgagguucuuucugcuuagcuacccggagccgacuacggaggaggacaccugaguuuacgucucuuccaucugcugcucaccucagcugccuggguccccgacgagagccagguacggggccgggauugcgcagacagggucugccgggggucgggccugccuugaggucagguugcucggggguucggccugucugcuaggagugcggcugcugaaaguccggcugcuugcuggaggucaggcugcuggggguccggccugucugcuggggaccgggccugccggggucuggcugcuggggguccggccugucugcuggggaccgggccugccggggucuggcuguuggggguccggcugucugcuggggaccgggccugccggggucuggcugcuggggguccggccugucugcuggggaccgggccugccggggucuggcugcuggggguccggccugucugcuggggaccgggccugccggggucuggcuguuggggguccggccugucugcuggggaccgggccugccggggucuggcuguuggggguccggcugucugcuggggaccgggccugccggggucuggcugcuggggguccggccugucugcugggaguccggcugucugcugggggccgggccugccaucggggccguaguaccgggucgcacggggucguuaacccgccagccgagugacagccacguagauguguguuuucuugcugcgggcccggcccgccaggguaggguguugguuuccuaggacgggugcugugcguccagaacaaaaucauuuggggauucacaucaaacucuugugaauuccuugaacaaaacaauuucggaacgccugcugugugucgggcaccgggagcuaauaguaaagcagcggaucuguaguuggaagcugugggcgaaggagggcugggaaaggacuaaugggcaccuuaaguagcgggcguguaacauagagggaacuggggagggugggaauggcuuuaaacugaggcgggaggggauaacuagacguuugccaugggcgagaguguuccagucuuaggcgacagucuaggaggccuccaggaguggggagagagcugaugggaaggucaggaaaaggccccgggaggggcuggugaguacuagaugacgggaccucgugagccccaggaaaaggccccgggagggcugguggguacuagaucauggaggggaccucgugagccccuugauucucucucgagugcgguaguuucaccagcugucugccuguuuuccauagugacuuaacagcuugcgcuucucccugaucaacuccagguugaugucaucgaggaauaaguucacaguaagauucaaugccuaagggaguugaagagagaggcgagggacagaguuaaaucuucucuggauaauggagucaacugaugugauuuagcaccuaguaacagaguuuuguuuaugugaacaaguauauuccauggauaaaauugugacuuaaaauucaccaaagucguaaucaucacuggcagcugugugaauuagcucucgcccccucagugugaguuuaaauagaaacccgaguucaaggagugcuucauagacuaggaauuaaaaggccugugaaggaguccgugucucuuaaugggguugacuacgaauggcggacaccugguauuuguacuaaaacuccauggaaugcuccccacacagugcguuuguugacuuucauuagcuguaauuacauuguaaauccuggugacugaagggcaguccagcuuuccuccuaacuauucugauucucuuguaggugacacuuaacuccgccaucugcguuuugagcacuguucucauaauggaguuuccugauuuggggaagcauuguucagaaaagacuugcaagcagcuaggugaguacuuuuaagagacuuaauagaaaaugguauuuuguugggggaaagcuggcuguucuguuaauuagcugauaauugugucuuggccuuccuggcuccucaguauugggaacugugcuggugcagguucuguuugacacuuagcauccaccagaggcugggugcaggagugcaggcuggcuagcagggccagguggauccagggggcugcuggaauacuugcgaugccauagggggucucuagaagacagccugacccugggauuguuuucacauguguggcccucgaggaccuguccaucucauaggccuaaaacacuuaguguagguaaacacuuugauaguacuaucuggaaguauuuuguuccagucguuaaaacacuucccuguuuuuuguuuuuuagauuuucuuccaguaaaaugugaugcauguaaacaagauuucuguaaagaucauuuuccauacgcugcacauaaguguccguuugcauuccagaagguaauugauccuuuguucaaaagauucucaucuucaccgucugaagcugcacugucuugcugguaugguagggacuagcgacguauggcuaacucauugaaaauuaaauuuuaaaauccaguuuuucagucccacuagccucguuucaggugccugcuguuaggcaguacagaggagcgugucugcccucacaggacauucuguuggaugacucucagacaacugagaucuuauuuucagggacucauggagucacuuaguuguaaccuuauguuccaagcuuacuuuagauguucaaauacuugguuccuuugaucuguuacaccauagcuguuacaccauagcugugucuucaccagaugcaagaaagauuuuaauauuugacuuggaagccaaucaggaaggcaguaaauacgcuuauugauuugaauaacugcagccuugacauaguauuuaggugacucccagaguacacagcagaaacugaaagaggaccuaaggaaaugagcuugccccgaguccagagguuugagacuuguuguugacuuuucagaugguucccagcccguguuuacuuugucucuggaugggucacaggucauuuuagugaacucugccacuugaccgugguggcagugguaauguggguggcccagcauucugugcuuugaccaguguuggccagggucugacccuccagccauuuuuaggccaucacgguggguggggagggugacucacauucccugcguuuacuaggcacggaugacuaagccagacugcccagcuugucuucccacugccccuuccugccccagcaugggguggggucuggcuggagaccguuuacuaauacuuuauuucauuugaccaaaugaggaagcaccaccaccugugacucucccagcucgggcuguagacgggugugcucauaauuccgugagcaccugccacccguuccaugucgguugccaccucgguuuucucauugaccuuuccaucaauuccugcccuggcucagguuuuuagccaugcugggcguuagcugcugggcgguccaccccuucggagcccccagcucagguuuuuagccuugcugggccuucagcugcugggcgguccaccccuucggagcccccagcucagguuuuuagccuugcugggccuucagcugcugggcgguccaccccuucggagcccccagcucagguuuuuagccuugcugggccuucagcugcugggcgguccaccccuucggagcccccagcucagguuuuuagccuugcugggccuucagcugcugggcgguccaccccuucggagcccccagcucagguuuuuagccuugcugggccuucagcugcugggcgguccaccccuucggagcccccagcucagguuuuuagccuugcugggccuucagcugcugggcgguccaccccuucggagcccccagcucagguuuuuagccuugcugggccuucagcugcugggcaguccaccccuucggagcccccagcucagguuuuuagccuugcugggcgguccaccccuuuggagcccucacaaccuuggccugcagccagugacggucguuaguaccugggagcucacccuagguacacguggccucaucugggcgcaagcaacucucuguguacguagaagccacuggggaaaccgcaaagggaucaggccguuggcgacugaggggagcuggagggucuuugugguccauguuucccuccaucuccucccuguggaggugucugggcaggcucuguucucaccugggcggugccagccugagauggccccagcugguuucugcagucggcugaaguccauucguugaaacuucacuagacuccucagggcagcugaugcccacauucuagagauggcugccgcuaauccaugacccagugaugcuuuguucucggagggcucgggagaccgguuuuuguccucucuuuguguuuaagugugccgcacaggaguacucguuuaaaacuucugugaguuuaaguugcaugagucucagaugccaucuuaccuuuguuauuuuuaggauguucacgucccaguaugcccacucuguaauacccccaucccaguaaaaaagggccagauaccagacguggugguuggugaucacauugacagagacugugacucucacccugggaagaagaaagagaagguaaggacagagcccgccucaguuccuucaucugggaagccugguuuuuccuugggaagagucaguuugcuaccugaaaauuacucccaauaguuuauguacaaaguagaaaagaagaguccuaacgcugcguuaucccuguccuaaacugcgaggggccugaguuuucaguuuuauaaauguucuuuaauaugagggaucccaggucagguucgucuuucuugacuggaauuuacuaguuucccuccugagauggagaauucacauggcuuucuagauccauucuguucaugugcguuucauuuguuuguuuguuuguuuguuuguuuugagacagucuugcucugucacccaggcuggagugccauggugaauggugccgucucggcucauugcaaccucugccucccggguuaaagcgauucuccugucucagccucccgaguagcugggacuacaggcgcaugccaccacauccagcuaacuuuuguauuuuuaguagagacaggguuucacuauguuggccgggcuggucuugaacuccucaccuuaugaucugcccgccucagccucccaaagugcugagauuauaggugugagccaccacgcccagcucaaggagcuucucuagugaacuggcugcugucaggcuuaauccguuccuagucauggguccugguuggugguuaccaacuaucuuaguauaugauguucaauacuuuacaguuauauuaccauaaaccaaauaacuuuuggucucaaacauagagaauaaaaucaguguuccuuagucugccacacaaaauucucugugcggaagcuugcucugguccccacuuucuggcccugucuagcucucccugcuguggcugugcccugggacccucagccucuggaggucucuuaagccucugagacaucacagcucucuggcacacccgcuucuuccacaugacacagcuucccuugcugggggcucacccagcacugccccaaggcccccacacaggaaugcccucccggcugcuccuggcccgcugugcuccuguccuuuuggugggcacgcccuguguucugccugcaucccugcacgggucccuccugcauggucgcucagcauggccaugccugccugccuuggccggagggccacccccggcugcuggaacccuccccacucuccucacugccuuccccucuuggaguucugacuccuaggacuuuauaucgcugccuacauccuggcaccaaaaaaaaaaaaaaaaaaaaugaccgguggguacugggacaugauagauauucccuugauggggacaaccuccacugucccagggcuccuggagccagugccucuguggggcuugccugucaucugugcuuggccuccuucccucccgcucccugcuuccuggcugccucucucuguuguccucccagcagcaccuccgggccaucuucacgggaauccccagcuucaaugcugaccggcuuuuuuuuuucuuucuuuuuaaagggacgaacucuugcucugucgcccaggcuggagugcaguggcacaaucucagcucacugccgccucugccuccucuagcaauucuccugccucagccucccaaguagcugggauuacaggcaccacgccaccaugccuggcuaaucuuuuauauuuuaguggagaugggguuucaccauguugcccaagcuugucucgaacuccugagcucaggcaauccacccaucuuggcuucccaaagugcugggaugacaggcgugagccacuggguccagccccauguucuucuuaccugcacugagauggucaaaugaaacuuugcaucuguacucugugcagacaggaacuguguccaguuuaaaugggaauguucuuaccggaggcuguuaaagaauuuaaggccagcacaguggcucacacagguaaucuuagcacuuugggaggccaaggcgggaggaucaccugaggcugaguuugagaccagccugggcagcauggcaagaccccaucucugugaaaauagacaaaauuagcuggacguggcggugugugccuguaguaccagguacuaggcugaagcaggagaaucacuugaguccaggaggcagagguugcagugagccaagaucaagccacugcacuccagccugggcaacagagcgagacccugucuccaaaaaaagaauugcuuguugaagucacuuugcucucuuagauuuuuacauaccguugcucaaaagagggcugcaagaagaaagagaugcugcagaugguaugugcccaaugucacggcaacuucuguauccagcacagacacccuuuggaccacagcugcagacacgggagucgccccaccaucaaagcugggugagaagagacuccgcugcgauggcucggagcacgcaguagcaugcguggaagcagcuuacacucuagugggaaguggagccccauugagcaccaucccacacuggcugcugaucuuguuuguugagggagaugggacuauaauaaaauugaaugcugaaguuga

SEQ ID NO: 191563 - RNA, 417156 nt, Homo sapiens
agugucgcgauaaaugggcgccggcggagcggagggagauccgagcggcggcggcaagcuggcugcgagcggcugagguaagcggcccggcucgcgcgggcggcggggucccggggucccgggggucccgggaauggcaagggaggggccgagggcccggaccgggugugcucgccaggguggggcacaacgacccagaccccgugccucaggaccccgcgcccgccccgucucccaugggcgcgcucuccucucugugcucuccccuccucuccccacuccccuguccccacucccccuuugggcugugcuggggacagcgggccccucgccugggucuccgcagccgucccuugugccagggcgggcggccgaggggcgcgugcucguggucccagccccggggucccgcugccuaccguguggguccccgggcuagggugccggcgcgccgaggaaggggccugagcuggcgccugguggagaagucggggcugcaggggcucuuggcauccugguggcucgcgccgguccgcucucaggaagggggcgugugggcccgguuuccccucggggauggcaagggccacccugaucucguuugggcaauggaggaauugggcuguggagccuccuuccaggcgggccugccucugcggggcuggcagccuggggagcucaggccucugcuugcaccaggccaagguucuuguuaaauggaaacucagaaacugugcagcugcagaaguucuaccuuuggcuuuuaaacgcgcuuggcuguucccuaguuguggcuggugggccggccugccaugagcccauaguaagcgccgguguugggggugcaaaguucuuuacugcgguuugucuucagccuuccaaagccagacagacccaaguuccaaucuccguucuguaacuuuuugaagcuucgguuucaucaucucuagaaucuguguaaaaagaccuaauucaccacccuguugagacugagcuuacaaauauagugcuggucaaccugcagccguauucccaucaucuagcgguggaagacuugagggauauuggccccguuccccacaacuuugcaaguagauuucacugucaugaguuuacagaugaggaaacugaaguucaagaagucucggugcucggaaaugucagauaccuuucuuucugauaccuaguugaaaauaguaguaguacuuauuaaugucacuagaaauaaacaaugaaaaugagcacagcugugaugaucaucaucuuuacugucacuguugcaugccucguuucugauucccagaggccagauuuuuuuuuuaauuaauuauuauuauuuuuugaaacggagucuugcucuggcacccaggcuggaaugcaguggcgcgaucucaguucacugcaaccuccaucuccuggguucaagaaaaucuccugucccagccuccggaguagcugggauuacaggugcacgccaccacaucuggcuuuaguagagaugggguuucaccauguuggccaggcuggucucgaacuccugaccuguggugaucugcccaucuuggccucacaaagugcugggauuacaggcaugagcaacagugccuggcuuauguuuauuuauuuauuuauucauucauuuauuuauuuugagacacugucucaccccguuacccaggcuggagugcaguggugcggucucaggucacugcaaccucugccucccaguuucaagcgauucuugugccacagccuccugaguagcugggauuacaggcgcacaccaccacacccggcuaguuuuuguauuuuauuagaggugggguuuugccauguuggccauucuggucuugaacuccggaccugccuccgccucccgaagugcugggauuagaggcgugaaccacccugccugggcaagaggccagacuuugcugugagugcuccugguagguaguuucaggcaucaacugacuggauucaggaauuccuagaaaccugggaaagcaucauuuuugguuuugggugugccuguugaggguguuuccagaggagaugagcuugggagucugaguggaccaggugcugaagauccauccucagagucaggggcaguaucuaagagccugggggccuggagaggacaaaaacagagaaaaggcgaauguguccaucugccugcaggagcugggauacacucuuccucuccucuccucaacagcagcacuccaagcucgccggccuuuggucuccaggacuugucccagcagccccucgaacugagaauuacaccaucggaccccuggcucugaggccuucagacuuggacugugucacacugccaggcuuccagggcuccaacuugcagacggccuguugugggacagucucuguaaucgcgugagucaguuuccccaauaaagcccuucucuugugucugucucuguguccuguuggcucugugucucuggagaacccucuuacagugcaguugggggacgugccaccugagugcugagccccgccucccgggcgccagcuguccaucuguccaugugcaacugagacucaauugguggcuugcugguggggauuugguggcaugcuuccuugcuuccauuuuuugucugguaaauuggcagcauggcucccaguugccauugaagaaugugguuacaggcauggguguauuaugagcuccaaugugcguuaggggaguggggcuguccagaggcucugcugacugcacggcugauggcacguggaaaggcugccccugaccaguccuuugucuguccccggaaggaaagcaaccauggaagaccugggggaaaacaccaugguuuuauccacccugagaucuuugaacaacuucaucucucagcguguggagggaggcucuggacuggauauuucuaccucggccccagguucucugcagaugcaguaccagcagagcaugcaggugaguggcaugugccugggugggagucugcucuggggagacccugggcccgggcaggaccucuuccagucuucuguaguugaggugggucgguauuagcagagccuagagacagcuauucgucucccaggucucacuaugggcacuccucauuuuggggucguagcuggaggcuaguuggggcccugagccauccuggcuuaaaggccugccuuguuagcgcccugagugggccuggcgcucagcauugcguucacacaagugcacucacagacccuggugacaggaucggaaagccaguucauucaucuaauugaggacagaacccaaacugccugggggagugagcaccaggacugucgggaaggcuguguuggaaacacagugcugagagugccugggcagcccagagacaaagccacagcagugagcagaaggacuggguguuuuguggucucagacuguggagggccauuuacagauuuuggggugauuuuuacaguuuucuucuauaaaauaguuguauuuuguuucauuacaaguucuugggguuucucacuguagacacaacugcagaggauucaggccuccugaaggacuucaggcuccaaagagugaugagcccagucccaguuggggcugcgauaauggggcccccaaguuguagggagugguggggaguggagugcuggcuaguagugucuccagccuugccugggcccuguggcugcgcaggcuccucuaggcuccucugccuggacccucuuucccagucccugcugcgguccccagagccguucuguaguucuguccgcauuagaggaggcucuggcuuccugcgcucucagagcccagaugaggcccugcugcauuugguuaaacugugugugcgugugcauuuguuuuguugcauaauugaauuaauguguguuuauuagaaugcuagcuuguggccagaugugguggcucaggccuguaaucccagcacuuugggaggcugaggugggcggaucaugaggucaggagaucaagaucauccuggcuaacacggugaaacccugucucuacuaaaaauacaaaaaauuagcugggcguggcaccuguagucccagcuacucgggaggcuggagcaggagaauggugugaacccgggagucagagcuugcagugagcugagauugcgccaccgcacuccagccugggugacagagugagacccugucucaaaaaaaaaaaaagaaugcuaguugcuagcuugcucacugcccuuucuugaugaggacuguuuuuuauucugagauuaggucauauauauauauauguguguguguauauauauaauauuuauguaaauguucuuuugugaaauuaugaagguaauagaugguaguuguuuuuuaucacugacaaaaugagaaguggccaacucugagcugguugcaguggcucaugccuauaaccccagcacuuugggaggcugagguggcuggaucacuugaggucaggaauuugagaccagccugaccaacaugguaagaccucaucucuacuaaaaauacaaaaauuaggcgggugugggcaccuguaaucccaccuacucgggaggcugaggcaggagaaucgcuugaaccugggaggcggagguugcagugagccaucgcgccacugcacuccagcccgggugacagaguuggcaacucuggucugaaaugcugugauuuuaguguugcgaaugucugggaccucuuggccugucugucaaagcugugggauucuagagucugucuuggggcucggaggcccccagugcucacugguaaaggccucucggugaggggaucagugauggagugcgguagucagagcaagguggugagcggagugauggcggcaagaccagccuuggucccuggccccugucacaucccauuccuggacuucgucgugguucucucucuccugcugagcccccggcguggcagggagggccuggagaacauggcaggccgggggaaugugugcugucugguuucucacacaucguguugauuuaacguaaggguaaacuuucaggguuccuuucuuuccguuguagucagcuccaggcagagguggcacacggaucaggugugucugggacuccuggucccugccggucgugcccccugcaggcggggugcccacccuucucgagaggcucaggcuugacugcagacacagaagugagaccaggaaggcugcugaguuugaagggcagucuuaggaacgcccaaacagcagcagcugagaaucgagacacaguaacauaggaguaaaggaagugugggcuugggccaccagagaacacaggugggaggacagagaaacuucccuccccugucccaggcuuuccuggccuuggcacgcuuggcauuugggcuggguaauucuuuuuucucaggacuuucuugugcauugugggcuguuuaacaacuucccuggccucuacccccuggacgccagccagcagcagacacaugugaccaccccccugugacaaucaggugucuccagacagggccagauguucccaggggcaaaacuggaccccacugggaaccaccacucuacucuggugcuucucaaccuuucaugugcaugugaacgcccugagaaugugucuaaaaagaaguuucuuuuuuucuuuuggagauagggucuuacucugucauccaggcuggagugcagugguacaauguuggcucacugcagccuccgucuccuggguucaagugauucucccuccucagccucccgaguagcugagauuacaggugcguuaccaccacacucggcuaauuuucauaguuuugaguagagacaggguuucaccauguuggccaggcuggucucaaacuccugaccucaaguuauguacccaccuuggccccccgaacugcugggauuacagacgugagccaccacgccuggccuagauucuuuuguuuuuuuuuuuuugagacgaacucuugcccugucauccaggcuggaaugcaguggugugaucuuggcucacugcaaccuucgccuccuggguucaagcgauucuccugccucagccugaguagcugggguuacaggugcguaccaccacgaccagcuaauuuuuguauuuuuaguagagacgggguuuccccauguuggccaggcuggucuugaacuccuggccucaagugauccacccgccuuggccucucaaaguacugggauuacaggugugagccaccacacccaaccuaaagagaagauucugacugaguaggucugggguguagucugcgacucugcauuuguuaagugccgggagaugcugcacugcaaggcucugggccacgugaagagucagugacucugccuuuuccuccagcugagcaggucguacccaaaggccggcucuggaacuauuuggcaagucuucuggggcucuuugaggcucagcuaaccuguaaucacuagcccugugugguaggcagacuucugagagggcccccaggagcucagcucaccuguaaucacuaguccuguguggcaggcagacuucugagagggcccccagaggcucagcucaccuguaaucacuaacccugugugguaggcaggcuucugagagggcccccagauuccaggcuccuugugcacacucaccuuccuacugccucccagguuucaguccaauacugaguagguuucauugcugugggauugugcagauguaauuaaggucuaagaucuguugaccuugagauagggagauuacgugggugggcuugauccacucccuggugggcuugauguacucaccugagcccuuuaagucugaguccagacguccgaggccgagcagucaagagacauagcaggagagggauuugaugagggagauuggacgugguugacuuuggagauggagagggccguguggcaagggaugugggcagcaccuaggaguugauggcuguacugggcuggcagccagucgggaaggagaccucauucuccaucucugagcuccacgugagaacauguccuggccgacugcauugauuuuuagucugggagacccuggucagagaaugcagccaccuacgucuggacuuccgacccacggagccguuggcugguaaauaaauggguggcauucgaggccguugccuucacuaauaugcuuaaugucaucucaaaagacgucuuccucuucccaggcuuuuucaccuucccguuuccugccccuccccuguuccccagccuggagcccaguggcugggccacaucaagacuuagcacgggaccugcgggaauggguccucagggagugugucugcugcacugagucacucaccugguuugaugccgucacugaggauucuguuuuucuuugggugcgaccugcucagcuggaggaaagagcagagcagauccguucgaagucccaccucauccagguggagcgggagaaaaugcagauggagcugagucacaagagggcucgaguggagcuggagagagcagccagcaccagugccaggaacuacgagguggguucaggcggggcgagggucggcccagacagccccaggaagcaagggggcugugcacgguaccugccagguuauaagaaaucacauccuagucccugggagcaagggggcugugcaugguaccugccaggucuuaagaaaucagaucccagucccugggagcaagggggcugugcacgguaccugccaggccguaggaaaugagaacccagcuggcuggaagccugacacgcccugugucaugguugccaggacauuccuucugaggccacucaugcuguggggcagguaucaguuaugcuugauguccuagaggaggguggcaugaaaugggaacacuugcugugucuguucauugaggcugcggugcuggcacagauucuuuugcugggucuccugguuuccucuucccucuggaagaauuggaaugcaggucuggcagaaaugccaagugguguaggagugacaggcuuaggaggucaugggguggaucagggucucggguccaugcugggucuugggguuggagggcccuagcaaagggugccggucucaauggcggcucuguguugcuccuggcuccccagggcagcagggaaaacacccuguccuuggggagggaauuagguuuccacugagugcgcggauccccucugcucugauuaacagcacuuugccaggguuucagucagugcugaucaguuguggaaaugcugccaagguucaggcagaguauugggcggaaagucucccuggccuccgugcccucucuuggcggguggauguccagccccgcccugacaucaugcgguguauucacacacucuccugggcccuagaaaaauagcucacgucuuccggggugugaugcugguuggauugcuugccccuggccugcagauccugacugcggugugcguugugugggcucagugagacugaggcaccgcuggggugggggccacugccucaggguuggcuccguugcugcuuugagagcuguuuucccugagagguggggcguuugcucauggccuggguggguccuaggagggacaguacuggaggaauuggugggaaggggagggagaguccacaggagucucccuaacuacugagauucccuuguuagggguggagaggagccaccaggucauuggucuggaggcagcaugcugaugguauggcuguggcugucaggcaggagggacagugugcagcuguuggaguuccucuaggccgagagucccugagggcagggcccacccgacucugcccaggaucuccauuguguggcacagcuuauggcauuuuaugggugcucacaaauguuggauugagggaggggucauuguagggucuccgggaacccugucuuggggaaauccaaggaugcaggugacugggcuuacaccuggggcucccugcugagcuccagccaccuucuaacaggacuguccuuccuugcccgcagacacagcugcaugggaccccaggaacagucagaaccaguaguuuuccaauuguuccuuggaguuccaccuggaaauaccuauuaggggcgagacuuaagugucugaaguccaaagaccugcuggcugcccugucugcgcugggacuggcaguuccaggcccggugccgcaucuggcugugauggugcugagcggagccccgugccaaccccaguucuuguccugcaucacagaagggucucuugguuguugugaggcagcccuugcagcucacaagggcuggagucccuccgaggugcgcgggucagccucucucagaaggcggccaccucugucacagcucuccuggguuuugggcuggaguacccuggaugaggacagcacaagcucguacuccacccggggcuccgggagugcuuggugcuucccgaggaaggcagggugagagggucccggagugccgggcuccaccaggacucaccgccuucaccuccugggacgccgguaccuggcagugaacucuggagggccugcgggucauuagagucaggaggucugagcguggugcuuggucaugucccaucccaaccagugagagccacgcggccucccuaaggccagucguggggggugggucuggagguuugugguuugugugagagggggugcauguguggcagauuugagcccaguguaaacugcuucugcccacagccuccuguccacgcugccugucucugccccuguugucugcucgcugggggagugccagcuccuuucagugccggacagagcguaauuagacaggauuugcuggugcuaugaaagcucagcuucuccccaaggucaaugcugaauuuuagauuucccaugcccccucucccugcagaggcaacugcugagcagacggugugauaaaugugugugugaucugugccaagugcccuuccugggagcccugaccucgcacagugcucaccgucauggugccacagcgggggugccaacgcuggggcugggucccaggucccguccugguucugccuaugacuuggcucauggguccugcucggcucuuuuuugugccucggcauguucugagagaggugugggggugagggcuccccgcugacccucccgugggcggcacguggcaucugacucuugcucucuuaacagcgugaggucgaccgcaaccaggagcuccugacgcgcauccggcagcuucaggagcgggaggccggggcggaggagaagaugcaggagcagcuggagcgcaacaggcagugucagcagaacuuggaugcugccagcaagaggcugcgugagaaagaggacagucuggcccaggcuggcgaggugagcggggccucugcugcgcagggagcuguuuucccgaggagagggagugcaugcucuuguuugccacugcagugcccgcuuguguuuucacuugugcuucccacacgggcagcugcguuuuguacauaguugucaucaguagaaguauuaauuuuccauucuguaguuuucaguuaaaaaguugagacuuugggccgggcgcgguggcucacgccuguaaucccagcacuuugggaggccgagguggguguaucaucugagguugggaguuggagaccagccugaccaacauggugaaaccccaucucuacuaaaaauacaaaaauuagccaugcgugguggugcgcaccuguagucccagccugugggacucgggaggcugaggcaggagaaucgcuugaacccaggagguggagguugcagugagcucagaucacaccauugcacuccagccugggcaacacagcaagacucugucucaaaaaaaaaaaaaaaaguuaagcacuuuuuugccuuuguaauuaugaauuuaaauggaugaugaaucuguuuuuuguuguuuguggacguuuaguguguuuguguucgcucauguauguaugcgacagguagcccuucccucagcccucgcuucuguugacuuuggacagaccccuaggacuggguuauaaggucccuagcgauggcggucucugcagccguugugcucagaggccuggcugagggcuccaauuuccccguagccuucccugucguggaugguggucuuuucuggaaauagcuguuguuuugucaggaggcuuaaggaggcacgucuggauuugcauaucuuugacugucugcaaggucuacaggcaucugauggcgucggauaauugccucugaacuggagccugugugaacugcaguccuggugaagguugcuugcauuuuagaaacagcccagacaugggcacugguggaaauuggaaucuucugaccucuccuguccuuugucuguggcgaucaagaucgcuggugccaagaggaaacaugaaaaucugcugguguggggguggaggcgugguagggguggggugggcgugcagcggggguccuggagggguccagaaacuggccgcggguccuuccuguggccgugcuggggaggcguguucaggcuguuccccuaucugcuucuggagggaacguuggcaggagaggaggcgugauuggcucccgagaagcugcucuugccuugcccaugcucuggguuccaguucccaugugcugggcuguacuggaguugggccgggggcuguccccgcugccugcgggcaccugugguuccaugggggagggugagucgugccgagcacuucaugaggggcagaggagcaggagacugcaggagccgcagggcggugcccggugggguggggcauagugaggggaagaugguggcgcugcaggugcugcugcuuuggccugucaugucuaagccgagguggccgcuccucagggaagcccucccugcgcacuaggccuugacugccuucuccugucacaggguccugauugucacgcuccuuacucuggaauuaucuuaugcgccucuuccuugccaacuguccggcguccccuacaacacgggugacccugugggcaggugggcucggcccugcaucuggccuugccccuggcacacggugcguauuaauugaguucggaagaccucugggaggauguguuuauuguuaguauguuuuuaauaccuuucuucuuuguugacucccagguugaugcuucacuguuguggugaaguaaaccguacauauugugggcauguggggagcacgcagcccccaugcgggccuucccagagcggcgugggguggacagcggugauaggcuucagcaggcccuaagcugggcacguucucagggacagggaaaugagugcugaggccuccuuguuugcggagggugccgcccagccaggcccacccaggucguuugcugugugaguuugccauuguccuguccugggugcgugguccccagggcugacaucacgcccguguguuuccguguguuaacuuacagugaugcuucucagggucuguccggcuuuucacauuggcucgacccacgugcucuuucuuucucugaggacaccugggguuuucugagcuuuuccagaggguuaggguccucagaaggucgccuggugggaguggucaggaggaagccuggcgguucugucgcgugcggguuccaugaugucaggcagaccugcuguccuggaggcugccagaggggcugcuggcuuugcucaggggccgccuccccaggggcgcuccugcccgugccgcgugcucccguuccaagcgcacggccuccccagcagguaccgcccugccccuugcacagccuccgucuuuguccuguugguuggccagugccuugcuguggugugagggcgaugucgcuagcaaacagccgucaugguagcauugggguggcuagggagggaugacaggagccacgguuggagggaagaccgaagugaugguguggcggguauguggaugucugaugggacuuugggagcguggggcacuggcacagagacugccaggugccaggccugagaguccgggcccaucuuggcugguggaggcuuuugcuucugaagccgccucaccaagccuccuuuccagggccccuggcuggggcccggucuccucugucagcuccuggguggcuuguggcaggcucugggcugugcugcucuggagcaccaggaggagggugggcccugcgugugagcgucugccugaccugcauccuccagaaggagguggcucugcccccuggcccucugcuccccugcuccucuucccccugcccucugccccccuugcccccuugccaucugccccccuaccgcucugccccccuaccccucugcccgaugccccucugcccccuuauuccucugccccucugccuccugcccugauuauagcacguggguggugucgccucuccacucuucucaucuccaugugcaggcuccuuccacgcacgggcuccacucacugagcggcucucugguccccucuacuuuuagaccaucaacgcacugaaggggaggaucucggaacugcaguggagcgugauggaccaggagaugcgggugaagcgccuggagucggagaagcaggagcugcaggagcagcuggaccugcaacacaagugggcggggccaggguguggggucgggggucgggucacgugugggggcaugcgucccaccucucuccugguggcugggugggauguggauacacucccagaugcuguccuaauucacagacacucaagaggggcagaugcugaggccucuggagccaggaccgugagcccagaaaguguccugauguuccuggagcagaaugggggcagcaacuuccucccccuccuucuuagagagggcuccugcagagccagauuuuacuuuauuuuuugagacagggucucacucugucguccagccuggagugcaaugguguaaucauggcucacuguagccucaaccuccugggcucaagugauccuccugccuuagccucccgaguaacugggucugcaagcaugugcaguacaccuggcuaauuuuuuuuuuuuugagauugagucucgcugugucacccaggcuggagugcaguggcaccaucucggcucacugcagccuccgccuccuggguucagugauucuccugccucggccuccugaguagcugggauuaguuuugcaccuggcuaauuuuaaaaaacguuuuguagagauggcggucucgcuuuguaacccaggcuggucuugagcuccuggccucaagcgauccuccugccucagccuccuagagugcugggaucccaggcugagccgccguacccugcugagggcuagguugaaagggcagcaucaugugccuuggagguggagggggcguggcugggaagggauguccaggcacagggcugagccgaggcacagacgugagagccuugucuggaggugcagucaggagacugugggcaucuccugcagacuuggacccuuccaucagcagaugugguuuuaggagaguucuaguuccguaguagagaggagaggucauuccuggguggggcccuaccgcagcugcaccagggcuggggguugccgcaggcaggugagagcuguggguuccacuguuggagagguccuugcagguggccugggcucacuacgcaccccgucugaaugagcagacugaggccugagagccagcccacaggggcuggggccugggaccuugggguacccaugcaguggaguguguguuggcggggggcggggggucugugccgugggagguccugaaccuuggggugggaaugaacguaugugggucugugcuggggcgggucucaggcugaggagaauuguuggccuugccgcaugccuguuucugugugugauguauuuuucuuucaauagaaaaugccaggaagccaaucagaaaauccaggaacuccaggccagccaagaagcaagagcagaccacgagcagcagauuaaggugagucacucccugucagugccuuguggacaucccugugguggccuugacucuccugccccugucggccuuucugcgcuggugccgagcuccgugguccuucugugagguuagcugcugcccuguguguugggcacugugcugggcaccagggaugccauggugaaugaggcagaugcuuccgcucuugggagcguguauucuagaggagggagacugaccacaaacaccaagagaaaauguccgugugugugaugacgucaagugcugaugagcgugagaagaugcuacaggcauagagagguugagaaagcugcccacaguugcacagcuggagcugggucucagucagggcaucugacucaagcucaggcugugccauuucccugcggaggacgugccagggagacguugacuccagaucccucuccugccuccuguugccuggagagcagccuccagacccugugcucuggccgugcccucucagcccuuaugcacccucaccuccaggcuucacaccagcucuuccuggcugcagagcugcccggcacccccagccuggccucugccauguccgcuccuggugguggucccuggccccucgcagcccucaguccaccucucaggauuuucuggcuggcagggcgauggacucuguuaguguuuguugaaugaccgucugguuuggucgugguuucauacucugccuguucagugacuugcugcucacagaugccagcugucugugucccaaggggacuggguaccguagggaaaagccuguccucacuauuggaaagacugagcugucacacgugcugcuagaguggcagaagugggcuugacacgggaggggugggauguuuuaccauggagugccauccuggaccagacuugagacagacuuuugcuccuggagagcuccccgagggcagguggugagcacagcagcccggcagugugcagugugaaugccagcucccaguacgcggagggcugggaggucggcgcugggaagagcugcccuggaguggaugcugaggcucaguauuggaagcagcuucgaggccccuggugcagcccaggaaggccucccacaggagaguccugaggcauggaggcugcugaggaccuggggcaguuuagcgaaggaacuuugugaccucaaugacuuuaauuuuuaauggaugguauuuucuagagcaauuuuagguucacagcaaaaugagcagaagguaaagcuccuguguacccccugcgcccgcuccuacacacacagccuacccugguagaguggagcacgugugacggugaugaaccugccuggacacaucagugucacgcagaguccacgggucaugcgagggucacucuuggagugggacaguguaugguucgggcagauguaaaauguucuauauuugccauuagagugucacacagaaaaguuuuacugccuaaaaauccucucugcucccccagucaaucccugccucucuccuucugagcccuugacaaccccuuccuuucccagaacguccugugguuggauccugcaguguguauagccguugcagaccggcuuccuucucuuagccgugugcgugugauuuucuccaggucucuucguggcucauuuuucccuucuucucugucccuggccuccaucaggaucuggagcagaagcugucccugcaagagcaggaugcagcgauugugaagaacaugaagucugagcugguacggcucccuaggcuggaacgggagcugaagcagcugcgggaggagagcgcgcaccugcggugagggguugcgggggauggggcagccgccucgagugagucuggguuugugcacauggagcccacugugcagacccuguaggggcagggcucccgggcucuuggccuuaucccuaggguguguggcuauuugagcgacucuuuguggcacugccagggagaugagagagaccaacgggcugcuccaggaagagcuggaagggcugcagaggaagcuggggcgccaggagaagaugcaggagacgcugguuggcuuggagcuggagaacgaggugagggccuguguggugugcgguuccuguggguguccucugcccugccuggaggagccucgguauuguggucacgcccaccagcugcucaccuacaacauggagguugcugugauggggugggaggcagaaucgugguccccagagagguccaugccucauccucagagccugugaacacagcaccuucccuggcagggcgaaugaggugacuggucagcuggcccacggcggggaggggcuccugggccauccugggggcucagagugaugugagagggacuuggcagcucuugcuggguguggagauggaggacgggccacaagccaaggaaugugggucaucuggaagcuggaaagagcagggaaguggacuguccccuggaaucugcagaaggaacacaacccugccaacaccaggauuccagcucggggagacccguuuuggauuuccgaucuaaaguacuauaaaauauuacauuugugggcuuuuuuuuuuuuuuuuuuugagauggagucucgcccuguccccaggcuggaaugcaauggugcgaucucggcucacugcaaccuccgccucccggguacaagcgagucuccugccucagccuccugaguagcugggacuacaggcgugcgccaccacacccggcuaauuuuuguauuuuuaguagagauaggguuucaccacguuggcuaggauggucuugaucucuuggaacucgugauccacccuccucagccucccaaagugcugggauuauagacgugagccaccaugcccggccaggcuuuuuaaauguuaaauuuuuuuuuguagagauggggucucccuguguugccuaggcugguccugaacuccugggcucaagugacccucccgccuuugccucccaaagugcugagaugacaggcgugagccucugugccgcaccaauuuguguuguuugaagccacuuaguuuguggugaucuguuucgguugcagcaggaaacugguacagagggugagucagaaugcguguggcacugugaggaucagggcuggcagggcccugugcuggggguguucugucuucaccgcggcaguugguaggaaggugucagugcuggaaaacauccugcagucauguugcgggcagaggaggaaacugagguucagagaagcucccucucuugcccggugcacagcaaguuuggaccagaauuuaggccuucuggccccugccuggguccucuguccuucaugccacuucccuguggccacagccacuccccucugugccuggcacaccuaugccgccuuucuccggugguuguggggccuggcaggagggcagacuccaucugcagugcucugcagcugcccagcuguccagcuggccacuuccagaguccccuuggguggcguggcgucucuguccucuucagagcugugauacagccaaggucguuuuggggccuuggcccugugacccacggugagguggcucccugucagcggggguaucuggcagggacucuucucucaggugcuggguucuguaggagcuuagccugaaaagacagcucccaugcgacaucuuuucucucucccgcgguguaauuuauuguuugaugguugaagaguuggggcucucaagccacauuccguaguugggugcuugcugcuccaugucccugggccagcuccuucaucucccugucugucuccccgucugcacagggaggaguggugcuggcugccuugucaggacugugaggcucacaugagucuaugcaaagugcucagagcagugccuggcgcguagcgaauguucuguagcguuggcugucauauaguuacuagucaagugcgugccugcgcauaggaggggcugugagaauaccucacugacuugccgaguggagcguugauaacagcauggugcuuggcacuggguggaggugaagcgaggccagaacaaaggcacagagucccugcccucagauugcuuccguccuagaagggccgugagacucaccucuuugggaugcggcucagcaugggacaggcaugugacacagaggggugggcuggccuguaggcagugucucacccucccucaugcuccaggguggcugcccuccucuccuagggccugcugguccuggucugcugugugauggcaggaaguuuggcuccaggacugagucugucugcuccagggcuugguucccugaggagccccuggaagaugggggagggaugaguccuaacggcucaaggacccgaggcugcucccuggggcacagucaaccccaggauccuuucugaggcugucugccuucucccuccacagccacacguugcuuuuagcuugcugggauucacacuugaauuuacggggccaggaaggagugaggcaggaagcgccaguguggcuucugcaguuggggaauaauaacccggccacuuccaagcagacuuggagcauguagcgcccagcucagagaugagggcaggcucuccugagaggucagggacuuagcaccgugaucaugauugucagucuuaugugaugauccuguggcaggugaugacagggucugugcuuuuguugucuuuucagaggcugcuggccaagcugcaaagcugggagagacuggaccagaccaugggccugagcaucagguagggaagggcaggugucuccggggucccgccuucuuugaaggguccugggugaagagcagagccugcuuccggcucaccagcgcagucuccagccaggcaucucuguggcuggugcggggcauuuguccugggcugcucagguuuaaugaggccuuucccagcggauggggcaguggaacccagugacucauccugcugaagccuuaguaacaucuucauucagaagcggaauauccacagcaaaccaguggcaggcgucugauugcccugcguugcggggcuuugugaaaggacucuuuuugguguauaccgaggaaauaauugcuuuugggggaaaucauucauuuuagggaacuguaaccaguggagaugaacugaguuuuuagaauuaagaaaaacccacuguauuaggcuguucuugcauugcuauaaagaaauaccagagacuggguaauuaugaagagaagagguggaauuggcucacgcuucugcagcuguacaggaagcauggugcuggcaucugcucggcuucuggugaagccgcagggagcuuucagucauggcggaaggugaagggggaacaggcacgccgcaaugcaaaaacaggaaugagagagcgagagagugagcgagcgugaguaguguugggagggaggugccacacacuucuaaaugaccagaucucaugagaacucacuaucaugaagacagacccaagcugugagggauccacucgaggauccaaacacuucccacggggccccacuuucagcacuggggauuacaauucaacaugaggcauggggcagggacacagauccaaaugguucucacccaccauaguggaagacgauugucuggugcuuguagcagccucuucacgcagucugugccaagcugagugccagcgcuuggguggugggaugugggguggagcugccgggggaccacccugggugcuggggaugguauucuuauagacagguagcuggaccguucccaggucugguccugucuguccuccugccccauccuucccaggacccugugcucaucuuucuccagcagccgcucaguuggccccugcccuucagucgcggugccccugcaggugaccaccuccuggcagcucuggucuggaccccucuuccugguugcccugugugcgccaggucucgaggaggugcaggagcgaugcuuuugaaggagccaucagagcccggggcucagggcccgaggugcuggugccgaggcggccucuuauuguguuugcuugugagauuucaaggcuucccgcuucuugccugucuuuccugcuguucuuggaaacuaggcugagacugagacucucugaaagagcuauccuuugaccacaccguccgacugcugguucuggaauccauuaccuucucaucagcauuacuggcuucaguucucugucaccugaaagugccucuucauuuucuuugagcuuugcuaagucagagcacggcccgggcugcugucuccucuugaacucccccuguagaacacagacuucuguagggccggccucagcggggccuaaaugcuuugugcuucugucuguucucugggcuuauuaauugcuuggaaggcgacccuucugcucccaggcauacucuggccagaugagaaaccucugugacuucuuuccugugaagggacaucagaggcccccacgugccugaugggcccggcccugcuggaggguccagugugcaguuugcccuggagcacugggugucagucgggcacgagaccuggcacagcuggcugcugucucuggcugguuucaaaguacuguggauccuuucagcccuguucccgcaucugagcgcccugccugggcauggcuugugugagggcgagcuggccugggggugcugccugggcguggccagcaugagggcaugcuggccccagggguucugccugccugugucuucuguguucacucugcccucccugguggccaggcccuggaugagggagaggagggguuggucuguagggcugguggaggugggcugccugugcccaccaccagcuuaaagugggcgggaagcaaguggcaugcauguguggcgcccugcagcuuugaugaggaacacagauaguucuucggaggcuggauucaaggcucccccugccccccgccaccaacaguaagaccugugucaagucacugcgcugcucugggccaguguucucuuuauugaaagggggacacggagcucuucuccccaacugcgugugaagauccgacgugaucguguacuuguggagggcccugugaguuggagaggggcuggugcgagcguccucucugagcagccggaggcugauggccaggaagguggauggagccguccucgcugugggggucgaccccuagucuccugcguuggccuuggcugugggccugguagagggcagguuuccucacgugcuggguugccugccaugccugggccccuucagggcuccccgcugcuccuuguguugugcuccacagggcgggugucugagugugguucugcaucaggccgugaucucgggugacucacgcuggacgucagugggguggugcucaugccgcaguccacgggaaugcgggcuggcggucccgaauacggcuccuagagaguccacgggaaugcgggcuggcggucccgaauacggcuccuagagaguccacgggaaugcgggcuggcggucccgaauacggcuccuagagaguccacgggaaugcgggcuggcggucccgaauacggcuccuagaaucaccgggaggguuugguaaacgugugcauuucuggcugcgcacaguggcucacaccuguagucccagugguuugggaggcugccgcagggggauugcucgagccuagauguuugagaucagccuggggaacgcaguugagaccccguguguaccaaaacaaaaauuagcggugcucaguggugugcaccuguagucccagcuacucaggaggcuaaggugggaggaucaccugagcccaggaggagcugugauugcaccacugcacuccagugacugagugagucccugucucuaaaaaacaaaaacaaaaaccaaaguggauuucuggguaaaccugagaugcacugggcuuucuuuucuguuuuuagggaccagguuugggguaguucuuaggaauuucccgugucuggcagcauugaaugugguggugaagucggcgacagggacacagauguggugagaagcuggggccacgggggcccccaugggagggcugagugcauuugcuguucuuguguggagacaugcgugccucugugggcgagcuuggggauccccuccucucagccguggggaccugaggugacaucagauguccuggaagcagagggcucuguggcugggagugcccugggccugugccgggugggcuggcgucugcuugccuucgggcccaggcuuugcugggauuuggggcuugccgaggcccgaggccccguggguguggaggagcugcugccacuagguggugcccccgccuuggugauccuucccacagcagcuucccuugggucucucuggccuaguggaccgcugcucucccaccaugggacuugcuugcugacacugggguuuuggucgauggggaugugaggggcuuguggccacuguuccugacugccuucaggggggcgcuucuggcugucccaugccugccuuguuucugaccaguguccuggggcccucaggccugugggcucugggcugugagcuccuggcguugaggucagacguccuuugugugggcccuucccuaaggacagggugcugacguccugcaguccucagagggcucuucggccucgccccgggcuuggauaaacccuggcugagccccaggagagaguggccuggucacccucuuccccauguagggcuucuuaugucuuaggagaggaggcugggcaggcuggcuggggugggucagugaaaccaugggaagacccuguggaacgagguccuuaugugucacacaggccugggcacaugugacaugugcagcacacggguucacgcaggcugggggcauguuaguuucuacgacuuugaagucacaggcaaggagggacacagugcguguggaugagccugcgugaacacacguggggaagggcaggaugccagugccgggagugugguguggacacccucauccuuagggugcuggaaguugggcugagggaguuagcagcagugcgaggcgugugucuggaggcagcgaugugaucagcuuggucucccaggagcauggucugucucggggagugacuuacgggugaggaaagcggaggccagcacacacccuuugagguacgugucauccucggcaagaccucgggcacaggagggggaggaggaguaauacagagaggccagugggaaagauggcgugaggcuggagcccaucugggaaugcaggaugcuugcuucucuuuggaaaaucaccuguuucaguagaaugaaagggggugcaggccaucucuguaggcgaacagcacaaccauuuguaacaauccaagacucguuugugauuuaaaguucucagcaagcuaggaagagaagagaacuuccucaaccagcuaaaugauaccugcagaaaaccagcugauauaauacaagguggacggacugcaucccugacauggagaccaggcagggugucuguucccugcaccccugguugcacuguacuggagaucuucaccaguauaauuagggaagcaaaaagaaaagauggacagacuggaaaggaggaaguaaaacuguaccuggagacaacauaauuaucuauagaaauucccagggaauaaaugacaagccaguaggacuaaaccgugagguuuacagggucacgggauacaaggacaauguaccaaaauggguuauguuucuguauacuagcagugagccacucgagguacauaccauguaugauggcaucaaaguccaugaaauauuaggaaugcauauaagaaaaucuguguaagauuuguacacugagaagcuuaagacgcaacugagacauuaaagaucaccugauguagaaaaauggagacauuguaagaggaaaaaugaacucuuuuccccucugcucucacacagccucugacaccagauacuggaagguuucccccacaccaagcaguucuccaggggucaccagcuggauguccugcagccucaucugcacacucuccaccuggaguuccaucagcuuccaaugggucagggcccagucccacacaucugugcccccuucagauuccaggugcaaguaguaggccggcaucucugcuucauuuuacgguuuucuucucuuccucuuucacugacaucagcuguacuucugacugacaggcuguuaaacgaggccccugcuacccacuccuuggguuucauuaauuggcuaguguggcucacagaacucgggaagaugcuuuguuauguuuagucaugucuuauaaaggauguuacgaauaauacaggugaacagguuggcagagugaggugugaggagaggcgcggagcuuccaugcccucucugggcacaccacccuccaggagccucugugugugcagcucugaacccuggccuuauuuguggguuuuuauggaggcuucaucacagaggcaugauugauuacaccauuggccguuggaaaucaacucacccuucggccccucuccccuccuaggagguugaggggugggacucaaagucccaacccucuaaucucaccuugguguuucggauaaccacccuaucugaagcugccugggggcugccaaccagcacucagcucauuaguucacaagagacacucuucucacuccagauaaggagcugcauguaugucagggaacagaaagaccaaauauauauuucagaguaucguaaagguacuguggucguguauuggaagauucauuauuguuaagauggcaguuugcucaaauugacccaaauauuuaacauagucccaaucaaagccccagcagaaauugaugaacugaucucuaaaauuucuuuuuuuuuuuuuuuuuugagacggaaucuuacucugucgcccaggcuggagugcaauggugcgaucuuggcuuacugcaaccuuugccuccuggguucaagcaauucugccucagccuccccaguagcugggacuacaggcauggaccaccaugcuuggcuaauuuuuguauuuuuguagagacaggguuucgccauguuggucaggcuggucuugaacuccugaccucaagugauccacccgccuuggccucccaaagugcugggauuacaggcaugagccacugugcccggcugacaauuucuaaaauuucuaugggaauguaaaguaccuauaaauuguuauagccauaacaguuucaaaaaagaacaaguuauacagcuuacacuggccaauuucaagacacguuguaaauugcauaaauugagacacugugguauuaaguauagacauguaaaucaggagaacagaguagaauguucagaaaugauugaagaauacaguguugauuguugucaaaguguccagauaauucagugggagaaagaaucuuuucaccgagggugguaaaccaguaggcucuucguggugaggaugagccuuaacaccugucucaugcuggacacaagauuuaacucaaaugacgcauagaccuauguguaaaagucacaaaaucuggaagcuaggguuuggcaaagaggucuuacaauacaacgaacaugaaccauaaaugaaaaaauugauaaauuagacuucaucaaaauugaaaacuucugcucucaaaagauacagugaaaaggcagaccauagacuaggaaaauauuugcgagauauuaacauguaucugaccaaagaugugcuccaggauagagaaggaacucuuacaaauuaguaagauuaccauaguuuaaaaaauggucaaaagacuuuuaacagauacuuuauuauuuauuuauuuuuuuggagauggaaucuugcucugucgcccaggcuggaguauaguggcaugaucuuggcucacugcaaccuccgccucccagguucaagcaauccuccagccucagccuccugaguagcugggguuccaggcgugcaccaccacacccggcuaauuuuuguauuuuaauagagacagguuucaccauguuggccaggcuagucucaaacuccugaccucaggugaucugccugccuuggccucccaaagcacugggauuacaggugugagccacuguacccggccugcuuuuaacagauacuuuacaagagaagauauauaggugguaaauaaggacaugaaaagauggucaacauuguuaguuauuaggggaaugcaaauuaagacuguaaucgcccaacaggguucuucuugcugcccagaaagccaaugcacugagaacggcagguguggcagcagagagggaguuuaaugauugcagagccagccgagggagguggacgcgagauaacucucacaucugucucccugagaauuaggaggcgagggcuugaggguguuuuggcgggcagcggccuagggaguggugaaugcugguugguuguguuggggaugcaaugauaggggugucaggacugucuccgugcagcugagucaguuccugggagauggggucacaaguccagguggcaucucuugaucugcugaaaugcuaaaucugaaaaauaucccaaagaccaguuuuuuagguuucacagcagugaugucuguaggagccguuagggaaguuccgaaucugacaacgucugguuacgugacuccggguagcaggcacuguagaagagcaagcuaaguaagcagugacaggucaugguuuacccgugccuguucuuuagcaaaguucaggccccuguagcaaugccagucuuaaucuccaaacaaggacgggugucauuuuuccuugccuugaaguuuaacuauaaacuacauuccucucauaguuaucuuggccucuguauuagaauaagcaaaaaaaaaaaaaaaaaaaaaaagaaaagauccugugagguuagaagcaagguggagucaguaauguagauuucucucguuacuuaaaauucuguaaaggcgguuucaagacugcagugagauaccacugggcacccaauaaaauggcuaaaauuaagcagacugaccauccugacugcuggcagagaugcagagcagccaggccuguugccccugggaguagcaagugguacggccacuuuggaaaugguuugguagcuuuguacacacuuacggugugacccugcaguuccauuccucgguauuuaaucuaagagaaacccaagagaaaauguggucucaugaagacuuguacaggaauguuuguagagccuuauucuaacagucugagagcaggaacaacucaggugccugucagcaggugaagggauacguggaccguggcgucuccacgcaguguaaugcgcggcagcggcggugcuuggaaacaugaaagggucucucuugcugagugaaggaagccagacuuacugaguuuauacuuacuauaccaucccauugauuugaacuuuuuaaaaagguaaaacugagcaacagugauagaaagcaggucagugaucccuggagucucgugcugggauaugauuggggucuuauggggugcuagaaauacccuuuggcguaauggaugugaucgccgcacagguguacacgcagcaaagcucaugacacugcucuugucaaacuguucacgugcgcagaucauaccucacucaagcuggccugucaacagcagacggucagcucuucggauuagcugugaggggaaggaaaauuccuuaguggcgacuuggacugaauuggagaguggccugggggugcuguuuaagccagccuucauuuggggagggacccauccccugaguuuauggaaggccuacggccacggcugcgugcaccuccugggucuuuguuacgucacaggagugcugugaggaguggcagcauguggggucagugcaggcugcagagggucaaggaguuucacauuugaugaaaagcagaacaagcugcauaaaugcaaaugaauggaaugaaaaguggaacguguucuuccuuuccugcccucccuggugaccucacucagggcugggugcccugugucacagcuuccuagccaucgucaccuuguguucucaguauuccuggggggcuguuccagaauagaacugauugccccggaggugggcagcagggcgugcugugcuuggccccgguucgucuuucuaggcaaugccugaugaguuuccugugugucguucuggaaauguguguacauagaagcucuuuauguacucccaucaccuuuuaaaauuggggcuccuuccacaguuuuauucugcaacuguuuucacucaguuuuugacaguuuuuuggccccagcgcaggcuggucugcugaacuacuuuaaagaacugcagggugugcuggagugcagacggacucagacuccagcagccccuguugauggacacuuaggguguuuccagcuucuuuccccaauuagccaugcuaugcugguuggguaaauucuuaaaaggaugauuuuuaguucaaaagagaugugcguuugagacuccuagcuggugccacaccgcccucccgaaaagcaugagugcugugcgcucccgucacggcgugugacugccgucaccuaauggggguggugugcuuucaacguuucuagagagauucagcucgaagucacaguacagugaggagagcaggcaucuucaaaggcuuggcuuuucaaaacugucauuuagcagcucccacugagggggacccuaugaaauaggaagggagugggugucaaguccuguagccgagcccccacuucagggaggaaaucauuugcucguggccaagaugccgcuguuuuuggcuccuugccugucccguugugccugaaucuggccuugcuucccaucccggcgggugggcauuauacccgucagcaagggcaggccugagggggugaggaggggcugcagaggaggcugggcuggggaggugggaggcgggcauugcuggcucagaguccuggcagcugugcccaccuggaacugcugacccauccccuguagucaaagcugggcaccugucagugcugaccuggacauuuucccaaaaacuuuuguagacuggucagaugacaagucucagggcccagcuucccugaugugugaggccaauuaggaggacagugaggggaugcaugauuuuccucuaaggaagggucuaauugaccagccuggacaguuuuauuauccuaguuaccgugcgcgugauuuguaauuacccggcuguugaguugaucaauaccagacgcccugguggugcuugggaaggugggcgacugucagguauguugguccauuuuaauuggcgccgguuugguuuucuuuggggcaugggaggaggagggggagaagcguuuggccuucuggcuacuugugugagcauggcccuucuucugggccugcaugccggaugccucguggucugggccacguuuccccuuuucguuuguucauucguucaccaugagcugcucuuguggagcccaugaucuggagggagaaggaucccucaggccugugcgucuguggugugcaggucccaggacccuggagcuggagaguggcgagugugcugcccuccagaggugcaggccaggguggggcgugagccagguucccagcuccguccgagcacggugccugccaucucuccucuucucaaccccagcuccuccuguggcugaguccuggccgcuuucugccuugggguuguguugguuuuccguaaacgcauccucucaauccugagcauugugaguuaagagcuggggucucccuuuagcgccccugagccagacgugcaguaggcgugugcugagccuuugaagaguggaggaccgagcgagggcgucucugugccuugcaguugguggugauguaugggcggagccuccagugcucuuggcugcugugacagggccccccugggguccugcacuaucccagcgagacccccaaagcaaggccagcagagagcuuccugacagcugccucgcuuuggcgacggcccuggcuggggugcagccugugccccucuccgcccccuugugaaguuucggaugggcguucccagcagugcugacaggcucacgccgcccuugggcuucauuccagguacggucgggcaggcuggagacugucagagucugggggcggugcuguggguguugggaccccgcagggagaggcgagagaagggcuucccagaagagaccguugggcuccaccccugcaugugccugacugcacagacagcugagugcucugcggcguguccggguggaaacgcuaucacuuggucucggagcucuuuuuggggcuuuucuccaagcuuuguagauagggcucuucuacuuauaggucucuuuuuaaauugauuuuaaaaagucuaaggccagagugacaggcuuuagacaaguccggcugccguagguuccaggauuuauuuuagaggaggcgguggcaucccuggugguaucugggcugguuuuuacucaugggugcuuacugggguccuguugcgugcuguccccuccuugugggcuaggggcucccaggguguccacgucccuacuuuuacagguagagcagggggugcccuggcguggaauggaggaagggucugggcagcuuugugacagggcugguaggagggggauuuugacaggcggcuugaagccagcgccagccgagggccagaggcagagaagcugaaggccuccucugggcagcccaccacuaccugcccuucucuccgaggacuucccagcagugccauggccuucggagagcuggggucucaggcaggcuacggggcuccacagcuccccacccaacauuccucaacgucagcuuuggggcugugaggugugaccucuacaggaucaccuggggucacucccugcagccagcuguagcugucauuugugucaggagcugcuggucuugccugcaccacccacccuucccgcccuccaccuacccugcguggccuggguucuugggaggaacaggagauccugagcuguugaauuccuggaacccacggucacucggcacccgcaucccgcuccucccagcuccugcacgcuucucacugguguggucaccuggaaucaggugcccugauucugcuggacaggcgggaggggaggcugggccgaaggguggaccagccuuugcacgcucaguggcugcaggggggccgugugcaugaagcaggcgguccucgugguagcaccguuugugcagagccgcgguggggagagcgggcuugcguucacagaagugcugugagaugaucacuucaucacaagccagucagcaccagccuguggggcggcucauguggacuaagugaucugacuuuccuggcuuuuguuugacgauguuuccacuguuauccaggugcagagagcucugaucucccacgaucggaaguaccgugugcgugucuuaccugggcagaaugcagagaccuucacuggcagcuguguguggacccuggggcucuguuacacagccaggugcugaggagcagggcuccgagccaggccagcgaaccuuccuuagacccccugugugcaggccuggugccuggugucgggggcccaguggagaacaagauccggcuguugccaugggacuuucgucugguggggaguccugaggaggauguggaugagguggagaagagguuccaggugaacgcaaguguccacccugcauuccaggguggcaggcggcccggggcggguguggggugguugggugggcgccccgcgugcuauguuagcguaggguggugcacaccuggccggcaggccuuggucccgcucuucacccuccaccugucgugggugcgccccgggagggguggaggauggagggcaggcgugggaagagcucugagacccuuggcuucauggagaguguugggcaguuaccccucccuugcccucgggccuuugugaguguggcuuccuggaacucugggggauuugucaccagugacugcagggggcucucccaucccuuucauccaggcuucacugucugcccuaagcuggggacugguccagcugaccuggauggugcggagugugggcccugcuggccagcauggcguugggaagcaccuaggugggugguggguuggguuguggccuuaccgcggagucugggcugcagcugagaaagccgucuccuaggaccaggaaucuggguuugggaggcuggaggucuuggcccagcaguucaguggcugcccggugugucugccuggccuggcccucgucugguuuccguugucugggaggcaccccugcccgugccaggcggggcacugcgggggcgcggaugcggaguggaagacugcugauuuaggaaucgaaacuccagggacauccguguagcagagugauucuaagaugauuaagaaaaccaucaaugauuuaaagaaaguguucacugcaguccuuauugagcgguuugccgcgugcagggcauguggggguggcgcaccaggcugcaggcgcccuucaugacggcaggcaggggaccuccuaggagucuuggcugugacacgugagguaugaaggccagaaaggugaacguguggaaucugugacccagaaguaacaaacuccuuucuuggagagcaguuagguauuccauuccuuaguccauaugccaacauuuaaaaaggccaaaaccagaggccuagaaaauguaucuggaaguugcagugagaccguuuuugaucauuguggccuuccuggggcucaguuuccucgcuuugcaaaugccauuuuggcagggaucugcuguggggcaucuccgugcagguggagcuggaguugcgcaucuuucucaggcuggcaucauacaggccccagugcacucuggcagggaggggcagcccccuccuggauagccccgcccaaggccgggaggacugugaaggggggaucccacugccugaccucagccugucgggccccacagcgcgucucucuguggacuggucgccggcuuccuguggccuguguguccuccgaguggcuggagcuuuggaacccuauucuguagcuuggagcuccugagccucaaagggcaggggccugguuccuugcccauccuugcccagccugauggccugugcuuguggacuguacaugggcaccugcuuuaacaccuggaggaguaggggcuaccaagagcauguggcucugggccucccugggagagucacucagcggcaggagaacugagugggacacaucagggagugucugucucauggacgccuguuggccugcagccuggagagggggccugaaguguguguuccaugcucuugacccccaggaagcacucgccucuguugaaagccucgugccgcagagcgcgauugcugucccggguggacggccaucacgggcuccuugcuccggcgaugccagcgcuccugguguuguguguggcuggcucccccuugucucagcccugggcuuagagcaggccaggugcucaggcagugguuuuguugcuugaagggggguguguaccuggcugcagccuguggagagcgugaguggcuggcagaagcaaaggcgggcucuugggagaugagagcaggcagccggccuggaggcuuccauggggcuggucagcuccugcuggcucuuccuggcacaaauccacgcugggcugggugccuuggcucacaccuguaaucccagcacuuugggagccugaagugggaggaucgcuugagccugggaguucaagaccagccugggcaacacugugagacccuaucucuauuuuuaaaaauaaaaauauaaagauaacccuuccuccaaaaaaaaaaaaaaaaacccaaacucaugguggaccuugggaugagcgggggcgcuuguggggcagaacugggugugguugccccguccugggccuguucccaggccugcucuuagaggaggggcugaugggcccugugggugcagggagauggggucagucacaggcuggggccugggggcugggaccugggggcugggacccgggggcuaggaccaguuuuggcucucaggcagggagggguugugaacucuguuuugggaauguguguuugaagugucagugauguagccagaaggaggugucagacagcagccgaugucaggccugcauggcuccuagaggagcccuagggcuggccugcccagugaggggcagggaugagccggccuaggggaguggcagagccagaggagcagacagcuggcccgagucuggagggauuuuggcguuugcagguggcuuugagccugagggccagugccucaccgggucagagagcucugcagcccgccaguccuggucgugccuguguccgagcuugggcccgugugcagggagaagguggcugugcagugcacgucguguguaccaggcgucggcggagugaugcgugggucggggcgggagaugagaggaggagugaggagaggcuagaagccuccagagcagugggguuucuuccucuucuucacuggugagugcuucuugaacacauaggugugcaggccuggugcugggugcuggggauacagcuauaagucaggggcuguuuuccaguccucucagaucuagccgggcauaugucugcuaggucaagcguggcuccugaagagaugacacuugagaggcuggcagcauguuccagauagggugggugcuggcagcacacagguuggccagaugcugcguguucggacaguguuguguggcuccagcugguucuaaccacaguucuccugggauguggcagaagcuggacagguuggcagggaucuguccuguccugagggugguuuggaccgcguccugcaggucacaggagccgcagaaggucuucaucagggaggagcacauccgccaauugugaaggggccucuuuccucacugaauucgcagggcgaggaccuggcgccuuggcaggacccugcugguggaagucccuggggcugucugacccgcugcagguuucagcagccccgaaguguggggagggugggcgguguuuccuguugucaguugagagccucauggaguaggagccguggagucagccgcguuguagugagaguuagaauugagccgcacuguuccugugagcagggagcccgaggccuucugacuucugaagaggguucguguugaaggccagacucucccuguuuuucuguuuccucuucaggugaaugccuguuccuuugugaccacagugucuguggguagcacugugauuuuggagacgcucguuuguuuguucaucugaacauuuauuuggagaccugccguuugccaggcuuugggcuggcucuggcgacgcugugacgagcacagcacagucugcccacguagugcacacacacagacagcuuuaaacaaugaaaacaacaggggugccuccucagaugcaaucuuuuggaagaugccgcaggagcguuuugcgggaguaucuuaguuggagacggccuuguuggauaugaaugacgcuggugggaaugaaggccagacguuuucccugguuuggaaacagguggcuuacaagaguuucuagaguuuauuuguuuaaagacagagccuguucucaagagggucuucacuuugcuggcaggauggcacuguugacgguggugguuggcucuggagagcugcuguguaguugacaaagccuguugauaaucagcgucucauucguucuuccucagaacccuguggacuaagcuggguucugggaggggcugacuggcccaagggcauccagugaauuuguggcccuguugccggaaugcuuggcugauccuggaguauggugagcugugcccucaauaaccuccauccaucuggcuggccacauggugccaugcagcuggauccugcauuuuugugagcugaucagcccgaugcuggcacugaaaggauucuguugggagcugccauccauuuagccugagcggaacucagcacaugugcgggcaugaagcccaucagcugauagcuucuuuuucagaccugauggcucccagccgaacuuuggcaagaaggaccuaccagccugcuggagggcugaccugccugccuuugcugggagccaagcaccuccuggcaguucugggauuugguuuucagugggaggaggcucucugcaagguagaguaagagcaguaauuacuugggagaggaagcguuuaacuucugaggcugcaacacaauacuaucuuguucgcggagguggcugaguuagaagauuagcaauuaauuuuuuaucaggugcaaacuacucuucaguuucauggaaucaaacaguccucccacagcaagggaggggcaggcuuccaccccguguaauuuuucagagcacugcuguuugucugcuuuugagcugauaggaauuauuuacgagucuauuuggaggacauuuugacacacaauucuugguauucccauuugcucuuucuaguuuuuacuuuuccugcauugcuagcguuuacugcaauuaggucucaggaguauuuugccuuuuauuaggauugcaauuacaaaaugcagguaucaacuagguuccuuuaaaucaaagcucacuuuuuauugacucggauaagaaaaguagguauuuuuaguagacugaguugaaaagagugucauugguagcuauuacaagcauuucuuuuaguuuagguguuuuuauuguuuacgagagcuuagcugaaguggcauagauaacccaguaggggucacugcuaaguuaucuguaaguuuucuaagcuugagcuuuagauucaaauacuuuuuuuuuuuuuuugagacagagucuugcuguguugcccaggcuggagugcaguggcaugaucucugcuugcugcaaccucagccucccagguucaagcgauucuccugccucagccucccgaguagcugggacuacaggugcgcaucagcacgccuggcuaauuuuuguauuauuguauuuguuuuuuuaguagagaugggguuuuggcauguuggccaggauggucuugaacuccuaacuucaggugaucugccuuccucggccucccaaagugcugggauuaucaguaugagccacugcguccagcccaaagacuuuuaauaauagaaaagguacuuucucuuguuucaucauuuaguaugcuagguuuucuuugaguuucuguaacuaaacaguggguaccuaugauagguugggauggauuuagggcagagucugguacguuuuuucuguaaagggcuggguauuaauaguaaauauuuacuuuguagcuuugggggccauaaggucucuguuacaauuaguuggcucugccuuucuagcccagaauagggugauuagcccucacggcuugucugagacugaggaguuuugcuugggaggugggaccuuucaugugaaaacugagaugacccaggaugaaacaggacugucacugauuuuagugcaaaagcugcuguagacagugcguaaaugaauggauauggcuguguuccaguaagacuuuauuuucaagacagcuggggugggaguagguuuggccugaaggccaugccugcuaacuccuaccugaggauacagggcuagccauuuaauuuugguuuaaaaaauccaugcagaggcugggcauaguggcucacgcccguaauccccgcacuuugggaggcugaggugguaggcagauugcuugaccucaggaguucaggaccagccugggcaacauagugagaccucaucucugcaaaagaauacacacacacacaaaaaaauuagccaggcaugguggcacgcacccauggucccaacaacucgagaggccaagucaggaggaucaccugagcccaggaggccgaggcugcagugagccgagaucaugccacugcacuccagccuaggugauagagcaagaacccgacucaaaaaaaaaaaaaaaaaaaaaaaaauccaugcagagccuugcugccuuuucccugcagcuuuucuuucccaugcagagccuuuugcugcccacacagcaucauggugguuucuuccuuuccagauuugggacaguugggcgacgguguggccuugccugagggugguuguggaagagagccuagggugagacuggcgucucccggaucgcggcucagcaccugcucuggcuggagccuuggcagugcacagugagguuuuccggaggaaucuggaguuacccgcggccguguuaccccuugguaauaauuuugaagggauaaaacccuuauaaauuugcucccaggguugagaagugcucauuucugucucgccuuuuuuucugguagccgaggguucccaggagcacauauugugaucacgucuguuccauucaacaaauauuuguugagggcuuaugacguaccgugguguauacuggcugggagaugcagcagagagcaggacgcacggucccugugcugaaacucagcacagcaauguggugcugggugcggaggcggggaagggcuuugaggaccaagaguuggagggccuugcuguucuaggacaaggaccguccucugggcggggacgcuuucucuccaggacgugguggcugucggagcuggguggcccuugucucaccccgguugcuugggcaagugaguaugcuggggcguggcuugggccgaugguuugugagccugcaccugucagccucaguuugggcucccuguggggcgugugagucccuguucugacugaggguuggguuaggguuuccagccucccugccccugggaagaggcuccacccuccuccacgagugcugagcuccgggucuauuuguacugugaggaguugcuuuugucuccaucaaaaacaugaaccacuguuuggagcacuuccauuuacugacaacccuugccaaauuaauuuuauuuaauuaucucccagggcuaagcuugaauacauuuuguguuaaguucacaguuuuuuccuuuucuaaacgaaauggacuuaauauccuuguuaaaaucugauuaaaacuaaaauugaguuuuuugaagucugauuaucccaugaaauggaauuuuaaaccuaauuacagauggauuugcauauacuuuucagcaccauugaaaagaaacuugguauaaauuuauuaaugacauccuuuucucucguuuccuuggggcaugacguuaguuuaggagcaugagggagguggggagaaacaccacccuucuccccgcccuuccuuagaauuuuuuaaaaaacuuuacucuguggagaaucaguucccuaggagccuggggcauagucacacuuucauucucaucuuugcugcuuuaccggcuuagguggcugauaguuuuccugaauuguuuuucaauacucagagcucuugucuuucggaagauggaagaggagcaugcacgaucauagcugcuggugugucuucccugucagcuuaaaacgcagauuuggccgggugugguggcucacgccuguuaucccagcaguuugggaggccgagguggguggaucaccugaggucagaaguucgagaccagccuggcaaacauggugaaacccugucucuacuaaaaauaacaaaaauuagcugggcgugguggcaugugccuguaaucccaaugacuugggaggcugaggcaggagaaucgcuugaacccaggagguagagauugcagugagccgagaucaugccauuacacuccagccugggcaaucaggacaaaacuccaucucaaaaaaaaacaaaaaaaacaaaaaaccccauggauuuauauuuaacgugcuaccuccacccugauuuaauuuuaguuuuuaauuuuaaguuuuauuuuauguauuuuuuuuuuuaucgagacagaggcucgcucugucacccaggcuggagugcagugacgcgaucucagcucacugcaaccucugccagccggguucaagcaauucuuccgccucagccucccgaguagcugagauuacaggugccugccacugcgcccggcuaguuuuuguauuuuuaguagagacgaaguuucaccauguuggccaggcugaucucgaacuccugaccucaugauccgccugucuuggucucccaaagugcugggauuacaggcgugagacaccgcacccggcuuaauuuuuuuuaauuuuuuugagacagagucuugcuuuguggcccaggcuggaguguaguggcacaaucauggcuuacugcagucucugccuccugggcucaagccauucucccaccugagccucuggagcaggugggacuacagacacuugccaccacgcccagcuaauuuuuguauuuuuaguagagacgggguuucaccauguuggccagacuggucucgaacuccugagcucaagugauccgccugccucagccucccaaaauggugggauuacagguguuagccuccacccuaguuuuagauacauuuguauuauuaaaaaaguaaaaacaaacucuaaaugaccauuaggugaaauaaacaagaaauuuccaaagggccauguuccuguucuuugagaaaucccacuuuuccaggagggcuguuugcuauugugucuggacucaugcugccuguugcgacuuccuaguggcagguggagguaacaggcucccagcguacuugcccucagucuggcugucaccgugguuuuguuucgucuggaauuaugugggaauggaaucauacgucaugcagucauuugugucuggugauuucacuggcagaauguuuucugaaaagcauucauucacauuuguugcuuguaucgguuguccuuguuauaucgaacggauauaccauaauuuuuaauccgguuuuuugcucuugcagauaaagauucugugaacauuuguauugaagucucuuuauguauguuuuccugucucuugggauaauaccuaggaguggggccucugggugauaugguauguuuuaauuuuagaaaaagcugaugagccaaaguggcugccuaauucuguccccuggccacccgugugugagaauuccgcuggccccacaucccgagcucuuucauugaauuccgcuggccccgcaucccgaaugcauucauuggccaccuucacuuuagccauccuggugggugugugcgguauuuccuuguggccuucauuccuguugcccuggugacuaaugauguugaacaucuacucauguacuuaacuugacggccauauaucuucuuuugugaagugucuuuucaaagucuuuuccccauuuuuuaauuggacugucaucuucugaguuggcagaguacuauauauauucaugacagagucuuuugucagauguauggugaauauuuucucccgguacguggcuuccuuuucauuuucuuagugucuuuugaaggguaaaaacuuuuaauuuugcuaagucugauuuaucaauucauuuucuuuaugguuuguguuuuuuguaucugccuaacccaagcuuuuagaaacuuucuagcuuuaacuuuacuguuaauuuugaguuaauuuuuguguguaguguggucacaguugagggucgcuuuccugccccacaauacguaugucuguuucccauuugaauuuccuuggcaccucugaugaaagccugucagccauacauucaugggccuuugcucgaggucuucuuucauugaaucaugugucuguccuuucuccaguaugguaaggucguaauuacugucacuuccuaauacucuuugaaagaacauaguaagcccuccagcuuuuucuuuguaagaauugucuuggcuauuuuaguuuuuuuauuuucagauaaauuuuagauuuagcuuucaguuuguuuucuuuccccccauuuacuuuuuauuucguuuauuuuuucuugccuuagugcacucacugggaccuccagugcaguuuuaccugggcauggugagaauggcuguccuggccuugucagccuuagagggaaagcguuuagauuuuccugaagcaugagguuaguuuuagggucuugcgagauacuguucaucagguugaggaggaugcuuuucuuuuccccgauuuguuguauugggucaaauacauauacaauaaaauugacuguuaacuguuuuuaaguguacaguucaguagcuuuaagaacauucauauugcugugcaaccaucaccaccauccaccuccaaaacuuuaucuucccaaagccaaacucuguacccauuaaacgcucgcucccugugcucccccguuggcucuaggacccaccauucugcuuccugccucugugauuuuuuacuacaguagggaccucauagaaggagaaucaugaaauauuuguccuuaugugacuggcuuauuucacuuaacauaauguccucagggaucauccauguuguggcaugugccaaaauguccuuucuuucuaaggcugaguaauauucuguuguauggauagacgauccguucuucuuauccagucaccuguugauggacacuuagguugcuuccacauuguagcuacugugaauaaugcugcucugaacacgagcgggcagauaucucuuagagccccugcuuucaaccugcuggauccugugguucaacuuuuaacuauuuuaggagccacuacauugcuuuccacaguggcuguaccauuuuacguucucaucagcagugcacaggaguuccaguuucuccacaucaucaccaugugaugugauuuuuuuuuuggugguagccauccuaaugagugugagguggugucuuguucuggcuuugauaugcauuucccuaaugauuagugguguggagcaccguuccaugugcuccuuggccaguugugugucuucuuuggaaaaaugucuaugcagguucuucgccuguucuugaaucgcguuauuuucauuguuguuuuaggaguucccuuguauguuuugaauauuuuucucuuacagauacgguuuccaaacauuuucucccauucuauagguuguguuuucagucuguugauaguguccuuugacaaauuuaaaauuuaaaaauuuaccaagauuucauuugucuauuuuuuuuuugcuguuaucugugccuuugaugucauauccaagaaaucugugccaaaucccaugucauaaaccuucuccccuguuuuuuucuaagaguuuuauaguuuuaggucuuacauuuaggucuuugauuuguuuuggguuaauuuuuuguguaugguuuaagggcccaacuucauucuuuugcauguggagaccaguuuuccagcaccauguguugaaaagcuuguccauuccucauugaaugguuuuggcaccuuugucaaaaauuauuugagcauacgaaaguguuuauuucugggaucucuacuguauuucauggguccauaugccugucauucugucagcaccacacuguuuugauuacuguggcuuuguaguaaguuuugacuuaaagugugacucuuucaacuuuguucuaacuuuucaagauugcuuuggcgagggaccuuugggucccuugagauuccauaugaauuuuaggauagauuuuccuaugucugcaaaauauuuaguuaggucuugauagggauugcauugaacgucuagauggcuuugggcgguguugacaucuuaacagcaaguguuccacacguagugguuucuggaagguuaguugugguacggaauaaucuuuucaaacugucguacuaaaauucauuggucucuugcacuuugaauggaccuuuauccaugcaugguuauguaacaucauacauugcucauuugaaaauaucgacgcacugaauuauguaggucuuuuauuaugccuuauuaaagaaauuacaagcuaaucaccacaaguuauugaaaagucuuuaaacguuaggaauccaucaagcuuguggugguagauacaaauuuuuaagaauuuagauauguguuuggcagcuugaguuuuauuauugucaacaaauacucgugguuguauucuuucaaaugauaacguuuauuuaauucguuuuugagaaaaugucuaccagaugcucaagccugaguaacuauuguuggucaguuaguuuuuaaguaaaauauuuuacauaaaaagggcuaguucaguucacaacucaaacauggaagaccaaccaucgcacuuuaguaugcaccagaaaugucuuacaugugcuuucuauuucuucacacagaauguugagaucuuaucaagggguuaagauuuaaugaagugaauauuuuaacugggcccaguacuccuguaguuccagcugcucggaaaguugaggugggaggauggcuugggcccaggaguuuguggcuguugggagcugugauugugccugucaguagccauugcaguccagccugggcagcauagcgagaccccacguggugccccugguuuguuuugcuaacguguuauacccaucagugcuuuuguaucuucaguucaaaugucagcacaguuagaagaaaaaaggcaaauaauagcuuauuauuauuauuccuuguuuuuuuggagacagagucuugcugugucacccaggcuugaguacaguggcaugaucuugguucacugcaaccucaaccuucuggauucaagugauucucccaccucagccuccccaguagcugggaccacagguguacgccaccaugccuggcuaauuuuuguauuuuuugguagagaugagguuuugucauguuggccaggcuggucucgaacuccugaccucaagugauccacuuaguauuauuaugaaaauaguuuugauggccaggcacagugacucacgccuguagucccagcacuuugggaggccaaggugggcagaucaccugagguugggaguucaagaucagccuggccaacauggcgaaaccucgucucuacuaaaaauaaaaaauucgccgggcgugguggcgcaugccuguaaucccagcuacuggggaggcugaggcaggagaaucacuugaaccugguagguggagcuugcagugagcugagauugugccacugcacuccagcgugggggacagagcgagaguccgucucagagaaaaaaaaaaaaaaagaaaaagaaaauaguuuugauguuacaagacugccuagaauggugucugcagaccacacuuagugaacuguuguccuagcgcuuagucccucaaggcgagaagaggcucacaaguuggacucacaugugauccuacagcucugugacaugcuuuucaaaaauauuguacaggauaauguaaauccauccucacuacaaagaaagcucaaacaguacagaauuaaagugaaacuuucuuggauuucucugcuuuuucaaauucugcuguaucccagguuaacauuagcaguuugcuauaaguccuuacauaauuuuuaugugcauggacgucuuacguacauaacaaauggcaucauacggccuguauuguuauauuauuuucccuuggauugaguuacuugaaaugucugguguuuacucuuuaguagccauuauuccaucguagaaugcacauauuuuaacuauuuccuuauuagcauacacuacaguuguugccaauuuuuucuuuuugcuauuaacacacagauuuagugaauaccauuucauuaaacauauuuuuuaaguguaucugaaacauucuuuuuauugaugggaaugcuaagacauagaguaugaauauuuaacacuuuaauaauuuuugccaaauuacguuccaaaauuauacuucuguuaacaguacuuaagauugcccauuuuucugauaacauucauugauguuguuaguguuuccgauuuuugcccuuuacuuaaagucagcugcuguauucuuagcacagugcuuucugugacagauguuucagaugacagugcuuccugccugcaggcucaucugucugcccugguagcuuucaggcucucaggcacccucccuaauggaccgacuggggucaagggcucugaaaaugcugcccacccuggcccaagggccuccugaacagguaggcugggggugggggugaguccgguggcuuagaugacaaauggagguagaggacgcauucucgccuguuauuucgauuuuuuucucuccucacccugaccgucacguucucaccuuuuccaccucaauccccagucacacuagcuucccaggauuaaaauggucucucucucaugaaacuuguuuagaaaucuagaagcauuaaaaaaaggaaaaaaaaaaucuagaagcaugcacguggcuuagaaaaugccuuuguguugccagaugcaguucccuugcuuugacaguggcauucaauguggucuuuuaaaaaaagaaacuaucuauuccuuuaacauuuuuuugagauaauaauuacauacagugaaauggacagaucuuauguauauaauugagugaguauugaaaauguaccaccugugucaucacugccuccgucaggcugcagaaaguuuccauuaccucuggaaguuccuucucgucccuucaaucaauuccuacccccgggagacaagcacuguucugauuucuauuaccauaaauuaguuuuguguguucuugaauuguaaauaaauggaauuguacuguguuuauucuuaaauugcugucaucuuuugcccagggcugggacuaggggggaggcaagagagugugggaucuacacugcacaccccaagagugagauucuccgagcaaucaccuccugaaaguuuguacgccggcaucucucuugcuucacccuuguccuggcccugcuuuuggacaacagagugcuuuugagguucagcccuguuuuggggagaugagugguacauuacauuuuauuuuuauuauuuauuuauuuuuugagauggaguuucacucuuguuucccaggcuggaguggcauggugugaucuuggcucacugaaaccuccgccuccuggguucgagugagucuccugccucagccucccgacuagcugggauuacaggcgugcgcuaucacgccuggcuaauuuuuguauuuuuaguagagacaggguuucaccauguuggccaggcuggucucgaacuucugacuucaggugauccgccugccucagccucccaaagugcugggauuacaggugugaaccaccgcacccggcccagugguucauuuuuaacuuguacgaaucugcuuguuuguuuccccguuugcuguccgaggacaucuggguuguuucccaguagcugccucuugugaguauagcugugguuaauucacauccacaucucaugugcuccuauguuuccauucucucgagugagcacccagaagucaaauugcugggccuuuuaaugaguacguguauaacuucauaagaaauugccaaacugucuuccaagguggugguaugauuuuaugcuccuaccuggaauguaugagauuccauuugcauuauauuuucaccaguauuugguguggcuguuuauuuuuaaaacauccuuuauuuauuccagcgguuguguggcguuaccgacuuuuggcuuuaacucacguucccuaaugaccaguucccuagucagugaauauguugagcccuuucuuuuuuuuuuauuuuaaaauuuuuauuugagacagagucucgcucuguugcccaggcuggagugcaguggcgcgaucuccacucacugcaagcuccgccucccggauucaugccauucuccugccucagccucccgaguagcugggacuacaggcgcccgccaccacgccuggcuaauuuuuuguauuuuuuuaguagagaugggguuucacuguguuggccaggauggucucgauuuccugaccucgugauccacccgccucggccucccaaagugccaggauuacaggcgugagccacugcgcccggcugaguucuuucuuuugcuuaauagcuuuguuuuuuauuuuuauuuuuauuuuuauuuuuuuauuauuauuauacuuuaaguuuuaggguacaugugcacaacgugcagguuuguuacauauguauacaugugccauguuggugugcugcaccgauuaacucgucauuuagcauuagguauaucuccuaaugcugucccuccccgcuccccccaccccacgacaguccccggugugugauguuccccuuccuguguccauguguucucauuguucaauucccaccuaugagugagaacaugcgguguuugguuuuuuguccuugugauaguuugcugagaaugauagucuccagcuucauccaugucccuacaaaggacaugaacucaucauuuuuuauggcugcauaguauuccaugguguauaugugccacauuuucuuaauccagucuaucauuguuggacauuuggguugguuccaagucuuugcuauugugaauagugccgcaauaaacauagcuuuguaucuguuccuugggaagugucuguucuuagucuuuugggaaauuguauugguuugcuuucuuucuauuauugauuuuuccaaguucuuuauucuggauacaaguuuuucauccaguguaugucuugucaacauuuuugcccugucuguggcuugucauuuucuuuaguuuuuaaauuauuaaaauauacaugacuacuacuguaagacugacuguuguucuuuuuuuuuuuuuugaggcagagucuugcucugucacccaggccaggaugcaguggcgcgaucauaguucacagcagccucuaacuccugggcucaagugauccagcuuccugaguagcuuggaauacaggugugagccaccacaccuggcuaauuuuuucucuuuuguagagauagggucucacuauguuguccagacuggacuugaacuugugaccucaagugguucucccacacuggccucucagagggcugggauuauaagcgugagccaccaugcccugccgcuugucuguuuuaaaguguuuaauuuggugguuuuuaguauauuuguaagguuguacacucauaccuacugucuaauuccagaagauugucaugguccccaaaggaagcccaguuggccgaaguucccuguucuccuuuccccagccccuggcagucacuccucugcucuuugucucuggguuuaccuguucuggacguuguguaucaguggaaucgcaccauagguggccucugugcuggcgcuuuccucucagcacguucucaaggggcgucuacccuguggcacggaucagcgcucccuuccaccacauggcacguggucauaccccauugugucaucagagcucauuucagugacccauucaucagcuguagacauuuggguuguuucacuuucuggcuauuacgaacauucaaguacagauauuuguaugagaccuuuuuuuuucacuucucuugaguggaaacacuggguuacaugguagcucuuucuuuuuuaggaauugccaaacuauuuuccauaguaacuacaccauuuuacauucccaccagcaguauaugaagauuccgguuucucugaauuuuuaacccuuauuaugaugucuuuuuucuuaugguuagccucguggguguggagugguaucuuaaaguggauuuuuuuuuuuaaugacugcaugauuuuucauuggauggauauaccauaauuuaaacaaugacuuauugugggacaaaaaauuauuuccaguuacauuuuaugaucuucauuguuuauaucaguaguaguuuauuuuuuuaaugggauuuuauuuuuuauuucaauaguuuuuggggaacgugguguuugauugcauggaaaagcucuuuaguugugguuucugagauuuuggugcaccugucaccugagcaguguacacuguccccagaguccauuauaucccucuuacaccuuuguguccuuauagcuuagcuuccacuuauaagugaggaugugagaugucugguuuuuccauuccugaguuucuucgcuuagaagaauggucuccaacuccauccacguugcugcaaaugccauuauuucauuccuuuuuauggcugaguaguauucuaugauauauauauauauauagagaccacauuuucuuuauccacucgguugaugggcauuuaggcugguuccguaucuuugcaguugcaaauugugcugcugugaacaugcgugugcacgugucuuuuucguagaaugacuucuuuuccucuguaggauugcugucucaaacgguagcucuacuuucaguucucgaaggaaucuuuguacuguuuucuguagugauuguacuaguuuccauucccacgagcaauguaaaaguguuccuuuuuccaccacauccacgccaacaucuguuauuuuuugacuuuuaaauuauggccauucuggcaggauuaaggugguaucucacugugguuuugauuugcauuucccugauaauuaaugauauuuagcauuuuuuaaaucuuaugugcuuuuuaauuuguauuucucauggcuaacguguggaaacgucaguggcugcauagaacagagacacaaacauuacagaauuaguucagaaaagucaugaaacaaguaaaaaacaacuacagcuggcagcaccagcagccagcccuggcaagggcagagaaucugauuccagaguugccgcaaaauucggaagacaugcaagaagcaagaaaguauaauucauacaugguggagaaagcaaucaaucaguagaagcagaauaucaauaaaaagaaacuauaaggagaaaccacauagaaauucuacagaugaaaaguacagcaacugaaaugaaaauuugguagauaagcucaccggcauauuugagcagcagaagaaagaaucagcaaaccugaagauagguccgucaggauucuccgguaaggggaauaaagcagagagagaagaaaaaugaagacaggauacgugcuuucuccacuucuguucagcauugugcuggaggcucuacccaggacguuuaugcaaggagaggaaauagaagacauccagauuggaaaggaagaagaaaacugucucuauuugcagaagacaugauuuuauacauuaaaaaacugaaagaauacacauuuacaaaauuauuagagcuaauaaacaaguucaacagaguugcaggauacaagaucaauauuuaauauuauauuuaauauaagauaauguuuaauauuauacguuagcagugaacaaucugacaacaauuauuauccccagagauauuuugucuaauuuucucauuggcauuuugcuuuguuucagaugcuacagaaacaagcccaguuuccuugacaguugcacuauuuuuauuacaaaaccucacuagacauuucacauuugaaaacucucagucguaaauuaaccauggccaucaagucucugugaucuguggacaguuuuuuguuugccucuaaugcuugucuggaaguucggcaugcuuuaggcuagaugcucggucuuaagcaaaggccagucucagaaugaauauuagccagagauuuccugagauaccuagaacuggugaguccuugaugaggagcuccggugcacgcugggccaggugguggccacucugccuuugcccucauuuccugcuugcucagagcuucaaggugagcaggagggagaacccagggccuucacaggccuuuccgagccugugcgcaacaugcacggacauggccccuuagaaucucaguccccauggacagcucauuucuuagcuuuucugugucagcguucuggugagucuuuuguuugccacugcugucacucaggcauuugugauguugaagugguugacagacucauuccccaaccaaguuuuugcccugggagagauuaggggaggugaaaucaagacaggacuuucuuucuuuucuuuucuuuuuuuuuuugagacggaguuuugcucuuguugcccagucuggagugcaguggcacgaucuuggcucacugugaccuccgccucccagguucaagcgauucucuugccucagccucccgaguagcuggaauuacaggugccugccaccacgcccagcuaauuuuuuguauuuuuaguagggaugagguuucaccauguuggccaggcuggucucaaacuccugaccucaggugauccacccaccuuggccucccaaagugcugggauuacaggcgugagccaccaugcucggccuaagacaggacuuuuaauugggaucuuaagguaguaagugacccagaugggucaaguaauaacucuucuuugggaaugguauuuugagagaugccagccccauucuguucccucuguccugggaauguagagugcgauuuuucuuuuuuuuuuuuuuuugagacagagucucgcuguugucgcccaggcuggagugcaauggcgcgaucuuggcucacugcaaccucuaccucccggguucaagugauucuccugccucagccuccugaguggcugggauuacaggcaugcgccaccaugcccggcuaauuuuuauauuuuuaguagagacgggguuuuaccauguuggucaggcuggucucaaauuccugaccuugugguccaugugccucggccucccaaagugcugggauuacaggcaugagccaccgugcccggucuagacugauuuuucaaggccaccauggaguuguggugugggggcugggaccagggugaguuaaaaugccccaggcgcacucuucuugagagccaccugauuuucuugaccaaacguucccggauugcuguaagccuuugguuaguuuucagaguucaaaaaucugauucugaccguuuuagucacucuucuguugcuuuuaugguggagugaacuuccauaggcucuuacucugacauuuuuacugagaucuuaaugguguuuuggaugaguaaaaauuuuugauuuugaugaaauccaauucaucaauuuuuucuuuugugauaguaguuuuucuuuucuuuucuuuuuuuuuuuuuugagacucugugucgccuaggcugaagugcagugaugugaucucagcucacugcaaccuccgucuccuggguucaggugauucuccugccucagccucccagguagcugggauuacaggcgcccgccaccacacccggcuaauuuuuguauuuuuaguagagacaggguuucgccauguuggccaggcuugucucgaacuucugaccucaggugaucugcccgccuuggccucccagaguccuaggauuacaggcgugagccaucgugcccagccuaauuucuguguuuuaagaacuguuccauuucaugguugcaaauuuauuuuauguuuucuaccuguacauuugggugaauuccccucuucuugagguccucccaguauccugagguuccugucuuuccagcaaguggucuuaaccaucuggaagaugggagaguuuuguugcuguuggcugcaugugcaccgccaucuuugacccuucagaguaguuugucaugcuuuauugaaugagcauuguucucagaugacacgcagguaaggcacugguuguacgguuuguccaauucuaucacguuaaaaaggaggaaagguucuuauugaaccuacugcugugaaaauuaaggagacucaguaagaguuucugaauucugggauaccagugaaggucaaagaucauuugaaaauauuucguuuuuaucaaagcugaguucaacaaauuguuguagguuaaauagcuuaagaagaaaaggcaaugacuuccccuuguauccagaaaauagaacauaaaaccagcauccacaaauaaccucaguaaaacuucccucuucaguucauuuaguucuguguaauuaauucuuauccuguuagaucuaggguuuauaaacucaugaaaccauugcuucuugccuaaagugaauuuggaaauguggacuuaaccuccugguguguuugaaagugguguaaggguugcucuugccuccagagccuguccccacaggugucagucauggcgaugucggcugcaguccuucuccagagccacugagacugcccuucuuguugaagaugcaaacucuggccugugaguuuaucccgagcuuucaggcaggcguuuacagagucgagcagaaacuuuucacagaugacaaagacuugauggcaaugguuaauuucuuacugauaauuuuuaagugugaaaugccugaugagguuuuauauaauuuucaaacaugaaaugucugaugugguuuuaauaguaaugcaacuaaugaggaaauuggguuguuucuguggcauccaaaacaaagauaaaaaggcgauuaaaaaauuagacaaaauauuacuaaggauaauaauucagccuguuucaaagaagucaguggauguuaacaucugauucauugaaaugggugaacauaauuuuuaugaagaaaacagucuugagauguacaauguugagacaaaauauucccggaauauaccaaagcauaucaaaugaagagacuggguaagucugagauagagugaaccauuuuuaauuucauaaaaccucaugaauacaucugcuguacaugaaugcauagcacuaggccacuugagaaccaguggccuagaaagugccagauucaaauuaaagaaguaauguggcuaaucauuuuaggucauugaaauuguggcuguaacacuauguuguuacugccugauaucagggagagcacuugaaggacucggauacagaaaaacuugaccagacuauuucauaagcauuuuggucuguguuucuccugacauuaaaacauauuauggaaugugaaggcauugacagaucuccagggauuuccacugaagcgcaccauuucugaaauacgucuuuuaauaacauauuagcgauucacaguucaccuggagaaggcugggugucucuucugauuucacaacccuggccacacagcucaccaagcaaacaguuauuacuagcguauguuuuuuagaggagcucuugccuaucuuuugauaaauuuaauccuaagaauuuuguauuauugaugauaauuugaguagaauuuugaagacugucaccuuuccaauauuugcuguuauuguauagacacaguauaguuuacuauguugacaguguccugugacuuugcuggauucucguguauagagacaguauaguuuacuauguugacaguguccugugacuuugcuggauucucguguauagagacaguauaguuuuaguguuuugacaguguccugugacuuugcugaauucagucuuagugccaguaaauuuuuuuuuuuaagauuccuuaggcuuuuuuuguauaaaaauagugcuauuugcaaauaaagacaauguuacuccuuccucuugagcuuuauaccuuuuguuucuuuuuuaucacauuauuacauuggccgggaccucugguacgacgugaaauagcaguggugguagcagauagcuuguucuuauuuuugaucugggggaaaauguucaauauuucacucuuuuauuuauuuauuuuuuuccuggagacggagucucacucuucacccagucuggagugcagugguggaaucucgguucacugaaaccucugccucccagguuccagugauuuuccugccucggcuuccguaguagcugggauuacaggcaugugccaccaugcccagcuaauuuuuguauuuucaguagugacgagguuuuggcauguuggccaggcuggucuugaacucccaaucucaagugauccacucaccuuggccucccaaagugcugagauuacaggugugagccaccgcacccagacucauccuuagacucguauuuaauuaaagaaaauguacaaugcagacaggauggcugaugauaguccuuuuuuccugccugauuuugguuauuugugcuuuuucucuucucucuuaauaucuucagaugucugcaacuuuauuagccuuuuaaaguaacugauuuuugacuugguugauuucucaccguuguaguuuuuccaucuguuuuuaaucuuuauuuccugucuuuggguuuauuuugcaugcuuacaaaacuuccugggugauugugugggauggccuggacggaagggaccagggcuucaggaggaggaugagccccacccuuucuguggugggaaugccugagcucuguugggcugcacauggcuccuacuuuggcagucauucaacaagccugaggaauguggcuuacugguaaaauagaaaaguauguugccagaguuuuucuaggaccaguuugggggauggagaggaugguagauugaauacauacaccuaccuuuuucuuucugaaaccucauacugcagugagaagugugguggguuuuuuuuuuuuuuuuuuuuuuuuggcaaagguucaugugaauaaggagaaaguaaagucauagcauuccuauuucagaagcuggaauguaauuggagaguuggugauggacuuagcugacuugagaaaaccaaaugcuaauuugggaguggggaaagcugagagcuagcuugaucugugcugcagaguuuugaccacgcuugggagcugugacugcuuacuuccagaguggccacacgaggacauaagaguguguugugagccggcugcucagaggcccugguccuugcucagcccagugcagccggggcgggcauuaggcgugcugagcaggcgguaaagccgauggucgugcacuuggcgcuuuucgggacggggugccuuauggacuacgguaagugaacucugugugaccgccgagaugaccagcuuuguccccacucagcauugagucugggcugguggagcguuguccacuaagcaagaguagaagggccuccuguggggacugagacuauccagagggaggacagaaagguacugaagucgccaccucacaacucuguugccgugaaacuuacagguggccgucacagucgcucauucagagccuccuagacaucugaaggagucucugauguaaaagguauagaccaagcaaacagaaaaacaguguagaggaaauggaaauuaugcaaggauaaaacuuccaggaagaaaccucucauaagcauccucagugagauaaaagugguuauuuuaacaagagaagauaaugaaacaagaaaaauguccucuggaagaagcacauucagugaacaagaagaguucugggaaguuaaaacuacaugaacagauauggggaaaaaaucaguguaaguguuggaaaaguuaaggagauccggaaagaaaaaaaagaucaaacaggagaaacggaauacacucugaggaucggguucuguggaccacauucaacaaguaccgcaaagaaacggcggggaggacagcauaaugaaacaauugaaaaacccucucuugagcgucauccucuucuagacugaaggagccaccaaguacccaguccaguggaugaacgucugugaucaaagaccauugccauggcauguugcuggaccccaaauaucaggguaaagacagcauccuacacaccuucagaaggaugagaauagguuacauacgaagcgggaaucaggauggcuuugugcuucuagacagcagcauuggaauuuagugcacaguaaagcaauguggucuagaguugcaggaaaauaauuuucagccuuugauucuauacccagugaaacuaacagucgcaugagagagcagacuaaaggcacaauggagauuugcaaagucuuuaaaaaagucagucauccuggccaggcauggugcuucauaccuguaaucccagcacuuucaguggcugaggugggaggaucacuugagcgcaggaguuggagaccauuauggguaaugguauaggagagugagaccccaucuguccaacaacagcaacaauagcagcagcagcugggugugcuggccugcuuguaguccuagguacucaggguacggagggcugaggcaggaggaucgcuugagcccacgagguggaggccacagugagcuaugaccauaccacugcaccccagccuggguggcagagugagacccuaucuuaaaaacaaauuaucucccucaaaucuuuuuucagaaagcuacuggagggugcauuguacuaaggaagagagagacugaugacugaggaaggauuggaacgcagggagcaggauauccgucacugggggagaagcagcugaagaugaugccugugcccgggcagauggugcucaguccucagagcaggaaguggugccgagaaagucuccccaaagacgagauugccaggcagcccgaugccgggugagcauggacaucuccagaggagauuugaacaguuuaaagagccaggguggaaugagcgauaaacagacagcuaagcaagugaaaaaccccuucuccuguuagcuugaggggaagcacaaaguaggaaggaguuggaagucaccaugguuuccuuuguggccucagugugagugguugagcacccagcugugcucagcuagacgcggggcucagccagacgcggggcagcuagagcuguggugauggugguaccugcggggcggcagagggguggugggagcacagagccauggccuccucuuccauccugagaagucacagguaaugccccaaacugaagaauuaggaaaguggcaaugaaagccuaucgucuagaggaagggagguccguuucaacauaauugacucaaauaacuuagaguguuugcuucugaggcugggaacugggccaggagaugcagaguggaguuggggauggcugcuugccauaacaagccuuguaguuugacuauguacacuuuguuuauguaacuucacgaggaauacguauacauggaagaaaaggagauucgacugggaaugccaggggcaugcuagcaggugcuguagucucagccagaggcaugugugcagggugccuggcaccgucuggggucuucugugcgcacagaccgcggugugcacgcucccaggagccaucugauggggcagccucgagcaccucugacuucugacuucgccccacgggagcccaucuggggcuccagccuugaccuggcagccagcagggcugggaugggacugcggccagccacguggguucucagcugguuagggccucgguccucuaucccuuaccucugucccacggagacccgugcgagggcccaucaggcacucgagcuggcaccacgaggacuacugacggcuuugcuggaugcugcugggaaguugagccggccaagguggcgaguggcugcgccugggcugccccguccuggcggcggcgcccucccguuuucuguucugggaagcacacggugcaggcaguguuugugccuuuucccagaggagcccuuuguccugaggaggcguggauguucucuggagacccggggccuuucgcagcggcaccgugacuuccugcugcugggcccugggcccuguguggagucgaggccugcaggggcgagagucagacgagaguuggagucugggguucacaugggauucugcagcuucccagcgguguaaucuugggccagacacgucccacccgagccucgugugcuugucuguugaaugggaagggucguggugucucgcaaggcugugaagaaugaaagcuguguggugaggaauaauggcagagaacacucaccaggcccuuuccaggugcugcuccaagcacuuccugggccuucacuccagcaguccucccugccacccuuugaggugggggcacuguugucauacucauuuuaugagugaggaaguacaggcaggagagguuagcagcuguccugaggacucacagccgaugaguggcugggaucugaacccacacagcaguguugcauugccgugugcucuucccaucagacuuaggccucguggugaugagcuugugugucuaucccagggacccuccagauguggcugauuucuggcaucucuuacgggucuggucuugggcugcguggucucauggccccuuuggcagccugcauggugcccucuuacugggcacggugaggccucaggaacacagcagcuccacccuccaacugcugggcuucucugcugcccuuugcauggcggaggugacccauaugugucccaucuccacccuccagcugcuggacuuuucugcuguacuuugcauggcggaggugacuauacgugucccaucuccacccuccagcugcugggcuucucugcuguccuuugccugguggaggugacccauacguggcccaucuccacccuccagcugcugggcuucucugcuguccuucucugcuguccuuugcacgguggaggugacccauacgugucccaucuccacccuccggcugcuguccuucucugcuguccuuugcaggguggaggugacccauacguggcccugcuguaauccgccaagcacuuccgggggugagguugaggaaucuuuguggggcaugugugcacgugugugcaugcuguggcuccagcaccacaguguugacaguccugugagccuacuggguaagagccuagguugaggccugcugccuccuuugguuguguggccucaggcagguuauggaacugcacccauguuuucaucuuuaaauuggggagaaugagagugcccuucgcucugcuggcacgauacgcaggaaacguugcuucucuucagcagauuauuaggauucucugaaaguucuccccaguucucuuuucuaccccauucauuaauggcagccaccaguggcguagcagcaaggaaaauugggccguuuugaagcacuaucgaguucugccugucuugcuaaaucaucuguguuccaacugugcucuuugaacuguugaaggccagaaguuguuuugcguuugaucaccuauaaccgccaaccccccauguguuucugccuguguuuaacuggucacagggagcuuggggcuccuccgguucccauccuugggagaggcaggcccauccacucaguacccacggcaggcaccugguucucaucucugacgccccgacuuucccuucucagccugugucgccuuuccugugauuuccucuccuugccuuccugggauccugcuaguuccagcccauccccacugccgcuacgccacuuggaaacccuuucucgugcaguggccaccuuaccgucccuggcuucacuuuugcgucuugcaacuauucuucacuccagcacuuggagggaucugccugagaugaagcaaugaccacgagacccugcucaaagcuguuugucugucccugccgaugucacgaugaaguccucaugucuccauguggcugaccagaagccuccugccauugccuggcucucccgcuucucugucacccucgccucagccucugcaccagccacaccgaacaugaguucugugcuuucucccacucccucugcccucccacuugcccuccccuuucccuguuacggcccacuccagccccgaacacuuaguggcuuugaacagugcuugguaauuuuucaggauucugcagguugccuggggccaaucugguggcaguuggggaugggacauccaggauggcuuuaugugcacgugugcugccuuguuaauggccaggaggcagggcugccuucuuuccucaggggcucucucuggcuaggacgagcugcuucacguggcugccaaagcccauagggacaagcccuggcaugcagguuccuuaagccuguugguugugguugcaguagcuguggccagagccuggcccggguguuuguggaagggacgaccugagggcacgaguccgggaggcagggccccuucggaugcauucaucauuuaggguuuaucugcauccugucucgucucaggaagccuuccgcaaccccuccacccagacugugguccagccccugcuccaagugcccccggugggccuuugugcucucaguccuggccgaccccuccacccagacugugguccagccccugcuccgagugcccccagugggccuuugugcucucaguccuggccgaccccuccacccagacugugguccagccccugcuccgagugcccccagugggccuuugugcucucaguccuggccgaccccuccacccagacugugguccagccucugcuccaugugcccccugugggucuuugugaucucaguccuggcaccuugacccgcugcuuguucugcucuccuuuaaacuccaugcaccugaccuguuaauugcacgcagcgcggagccuggcaccugcaguguagacacacuggccaccgcucagugcaagagggccccuuugcuaaugugcacagcucuuuaugccuuuuuuccuaugccuuuuuggauuggagcaagagauuuuuuuuuuccaaguaaagaacaauuuauguuccuaaauacuuuuuuuccuugacaugacgaaguugagcaagguggcuauagaacuuuuuuucuuaauuuuauugcacaaguaauguucuuuacaaaguagggaaauacagauacauaaaaagaagacugccaaucccccguaaucccaccagucgcaucccuacccgcucuuaggagauuccgguuuaccuuuguagauuuucacugucuacaugcggacuuuaaaaggugcaguccugcaggcgaauguguagccgccugcguuugcgucauaggucccgaauguccuuucugccacacaggaggccaucccacgcuuguccugucacggaucguuugccuccugugaauauucagguuguuuccgguucuuccuguucugaacagcgccaggacaagcaccggguacacauuuuugcauuuuaaaacacauuuaguaacucauucuucagcuggggaaaagcccacguaagagcccaucagcaaguccgagcgcguguuccucccgcuucagccgccaucccuggcuccuuagcguguuccucccgcuucagccacaaucccuggcuccuuagcacacucggaauaaaaccugaguccucccgguggccucugggccccacgccccgugugucugcccccugcuccaggcuuguguucuuccuccacccucccagagcuccuugguguuccggccucaggaccuugaccucguggcgcccuccacgcgggaguaucguccugugccuucucgcggcugguucacccacaccagccacaucaucagaaggaagagauucuuaggcgauuuuuguuugcugaaggagaaucacagaucaggaugaggucuccuggucccuuccucccuuuuaaggacagauaacugaaguucaggaaagcccaggccacacagcaggccagggaccagcuggggccacagcccaggccugcaggugcauggcuguugccuuucuagaguucugaggccuuuucucucccuuuauugcucagcaaguucaaagaacaucucgcuaaugaugcaccuuuuucugaguuucuguucguuaaaguccuuuguucccacauugccuuugauuguuucucuagaagccagauuuacuugauuuucaauucacuguucuuuuuuuuucuuuuuuuagacagucucgcucugucacccagguuggagugcaguggcacgaucucggcucacugcaaccucugccuccuggguucaagccauucuccugccucagccucccgaguagcugggacuacaggcacccaccaccacgccuggcuaauuuuuguauuuuuaguagagaugggguuucgccauguuggccaggcuguucuugaacuccugaccucaagugauccacccgccucggccucccaaagugcugggauuacaggcgugagccaccaugcccguccaauuuacuguucuuuacucugcaaucugcugccucuuugccaaaauaaaucuuugcagguaagauaggugcgguggggagugugaaauuuauuacagaaugguuauuuugcuucuuaaaaaauuuuuguuuuaagaggcagagucuugccauguugcccuggcugguaucaaacuccuggcuuacacgauccuccugccuuggccucccaaagugcugggauuacaggcauacaccaucaugccuggucuaaaauauuguguuuuuuuuuuuaauuuuuuuaagagaugagguugcccagguuggagugcagugaugugaucauagcucacuacugccucgaacucccgggcucaagugguccucccaccucagccuccugaguagcuggauuacaggugcccaccaccaugcacggcuaauuuuaauuauuauuauuauuauuauuauuuuuugagacggagucucgcucuguugcccaggcuggagugcaguggcgugaucucggcucacugcaagcuccgccucccggguucacgccauucuccugccucagccucccgaguagcugggacuacaggcgcccgccaccaugcccggcuaauuuuuuuuguauuuuuaguagagacgggguuucaccguguuagccaggauggucucuaucuccugagcucgugauccgcccgccucagccucccaaagugcugggauuacaggcaugagcugccgcgcccggccugcuaaucaugacuaaagguagaacagucaggaaugucaccuguuaucucugaagucauagucccuugguuuucccugaccugccugcuacugcgcccacuugcagcagcaccuccguugcccagugaagcaugcugcccuggucuuacuguuucaccggcacucuccuaucugcgaugccacuguccacagcgggguugcuuuaggguuucgagcucaccuggggccuuccuggguucuagccccgugagcuacaggcacuucuuuguaaaaggggauuccaccaguuaggcagauuccgguucagucuccagcagcccggggcccuuccuggaagagugcuuugugagcggagugcgccgcccagguguguaguggugcuucucaggcccaugggcugcccuucccugggccucuucuguuugaggcccuugucacuggguucgccuggcaugaugauggaggcccugcagcucccugccaggcgugguuccgcccaggucauucucccggcccagcugcuguggacaguggacacacgcugucacagccucaggccggccgggccacgccucccggaagcgggccugcuugugugugguugcaucccaagcucuccacuugcugccccuguucugagcuucuugccgaaguuguguuuggggccauuaucuagcuuucuuuuugaacguuuaaagcauucaaaagaucagcuuuuccaaagagugaggaaacagggagagaaaauuauggcauuuguuugaaagguucugagggcuuuuuuuuagcuugaacaguucaaacagcgccucuuguuaaucaggaauguucuggcaucccugggguggucacacgggcuuaauuggaacccaggcugcuuugaagcccuugagauccuuccugagcugggagaaagagugcgagggcagcaacuguaaagccggcauuucuucauuuuauuuacaugugucuggggacccuuguaacucaugucccugcagcaguugagccaaguugcugacuuguggacagcucagagagaugggggccaguuucuggcaaaagagcuguaaaacauggccuggguccagggcugcggcgggauccccuccugggaggcgaggucuggauggaccacgucacagucgugguggcguggacuuugcugcuggcggccuguucuugucagaaguuuccacaugggagaacgugugguuuuacugaagucacuuaaugagugacccuaauagcucuaagacguucaucaguauggaccccaggacuuacuuccucuuucgcagagcauguggacccacaguaaccacacuggaguuccaggcacagguguacccugggggccggucauucugcguacacagaccugccuuugucagcggggcugugggcagcaugggguggccauccagccauggccauguugcuccaagccccaccgugguccucaggggcacucugucucgcccugagccuccagccaccuugcccgucagucuuucccuguaccucuuggggauggggagucugccaccuagcaaagcacccacuugucccaccccuuccauucuguugagcugagacgcguguuuuggucguuucgugccguggacaccaccuugguuuagugaaacacggcgcagaguccccucuccccuggaccacguuuccccauuucagcucccugcugugcacggcugcuucuucccgcucugcagagggugguccugguggcuggagugcggcaggcagcagcauccucccaugguggcucgcaucccagagugugaccguggguucaugcugacggcucaggcauccccugagccuggacacugaaguguacagauugagguguguuguuggaugagucaugacaaguggaacaugugcacucguccagauaacacacuucuaucaguccagaguucccgggguccccccaguccagcccuucauccccggcagcuguagcuuagccuuguuuguuguagaacuuccuauaaauucuucccuuucuauuuuuuuucuuuuucuuuuuuuuuuugagauggagucucacuuugucgcccaggcuggagugcaauggugcgaucucggcucacugcaaccuccaccucccggguugaggcgauucuccugccucaaccuccagaauagcugggaugacaggcgugagccacugcgcccagccguauuuguauugcccaccuuuuguuucguugaaucugugcucaggugucaccuuucccuagcuagagcccuuuccuggcccucccgggucaacaugcccccuucccucagccucaggcuuuccacucuucuccagauccggccacuggaucaagccacugucaccuccucugggccuuggggaugucaccugcccacucuugucauggucggccuccuuagcgagccacucagcucuagcugccaaggacucugucuguuuguccauguaguguccuugcugggcacacagcaggugcucaguuaaauuuguucacuggaugcagauucugcaggcaucuucacagauuaugcugauggagcaggugugcccuaccaccauauguuucuacaauugauuuuuuuuuggugcaacugucaaaaaauuuauuuuuccucuaccacccgcaaccccccccccccccauuuuuccugcuucuuagugugguuuuagacucugauucugucacuuaacauaucugcugucuccauuugaugugaccuacaaccugauaggcaugccgucugccccugcucgggcgaugggcgugggcaccagcaaccgucacagggguccaggguuuuccacugacugccgggugcccucagcgcagagcuccugcaggagggucgaauugucuguuucauagaccagaaaacugaggcucagcugggcccuucaccuggcugccuccagagugcgggcuuucugcugugccaggcuguucucuugccucucccauuccuuugcaucagucggcacucuggaacagugccugaggauguuagaaucaccuuaugucuccucuggaaagaggccaguggauagagaaauauuuauuucugaucuuguagucucuguuuauacagcgguucguuauacaaguaaccuauugagaagaggacauaggugucugcaugcauccgcuucucagugaguccaugcuggacuguaacuguucccauuuuccugaggugggggguugagguuuggagagcucagagucacagauucgcaaugaauggacuuagaauugagugcuugacugacugcagacacuaagguguuaacucugcugccucuuuaugcuugggaugguuugcagaaccugcuuuuugaaaacaagacuauuuacaugcacguuucuguucccaguaauucuuggcauggaugagggagaugcuuugugucagauucgcauggugaggagggggcagcucugagaggagccaggcccaggcugccuccagggcguccagugcuccccaggcuugccuaggagagugucgauuccugcugcacagcaacucucaugaccaaguuuaaaaugcauuauacguagaaaagugugcuucuguggcucacgccuguaaucucagcacuuugggaggccaaggcgggcggaucaugaggucaggaguuggagaccagccuggccaacauagugaaacccugucucuacuaaagauacaaaaaauuagccagguguggugucaugcgccuguaaucccagcuacucuggaggcugaggcagaagaaucgcuugaaccgggggggcagagguugcagugagccgagauugugccacugcacuccagccugggcgacagagugagacucugucucaaaaaacaaaaaacaaagaauacauacugucgccugugugcccauucucaagaaaaaggaaaguuucuuugaaaacauguggaccuucccuaguuccaucccauuacgcccccaacccacacucccagagcaagccccugggcucugugaucacuccugaguuuuguaaacacuguggugcucacucaguccugcucccuggaggccuuggccgcccauccuuaaugugccgguuugugccuguugcacgucauuguaauuacaucauuuaauuaaauauggaagcugaugaaaaauaauuauguguagagcaauguuucugugaagacaaagcugaaugcuuuggaaagucccaaaggaaaauugcuaaaaaauugcuauugaauaaagcaaauagugaaagauuaugaggaaaaguuguaaggucugggaagaugacagggauccacuuuaaagaaacaaagcuaacaaucaugagcggugugucguggacaugguucaugcaaaaaaaaaaaaaaagaugaaacuccaauuaauggacucauguucgaagaaaaaguuugcagcuugaaagauaauuguguguuuuucuguuuuaaguugaaauguuugagauacacgcaucauuugauuccucacuuagccaacuucugggauccauuacguuuuuuuuuuuuuuuuuugugagugguggauuauagauaacuuuauuuuuauucuuuguguuuuccucuuuuaauggauuuuuuuuaagauaucauuuaccccuuuaaguugguuuuuuguuuguuuuuuuuuuuaguauuuauugaucauucuuggguguuucucggagagggggauuuggcagggucauaggacaauaguggagggaaggucagcagauaaacacgugaacaaaggucucugguuuuccuaggcagaggucccugcggccuuccgcaguguuugugucccuggguacuugagauuagggaguggugaugacucuuaaccagcaugcugccuucaagcaucuguuuaacaaagcacauccugcaccgcccuuaauccauuuaacccugaguggacacagcacauguuucagagagcacaggguuggggguaagguuauagauuaacagcaucccaaggcagaagaauuuuucuuaguacagaacaaaauggagucucccaugucuacuucuuucuacacagacacaguaacaaucugaucucucuuucuuuuccccacauuucccccuuuucuauucgacaaaaccgccauccucaucauggcccguucucaaugagcuguuggauacaccucccagacggggugguggccgggcagaggggcuccucacuucccagacggggcggccggguggaugggcaggggccgccccccaccucccggaugggcgggggccgccccccaccucccggacgggguggcuggccgggugggggcugccccccaccucccggacgggcuggcuggcgggcgggggcugccccccaccucccggacagggcggcugcugggcagaggggcuccucacuucccagacagggcggccggucagagaugcuccucaccucccagacgggguggcgguggggcagaggcacuccucaguucccagauggggucgcggccaggcagaggcgcucuucacaucccagacggggcggcggggcagaggcgcuccccacaucccagacgaugggcggccgggcagagacgcuccucacuuccuagacgggaugucggccgggaagaggcgcuccucacuucccagacugggcggucgggcagaggggcuccucacaucccacacgaugggcggccggucagagacgcuccucacuuccuagaugggguggcggcugggcagaggcugcaaucucggcacuuugggaggccaagucaggcggcugggaggugaagguuguagcgagccgagaucacgccacugcacuccaggcugggcaacacugagcacugagugagugagacuccgucugcaaucccggcaccgcgggaggccgaggcuggcagaucacucgcggucaggagcugagaccagccuggccagcacagcgaaaccccgucuccaccaaaaaauacgaaaaccagucaggcuuggcggcgcgcgccugcaaucucaggcacucagcaggcugaggcaggagaaucaggcagggagguugcagugagucgagauggcggcaguacaguccagccucggcucggcaucagagggagaccgugcaaaggggagagggagggggaggggcaggggcuccauuaucgucuugaugauucuggguaggaaaccuugcagugauauauugcugccccauuuauagugccaguuauuugcauuguuaugcauagcugagcgucaguuaggaaugauagaauuguuuuguuacaaauguuuauaauuagauuuucucugcauuaauuuguugugggaauuauuuuucuuuuuauaaaauuuuuauguaguaccugauucugcaauauaagguugcaauacuaggcuuugaaaauuacuuauugaacagcuauuguauuuucuugguacagaauauugaaaacauucaaaaaguauccaguggcuagcccggcaugguaguggguaccuguaaucccagcuacucuggaggcugaggcaggagagcggagauuccagugagcugaggucaugucacugcacuccagccugggcgacagagcgagccucugucucaaaaaagaaaaaaaaauaggccgggggcgguggcucacgccuguaaucccagcacuuugggaggccgaagcgggcagaucacaaggucaggagaucgagaccauccuggcuaacacagugaaaccccgucuuuacuaaaaguacagaaaaauuagcugggcaugguggugggcgccuguagucccagccccucgggagucugaggcaggagaauggugugaacccaggaggcggagcuuucagugagccaagauugcgccacugcacuccagccugggccacagagugagacucugucucaaaaaaaaaaaaaaaaaaaaauaggauccaguggcaagccuccugccauguucuuguucuccagcaggaggccauuguuauuuucuuguuuaucuuuuagauuuuuuuuuuuuuuuugagacaggguaucauucugucugucacccaggcuggagugccgugcgcgaucauagcucacuguagccucugccucccaggcucaagagauccucccgccucagcauccugaguagcugggacuauaggcacuccccaccaggccuggcuaauuuuuuguauuuuuuuugcagagacgggguuuuaccauguugccuaggcuggucugaaauuccugggcucaagugaucuacccaccucugccucccaaagugcugggauuacaggcaugagccacugcgccuggccagacuucuuuugugcaaaaaugaaucaacacagccaugcagguuuugacuuuucugcacacggcagcauagcauacuuauaguccgcuucuugugucuguauuuagcacugccuuuuuggugaucuuucauguuaauauaggaaaagauguguuuuuuuccucuuacacaaguuccauuguauggauagacuacgacauuuaaccuguuauaccgaacuuuuaauccaguggucugaguucaguagaaugacuugcguagcauuuagucggauaguuacuguucuggaaugauaugauuuuuuuugcucauucucuuaguauuuauugaaaacguauuauugggccaguggaaaaaaacagaacaaaauaaaaaacagucccaugccuuucuggagccugcauuccaguggagggggaaagacacuaaauaagcagguagaaagaugcaggaucucagcuggugguguucugugaaggaggagagcaccaggaggagcggccaggagccagggcucaggugacauuccauugaagacucaaacaagugaagagggggcaggccacgcaggcaucuaggggugcgguguuguggaagagggcugugcagaggaccugaggugggaauguggcucccguugugggagguuuugaggcagugacguggagaagcagaugccuccugcaccccuguccugcacaggcagugugugggacccacauccccguaggaaagugguugcucccugugggagucacagcgugacgaggguuugcugcugcgugggccuuugggcuuauggauggggcuggagaguagugguggagcagccaggccugaaaccacaccuugccugggucccuuuccaugggguaagagugaccuuuccucugucugcugggaagagugugaguggcaucgucugccauguggccagggugucacggagcggcccaggcucuuggugagagggacuggugccccaugugaauccccugacuugggguuccucugaucuugggaccagagagucugagcuccagcuuaguggccucaggcugggugcagcaggugcagcaggugcagccucaggcagguggcuccugcagaaccugacccagggccggguacugcacagcauggcauuaguccccugucuucaggaaaacaccagcugcuccucccguguucuggggccaugcaucucucccaaccuggcgaccccaccuuuccacacaauuguguugcaucagccagaaaaguccggcugacaugacgcccuguugcccuugugacuuugcaguugugaaugcugauuguccuuugguuuguagcacugagguuuugcugucuaauguauuuuauuccuauuucugcauacuuuucgcaaaacaagcccugcagagacagccugugucgcuuggguuguguucccugccuuccgcagggcucuggcuggagccccagccucagcaguuuuggacugugguccuaggcccuguggauuucuauucuuugaaagcuugaggugucuuguuugcuaauuaguuugauggcuguugcuguuucauucauuuuccaccucggaguccucugggucuccaguuuuucagacucggugaaacuggcacuuugggcuucagcuagagccccaacaucugcuauuagccccaaaauagcuguggcuugggcuggagcugcucucgccucggaaggaaagcaguaggccggacuccccacagcccucugcugcucugcgugcagcugggcuugagucaaaauucagcugcagauagaacaaaaagacuuucuuccccuugaaaacccaccaguuagaauuuaaaaggcuucgcagcugaagcccgcguguucagcagcagaugucacagcuuggacugcaguuggaacugucacugccgugucaucuccgagcugaggcuccugaggccucugaaugccuuccacuuuguaguuggugaagugcggguuucagaauggacugucgggaguuauucuuaggccguaauaauacuuggcacggcuccuccugguuacgagcacuuagcuaauccccagagcacccuugguaaacaucucugaguagcuuuaaccacacacaggucaggaggcuucuggaaaauaaacacucuuccugccaguuggagguguuggggcucuggucuuggauuugauguguggcgaaggcugcaauuguuuaauaacccuucaugauucaacagcucuucaagaacuuuccucuguucuuguguggagcucgugacagccaguggugguggagcuccagcccucucuucccacaggcacaagccggguuccugagucccagggcuucucgggaggugucugcccuccucuuucagacacccucugcccugugucccagggcccugggccugugcugcacugagcagagacuguaggggaccggcucucccacuccucccagaugggcagcgucuuccgugucgggagcaugcugugcugcuuuucucuucucagucucuuaguuuuugcggguucuuacgcaugugagguguggacuugcaugguggggagcucaaaugguaacaugaaggggaggagcccucugagugcugugauuuguuccaucauuaccgcuuccugaucacggugaccugcacugcuggaguggucaguggagccaggccuccccacaacaguguucccaucgccuucuuacuauugauuucuauucuuaaaauauuguauuacuuagcacucuuuugaagacguuccaguauauaucaaaugaucaaaaguccauaaccuuguccuacguagaagccaaaggugucaugcaguuucagguguucgaguuuccagaauucuugugaugacauuuguaggauucuucuuuuagacuuggaccaaauucuguaaccuaauauuuguccuucagauugacagagaaccgcaggcaguguuuucucugucacacgugugguggguggcauccuggugacauaaagaauugccuuugguaacuugcccagaaggcuguaggguuauuuucugcuuagacuuuccccuauuucuuucuuuucuuuucuuuuccuuuucuuucuuucuuuuuuuuuuuuuuugagauggagucuugcucuuguugcgcaggcuggagggcaauaccguggucucagcucacuguaaccuccaccucccggguucaagcaauucuccugccucagccuccugaguaggugggauuacaggcaccugccacugcacccggcuaauuuuuuguauuuuuaguagagacgggguuucaccauguuggccaggcuggucuugagcuccugaccucaggugauccgccugccucggccucccaaagugcuggcauuauaggcgugagccacugcgcgcccagccuccccucucuauuuaugcagaugaucgguaguuccggaaguaguuguguguaagaaucaccagggaguuugugugcagccccuaagccccgccuucaggggggucuugauucaguggggugggguggggcggggcaggcuggaguugccucagaugacucuggugcaggugguccaugccauuagcccgacgucaugacgccacgcaccgugaaaccaugcauccacugcccucgccacacgcgccgugaaaccaugcgcccgcuccccucgccacacgcgccgugaaaccaugcgcccgcuccccucgccacacgcgccgugaaaccgugcgcccgcuccccucgccacacgcgccgugaaaccgugcgcccgcuccccucgccacacccgccgugaaaccgugcgcccgcugcccucgccacacgcgccgugaaaccaugcgcccacuguccugguuagagccgagcacauccucguguccugcgcuuuuugcagcaacugccugaccaccuuuuugcccagcaucagcuuuaauggguguucagugcucaauguuauggcuaugaggacuugcuuauuuuuuuuauuguugagcuuuuuuuuaaauuaaaaacuaugagauggagaaaguaaguuggugcagccacaguggaaaacagccuguggugguucucggaaaaaccgaaaaggggaugcucugucagugccgcuucugcguauccacccgagaucauuaaaagcagcguuuggaacaggcauuggcacacccauguuccuagcagcauuauucacaacagccaaaaggugaaagcagcccagguguccaccgacgggugaguggauaaacguuguguagccacacaauggaguauuacucagccuucaaaaggaaggagagucugccacaugcuguaacauggaugagccuugaggacgugaugccaaguagagugagcccgucacagagaaaugcucuauggcuccacucauguggcuggaguggucgcauucuuagagacggaagguaguauggagguggcuggggcugggagcagaggggcugugggaguuccucuuuaaugcgacaggguuucaguuuugcaaaauuaagaguucuggggauagguguggugcugguugcccaauaacaugaauaugcucaacacgacagaacuggggacuuaaaaaugguuaagaugguauauuuuauguuaaguguauuuuaccacaauuaaaaacaucccaacacgguggcaggaugccaccguggccagguguggugcuugucuuggguuuccucaggauguccucuuggaagagcguggcaggucagcaggucaggccugaggaccccccuuugcucgcucucuuagccucguccuuuuggaggguccagucuuccucagguagcaagccuucuugccaggccacagaagccccaagccggaggagcggcucuccggcucccgugcugcuucuccgugcaagccucucugagagcucacaguccaccccuguggacuccuccgcgugcccagagccuccugggcuccuccuccccaccccgcuugguucaaggguauguccuuuacuccagaugguggccuccguccuucuccacaggcugcuguuaauacgagaagagggcgccggaaugcuuccuguagaguucaggaggugaccuccugacccguuugaucggauuccaccuuguucuugaugggaccuccuuuguggccucagaaauguccacauguuggcaaaaccauuucaucuuuucuuuuucugauauggagugcucugaaaccauugccuuaaacccauucuguuuccacuagcuaaagcucauacacuucauccccagagagcccauuuucuuuuauuuauuuauuuaccauuuauuuauuuuuauacauaauauuuuacauauuuauggaguaccugugauauuuucuuacgugcacagaauguggaaugggcaaguuuaggguauuugggguaaccaucacuuugaguauuuaucauuuccacguauugggaaaaauucugguucucuucuagcuacuuugaauuauacaauacacuguuaacucuagucacccuccucuucuguggaacaacugaauuuauaccuuucaucuaacuguauguucguacccauuaacucaacucucuucaucugugguuccgcucacccagaccuuucaauccacuaguuccugucauucuacucucugccuuuaggaggugaauuuccacagcucccaugagugaagacgugcaguuucuuucuguuccuggugguuucaccugacacggucaccucccauuccagccacguuguuacaaaugacaggcucucauucuuucuuuuuuuuugagauggagucuugcucuguugccaggcuggagugcaguggcgucaucuuggcucacuacaaccucugacucccugguucaagugauucuccugccucagccuccugaguagcugggauuacaggcgugugccaccacgccuggcuaauuuuuguauuuuuaguagagauggaguuucaccauguuggccgggcuggucucgaacuccugaccuccugauccaccugccucggccucccaaagcggugggauuacaggcgugagccaccgcgcucggcccagcucuuguucuuucuuacggccggauagcauuccacuguguguacauccccauuuucuuuauccauucgucugucgauagacacagguuaauuccguaucuuugccaucuuugcugugauaaacaugggaaugcagguaucuuuuugauacagugauuuccuuugaguaaauacccaguggugggauugcuggaucauguggugguguucuguuuucagcuuuuugagaaaucuccauacuggguuccauagcggugguacuaauuuacauuccuuccaacagcagcugagaguucccuuuccucugcauccucaccagcaucugucuguguguuuuuuggucuguuuauuagccauuuuaagcugagguaaggugguaucucauugugguuuugauuugcaauucccccgaugauuagugauguugaccauuuuuucauauaccuguuggccauuugcaugucauccuuugagaaaugucucuuuguguccuuugccuacuuuuucgugggauuauuuauguuuuuuuaauuguuguuauuugaguuucuuuugaguuguauuuuggauguuagucccuuauuggccgaagaguugacagauauuuuccugcauucaagaggcugucucuucacucuguugauuguuuucuuggaugggcagaagcuuuuuacuuugauguagucccauuugucuauuuuuguuuuuguugccugugcuuuugaggucuuagcuauaaaaucuuugccuagaccaauguccugaaguguuuuccuuguuuucuuuaguauuuuuuauauuuuugggucuuagguuucagccuguaauccaucuccaguugauuuuuguauauggggaacacauuuucuuuugauugacacugccgaacaaaggguauacaaaauuucacaacuuuuaacaugcugguugaugauuguacuugaaguguuuucuccucauguccccggcgacauccagacaccgccuccacggugcauguccucucccggccucccaaugccagugugaaaaugggcuuggauugcacacccugaaaacagccuccagccucccugucccuuccacauccauaaaguuaacggcauagggauugucagguaauagcagugcacuguaccugugccguaggguuuuggaagugagccuuaggaagcccagccgagcagguagggaguugagccuggaggggucagggcuggggcugagacccagguuuucucccauggguccaucuccuuuuccuuuaaggauguccuggccuucccucugucucugcaaguagaguagacuggucccgugugacguucuugaaggcugucaucgagcucacugugcuugugcuuuugaguggaagcugaacccuggucaugagcaagaauggccagacagggcucgugaggcuugguuuagccaaaguggugacugcggguuuuucagcgcaagaggcugcgaagggagggauuccuucuggugccccugugcccuccagcggcuucugcccgugggagguguugggcacggcugccccugugguuggagggcucuggaauagcaagcccugcagcuucaguccucccuaugaugggggccuggucgcauggggacugagagccggcagggaucugggggccuagggauguggccagcaaguauccaggcugagagcccaucacgugacagugcucccgagggcuggggucugugugggaccauccgccucaggcgccagccuucugccucagggcaagccaugcucucuguuccugccuggggcaggacaacuccaggucacacccaccucaggcaaggaggagcgugcaggggagccacccggaagcagccuccugcagagucggugggaauguggagagccagccugcuccuugggugauggagauggaugccccggggcuccagaguacucagguuucuccuguggcccaucagugccagaaugaggcguugaccccaugacaugagacagaggccuuccugggugacguaggagacugccuggugcgugugccaucugugggcgcccagcacuucagaagagagcucugucacugucacuuuucaguugauuugaaccacucccauuuccccccucauugcuaaaugguugcauuuaucauggucuuggcaucacugggaaucgcagaacaugguuagcagagccuggcccucugagaucuuaccccagcucccagcuuugcuggguggguucguaccuuggggcaagaagcuuguuucuaaaucggugucaaaugcuccugacccugccuucugcucugcaggcugcagggaggcuuccccacagagggagguggcaggcagugugcccucuggugagagagaaccaucccagcugggagaacccuggggccugguacugccugccaaaugccucuccacuggccuccugcuguuucagguccagugacaugugaggucccugaggggugugaggcgggguggucuuggcuguguagguggagccuguagccugccgccugugaccaccccaccugccgcugguucugggcacaggggcugggaggcgccguugcagauguggauauaugcgauuuuuauuuauuuguuguaaauaaauucuuugcacugaguuagugaaaauuuacaagccccuuugauuaaugcaaaacaacuuaaauaucucauucaaauguuucagaaaaaauaucucuuggcuuggaaagguuuccuuacuuucguacugauauuuuuaacucccugagguuggaagcuuugggaaacuggagagaauggucacggcguucaagggcagcugcaccuuucaucucuguccuagaguucaguuucucuuccaaggucuuucagucauaaaugguuuuuccacggagcugcuuucuaaccccgguuugccugugugugugaggacagauggggucuccccggugccagcuacuccuucugcacccaucgcuguccccacuagauguucagcaaggggccuguucuuugggugggcagaggaggccucucugggggacguggaagggagaaggccguggcgugcucugugugaauuggcuguggucagagggagggcuuaugaccagcccugggugugugugagggcucagggccugggccaggccgcaggacaucugcucacaggcucuugguagcuuuguuccagugauggaagacacuccagaaacaccaaacuaaugcugggcaaggcggccuccagcuguccucugugccgugcaaaacaggcaugggauggcgaggggcguggggguggccagagacacuguaaggaaguggcccuuccucuguuuggaggaggagcugggugcuggaagaccgggggaggggcugugugagcgcuggaugagcugaugaggguuucgggggcccauggguagggugcucaagugacaggaaaggucaguggcugucucagggcagagucuggucgggcccagugcgugagguuugcagcgugcgcguuuuaggcagcaggauggcuucuguuagggguccgugguugcagugugccucuccguggccguggcugacucgcagagaggagcucccgggcaggcugcugggagggugugcccgggauccacccgaggcugcucugggggccuggcugacagagugacugggaccucuccuuccaggggugcagguagccuccuuggccaaugucgggguccccguugcucauucaguggugcggugcgggcucccugaguggggcuggguggggcucucacagcauugccagcgccugcuuucuauguggaccugcgcuugguccaugacaggugaagagaagaacaaggauggguccucgggccugagcucacaugccacugggucagucuagccagggagccuuggcuuugugccccagguugugaggcugggaaugcucacacaccacuggcguaacuuugcaugcauggcucagauccuugcuguguccuccggagucccagcguugaguuagaagauguggcucgggccgagcucagcuguugcugaucaucggggugcacuuugaacuuugaagcggcuguuucacauuggagucugaguuuccucguuuaaaaaauggaaacggugaacaacaggguugcuggggcauucacugagacaaucuggaaucguccuggaaaguagaaagcgcuacaccuggagaucgcugauuuuacucuuguuguuauaugugggucuucugaaggagaggugaggaaaggaacuuaaaacucgcugagcaccuccccugugccaggggccuggcgggugcuuuuuaaacaugauuucguuuccucugaagagugacacugucaggucgugucucuguuucuacaggugaaguaaaaucggggcuuucuaaggucaucuccccgguguugcauaggggugggggcugugguugaccccaggcuguagugcgugcaugcugcccuggaccuggguccacagaguucacacauccugggucccagagcaucagcuacagagguugcuuuuggccuucuguuuugugugcagaaucagguuuacuucucggggacagcuggaacugagugugccuuguuuauccugcaggacuccagaagaccuuuccagauucgugguugagcugcagcagagggagcuugccuugaaggacaagaacagcgccgucaccagcagguagaccuggccgcccagggugcuuguggggaugcguuugcuuuggagaguuaggggugagugagagugugugcccccuggcucuugggggauggcuguccuucaucaugugguuggcccuggucugggaggagaugggggagcagggauuugagggaaggguuugccccauguuuccaccaugugcugugagccuccgcugaggcaccaccguccaucguucugacaaugugcuaaacugccauggggucuggggguuggccuccuguuguggggucccuccuuggaucaggaggguucuugucuucccagcaggguuggggccucauguggucuugggaaccagcccgucggucacuagcgggcccacccugagucuucacgucagcaugaaugcaggcgugauuggaaggggcucacuaugaauaccaagagacaugccccucacucaggaagucccaagggcuucagggaaccugggaugacgaucagauauguauuucuucuuaucccacagcccggcucuucucugguuucgcucguggcugugaggggccauccaggcuccggcaucacacccagaggcggaaaugagaggccucuuuuuuggaucuuuucuguacaagaaagcguuuccuaggacccccacugccagcaagggccccuuaugccuccuuggcuaagaaggggucuuaugccugccccugaccagaagguggagcuaccaugagggacugaaccccauccggugggaccuguggggcuggugggcaguggggugggcuugcggcagagggaagggccgugcaacggggccccaggggagcucugcgcccugcacggcugaccaggccgugggucugugcggagggccugaagcucaccuguuugccauugaugaucaagcucagccuuguccuccuguggagagaguguuuuaauaauuuauuaauagccagaaggagguuucuuauuuugggggcugaugucacuuugaaaauuggcuuuuagaagcaucugguuguguuggacauaaucacaucaauuuacugaaaaaccucaaaugauaaagauugccuuuugcuuucaaagccgcugucagaugaaacaggcauuaaaagugauuugaaguuaaagcguucacacuuuaccaggcgauccucaucauuuuacuuuggaaaugaaacagaaugaacuauuaaaggaaaggaaaguugccuguacuuuucucccaccaaacagggaggugcuuccuaaaauuauuugccuugaccagcagcagcaggcccaucucuguguccagggccacacggaagggaacauucgcaucugcaugcugcccauguugccuucgcuguggucagagauguggauugagcccauggggggauugguuugggaauggggucucugucucagggagcagccucuacagugggcaggugguccucacaaccccagcuguggcuggccucucaggaccugugggcucccucugagagcuggggcacccgcccuggggaagggugagucuuggggcaucccauggacgcgcuuggugcuccguccuguucugugaaauggggucuugggggugagacgagguccucaguacugcgcuggucugggaggccaaagggagaagcugcccugaaauccuggguucucacaagcguuuccagcuugcuuucaugugugugucuguaugcuggcuucugucccacguguggcuuauugcccugugugggcuucuuuagccaaggugcaggcuccagauggcgcuggucacccgucgccaggagcgcuggagacgcuucccugagauggggcaguggagaggcgcaggaggccucugggcgugagguuggagcucccggucccucuugccugcagguccuggggggcggcuggucugcuccuugcuggucaugugacuugggcaggcaccugguccucucuucaucucugugagcugaaagguacuggcaguaacgacuggguugcugugaggucugagccuccugaacugcgccugggcacugagccguccccgggucucagugcugcuugcugguggguggacacuucccgaccaaggcuuucuggggccuggugacgcugagugccuggcccuuuugugcacuuccaaggcccaggaaggaggcagacccuaggacaggcagcgcuggcaguggccaaugagguguggaugagucccgucguggccuuggugcuugcguucuggccucugggcugcugcucucuuccguggcgggacaccguguucgucgcggccugccguggcggggucagggagccucgcacgguugaacagcugagcacauuucuacaagucucuuacaggcaguuggacagaaauucagaugagcgugaaggaggcggcauggcagaagaugggaggccacgguggcccagauccccgagggcuuugccaggcgggccucauuuuaaagucacuuuuguuuguuucucauugaaaguagcuuguagucacugaagaacagagcccugguccagcugaggucacgggucaugagagcagcugcugggcauuuucccucgucugugcggaccagcgggcacgugcuugugaccacguauguucuccucugcaguuuuuaccaaguauguuggccguguccaucuuucccugguagugaacgcuguucucgccaucugaggagcuucucagggugcggcuccacugcccuguuccucguagcccagugcccggugcucccucuucgaggcguugcccuguuccucguagcccagugcccggugcucccucuucgaggcggugcccuguuccucguagcccagugcccggugcucccucaucgaggugguacccuguuccucguagcccagugcccggugcucccucuuccaggcggugcugcugugacggugccgcugggguagcucacguggcagcaucucggaaugcuugugccucaggccgagcuucugaagugacggcugggucauucgugugccuguuuucaggagcuuggcuuuuagaagaugaauguugccuaucagccggcguagugugccgcugugagcagccuacaccacgcagucuugaugcacuuccuggguguuguguaacuuuccuucucugcugaucugaugugcggaacagagcgcccuucccacagucgcugucuuggugacuugguguuccuuucaccaacaugacacauguccacguccgugaagccagaagccagcagguaccucagcagguccugugggucgggcuccucugcggaguuccugccguugcugccuuuuuaaaguuugccucaguuucucuccauaguuacugcaguagcauuccagccuguuucagggaggauccuggagcucucccacccagaggaguuccaagguagggaaggccgcccagggagggucugaugucagcuugccgugcaaccuggugcaggaaacagaucaucccgcagugagcagaugccgagccggaagccaucaccucccuuguuugaggaagagaaaaugacaccauaucucggaguuagcugcugggccaccaaccagccuggagcaagaaggaauuuuccuagcauugagcuauaguuuugaccccuuuuacuggugaagcacaguuccaaacgcugcugugagcuggacugaaguuucugucugaauguuucugcgcucuuaggacuggaggcuggaagccccacgguggcaccugugcugcauucuggucuuggggcuggaguugguagaggcaagaagcuucuggaacucucaguguaggacuuacugcuuuccaggguugcgaggagccugcuuguuagcuuuaugcggguuugcucaggugcugcacuggaauuccugucuuacagcagagagagugucuguggggcugcuugaggauucagcgggaugacguugguaacgugccuggugcagcagcucucggcaguccccgggacguggugcugugacgaaggguccggggcuggcuguggagccaggagcaggcagggcucucagugggcagcggggcagccuacagggcacuggccguaaggcgcuccaggaggguggggugcuugagugcauugcagccuggggguugggucagaaccaccaaaccuugccuccuguguguuucucccuuccuuuagccguggacagauggggcgucauuggucacuggugugagcagagcgugucagagauccugggccucuuuaccuuggagcaggagcuucauggcaguguaggggagccuggccugguuuacgcucaagccucguuucggcucuuagaaucugagaauggaccuccugguuguggggcugaggacagggcauacuguucagaaucaguggguggaucuggugcgcccucugcucacgcuucacacagggcaccccggggcugcccuguagccucccuucccuuuccgggcccucuuagucuccuuggcccuuagggacccaagcaccccucugccuggcguccccagcucugccgugggaagagccgggacaggaggcugcaguccucuguggcccagcccguggccaugcugucaucuuucagaucugggggggaauaggccagcgugcucugagggcucgugaagaacagggcugggaagcucgggcagggaugcguggggccaugcucuuggcgguuucucugcugugcuggaaauaagaccgugcuuuggagagggcugguggcgggagcggggccucucaggaccccgugagggcuccaggguucagguguaucaucuguaaucccggcgaugaaugacgauggggacgcugagagcagucaguguuugucucgcaucugcccucaccaugcgcugcgcugugcuucaugcgcagccucucacuugagccucacagacgcucccagcuggaagcucuuaugauucccucuuuugcagggaggaacuugagccccgggcuaaacagcugggagguggugaaagcaggacgugcguccaggccugugggucuccagagcucugugggauguguuugcagguggcuccugggucccugugggacacguuguguggcugccgucucggcuuuggccuugcuucucugccucagcagagacccugggucauggauccugccuggugcuguuuugccuguuugaagccccaggcauccuccucgaugcugacuuaagguagagccggcugagaaguccacagaggggagccccugagggccguggaugcagauggagcucuucauguuggggucugcccuggccuccccugccuccccucugugcaucggcuuucccagaagugcauuccagccugggcugugaucgccgcaguuuguuuugaagaucccaccuugcugccuccaggcagaagagcccuuggccugaagccacaaggcuggcauguccuggagcaccuggccguguggugcuuccaggugccugggccuggccuguuucaucuacugcugccaucaggggccugggcagcgucaggaggagucaggcccuugucaagcauaagggacucgagagucauugggugugaugaguggauaucaccauguuuucugucacagacggugcuuuucugagccucuuccugccucagguuucugucaccucccaagagugagugaagaucaguuuacuaguuaugagucuuuccugcuguuggucccaggugguuaggccguccucucaaggacguaacaaggccuugucaccuggcaucugaauuauggugcacuugagucauccagagaccagcaaggcauacgagauccaugguggcugggcuguuccccucuugcacuugaggggccucccgcuggagaagccaccacuggcccagguuccuggggccuguguuugcauuuggcucuaccaggaguggcucuccgagcgagucuuucuggugauggugacuccuguuggggguuuugaggcucagugcagucgccucuauggagccuguggacggugcuggcucagggugcagguuuuuagcuaguccuugucaucacuggcaccguguccugcugucacuuuuugagguaaugggaaaguacaauuucugggagccuucagggcauggcagggguaaguuuuccaggggacucuguggggcaggaugucuccuguguguggccaguggugaugaucagacggguuaggcggugggggcaucugggaggucaaggugacggaauuugccguggaucagugugggugagagagcacaucgggauggccaguucuggccugcccuugaacugaccauggccucagccauguguucccagcaagucucaugcucaaccugaccaccugcucucggcauaagggggccccugggguuugacauggccagaggccuuguugcguccguucggcuuuggcgccacucgauguaaauggucuuuggcagaagguguggaaucagccugagucuaaugggcugucuccauguauuccacgguggcagccugccaugccugucugguccagggcuguggcagggcacgcgccaggagcucuggguggcaccgugcccuucaccgugggcucaguggcagcuaggggcgcuccguccggcagcagagaacccgcgugaucugucuguauccugcuccugucccccucugccccuugugcgucccauguggggcuggucccaagaguuucucccgcagccccggaccaugccugggacgcacagugcaccugcgccauagaggccucagcccccaacccagcccugcaccaggggacagccuuuugaggcuccuugucugucucuagaacggggcccuugauggcaucugcuuuccuguggugguuccagugcggaugcuggcacgugccugccuuguucuuuggcgaaggcugcucggguuaguuuggcuagugugggcccuuugaaaagccgucucucucgugagucaguugucugucuguaggauagccccagugagcggguuuuuggggaaaugugagggacaucccugugccuggggucuggcaccaugcacuugaacauggaccccucagugagucaggugccccagagugcgcugcucaaggugacaggggagcaggcccauucugugcucacggcugugcgguccaccugcuggccggugauggcugccccggcgacccuggccuggcugguggccucugccuguccuuuugguucucagucccccucucuucuccacugggacuuuaguaggaaaagaggacuuggcggcaccugucccgggagccaggccauguggaggagcugggccuuccccaggcugucugugcggcaccugccugcagugcccagacuuggacgugagauggugccuguggcaugugcagccgcccgcuccucugugcucagcuuagaaccuccucguggggccuccucagcggggguggguggguaccaggccuguacauuuuguggccaauuagagggagagagagaaggggggcauggcauggagaugucugggugagcgggcgucugucuuggggccucccucccucaugcggugccuucuuguuccuccaguccuuuccugaucagggcuagugaagucccggguugggggacauagacccggugcccauccugccaaugccggguucucuguggccccccaguauggucugggggccugucugaggcaccaucauguuucaggcugcagcuggcugcugggccugagaucgagccccaucucuccugagaggggguccagcccauccuggcuccaggggaaagccugggucaucagcaggcauggucgggugucauggcugugccccgcagcacgcggugucugccugcuuggaggggccuccgcaguggggcacugcguggcccuguaggaugcaggcaggcuuuggcaaggcuggcccugcucuaggugggugucugaaccuguucccuccccaggcagagcccgcaaggcgagcacacgcuccuucaugacggggccggguccagcguccgcugccgcugggcucuggggucuguccggggugccuccgccugcugcuuuagccagcuuguguugcuucuuucagcaagaugagcugccguuaauauuucacacccagacuguuucccugaauguuuugcauuuccauauuuaaaauggcauuuacauauucauggcuuuuuaaauaaguuuuuauuguuaagggauguggaaguggaugaaaugugaaacucccccuuuuauucaagcacuagaaaaaaauuucaucccaaaugcaaucacuuucugaguguuuagcucuguggcaguugccauaggagauuguuccagaagccagugggucccagggccauggagccgcccuuucuggcaugcagggacugggggaaggcaacugccaucagcauugcuuuccagccgagguugggcauggaggccugguugcuccuugggguuucuccuggcgggggccuggccucgugcugggaugcggggccggcucccacccacauccauggcucuuguuuuggaggaagugucuaaggcagacgaggcucuucaucuuggaaguggcuaagccagggaugccuggcuucuuuucucccuucucccuggucacucggcgucccugcccugguuggccucuugcucccggcuuugcggcugcggcugcagcuagggccucggagggccauucggcccuggugcacucuccgauucugaggcguggaggguggcaccggcacccuucacccuucaggguccuuugaggguccuguguaagaacaugugcagggcggacgggggcugcuggaggggugcuggagucacuguuuuacguuugggcaguggugaauguggcugagccuuugccucugggacacuggccuggggaaggcccagaggaagccaccaaggauugacaagagugggaggccuugggagaggcgucugcaggggccaccugggcuuggacgcuguguaggugaucuugagccaagcacaggucacagaaggaugcacguccugcagggaaguaguugagggcuuuggaagccuggccaccuggccuguggcgugcugugcugcaguggagcagggcagggacugggggggggcgggguccagauaguagaccauaaaaacagggaaacugaggccuguggggggaaagagacucuacuugguggagugaagccuagagcauggauuuuucugaucuguauuguuacuuuuuaauauuuuuaggcauaaaauuguuuuuuaucaucucaggccuaaaccacccacaaaaccuuagccuugagggucgggggaagugugguccgagcugcagcuggccucuccacgcagagccccucacacuggccccugcuggagccaucuggacgggggucugccgaagcccggcuuccucccccaucagccuugaaggagaguggcggguguccucuguggcuguggaguucucagccuugaaggagagcggcggguguccucuguggcuguggaguucucagcagucugccuuuggccccagccccuggcagcuucucccagcaugaguguuguauuuuccauacucucagggugcugggucauugguagugucugguuccuccugagaccagaggcaggacacagagcucagggcuguggcccugggggcauggcugggggagucaccuucacugcugaggguggggggcaucucagugugcguccuggggcccgcagcgcucccgccuuggcaagcccuggacugcagccugugagcucagagggaggguggucccgugagcuaggguggggugggggugcggggagggugcucccauggguuggcugagaguacauugcuggcucagggggucgggccgugugauccccguggcagccagggcuuaggcuguggacaugguguggggugcuuccuggggguugggcccuccucacaguccucgcccugucugggugggcuggccacacaggagggugaggcugaggcagccucgccugcucuuccuccucgccucuggccucgguaccggggcgucugcugaggaggaagaccgcuuguccugcugggaccuugggccucuccgaugcauguugacuccagcugagagguguucuccuugccuguccugcuuuucaucuggaaaaucagguccaggacucuugcuuugcaagaugaguggagaauugaagauuucagaaguucccaacaucaagcaggugcucagggaauggcggcauuguuugcaggaguggggucuguggucucugucacuggguccugcucacuugacccccgagccuuucuuuccucauuuguauuagggucaguuccacccucaauggguuucuuugaaggguaugugcagccugccugggggaaggcagcggagugcuggccuuccucucagugcuugcuuggccccugggccugggguucucagagugaggugcugcaggcgauggcgguguggccuugagagcgggggaggccccaucugcugcuuccccuccggcugacuucuccuaacaagccggaagugugcgucuggcauucaugcccccaauccccaccucuugaugugguuccuuccguuuugucaguaggaucuguuuucaaccucugcaugcugaagugcucaucucucuaggccacuuggucuggcgcccaccucgucgugguucucaggaugccucauuucauuaggcugaguggcucuggacuaagugcaccugcagagcugaccgccccaccgccagccugcugagcgcugccgcagccaggacgguggccagggagcacguccccuggggcagcagaugcauccccuuccuuucuccuucccuuuggacccuguaugcaccccugcauucucucacccucuuuagcaaguuaaaaaaaagcuggcauuuccucccacccccaugaaacccuuuguaacagcagucucagguccgcagugucaggggcugcccagugguggugagagcgcagcgugggugcagcccuggugaagggccugggacucacagcucugugcucugaucaugggcuggcccgcgcugucaguacagaaacgcccugugaacuucagcugccaucauggccugugucguguggcuggugucguguggcccucgcauaguuauccgacauggcaccgucggcacagaaacgcucugugagcagcagcugccaucauggccgguaucguguccucguguaguugccccauacguccaccuccugcuuggcuuccccucuuuggagccuccagggccagaggagcacaguucagaaacugcuggucaggagaccuuuccuggagaaguuucuguuccgguuguggaucuggccugugugggagccugagguggcaucuuugaggugacccgggaccauggggaaagcgcucuguuuccuggcugagguuuucaggcagugccauggcacaagccugucugcaccuggggcuagagguggcacgugcaagucacagaagggaaggaggagacagccugggccccucacucaccugggccagagguggugugugcaaggugcagaagggaaggaggaggcagugugggccccucacuugcaugggccaagcagaccgguaacaugccugccgcucugugacguuucuguuagagagcggaaggugucugaccucagcuccccaaaucagaaaacggcaucuggagugccauauacguuugagaagagggugcuugggucaguucuguccuuugcaagcgaacaucuuucuuggcccccaaaaggugguaguagaauguagauuuccucaaacauuuggagaaaacacagaaaugaauacuacuugaauguuguuuauuguugcuucaggaagagaauagggagaugggagaagggcccuugcugggguuggucccuaaguauuuuggugcccugaacuucuguuuccuugcuuauuuugaagggguuugugugagccuaaccccaggagagcagcccacaccccacagcggagccuagagcagggucagggcugccaggagcugcuaucuggggagacugaggugggguccucgaggccuccucucucaugcccggcacugccaagcccagggcaucaucaguggacuugggagcauccucuuaugaacgcuuuucuugaguuucccuguaacuuguuguaaacuuuguaagcucugagccaagagcuuccuucuuagccuugaagcuggccacugccggcuccuuuccaugccgagcugggauucuuggugugcagguguggagagcagcuccggugccaucaggcgauuggaguacgcuuuccuuccuuguuuggcagaacauaaaaucagucucaggcccucccaccauggccuccacugcugagccccgaggagaugccaagagaugggaagggcccccaccgaggaaugcagcuggcucagagucugccuguggagaacaggagccccuggaaggggcaggcuuugggcaggugagugcacuuggucugagggaggguguugguguugccagcauccugagcucgaguuggugccauagaccugggagggucucucgauccuguuaggaaacuuggguaagagagucggaacaaagaaacauccacugcuaggcaccuguggguaccaggcacuccacacgugucccccugcccuggcacugauccugccugcuggcggggagccucucgcuuugccccaguuuccccaagguuguggagccacucagccuggagucugcuugugagcucagggcuggcugucuccuaagccugugcccucucaccacguugccucucaucagggcgaugcuuuuucaagcucagauaucacaggucgcuuccgcagggcaugaagccucuuaaugcugacccuuuuuuaauacuguggccgagaaacacaguugcgcagagucugcaggaggaacaguguggacguggcugugacaggcauuuuuggucagcguggggcaagugcggcuuccuguuucugucucauugagcuuggaguggacauaggggcucuaggagaaggaaggcugugaccccugcccugaaggagcuuucccucugccugggaagagaaaccagcagugaaucccuuaggggacuagagagcguugggccgcgugguccugaucauggccacgcuucccaaaugccuggcugcuugugaguuauauggcgaaaagagccugaaaauagagauccuuggacucaccuccaaaggcucagauucaggucucugcugaggccguugcucccuucaugaguguacuuucccuugggccugggacaugugcacacacgucaccaugagagguggcaggcaggacucccauauguggccgugagagguggcgagagcuggugggcauugucccgagggucgcugugagagcuggggggcaggaggcccggacauugcccaccaccugagccuuccucugcaccagcauugcccucacuugucaguccaggccccuuuaaugauaaacaauuaccgaaaacaaagaguuuuuauuuguggggaaucauaacuaucaguauuuaccaucuuuggaaauuaaaauuaaaauuaaaucauuauuuacaauuauauuuauaaucucauuaaaaacaauucauuaucacuuaacaaaauauauuuaugaaaaaugcauuuucuaacacaaaacgagacagugagaggaauggcauuguuuuuuacuuuuuacaaaucucuucagugucuggugaaauagaagaugggagcaucucgugucugcguccaucugccacggucucuucuuuuggagucuguggaauaagucuggccccgcacaggugugcaguuggaagaaggagggccuaguggccugagggccccacacacagguucugcucagccuugccugcugggugggugagggcugaaggcaggugcgcucaccguuccuucacaccuuucguggcuagucuuaccuuucuggguaguguuugcucaaaauucugauuagauuguaggggguguuuuuuguguguugaacaugaacaucauuaaugaacgucagucauugaaugucugggaagguguccucaguucugguuuuucuggaaacggugacucauguauccuagaaaaggcccacuuugcagcauuccgggcaguugaaggaagauggcucaacccauaagcagcagagcugacuucuuucagguguucuugcccuagaugagcagcaggggugucccuggggccuggagaucaugcccaccugauuucugguggagccaggaacuugggcagccacaaguugcucucugagaaccccacaaauccaagacuaguccuuaagagaggguggccucuccagagacgugugcagcugcuggacacaauugggcucuggugacugguccuguuuaaaugggcagauuuuucuuuuuguugucauagagaagcuaauuucuuauuacuugucaacuauuuccgucuuaaaaccaaguaagaaacuagaagcuuucucgcuaagaucaggcacgaggcaaggagucccacucaccacuccuauucgcugucguacuggaaguacuagcuauagugcaguaagacaagaagagggaauaaaggaaggaagaaauaaaacugucuuuguuugcagaugacaugaucgucuauguagaaaauucugagaacuaacaaaagaacuuguagaauaaugaguggugagagagagcaggguaugggccauacacgccgucagcugcuuuccuguguaccagcaacaagcagagggaauuugaaaucaacacccaguacuauuuacauuagcaccaaaaaacaguguagacacagagaccgguacagguuaugugugaggaaaucaccagaccugaugaaagaaaucaaagccguaaaucaaugcagcggcauucuauguucacggguaggaggagucaauauauuaucaguucuccccagagggucugugcagucccagucagaaucccagcaaguuauauuuguggauaucaacagauucuaaaguuuauaugggaaggcaaaagauggcaauggccagcacaacaccagugaacaacaccggaaaacugacacuccccgaccucaagacuuagcguaaaaccacagugaucaagguggugcgcuguugauggaagaauggacgaacaggucuguggaacaggucagagagccacgagauagacccacacagauauacucggcugaucguggaccgcagagcaaaggcagcucagaggaaaacggucuucucagcaaauggugcuggaacagcggaacagccacaggggaaaaaucuagacacagaccuuacaccuuccucaaaaaucaacucagaguggaucacauaccugaguguaaagcacaaaacuuuaaaacuccuagaagauagcggcggaaauaucuagcugacucucaauuaggcagugacuuuuaacguacaacaccaaaggcacagucugaaagaauugaugagauggaccucguuagaguuggaaauggcugcucugcgaaggaaacuguugagaauaaaaggagaagccccaaauggagaaaauauuuuucaccgucaugcaaaagacauaucugauaagggcuguuauccaaauuauacaaagaacucuucaaacucagugguaaggaaacagaccacccaauuaaaaaaugggugagcucugaacaggcgccucaccaaagcagacacgcgggugacggagaagcacgugcggagaugcucagcauugaaaaugggugagcucugaacaggugccucaccaaagcagacacgugggugacggagaagcacaugaggagaugcucagcauugaaaaugggugagcucugaacaggugccucaccaaagcagacacgugggugaaggagaagcacaugaggagaugcucagcauugaaaaugggugagcucugaacaggugccucaccaaagcagacacgugggugacggagaagcacgugaggagaugcucagcauugaaaaugggugagcucugaacaggcgccucaccaaagcagacgcaggaagggggagagcagggagacgccaggcucccuguaacaaucaucucuccugguaacugaugaagugaggacugcucuucagcaugagccgucaugagggacccacccccauggcccaaaccccuccucucagguccugcuuccaaucguggggaucaguugucaaccugagauuuggaggggucgggaaccacacaguaacaguguccuuccaugggugaauggauaaaagaugguauguccauucacucaaauacuguucugagcuaaaaagaaaugagcuaccaagcugugaaaagacguggaagaaucuuaaauauauauugcacagugaaagaggacagucugcaaaggcgguguacugugggauuucuccuccgugguauucuggaaaaggcagaacuguggacacaguaaaaagaucggugguugccagggauggacaagagggaugcgcaggcggacccagaggauuuuuggggaaugaaccuacucuucacgcggccgugaugguggacacgcagucgcacgcagcaguggaccgacugcacgcggccgugaugguggacgcgcggucgcacgcagcagugaaccgacugcacgcggccgugaugguggacgcgcggucgcacagggacugcagacaugcguucgucuaaacccgagaauguaagacaugacaagugagcccacguguccacuguggacuuggguucaucaguuguaaugaauggacugcagucgugcacggugcaggggaaucugccugggggcugaaggguagaugagaacucucauuucuccucaguuuuccuguaaaccuauaauugcuugaaaaaagaauaucuguaaauuuaaaacaaaaauuagcaaguaagaugaggcuagagagagcugucccaggggucagauugagacaaaaugcaguuggggccagcuuccuccugagucagccucacugacugcuuggagaagagagggaccacgcugagcgucaggaggcagcgccgcggcgggucuacgaggcacaucuuucaccagccuuuccauuagaggcaccugagcagcccuccaucauuucacgugugcauggucaggcccuuguggggggcucacaggacuugugugacugccaguugccgaaagaaggaagcaggucccuugucaugaccagagagaccccaggugcgauggcugucacauccugcugaccuucccagccugagccagcucgggccagggugaggacaagggcugaugggggcugaagggcacagagcaccccuggggaggcgugugggccugggggacacaccugagcugucccuguugcugcucucuggaugagaaccugggggcccagcuggugcaggcacgaauguuccagcacauuugugaggaugagcugggaggccuugagcaaggacaccaucagugccugcgcagagguccccugggacugacaagcucgucggggaacagaagcagcgcuuugaauuuuaaauugguuaaauuccuuuuccugucacagucucagcugcucccuguuuccuuagagagccagggaguuuaguguccucucaucuccaugcucugccaauuuuacugccuuuccguauuuccucaccaugaauagaacugauuuuauggugcguaagccauuuuuaauguagccucucaucacaagguggagaagugagggggauugugccucuccagaccauaguacaugcgucccuucuguuuuuaagcauuugggccaagacugccuuugcagauuccugaagugccugggaugaguguuuaucgugugcaggguccgcucuggggcccgaagaaggcugacacgcugcucauccaucucuugaaggagcucauagugcaguaugucaacccaaaauacuccaaagcguccgaaucuaguuuaaagagagcuuauucaagugcaagguucuuccaggacggccaccagggaagcacagauuccaaagaauggaagucaguguuccgaagcguggaaguuccggaucauucauguagacaaguuuagggaagcuuagcagaucucagcauccuucugcgagaggcuuaaugcaucauuagaaagaucggauucgaugcgguggccuuuaucuuuccgggaagguugauuuggcauucgcacugaagauguagcaggcaucuugugccaucuggucuguaggugcaggacagugaaagaggcagugaauccaucacaaagaucggugacuggaagugggagaggugugguguuuggucucuccuaguuauuuacggaacaagagcuaagaggaagagagagucgcggacacgcucccagcuucggccuccggggcuuaacuuuuucccccuggcauaauaaacugagaggguccugacauuuuauuuucuuuuacaaguaggagugauaggacacaccuuuggaauugaguuuauguuuggaaucauuggggucccagagagagagagaggcccaagacuaugugggaagcuggucuccuuucccagaccugccgcagacgacguagagaguuaagcucuggccucucaauugcuuccuuauuccaaauuucucggucuguucaucuggugugccccuggggaacuccugggaguugggggcuguaauggcguggagagagcucugggcuuggggacuuggccucgaggugcuguguguccaggcuagcuuuucucuagccccaggacguggugacugaaauauuucagcggggaggcaccugaaugcugcuggcacagcucccuggaccucucaggugagcuccauggcugcgcccagccaggcaccugcugcgggccgaaggcagggcagggaaauccaagaggagggcauuugccuccugacauguggaggugcuuuugaugcagugaggcgcaucggggcagccagguggcauuuccugcacccacuuggugcuggagucugucugccugcccaggugcuuuuaaccccaucccugccccucuguuggguaguguuuucuucacccuucugcugggccccagaaggacagcuuuuuggacugguugggagcuuccuggcagcgggugccaugggaaccaugaguccgucugcaccugcugacccagcugccugccugugugccccuccgacggugguggcuguguugugcaccuuccuuguguguagacaggauccugggggaggccguuggcucgagccuggggugcagagagcacuccuuggacugucucugacaugcguguaaaaauaacugcauuuguuuuucugaucucugggcagaagcucgagccugcguguccagcugugucugucuugccaccuugcucucgucagggagaccaucuuuguuagacaggcagccuccagagggaugggaucgugugugugcucucuccucaugacgggaggcaccugggguuccuguccugcugccucgugugugacuggacucugagaagcgcguguuccucgcguccucgucacuggcaggugacggauucagacccacggcaggaggggcgcugccuagcaggagccguguggacaggagccgccgugagccugcuggguggcuuggccugcucgugccuguccacauucacagucccgcggagacagaccuuuuacucuucuauaccugccacagcacauucagauguccacaggcaaaaaccugggcuuucccucuuccaggcgucuuguucuuucacucccucccugcccccuggccugccugguguuggccugcugcacaugugagcugccuggcgguggguuagcccugguggccccagcucccccgggauccugcgggccccucauggaaugcgccugcccggucccugccccuuccagcuggcucugggacuggaaggaauuuccgaucagagagcugccugcccacaaacccaauuuuguccucgugguggggucgugcaccaccuccacucugcccaguuggucagcgccagcagcacuccccaucuccucaagguccagaugcccugaagccuugggaaggucugugucccccucuggcuuuucuccuccucccugugguccgugugccugacugccgcgugggaagccugaaggugugggagcagagagacugcagugugagcugaagauggggccuugugcuccuggggaggcgugguguggccugacgggcuugaggguggccgaaugaaccuucugagggcaggucccagcagccaccuguccuguccccagggugagaagggcagagggagccgguuucagccccucuguguccccgccaggaucccugcaauggccaaggccccagcugagccuucagcccucuugcagacacaucguguuuucugcuuugccgcucauccuuccauguuacacagccucugguggcgugccugugcccuuugcgaggccucuggguguagggacucccgucagggccuucccucaggcagggcaggucaccuggccucuccugaacggccaucuuccagaagcagccuuccuguucguguucugugcuuuuugugacucccgugcugaugagcgaguguuucaugaacucugaacugccuaggucuuucacgguggucuggccuccuccgcccucucuuucuggcaccagggcugcauuucggggacucuaggcauggauggcccugccagguuucaguagugcuguuugggagaugagagguggcugagcugcugaugacaaaugcgauucagugacagaaaaugcagaauaauuagucugggaccagagaacucuaaagaauguaugcaaaccaggacaauuguccggcuucaugagaaccauguuaauuuagaaauaaucugggagggcgucagcagcuccucaacaggggaugaggccggaccagagcccgaguugaugaguuguaaccgacgacugugauuuaaaaagcguuuuauuuaucgaaugucucucagugucagggccuuucauccauuuguucucaucaugaaguuccgagagguggacacugucuuaaucucucaggugcgagcagaagucucuugcuugaggucacagccgcuggucggagucaguucagaccggcucuggggccauugccagcugcgugccugcguggguagugggguucugaggccccagcaacuccacccuaggcuuucucauuccuagcaggcgucugcuccccugacgcccacagugccggcugcucuugcacguuucccggagugcaggggucuuuggugggcgugagauuguaauugcagguggguuccugcggguuccuccucuccgcagguggguuccuguggguccgcuccucucugcagguggguuccugugggucuccuccucucuugccuuuuuuccccacccuagaccccaggucguuucugcucccucauugcccaccuacaccagguuccugacgucuggaccuuggucuuuccuaccggucgguguggucgggcccgcucccccgugugcagcugcuccuccguggcacagcacgaagcagcuucccaagaggcuguguguccauugcccucaggagaauccccucuggagcaagugugcugggcugucccugcugcccucuccuugccccuugggugcuccaucaggggccccacucuacagccuccugugucuugcuggggcugggugaguugccgcuccuuugugccccucugaucacuucagauuuucguccaucucccccuugucauaaguaggggagggcggggacgucuucucuguggcacucccaugacuagcaaaggcccgugggcucaugccagcccugagcaccucucuucuggaacaagcgggucaggccagcacuguggaagacuguccccaaaguggggucacugagaggcccccuccaggagaguguucagaugucuucaucccacccgcgucugcucuguucuucccugggaacgaggccucggaugugcuucgugacugaacucacaccugacuuggcccgcuggcuuuaucccagguucucaguuguaaucugccguuguuuaaaaugcccuacuggauacauagaagcauugcugaucagcugauuugccuggcagugugagaggggguuauucauucugaggucugugguuucuaaugaagcccgacccauggggacagugucagugagcaccugccuggcggaggcucguggcucacugcaggguugacgacagguguaaagcugcccagcggucacucugcuuccuugcagaaggaaccuacuaagcugcauguuuaaaaacucugagugacagaagaggccgguccccagagaugcuccugggccuccucacacugccuuucagagcugggcugggccuggguugugcuuggucccaaggaaggcuggcggcaucggccugugucgauucuuaguggccauauggugcacaaucauugugccuggccugggcugucaggucagguguccccgcugccccccaggccugaggggggaagauagcuccgcagcugugcacaggaccuccaggcuccugggguccaggcugggggccuccaguggucugguccacaucugcugcccugggguucugcccuuucugugcaugcccgagugccuguguguuuauugaaaauggaauucgaagcugcccuuguuaccauccccuucuagguggagucuucaaccuggggcccuccgaggguugcacucugugggcgucccccguccaugggccgcgcacugagccuugccugugucugcucucggcucccgagacgcucuccuucauccugcccggucuuugcaggaaccuaggccauauggcagaggugccaucccucgcuucacaggagggccgccuggcaggaaguggcagugaggaccgaagccugggucuguccccgaguccacugcuccagcgccccgggcugcagccccaccuguggaaagcagcccauggaagaugaccccucuccaggaggccgccuggccccacucacuuucucaccuguggcgcuguaaacgugaggaggcccaggggccaacuggcugcuuccucagaugccagugcuggcucaacgcuuaaaacagacgcguaagcugacuuucagguaguccguucuccugauuuuaaagcgggacaaaugucaggagucucucuugauauugucuccucaguuuauuuuucagagcugugguaaaugaccccaggaagcccuuagcuggaggugggagcucagucugagcugcaguuucuggagcacucgugcugcuuggugucugggcgccugccucugggugagagggccaguggcucacugcccuguuuggagucgucagaaaccucgagccagccuccugccggugaggugcugccucaccugguggggguuguagcuagaauuggguuugccacagcaggcccucgcucaccugggcagaugagaacucguaaauauucaaaggauaucucagaugcccuguuacagucucauccugaguguacgguggagcucgcucaccaggcugcggagacaucacuacccauuguuuugagcugucgcccgggggacacauggggccagcaugaggaggaaggaugcguggguggcucggcucagggcugcugcuuguguccucuuuguccccaccugggcaucuguccagucaucagaaggggcaccacccccacccaccuugucagcaccugccucguggcgccgcccccacccuuggguccaggaccugcuggagugcaccuggcaacaguggcggugacuugcccugcugcugcugugccacugugggcugcaugacccggggucugacgcaaccuuucuguggcagguccugugucuguaaagugcagcccugacagcagggacuuccuggggucgcugugaggaccggauccuuagugugggccgggagcccagcagggaaggggcccgggaugcagagcaggaaccaccugcaucccugugcccucagccaugcccauguguguccuccgugcucacuggugucuccugcccuggggcuggaaggccgccugcagcuccugcacccuucucaagcuccagggaggcccgcuggcaucacuggccgagccccugcguccuccuucacccggaggugccucuguuguaugugaugucaccgugcuuggcacugagcaaggcuccugaauucagaguuucucccacaagcgccgggcacccagguggaauggcugucuccugacccagaggaggguggggcagggugggccuggcccucccggggugugugagaacccagcaggucugccccuggggaggcguggagccccauacgcuccuugccgagcucagagcgggggcuucgugaccuccucucugccagagucuuccuagccauccugcccucacugcaccccugggcagucugccucuguuggcuggggugggccacaugcaggccggcuguccccucaggcugugggugcagcuguuuccucacuagcccugguagcaggcaggccuucugcccacucaucucccaggucuucuuacucucuguccugggggagccugcucuuccuuucggcacguugggcucuucccaaaucaguuccacgccccgugguaguuccacacccccgugucugugcguuuugcuccugggcgagggucuuuggagcccucgugccccuggagucuuggaagaggccugucugggugggcuugccuccucuccaugucucgacccuuguggguccugcaccgcugcccgauggccugccccuccugccuugcugcucugcgaguugagcaggggcguggcguggccucugaccuguggagagcugggggcucccggcugcaucuguacuggggguacugagagccuucgccuugcuccuggagguguuugcccggcuuccccgucuagaggaggagccugaccuggcuacagggggcuucccaggaagcagaguucuugcccccggggccuaagcccccgccccuugcugccugggcugccuuugcuugugugcagccuugcaggacucugguguauuuggagaagcuaaaaagcccuugccagagcggaaaagggcgcuggcuaauuggcagcuuuauuuauuuauuucuggcuugagugguaaacagcgcugauucuuugcacagcaggaacagauugggaggcauuuaccugacugauuccucaccugcagcaccacgccgccggaggaucuaucgauucagcgccgccugcgaagugcacucugaaacaggcuuaauugccuccgacucgcuuccugguaucgcauguccccgugaguccucgcuugagggcugcugcccuccagcggauugacgccucccaugcgugcccuuggcggggcuggcuccuccugggugcucccuggguggacuggggugcucuccugcuugacagggaaggaaacccuaccgucaccagcucaagcgcaaacagagcccaccgggugucagccgcccucacacacaggaccagggccucaccagcgcccucucuccguccugcaccccagcccaguuucgcuugcugggagcccucccgcaaugucuccaagcuguagcgugcaguuucaucucagucccugagcuggcugagcuccccugcugcuuuuuuuuuuuuuuuugagauggagucucgcucugucgcccaggcuggagagcaguggcccgaucucggcucacugcaagcuccgcuuuccggguucaugccauucuccugccucucagccucccgaguagcugagacuacaggcgcccaccaccacgccuggcuaauuuguuguauuuuuaguagagaugggguuucaccacauuagccaggauggucucaaucuccugaccucgugauccaccugccuuggccucccaaagugcugggauuacaggugugagccacugcgcccggcuccccugcugcuuuuuaagccagacucagcagaagggaggcaggugagguaccggucgccuugauaauacacuucucuaccagggcaggaugggcagacggugacggggaagcucaccugggaggggcgcuggguggacggcggccgucaccacccacacugacgccauggccugcacaugugcagcucuggacagauccugcgccuugacuucccagcugcgccugggggugagcuuuagcaacccuucacccgugcaccugcacagguggcagucguggcucuggcacuggggcugacuugccagcugcuuggaccaaggcugcauccuuccugccugagucucaccugccuggagcaggccagcgucaacucccugguuugugauucugggaccuggugauuggcuguuuuuuuuuuugaaacagagucucgcucugucgcccaggcuggagugaaguggccugauuuuggcucauggcaaccuccgccucccggguucaagugauuccccugccucagccucccgaguagcugggaccuggcugauuuuguauuuuuaguaguaacgggguuuguccguguuaggcuggucucgaacucccaaccucaggugaucugccugccucggccuacuaaacuuuuaggauuacaagcgugaaccacugcacccagccagggauuggcuguuuuaaguaacaguuaucaaggugcuagauaauauuuuaagacacuuugagguaugagauuaggcaaggcacacgagguggacaggucugacgcgggcagucugagcauuucuccagcccccgcggguuuccucugucccagcccucuggccacaugcgggguggccacugcuccgaccucucuuggugauggcuuuucuguggaugacaugagacaguggcaguucugcuugucccuccagacaagccaggaagacacuuuuaaaacucaaggccuuuucccaagaguuccucugucccuccagucucccccuccccaccccagaagcuacuuuuaacacccagggucuuuuccccagugucuuggugcgucuuggcucucuagcccuucugugcgccuuugccggucccucagguguccacguguccccacaucuggcugcugcacgggucuguguuccugcugugccagccccugcccggugcuggagaggguggagagcgaggcagacacaccucaccgucuggagggacagugagacagaccucacaggccugcgagggaggugggacaucaucaggcucguagaaaggugugaccuuucccuccccacccaacccucgaggacuccuggcccccaggcucuagugcuggaggcugaguuuggccaccuuggcucugggcccaagcggccuccugcuggcaacauuuccaggaugccgugaucugcagcauaguccugccccacucccucccaggagcccagaggccuguuauucugaggucugugguuucuaaugaagccugacccauggggacagugucagugagcaccugccuggugguacaccucuggccaccgggacucuguuaacgacccucccgugggggcugugaggucgugccugccacugcccgggaggcuccagcuggaccgaguguguguggcguauccgcagccucccucaucccugccuguccccacggugccuggcaggugcugggggccuggugcagagccucgcucugacgcugaacagagguugggagaggcggaggagccgcaucugggcuuguccucuuggcagcacccagcgccuacaccucacauggaaauggggcucaccagugaguggagacucagaucgugaggccucaggcgggaagggccccagagccaccugguccagcucguccuggugaaugcuguggcggggcgccugcccugggagccugcgccgggaguguccuugcggcuggggcuggugugccucugcaggagcccugccgucaccgugcgacuccacuugggcccaucucccucgaguccaccugugcugugauggcagccgccugucuuccuugcugggccuccccacgucaggucugcgccugcccuagagcaggugcaggggugaagaccuuccucgccccgcccuggaggccacaccagccuguugggauccuuuucugaucccugccugcagccuuggaaacggaagcagcuccugaggcccugcugucccccgaguuccucccaugggggcucgcaggcugccucccgccuccugucccgcacccccugucuuucuuggcauauacucuuguuuacaagucucucucgaagugauacucucagauaauuauuauguuucugaaacgccuugguuuuguguuguuggggaaacagagcaacagaagacacaguuccuggcucugaggaagccucuggguggggugggcaagagucagacccgugggggcacggggagucuggcagaaggcagcgcccuggguguggggcuuccgcuugguuccugcacugcgagugccuccucccugugccaggcucuggaagccgugcagauugcaggguggugaccccaaggcugcgcccccaggcucuccaggguguggcggccaguccuaggcuuucucagaagguggugcuggcuguggaggcagaggcugcugcagcgcagccuucguuaucagcugggaggaagugguggcggguguugagcugggucagacuuuaggaggugccauuugcuguaacauacaggcggggcuguugggguaagcacacgccgcagccagucuguaaggaaugguccugaaggacaggcaacuggggaagggagacuguguugggcaaagccagcagguggagagggccaagagagggggagguggccuuaccauagacccaguguggggcgugggacugcaggaggcuccacuucauuuggaggagugaaaaggcaggugccaccugguccccagggagagcuggagggccugaucugaggauggagagcaugaacuggggcuccuccaccuggggcauugcuagggaugccuugggcgcaugcugggaggagguggagugaggaggaugcugagggcggcuuucagggaauaaggagcuccugguuggaugcuuggaaggaggggagaucccagaucagaguccuggaccccagcgaggagccagcaggaaagagccuaggggucuggaacaguugucgugggacguguguggcugccaucugugugagcuguaugggugcagccaggacugugcugagggguccccugcuggacuggcaggcucucccuccucaggagcacucuggguuucggggugcauugucacucagcacagguuacccuccagagcuccagcccucuguccugcagcuguagcccaccugccacuaagucaagggcuuggaggccucugaugucugcaugugggucagagcucgggcacgugcuguccccacagucgggaccugagagcugccuggggucaacuugcacagggccaggaggauguaaagagcugcucuuguggcgucguccagcuuuggccagcuacagagagugugcgccccacgacagcuccugcucaucgcaucugggugggagauggaggacucucaccccguccuaaaccaugugggccacugucagaaagggugggugauggagaugcgauagggaaggcgcugcggagagccauggccugggagcuucucaugucugugaaccaggggcggggcacuccuuuggucacuuguuuuggggggauaauggagagggagaggagggcacugggacaggagaaaugucacaguagaugaaacacagcaggaguccaggcugccuggccugaaccuucuugcuuuguggaaacacggcuucaccaagagcaccgggcagcagucacccugaagcccuggagcucgagcccagccgcuccugcuuguccgcgcaggggucugggaggcagaccgucacguggggcuggaggcuggggcgagcccaggcagcugggcguguggagcuuuuggccuugauggaggacgucucagcuccaggucugcacugcaggucaaggagagagacgggaggcacaaucgcgggguggcuucuccucugagagcaggcugugacccagacggcuguggaaugcuagggacgugucugcgcgugccucacgucaccugugaaaugccugugagauaugacguggcuuuuggagggaugugcuuagcuggugguagccccuuauccggaaggaagacugugagccgagccugcuccuuggcggcaugaaccugccauggaggcagugugugggcagcaguaugugggcaggggcugggagggacggcccuguuccuucacuuccgucaccugccccagggaacuuggacaucgagggccugucaccaacaacagccuugauagugcuugcuggggagaaaaugcuggcccaguguguugaguaguguguaucuugccgcguucaugccacgcacuacggaugcugggcagaccccugugugcucaccgcgcccacacggccaagcucccguggcucugacacaccacucagggcugaccuccugcuucugggagccugauggcagcacagggggagguccugcuggucaggagggaggguucaccugcacagugugccguguagaucugugaccgccaaccacguccugcgugugucaggcucaggccccguucugcagaggagcccccagagcagggcuggcacugugcccuggaugcugccccauccacuccaguggagggucugacaggcuguggcugaguggcaccccuggcagcacagcguccggcauuguggucaggaguggccggcuggcggcuugggaugagugucgggugcacaggguggaggguggguaaggggcacugagcuggccugaugggcuggagccuccuagggcaguuggguggccugauccucuccuguccugccccaugcugagggacacuagggaacauuuggggguguacuugaggggccauugcugugcaagggacuggggccagggaugcugagugucuggcaguuguugggauguuuguggauacaagugaguugcuuugcgccaaaggccaguggggcccuguggauacacacacuucaugguugggugcuuccugcugcuguccucucccuggcagggcuucucucuucucuuaccccuguguuaguucacucucacagugcuagugaagacauacccgagacucggugauuuauaaaggaaaaagguuuaauuaacucacaguuuaucauggcuggggaggccucaggaaaaugacaaucauaguggaaggggaagcaaacacguccuucuuuacauggugacaggaaggagaagugccgagcaaaagggggaaaagucccuuauaaaacagucaccucucucgagagcucacuaucacgugagcagcaguauggggguaacugccccugugauucacucaccucccaugacaugugggcauuauggaaacuacaguuucagaugagauuuggguggggacacagucagaccauaucauaucaugccuccuccuugugaaugggcagcugccugucuguagagaccacgaccauguggguggccucuguuuguggguuucucccagccucugugccguccgcaccagcagugcuuguggagcuggacugccuguuaguuugcacagggguugacuuggcuugggaaggugcccuugggaauggggugcagcuucccugcagagccuugcuccucccugacgguggcccccagggcccgcuagacuguucaggaaggaggggccuggggaacguggauguugcaggagacucuuagcugcuucuggucuuuccugcccgcuuuggcugccugccuggcugccucugccaggccuaucucuagaaaaggcuguguucccagcguuagagccuggaucccucuccugcugcauugggagcuccccaaggucggguuuccuugucuucggguggugcccagugcugugccaugcuggguguuugcugugggccuucacuuguucauugcaaauacuucuuugucuccacuguccucuuuaccaagggcacacuucaggaucuccugggacuuugugcagcaccgcccaggccugcagaggcagggugcagaccaccucguacuuggugaugugccugccuccuuggcuaaggcccucucacuaacucugggacauccagacgccuuccuccccguugggucugguggccuguccugcuucuuccucaggcuucuucucugguuuuucugcuccaguccgauggaccugggcccccugcaacaguaugacacauggccuguuacugcuuuuccgcugaccgccaccuccugcagcccuguguacacacaggagccccccccccccccaacccucuggccugccacguguggguaccugccuuauccaggcccugcccaccuggggucuugcuggggacaccucgguuucccugcccuggcauucaucgucugcgcuggcucucugggggcuccccaguccucccuggcaaggcucuugucucuuagaggacagaggcuccuugucgcucccguucaggaagcguuuguucaacaccugcugugugcagcccacuuuaggugcuucaggaauaugagaugagucaggccugagucuuguucguccucccggcacuuggcacacacacagccgccugcccuccagcugcacccacgcacuccgcucccugggccuggcucucgcucccuucugugcugggaaggggcacaagaggauccuggagcuggggccacugggagcagcagccaacacgucaguguggacagugagguccugcucacgcccuucagcuuuuucuguggucaccuuggcccuuauuuaguguugaggaaacagagggauauucggguuagggagugugguuaaguggugggcaguggggcugggccccauucccacugagccuuauccccccuccaccgucuccggcagcgcagccgcauucuguguuuaggugguggggugcuggcaggagagggugugggccuggggcaggaggaaggggaagugggacagcccgcccugcucugagagcuucuucccgcagggcccgccaccguuccccuccugauggcagcaccucagugcguucccucugcuccgagcgcuccaugcaggucaugcgcggcagguccuucuguuuggccaggaauaguccugaccuugggggcagggccguggcuucccuggauguggccaugcgggaaccaugcagacugaguguccacaggcccggcauugacacgccauguggagccucuauccagccuccugugaccggggaacacgcggggacccuguccagcgccuccucugaucccggaacacacggggacccuguccagcgccuccucugaccccggaacaugcggggacccuguccagcgccuccucugaccccggaacacguggggacccuguccagccuccucugaccccggaacacgcggggacccuguccagcaccuccucugaccccagaacacguggggacccuguccaccgccuccucugaccccggaacacgcggggacccuguccagugccuccucugaccccggaacacguggggacccuguccagccuccucugaccccggaacacgcggggacccuguccagcgccuccucugacccuggaacacguggggacccuguccagcgccuccucugaccccggaacaugcgggaauugcugggaaggguccugagccagcgccccguggugugaacguggccucauguccuccugcgggagugcuuccgcagugugccaguggugggccccggcuucugggggagccuugggucgcggggcggggauacagacugagcuggcgccuccagcuguucgggcucugaugcaggucucccaggcgcucugcucuucucugcugcacuggcccgucacuguuucuacccugggaacagauucuuccggaagguucccugcugcugcagcggugcucaccggaaggcggggcuucgaggcccuuguguuugcaaagcagauucuuaccgagaucccagaacuaccugugggccucaaaagaugggucugacaagugucuugugugaagggccagaacggacucuuugggguuugccgggcagguggucucugucgaagacgcugaacucugccaucgugcugugagagcggcagcggcgauucguauuugauucuggguggcugugcuccaucaaaacuuuguuaaaaaaacaaaaguuguuuacaaaaacaggcugugggugggauuuggccacaggcuguaguuguuggacccuguuaagaaaccaccguucaagucguagccaugcucaucuucaugaagauccuucugccacgugacgucggcuugggccuugcugcagggaggugacccgcaagauugaucccggcagccaggcuuucauuucucgcaauugucucuuucaggaaagaugcccuaggaccauacacuuuguggccuuaaggaggauggcguccucugguguuggccccggcugggcggugcugcagggugggagcugugcucuguguagggaaggcccccugguucccugcucagaccgugggcuggcucagggcucucccgcccgagguguguugagauggccuuugggaugagucauuaccauccggccauuugcccuuuugucuuucucaugugucuggcauguucuucugggaacuuuucauuuugacauaauguuacacugacaggaaaguugcagaagucguggagaauguuucgacgcacccuccgccagcuuucccgaggguaacgucuugugagcccguguacaguuaucagaagcuguaaggccugggugcagcaggcgcggguccugacugcguucaggucuugccggcucucccacugagcuccuuuuucugugccaggaucuggccugggauccccauggcguuugguggcccuguccugcccugcacucugggacaggagagaaucugcuccucggucucuccugucgucgugaccccgccucuucgagagcacgggcugguguuuuguggauguuccucaguuggagcgagucugauguuauacaugauuagguugaagcuaugcauuuuuggacagaaaaucuuaaaagggaugucaugucccucugggugugugaugucggggugugcgacaucaccauguucuguugcggguguggucacuccggucaccuggcgaaggccucccuaaaugcauggcugcggcuuuuguucugauaauaaguaucuuggggaagaugcuuugagaauaugcaaauauccuauuuauuuuauuuuauuuuuuugagauagagucucgcucuguugcccaggcuggagugcagugguguaaucuuggcucacugcaaccucugcuucccgaauucaagcaauucuccugccucggccucccaaguagcugggaccacaggcgccugccaccacgccuggcuaauuuuuguauuuuuaguagagaggggguuucgccauguuagucgggcuggucuugaacuccugaccucaggugauccacccaccucagccucccaaagcgcugggauuacagcugugagccaccgugcccagcccccauuucuuacaaaaacuucuccuccuaguucaagcaucuauuggugcaucucagcugcggggcuugucaccauggccccagggcgguuuucuguccgcccgucucuuccguguuuccugagugggacgcuuugcugagggaggcucugccccucguccccguuuccugagugggacgcuuugcugagggaggcucugccccucguccccguuuccugagugggacgcuuugcugagggaggcucugccccucgucgaguagguuauuugugucaguugcuuccuucucuguuuuacuucacggccgugacccagugcucugcggauucgguucauucacgguauuucagccuuggucacugggagcucucacaguugggcucucgugcccugugauuugcccucaucuuuuuuuaaagccuuuuuuuuuuuucaaacuaucuggcacugcaggaugcucuaaacuuagauguuuuuccugcccuuuuccugcaguccgccacuuucccagugagcccuguuuccucuuguugccgagugcugcuuagagaugagauguggguguggggugcugccugcuccgggugugucagggccccagggccccucgguggacacccugacacuggcuccauccagcaccccugggcuguccucgccuccugugcugucuccuuggucuugagaagcccaggugucagcacacaccauguuuuacuuacccauccaguccucacgugcgcacagggucuuucuggaauugcuaauccauggcucugugaggagagguugacuugcgagggugcagugucuguggacaggccguucuguccuuggccuaccguucccaguggaaguggcguuuucucagcaccgugggugccguuguguuucccacugccugguguuguguucuuuguuugugguucccuuagguuuaccgcuuagagcugguguuucauuuugagucuuuuucauucugguugauuaaaaaaaacugucuauacagccucauuugcccuucugcugugcagcugcgcauuuucacaugccuggggcugacuugcggccccaccaccccagacuccccucccuggccaccccagcaugcuuucugucuggugauuuugccuuuuccagaacgucauacaaauauggcaucuuuggcucauggaggugcauuugggacucaccgcguggcugugugaaucgcagcgcugcuuuucguugcugagugaugcuccaggcacggcugcucugggacuuguuuauucguucacugguugaaggacaucuguauuguuucuggguuuggugaaauggaguaaagcugcuggaaauguuggcuuuguaugaucuaaacucuuacuuuuccuugagcacauacuuaggagugggacugcuggauccuggcauccuuuuaacuucagaagacauugccuugugggucuccacagcgggaagcauccggugugugcguucgcggugugugcguuugcugugugugcagguccacuccgcacaggccugcuccugcugggccacgccaggguuuugggcuuagcugcccccacagggcugugugggcuguguguugcguuuuccagcgugcggcugcuggccccaaccuggcgucagacaguugcuguggugcuuucugcagcccccagccguguuggcuugcacagcccucuggacuuguggucaucauggaguuguagccccuuuuccccaccugauuucccacguaucgggaucaaaucuaagcugguuucguuuugcuuccucucaagucuuuugucuuuccucccuuccuccuuuuucauugaucucuguucuccggugacuuuagggaaagacuguaccucauucauuccgaggcacgcuccuugacuagagcagagagcaagggcugagcagccacggucucgaaagcuccuugccgccugggaggcuuccacgccugggacugggggcugggcagccagcgugcagagguggaggggugcauggaggcgccugcgggcucugaggccuggcuucccgagccccucuagucuucaucugugggacgaucacacagaccgcaugguguggggggagcgaggggcgggcacaguggacgcucggugugugugcuccuccucucucccuguuucuucuuuguuccucuugucuuuaauuuacuuuucgucggaggacuuggccgcagcgugcccuguggacuugagaccgaagcucucuucugcucuuuguacccugcugcuuccugauccguucuuccuccccucacuuguguacaggacucgagggagggauggggugagagcagagcaagccagggauguagugagcuuuguuuggacaggaaggguuugcccgcgccgucaucuccucggcucugcugggaaacuguguuugagggagaugguggggucugagcgcagacggcuguuguccugugagaugcagaaagcgcuucuuaugggcgugcaccauggaauucccugcucggaccgcacugggggcaggcggugaguaucgguauagaaguagcuuuuauuaauuggugaagcccgucacagaucugaaagcaucuuaauagucugaaaugauggcucuucagcaagaaaaauuugauuugggacaaaagggagacacuugagacccaaaaugacuuggcuguguugaggaugggaaggaggccuucaucugccgcacgucugagucacuccagaguuuucuccacugccagugugagucagagcgaaucacuguuggguugugacuucagaagaagugaacucugucucaggcuguauuaauagaaguagaugcuucacaggagaggaggugucugugcgagucacagcccugcggggucugauuuccgcuuugggcguggcuucugagccgggaccucgaggcgccaagggaacaggagcagccgggcagcugcucgcuugguugugccugcuguguaccgaggcguggggcauggcggcacggcugugagcgcacaguccagccacagaaggaggcuucaagaaucuuugcggugcugccaucuggacaucugugucauugaagucacaggaggaggcuucaagaaucuucgaggugcugccaucuggacaucugugucauuuugauaacgugugugagaucaguggaggggagccuuaggaaaaucggcugugguuuaauaaacugaacuucccgcugcuuugagccggagccuccuggacuggaaaggcgugggccucauggccaccuccggccugcgcagcugggucugcacucucacaacugugcugagcccacgcuugugcccuuacuaguggccugaccucugcgcuguggagaaggguggauauugucgccaacucucagacuucuuguguguguucagaaaguacccaaacggauucaaaggaauaauuagcguauccuguaagauaugaaucuuaauuccuaaauuacauauuuagcagauuguccaaaauagcacuuguaauggcaacauucaauuaguuuaaaaaauguauauuauugcaacacucgccaugaguuuuauuuagagguuucuaaauauaaugcuauaaaaacacagaaguguuuaaaacuauuuagacccacgcagccgcagugagcucuugcuaaacuuccuacguuaaccagcucuugacaaucuuggauuguggggaagucuucugauguagucccuaaagcugacacgccagagcaucucgaggcuguugggggcuguugcugggauccugaggccgcacaccucccugcuaugaguucugacguuuacaaacauaggaagugaguugaaaugacagaguccuuggggccccacucuugaguguccuccugggguuggcgggcguggggcucccgcugugccggguucggcuccuguguugccguguucccugcggcugcugcagccgcuucucgucaccugauugugugugcgccuccagugcucucaugggcugcuuaaggcagggacuauccauguggccugaagaagaagccgaggcccggggaaguugcauguaauugacaccagagggcuggccucauuucaggaggagcagagcucggguuuuccgucuaggugggagaugggauggugaugggcccacaggcagggccuguccucugaugggaauccgaagugggugcggaggacccagagcugagggugagcagcucugagcugcagagcgggugcggggaggcugugugcgcagcacagggaggcgucuggaauggccgggugggggucuggaacccauacuugguagcgccuguuuggucugucccgugcucuuccugcgagcccucgcgggggcccugcacuuccccaggagcugccucagagaugugccagugaagaagggauggaacugaucguggaucgggccggcuccuggaggccaccugggcccauuucugacagccgcuccugccgcgucccuagcucagaaggagcucgaggcugagccguuuccccagggcugcugccuuuguuucucccauucugaaaggagaugaaaguuucuacugaccuuagagagaaagccagagugaaacccccucugccaaccccuggcucccugugaaaagccuuccugguaaucaaguguuuacagaggaaggcuuuguucagacccuuucuggggcucuguauguuuaaacaaagagcuuuuuagaccuaaacacagauguucauuugaaaaugaaaaaucaaauuaagcagaaccagccuuugaaaguuaaugcccuauagcaaguaaaacaaagggagaaaaacacuguguuguaaauuuuacuuaaauaacuuuuuauuuuaaauaaaguuuuaaacuaaaaaaguauaauuugaaagccacucaucuuccucucuguccuccaguagaacaucugugcugauucugacgcggaugaaugacaugaauuaaaccaaaaccgucggagcgcucuuuuuaccauaauuacaccuuguucguuugugagacacaauguggggaugaaaugccaauuaagccugcuaugauaaugagguggggccugaauagugaucagcggacaugaaucccaccggaauucauuugcuacagcccccaaguuuguucucuucugaugggaauguuaucguacauaaugaaaaucuuuagugcuccuuguauuuaaaaaugauccauuuugggguuuuuggucagcaaguuuuaaaacagguguuuuccgagcaccuggauggguuucauguccccacugagcauccuguugguggggggugggggggugccggugucuccuguccccugccuggacucuucuguggagagcuauggugucacagcccgggacacaguccagcgacaugugccaggcaccauccccaugggugcccuugcaggucuggguggcagcugagaaaccauuuucacccaucacuguguccaagcauuuaccaucuccgacccucaaauacccucuaauguuuugaaacauaggaagugcguugaaauuauugaaagcacugugaaggaaaugcuuuggguguuguggaaugacagggugggaaagacgucacugggggccaggcagggccuuaccaggaggcagcaucugagcagaggccugagggcagccgggggcugggcaggggugaccaagcgggacagacgagcugcugggacgccagcagggcuggcacagugcggggaucacagcaugauugcagcgggcagcuguugaagacuggaagcgcggcaguggcaugguuaccucacacagucggaagagcgaccuggagaaagaggccuucgggauggggagcaggaagugugucggugcgugaggaugcagggguccagcgaagaggcuguggguaguucagggggagguggugggguggcaaagaccacccugcagugaccacauaauccucgagggccagcccccucugccccagggcugcuguggcuugggcugcagccucuggacugggcuuccugccaccggaugcuccggcagcgagaccucaccaacucugacugucccgccccacacacuccuggcuuaccgccugcagggaaggugcuugcgacuccucuguguugcuagggauguuggcccugccuccuuccacgccucccggugcgcugccauccucaggcccuccggcugucccaggcagccaggugcugagugaugcuguaugugggugcccuuccuguccuugggagccaggcuguggggccgggcccugugagaacacacggcgucaggagccuccuggcucuuucacacuagacuacgcuccucuaggggacugggccagcugcguucuggacccccgggccccugcccaggucugcacucagcugucucucagccagggccaggagggucuccaucacgaguccuccugggggcugaagggugacuggcucccagcugagagagccggcugcagcauggacucaugacagcuggggaggggcagcccugcagaagggacugaauggugacuuuccucucucagguuucguggaggcccuacagcccaugcgggacaacacguuccagugcagcugcaggcgucuuuugcgggaugggccgagagugugacgggcuaugcuagccugggucuggugggcuggagaggagggaggcggucuccuaggagggauuugugccccuggccugccuucuccccccaccccugggagaguggagcucacguguccuccuugguguuaggcaggguuggagagggagccucggagagccugcuggcuuggcacagguuuccaggagcgcaugugggaagggcaggguggggccgggccugggaaagggggagagugagugaccauggccgucuccagggaugggcauguauauccgauagagaaggaagggcaggguggggccgggccugggaaguggggagugugagugaccauggccgucuccagggauggacauguggauccgauagagaagcggccugccgugcucgcaccuuucacgcaaggcaccgacgcaguggaggggugcugccgaugugccagcacuaagggcccaauuccuagccuaggcguaauggggcaagggcccugugcugggggugggaggcgggacugugugcugggcaggguggaggggcggggcugugugauggcuggcgcugugugugauagauaggucugggggguggggcuucgugcugggcagaauggaggggcggggccauguguggggcaggggcggggccauauguggggcaggggcaggggcagggcugagguguuggugcccuuugguuguggggccgcagcuggauagggcucugggacugugcuccagaagguguugcuagguggcaucugugacgaugggggccuuuccugcugcccuacccuggagcuggggagcggggugggugaggagcguugaggaggagagagcuggagcuggugguacugggguuuuggcugggcgucucacgugccuggacuuucuggucucaucuggaagguggucucuuacuggaccgugcgggggugaggagacaggccgaggccaccagguaaagcagggcuguggugagagaggccccauuuucccucagaaccuucacagugcguggcuggccuuggcaaggcugcauggcuggucccagggcuuccuggccucguuacuuccuggcuucagggcaguguaggagcagccacaaagcagacauuuggguuguccuuuaugaaugccucgggugaugauccacgcucccugccuugccccagcgcaggcugugcccgcccacccucccguggagcccacgcuuugcucugccugcugcugccaggccagcagagaccgccccguagggcacugcgguuucugcggccuguucugcccugaguggccuuccuccccugcucuuagcugggcccccucacuccaccucgcugcuggcuuuguugccuuucaggcugugaccaccugaagccagcucguguguuagugcccuuuguuaguaaccaaccccuugucggcagagaccuucccuuucugcucacuggaauauccccaagcaggacggugcgguguuuguggccucagagagugaggcucucccgggcugcagaggcacagccaguuucuucccggcagaccucuuuucagaacagccccucacugcgguguccggccccuggggaagccgggcucugacugggugggucagcccucaggcugugccaggaaucccaucuccaggcgggcugugcguaguucccuucguguuuuaacauuuaggaggugagcgguuuccuucccugagcuccggaaagaguccccagggcuugcggggggaccuacccugcauugcacguuggaaggagaggcagcugcaggcugagcccacauggcugugcacggccuggcgugggagcugcagugauuuaugugaccugugcucagauaauuaaagugggauuuggcagugaggucuuucauggcaaaggcguuagggaugucacaaugaggcauguaaguauaaaacaguuauguuuucaaaggcguuagggaugucacaaugaggcauguaaguauaaaacaguuauguuuucagguuaagaauuuaacgaggaguaaauucauuuaaaccgaagagcuggcuuaaggggagcuuucguggaagaucuguaguugcuggcauuucauuccuucucauuugagcccagccugucucugguggcagagcgcguguuccgaguguccaggugccgcagccgcccccuguaggcaccagcguguuugacaugcgggucagggaucugacgcaacaggccgccuccacaugccagacugcgucccccuuggccugcuauugcgccgccgugacggcucuccuucgcggaggggcggggcugugggggcugucuuccuguguuuucucuccggggccucaucugccuucaggagccugugcagugccacucgggcugagcagccuccgccagugcacaggggacuccgggcuugccucuguggaggaguuugccgcuaucugcucugccuuuguccugguuccccaaauggaggcccagccugccgugguucuaauccagguuucuggucaucaaagcagcaugccuuuaauaacagauauggccuguugugcaguuggcccggagagcucugaucauuacuuaucugccacgagaugcuuuugcucaaggcaggcugcugaggagcacacuccuuaccuucauugaaugauuuccagacaccggcugcauauuugauucucugccaugugucugggggccucuuucuccgacguccagcgggguggaguguuguauggcguggcaucagaacugguggucuccccgcauuccuugccuuuucccaccccaucuccagaguccggacaccaccugugagacugucccucugccuggggaugcggagggacuccgugcacagugguucagggggucugcuuaugccacacugcugggaucugggcagggaggaggacagcaccugcccucugaguagccgccucccuggcuccuccucguggccgcucccuccuucuccccugugggaucgagucucaguguucuggcugugcugcccggcuccugagaggccuucgcaggggcucccagggcugccugguggugggcuuugccccagugcuggcccaucugcgguugccccgcccaacaaagagcacgguggucgagagccccgccgcugugcaguggccucgggggcgggugagaucugcugcacugcuguaucgccucacccucuguccucucaggugcucacccacuucuuccaaacagaaacgucaucacuaggcauggcgaugucccaugugccgucuacugagcggcggggcaggcaggcccaggccuucacugagugcaggagcgcagguaugacugugugugcagggcccgucggggcagccauggcuugggcugcgacccggcccucagcguggccggauggacggccucccucuggacacaccaugugggcugagagcugaagcguggucggagcugccccuuuguagggugcaggggcaggggagagagcccguuccaggcagaggcagcagcaagcgcaggggcccugaggugggagaggacgcgcgucuccagcaggcaggcagcguggccaggccugacccagcgcugacccagguguuggcagcaucacggaggcugccuccucugaguuguggagcugauguccugagaggggacagugccaccucugccgaaccuguuuucuccgugugccuuauacaccugaggagaggcccgcuuuaggaguggguaggagaagacgccaucucugggcauugucucuggagugacaaggaugcgucucaugcugaggauggcguggagagugguccugagagugcuggugacgguggagacggugacggccaugauggugcgaggguggcggugaccguggugucacugauggugacaguggugaugguggggacguggugagagugcuggugacgguggugaugguguggagagugguccugagagugcuggugacaguggagauagugacaguggcgaugauggugcgagggugguggagaccguggugucaccgauggugacaguggugauggggauguggugagagugauggugacaguugugauggugacggugguggugauggugacgugagaaugguggugauggugguuauuggugacaguggugaguggugacaguagcagugguggugaguggugacaguagcagugguggugagggugacaguggugauggugacauggugagagugcuagugauggugguggugauggugacgguggugauagugacgguggugaugguggcgguggugauggugauggugacggcggugauggugacgguggugauggugacaguggcgguggugguggugauagugaugguggugauggugacaguggcggugguggugguggcgguggcgacgguggcgguggugacggugacgguggugauggugguuguggugacaguggcaguguuggugaugauggugggugcaguggcaggacuuggcaucuguugagagucugcccugugacuggugccaggaccuagccugcguuuucaccuuauccugugcucucagccucuucugcuggggagacucaguccugagucagacaggaggguccaaggucagcgaggcugugugaucugcccacucccacccauggcagauucagaccuccagucagggucuucccagcugcagagcccccugugugcacuggacugcacuccuccuucuccugccugguauguguuuauccagcaugugucaggcgugggccagcuugggcugugauggugacugagacagcuguggcccugugugcacggagccaacagucuagugggugagcagcauagaagcuguucacuuuggugagcauggagccgguagucugguggguggcagcauagaggcugcucacuuugguaaguugagggaagaagcgucuuuguucuuuacuggcucucaggguccaggugcacagccuccuggauggaggcccuuuaggaauggagccccagucucacgccaggcacccggauggagacccuuuaggaguggagccccagucuccugccacccaccuggauggagacccuuuaggaguggagccccagucucaugccacccaccuggauggagacccuuuaggaguggagccccagucucaugccacccaccuggauggagacccuuuaggaguggagccccagucucaugccacccaccuggauggagacccuuuaggaguggagccccagucucaugccacccaccuggauggagacccuuuaggaguggagccccagucucaugccacccaccugaauggagacccuuuaggaguggagccccagucucgcgccaggcacaguggcuguggcccuuccccccagggcagaccccauagcacaaaagcccgcauccucuuugguguaugaauguucccacaguggaaacuaggguuuuuccagucccuugugacaaaggauuaugaguuuuuucccauugaaggggagcaaguuucugagggugggaaggaagccguugaaaacaaauuggcagcacuccccccauccucuugcugauggggaaagugguuaauuaggugauuuuucucuuccccugacacgugcaaaugaggcuucguuaauaacugcacuguuacagaaaugauacgacuuuaacaccaacgucaaguugucaggcgugucugcagaguggagguggggggcacuggaggccccugcgccccucccgacaggagucaugcuggagccgcgccuccagucgcuggggcuuggccuugggcaacgagcuguuccccucccacccuccaacccccuucagggccagcuuaauuauuuaaaacugaugauaaaaacagaaugagcugccaagaugaagugaugauuugcggccaggaccuggggcuuggguggacgcggcucccacucucccugcuugcugugugcuggcccagugcggccguuuccaaggacgccuuccgguuugcagccagggcccaggacacggacagcaucucugcucucaggugucaggaggccugcagauggugcagggcccgcucagggcuuguccugccaggacgaggcagacgcgccgggugggcagguggguaggguaaagcagaagcaaagcggcaguaccacagagcaaggcaccagcauuguaaugucuggaguguggcacccccuccaggaagcaggugcuucacgcucagaagcgccuggcuguggcaugcuucuuacuaucugucagaaggcucaaggucaaaaggccgugcuuucugccauagaguuucaagaguaaaggagaacgcggagaucuagucagcugggauuccuagcucugcucagaaacaggcugggcuuugagaccuuuuccuccucauuuucccugcuggucuggaacagaaaguacuugcagcugacugcgcuggccgucguaaagcagugugcaccugucucucaaaccucaaugguugccugggauuugcuucucaccuauguccuuauccaucaacagguaguuauuaaaugcccaugucccugagacgguuuugggcuuuguguggcugggggcgaaguguaaggaaugaccucuaccuguaaggagcucacagccagccccuuggcuugagcugugagaaguuugaaaauccaugugcuagguuagcccagaugacaccaagagcauuggugcugguucuucugagucaugccuggggcaucgagggcugggcuggugggaggugacuccucacagucggcagccagucccacuggggauaguuucauggccagaauggccuaccaggggcuccucccugcaggguugagagcucacgccugaggacuguucacaggaagccacggcccgggugcuuccugggucucggguaggaguaccucuucugaaccacgucuaauggguuuuuugaagagaagagaaaugaaucucccagugcugacuucugagauucggcugucucccagcccgaugcgcucacuuccguccacgcucccgccuggccucuggguggcggguuguuaguacaguaaagauugcuagcugucucuuuugcaaaucuaaaaugagauuucauuuuuuuaaauaaaaagaaaaaagugcuugaacauuugcagcugggagauagcacagauuagaaacauuacuuaucucugcugcacaaaagaaggcagcgagagaggaauaaauugcuguugaaugcuaacgaagccaaggcggcaggggcugcgggaaacaacuccuguugaggaacagagcgagcaccugaccugcacccuccacagugggccgggcgccggagugcacagggcaggcggggcuguggguccaggugagacaggcuguggcugcugcauguugaccuggcggucgggguggagucuggucaccaguguuagcggugcguugggggaugcuccuuccuggaccaugggaggcugugcuaccacugcgcuuaggagccucagugaagcucacccucuucagccacgugcacuggggucacuuguguuucugucacccuugccacccaucgugucaggaggccuccguguccaugccagggugcccuccauccccagacauuccggcaccuuccuguuguuuccucuauaagaauucccaccugcccucuuggcuuagcaaauuccagcucagccuuugagguccaguucgaguagcgucuuuucugaccccuuuauuuggcccuccaggggcuuuccuucuguuccuccauuuccccuugggcccaccucuggggacgccgggccuuggugcgugaugccuggcguguggugugagcccugugguguguagaucuucauugccucuggcucaugccgggcagcuaucgggugugguagugcgcucccuugggccuccuggagcaguggcagcaggcggcucuugcaugugccguguccuccgugaccagggcugugcuggauggacgugucugccgugcugugcucccugcccauuuguuugagggggccguccuuagcguagccuuccugacuuguuaaccaggcaagagaccauacacaugauggcuugggugacugcugcugcguacggcaugguuggugggaccccaggcagcaggggagagggacccuggcuauuuggaucucugcggugagugggagggacucuugcccacuuugugucugguugucacaggguuuagggcccgaggucucuuguuccugucuggacugagcaccuggguccccguggcgugugcugcgcaggccucaucuguggacggaggguguuugccaugcgccuucugcgcagaggccuggugugugacuggcgcucuggugcuacggggcuuuggcagaggacggcgcugugcagucagccccaguccuggggccucaaagacucaaggucauuuugaguccuccaaagcaaggugauuccaagugugucuucagagucugaagucgcgggcguccucacugaucuguccucugugccccgagaagacagagcuguguggcauggagccgccgcaugagugauuccgcugccuuccucccgcuggaggugaagcuuccucucaguuccgucuuacuuugauccagugcgacaccgcgcugcugagcgugcccuccccguuggucugggagaccugagugcagaagccuacagcaggggcaccccuucugcuuucccggcccucgucccuugcugaggaacacugcccaggcaugagccucagaaugggcugagucucgaugcaggcgcugcucccaggggucccagacgccucugcagccucaaggccucacugucucccuuccccacucagcaccacucccugcugguccgggcagccccugcugcugcugugugucucuugccucauccccugugccaggggcgugcccuucugcaccuccagaggccuggugcccguggauggccggcuguggcuguggguguccgcaccuccugcugccuggguucucacccucauagcuucucuaggugugagaagcacuuucucauucacugccuggcucccagcuuggguuccuuggcauucucggacccauuguuccucggccccauugcuuucucagugguguggacugagaugaauuggagcagucgccugucugaggccugggcggagugagacccccuccccaggugucccggcucuggcccccacguccucgcugccugcauugugcugcuuuggauuuugggcugguuuugaguccuguccacuuggucuuggcugaggaggccuuagcggucaucuccucuugugugucccggaaacaaggacguugaggccugaguggggugagcgcgugcuugggugccguggggugggguguggcagagccaagaggggugagcgcgugccugggcgccgugggguggggcgugguggagccgaguagggugagccugugccugggugccauggggugugguggagccaggagccuggaggcugcccccuuccccuuucacaucucccgccuugcagcuggugugggggauacccguggugcguuuaucauaaccaugucaacugugguccacugcuugcuuucugugccuggcaggguccccgggugcgcugucauuccuggcaguccuggagggugcccgccuguggguggcagccuggagguacaguggcagaccugcuggccgggggucaccggcuaugaggguggggcccacgccugggccagcguccucugcugucgggcuguaccaugggucugugcccccagccucugcugggcgggguggugguggucguggggcagcugcagccugcccccucccuuaugucuguggcugggccucgugaaggggccugaguugacgaguuugccugagacacaugcaggaagguucucugaggcugagucuggccucguuccuccuguccucugccgaggagcuguagggucucgcuguagcgggggaagcuguccucgaagucuucaauucagaugccccuuggagagcuguuucagugcccgccccgcccugcccaaugcacacacagaauaaaauagaagaguccccuggucccaugaaggcagcuaacaaauucaaagcucuguggaaaagcagcguaggaggagaccuggcuuuugagagugaaagccgaguccgcacugagguucggccaggcucaugugugcccagagccagauugcaggcaugagccccgccacccccagaugugugcaggcgcagagggucagcaccacagcucuuugcgccggaggacugggucuuugugugaguucucccugggaucacagggcccuuuccuccugggagcccuuguguccgacgaggacgaccuuguggcuggcaaguguccuggaggcuggucccucaggacccucccuguccucaucuggaauucaccuuucuucugagcacagccuguguggcgucgugugcucugauggccuuacccagaggccaccuuggccgccggccuugcuuucuccuguuugugggcugcgagcugucauuacgugacugaguccugaucaggccugggggagcccgauucuaacgacccugaggcucaugagggaccccgucucuccugcugugucuccccgcggacccgcgcucuccuuccuucacagaagcaaagcucccuugagggagacaccucgccucucuccuucaggcacccccacccacccuagggcugccggcaagugugcguggaugcacucugcccuuccccuuagagacggcugggguguccggccugcacccacagcugucccuauuguccuugcccuccucuccucacggcuucccugcguuggccccgccggcugagccuugugcgccugugugucccugugccccucucgcaguaggcaggugaugacagcggcucagggaggaagugcugccucgccccacccugcccagcauugcugcuguccaccucgccuccuugcguuuucuguuuagcaacagccacagcacgcacuaucuccccucugguuacgcugcccuucucuuuaacagcgaccgcggcuucagcacugcccaucuccguuugcagccugggagccgcgcuaacccacucaggcugcuuugcaucucuucugcuauuugaaguuaaggguguguggauaaagggaugugugcuuggcuuuuucuuuucuuuucuuuuuuuaucuuuccaaaaacauuuuauuuuaaaauauuucuugcaggcugggcgccguggcucaugccuguaaucccagcacuuugggaggccgaggcggguggaucacgaggucaagagaucgagaccaucccggcuaacauggugaaaccccggcucuacuaaaaauacaaaaaaauguagccaggcgugguggcgggugccuguagucccagcuacuugggaggcugaggcaggagaauggcgugaaccccggaggcggagcuuguagugagcugagauggagccacugcacuccagccuaggcgacagagcgagacucugccucaaaaaaaaauauggggagauauauauauauauauuuacuauuuaaugauugcucaguuugaaaaacuucauuuugcucauguuucacuguaguguauguaguguguauauagagagcugcacaaauuauccaugaacacggcaucaccaucacccggucaggaaacagcgugaucagcugagucccuccugcccccccacuuccuguuccuggaacucccacccaguucccaucgcccugggucacuuuugccguguuuggucucuauguagaugggucaugugguuucguugguuggaguccuucccccuugcugcuuugcaccugcgagcugugcuccugccccggggccuuugcaccugccauccacgcuccugucccggggccuucucaccugccagccccgcuccugccccagggccuuugcacuggccaguccucuuucuggagcacccugucuggauagcagcagccuuccugacuuuccuuccugucuuucacaacuguuaccuccucgugggccuucccugcccaccugugaaacaucaugacugucuguucccugucuugcugucacuuuuucccgucaagcacauuauagacuuugguuuuuugugucuuauuucucauccgucuugucacuugaaggguagcgccuccucagcaguguugugaacagguuccaacacacaggggugcucgggcauccucugucgagagugugggugagugcgugucccguucccgaugugagagcuguggauucugcauccagagggauucugcauccagagggagugcuggccacugggagcccuuuagggacacacuccuccacacugaccaugggugggucccugcucagccuccugggagggcugucccuuguggcuggcguugaggccaccuguucccagcagcucagcaagggcugugaguuugcucauggcugggcgugugcucccagcgggcuccccacucaccagugcuguccucccuggccucugcuuuccuuggcccugcaagcugcacagacgaccgucugcgcccgcguggccugagagcucuguguggaugcuguggcucugagguuccuguccucucccugccuugcugucaugaguucgggagcagcuucuggggguuccgacugccgaccugacaucgucaccugaggcuuuucagcugauggagccucuccuugucuguugccccgugccccacaguggcuuugucugcguuccuggguuccgcguuccgugcuccucuggcugauggagcgcagcuguggacucucccgugcguugcccagccagugccagugugucucauagggguggaugagacggagcugucuugggggccacuuccucuucuagguucgccggaucugcuuuccccacauucugugagcuguguucccacaccuggaaggaaggaggaggagagcgaaggggaugucagcauuuuauuugaauuccuuucugagucugauuacaaaagcaacacacuuugauucagaacacucgagaauguggaggagacagcaaagcugagaagaaagguuucccgucgucccucuucccagggaaagcugcugugacuguuuuggccaggauccuuccuggcauuuuuauauacauggaacauguuuuucuaaugggauuuuaggagaaaauacugcaugcacuauuuacugagucaucuuguuuuguuuaaucuuuugugaacauuuuccauguuaaauauucuuuuaaaacauaacuuuuuggcuauguacugcccucccucugaauuuuuuuuuuuuuuuuuuuuugacacggagucucucugugucccccaggcuggagugcaguggugcuaucuuggcucacugcaacuucugccuccuggguuuaagcgauucuuccgccucagucucccgaguagcugggguuacagguuugugccaccauccccagcuaauuuuuguauauauuuuuuuuuuuguagagacgggguuucaccauauuggccaggcuggucuugaacuccugaccucgugauccacccgccucagccucccaaaguacugggauuacaggugugagccacugcacucggcccaaaugcuuuuauaugcauuaccugguuacccaugaagaaggcccucugaucugcuagaggaagauagaggagcaaaucugugugcccugggguuggacgaugaguuuuuagguauaacacugaaaggaaauccauaagagaaaaaauuugauaaauuugccuuguuaaagacucuugcucuguggaagauacuguuaagaggacgaaaagacaaaccacagaaugggagaaaauauuuacaagucagauauuugacaaauaacugguauccagaauauauaaggccuucuuaaaacucaauaauaggaaaacaggcaaccuaauugaaagaugggcaaaaugucugaaaagacagucacugauauccagagggcaggugugugaggggaggaugcucgggcggggcaugguugaaaacacagucaccgauauccagagggcaggugugugagggaggaugcuuaggcggggcgugguugaaaagacagucaaccgauauccagagggcagaugcgugagggaggaugcuuggguggggcguggucaugcacaccugugauccuagcauuuuaggaggcugaggugggaggauugcuugaaccugggaauuugaggcugcagugagcugugaucacaccacugcacuccagccugggagacagagagagacccugucucagaaauuaaaaaauaaaaagaggaugcucaggaguauuugucuuugggggauugcaaauuaguacaaccaugagacauggccacacacugugggaauggcuaaaaacuguaagaucacugacggcacuaaaugcugguggagacguggagccacaggaacucucacgcacugcugggaggagugcaaaauggugccaccacuuugaggcagcguggcagcuuuuuacaaagccaaacacggucuuaucguaugaccugauggcccugucugugggcucuuaaccacgggaauugaaaauuguguccacacagagaccugaaugugcguguuuauagcagguuuauucauaguuaacuaaaaaccagaagcaccacaacacccuguaacagaggaacagauaaacaaauuaguacauuugugcaauggaauccuguucagugagagaaugggacaagguaucgaucauacaacaacauagaugaaucuuuuuuuuuuuuuuugagauggagucucgcucugucgcccaggcuguagugcaguggcgugaucucugcucacugcaagcuccgccuccuggguucacgccauucuucugccucagccuccagaguagcugggacuacaggcgcccaccacuaagcccggcuaauuuuuuguauuuuuugguagagacgggguuucacccuguuagccaguauggucucgaucuccugaccuugugauccgcccaccucggccucccaaagugcugggaucauaggcgugagcuaccguguccggccagauggaucuugaauguauuuuucuaagugagaaaagccagaccccagccagacaucagcaugaacuccugacuggcucaacacaaguagacagauucagaaggaacugcaggcagaugcgucuguguaugcagggcuggcacauaccuguacugcugcggggcccggaggcaggcacacccagcaacagggagcugaccggggcccagagcagggcuuccaagcacuguucucgguaggaggaccugggcgucuuuggaaagauaccugguuuuaggacugggguaggaaauacacaggaggagccuggagugucuucuaguuccagaaaguaaggaaaugcagaaaacccaaaaggauggggcguguggaugggacacaggagccagaggaaagcauuccuguggcugaaggcgaaacacuugcagcaagaaaaugaaguggagugacuuauaacccgacgcgucaaauaaacgcgggugaaucaggcugaccgaaauaaaugauggcgugacucaauggggcagaugcagcuccucccuccggaaggauugcagauaaaauggauguaguucucugcccucaagagauggaacuuaaucccccuaggguaggccaggcuccgugaccuccuuccaaagaguggaguacccaaaagguaacguugccugccuggaggggccuggugggcagcaccuucccggagcgaugagggccccgcccgggcuccaagggaugauggggacgcugcgucugugguucuuuacagaccuguagcuccaguccagccucaacacacaccugacccugcggggggccugccugggccaguccugcucagaacugccaaguccaugagaaacaaggaaaggcugacaaaugagaggagacucaggagguguggcaacuaauggcacccugauccaacccugggaaggaacaaggacgcugaaggacagacacacuggugcuguccaggcagagucccagguccguucgugacaccguuccagugcuugcacugggaggcuggguuccugggaacucacuguacuguccugacaacuuuucuguacaccuagucguuccaaaaucaaaaucaaaauuuacuuuaaaaaccccugagguaaggaucauugggagguuuugaaguguucaggacgcuugccugaguuccccaaagcaagcgaccgcagaaccagauucaacuggcaguggaccuggccccuccccgagcgccggugacucaguggaccugcuuugucuucuggccuacccuucucucaccuccaccuuagaaccccagggguggugccugcucggcacuagccuuugaggccccuuaccgaccauuuggauguguuuggugaggagucccuggcggugaaugacuucuuccuaaugaaguuaaacacgaccaugccauuccugacaagggaaccugccguuuccugucacucuuccuuguccgccugcccucaaagcuuucguugcauagcugguagcaaaccaacaucacuaggguugguguucccugucccuggccggagcuccuucugcagcucgaaaggucuggggagagcagcccuucagcccacucugaucucauggcagguguguguuagccuggccuuaauuaagccuggccuucgagauggaugucagaacagcaugauuauuggacacuuuguuuuggaagcccguuccuuuagaaggugugcacuuggaagugugauuaaacacgaugcacgugauggggugggccccggggacagguguuggaagugugauuaaacacgaugcacgugauggggugggcguguggggugggccccggggacagguauuggaagugugauuaaacacgaugcacgugaugggugggcgugugcggugggccccagggacagguguuggggcuugguugcuuucccuguguauuagucuguuuucaugcugcugauacauaccugaaacuggaaauacaaaaagguuuaauuggacuuaugguuccacauggcuguggagggcuccgaaucauggugggaggcaaaaggcucuucuuacauggugguagcaagagaaaaugaggaagaagcaaaaguggaaagccuggauaaacccauccgaucucgugagucuuauucacuaucacgagaauagcaugggaaagacgggcccccaugauucaguuaccucccccugggucccucccacagccugugggaauucugggagaugcaauuccaguuaggauuuccacggggacgcagccaaaccauaucaccuuggcuguggccuccacugugccugggacuggccacagagagcugugucuccguggcugccuucuccuugccuguuugcguggucucgaggaagcugcacagcagggcccgagucggccgugugagccgcucucccugucaaagcacacccaucccugccugcuuugaccugaacuuggugaccuucaggccaucaguggaguggggcagaaugaauagccuguccuggcucauggcagccaccgggugaggcgccugcaugcguggcucggaggccuucugcaggcacaacccccaccgugggccuggcagcuugugugggaggcgugcgggucgguggcagagggugagcaccagcccugugugaaccuucacaacuccucuguggacccuggacuuggcuucacugcuggugagaaucuggugugugcuuuggggcacccaggaaauggaguugagggcgucuagguuguacuugagagauggcccggcuccgucgguguccuuccuucaggcugaagagcugcauggagugugacagauggcacucccuccacccguccccuugcugccucucgcucauggccacugcugagugcugggagugccccaggcugugccacaccguccugaucuccccggccucccagggagauggaugugcacgugcaguggcagcuccagagcugucaugguggcacucgaggcuggggcgguguucccuggaggcaagcggggagccucucugggguucaguggagcucagacugccauggugggacggagcggggcgggggcuguggugggaauagguggcucagugugggccagaagguuggagggcuggcgccgacacggaaccaggguagcacgagaccaccgugcugguaaccagauggcgcagccugugaugggggccuggauuguguuccagcggcaacaggcccgucggcagguuucaggcaggggugugaggaggcgugaagaggcgcgaugugugauccaaggucgcuuugcugcccgaccucguccacuguucuguggccaugcacgugggcccccauauuuccacucagccugugcgggugcuuuguguguagacuuuuaaaggggagaagucagugugguccgagucccagucuucuucuucucuaacucuccuagagccucaagccucgaucugcugggaaacggauccaguuagcugugagaggggaaguggcagcuuugcugaguuucacuggaucuucucagaggcaccggcuguugaauucuguuuccucuccccacacgcuguugugguuuucccuucagcugcuagcgccgugcugucuuggaugcuaaggggcgccuacgguguuccaugaagcuguucucuguggacaggcaggaucucucuaaacauacaguuggcgcuagcuuucuuucagcuccccagucccugcuccuggccaugggacaucauuccuuuuacaacaaagaggauccugucucuucccaaguaccacuguuccuuugcgaucggcacaggcaggagagguccgcccugccaggccugggucaguggagcugugcagacugugguauagaagcugccuucaacaguuguauuccauuugggcuucuccauuuccugauuaguaguaguauuaauaauauuauuuucaagacggagucucacacuguugcccaggcuggagugcaguggugcgaucucggcucacugcaaccuccauuucccggguucaagugauuaucgugccucagccucaugaguagcugagauuacaggcgcgcgccaccaggccuggcuaauuuuuguauucuuaguagagacaggguuucgccauguuggucaggcuggucuugaacuccugaccucaagugaucuguccgccucacccucccgaagugcuggaguuacaggcaugaaccaccaugccugguccauuucccgauuauuuauugguaguaaaauucacuuugagguguguggcucugugggucuugacaguugcacugagcaucccccaccacagccaugauucaguuccaucacccuaagaguuucuccugccuccccuuggucacagcgcucuuccccugccgccagcagccauguggguacguuuuuaaagagaagagcuuccaugagguuugaagcccaguuucuccaugcaugaccaccaccuccuccaugcucuucucaaagugauguugcuuuuucuuguuuuaaaacuuuuuccugaacucagcuuguaacucuuaggauuccuggccacaucucccgucuuccugcacgugauuucucugccacccuugcuuuuagucgcagaagauaacagcaauugugcugggcgcgguggcucaugccuguaaucccagcaauuugggaggccgaggcagguggaucaacugaggucaagaguucgagaccagccuggccaacacagugaaacccugucucuacugaaaauacaaaaaaaauuagcugggugugguggcaggcaacuguaaucccagcuacucuggaggcugaggcagaauugcuugaaccugggaggcggagguugcagugagccgagagcgugccauugcacuccagcucugggggacaagaacgagacuuugucuccaaaaagaaaaaaaaagaaaaagagcaauuguggcuggccugucucccugccugcagcguuuacggcuuucccaugggcagaggccguguguggcuccguccccagccggcugugcugucucugucgugcuccuuggcacugacugacugaccugucuggagccuccaauuaaaggucacuggcagcacuuccccuaauuaccaugccauaaggacuuggcagguuuuguggcuguggugugagcgagggcgugccugugcuucagugaugcguuacccagugcugaguuguugagcugcaccuuccuuuggaugggaugcauuuuggggaggaggacggagaaucugagcuucuucccuaccaggcaucuuguccucacugggccuguggggagggaggggcucauccuuaggagcucaguugcuugucuuuaggagcuccuuggggcugcuggccaggagggagggaggugacgggucuugccguccucccccgcagcguggaguccucccgggcagggugggauuccuggggguagguggagcugcgcacggaggugaugggucucaccauccuccaggccuucauacaugccugaugggccugugaaguuggcgggagugggcagucggcgcccucguacgcaccuggugguccugugaagcugcaucugccgugagcguccagugggucuucagagguuaggcggucacuggaugacccagcaacuucccuucuaagugcgcacccaagagaauugauaacauguuugcacgaacacucgugucaucguucauagcagcauugcucauaguagccaagagauggggccaacccaaaugccccucagcugugacuaaaaacaacacggcuguccacccagcgaggaguuauugagccauaagagauggaggcugauguaugcugcagcagggacuggccuugaagacaugaugccaagucaauucaacaguaugaaaggccaccaccuguaugaugacauuaauaugaagugcccagaauaggcaaagucccgaacucaaagcagggcauuccugagacacugccguggccucaugugcucacugugggcagaaauaucagaguggccacugcccugggagaaccagguggccgagaggcaauggcggcugcaggcagggacagcuacaugcgcugcucuccugggguguguacugcguggcugugcggcggggagacagaccacacggugaggugggaggguggagcuuguuagcaggcaccguuacuugcuccguuacacuugucuuuuguuaaccuuuucuaccuuugagcuucuuugaggacagucaccauugugucugcuuugccuggaaugguggcugauacacagugggugcuugaggugagcguggaguuacgguucugagacccguggcuagcaugugagcugcaguaacgaacaguguagucacugucaggacugagcaagaccggcguugaauucuugcucaucacugacugcuggcccuuuagcaggcucucugaugucuucucagcugggccaucucgucuguaaaggacaugaugauaguccuuggcuugggguggugggaaacacauaaacgugacgauguauguucaggaaacgaugacggcaaugauaaggucucuuuuacccacauguggcgaguuucuuacucuacaaggcuacagagucgcaggcucuucaccuggaggguugggagcacccuccugcccccgugcuuggcccuguauuugucacggcuccuuccuuuuucuccucccugccccagucuggcucugguggcucccaggguuaucuggggccggacaucaggacguuccaggagauguccagaggugcgaggcaaguucugagggagguucuccaaugcagggaucaagcuggcgguaggugacacauugaguggugugcuggcggcugcaguggccgccaccguggcucaggaaguagguuuucugggcuaggacuccgcacugagcuggguuuccugccucuaaucugcucuccagcagucaggccugccagagccuggggaccuccgugagcacagguaccugcucccucguccccggcacgucugcgugggcgcagggccuucucuggcaucacccugcccgggcagcgccacucgcaugcucugcccccuugcagugcucugcucccagcaagugaaggucauggcccuuggcauuccuggccucgcgcugcccguggcugucucuguggcggguccggccacaccuguggacaggcccuuucuguccccccuggacuuugaggaaaugaagucaguauucaccagcacagcagagcuuuauuuuucuacacauacgcagaaacuuccauuguguuuccugaauuauuuugacccaagucuuccagauccugcggaguguccaccgcacacccugccagcagugcugccuuggaaugccuuucggguguccagaggaagccgcugguuaacugauagcgagaaagggaauggcggcucggaugugagcauucuucuccgaguugggugcauguggaaaaccggaccuucacuggguggggguccaugcccagucugcgcccgcuuccccagugccuucuugcccaagcuccuccccaccccagggucugacugcgcuggaaucacugggagcauccugcagccggcccacaggaugggcccagcagacacucacagugaccaaccaggagguccuggagaugggaacgggcgcuccugcaguaucaggaacagaucuguuucuucccacgugcuuuucccugaagaacugggaggaggaaauguuggucuucuugguacacagccugcugcaggucaguggcggaggccggguuucaacccaggucucccaggucuuccuagcguccgaugccguugccucuuccaucuuggccacgggggacaucuugcagucuguuacgucuggagucucccgacagcccgcccugcgcuggccuccacccacugacccaccuuggaggccucuccgcugauuuaccugcccgagugcugagcgccgugccucgagacugggggcacucaccccgcaccuccucuccgugcuguguaagccaagaagugcucagugauuccaacaagcacuaacccugccuuuuaaaggucauuccugucuuugucaguucuuaaaguucaagaggaaauaaacugcuuagagcuggcauuucucaagucaagugucagcccuccaagccccccgcccggcacggaggaagcgagguucauaaaugagcugccgggugacucagugaugggcgaaugggugccuuccucucuccagcuccugcuagaaaggaaugaaagggaaacuaauaauuccgaaaaucucauuuucuccuuaaaguuuuguuacucagcacggggaaugcuuuggagauguuucuuuauuggucgagugacagcguuuagaggcugucagcccuggguacccaggacgucacgcgcagggagggacggcucuucccccugggggccugugccacccguuccugauugacgggcaggggagcucucccugcagcgcgagagacagcagaggccccaugaaggugccacaccuaacgggguauugacuucugugcuuugggucaaggauggcaaaaucaaugggaaaauaaacaggccgaaugugcuucauuacccagguagcgcugaagcagcuggaguggucgugcggcgcacaggcgugggcggaggcugggccgagugcaggcgccgggcuccaucaauugucaugggcacuagagccucagcuucagagcugcuaauugggcuaucgggugauuccaaagagagacgccacagagaucgcuuugccucuucuuuuaacuauuugucuaauuugaugcaagccucaguuaaacgggguaugugagccccuugauccucagagcucaaucuccucagccugguccuuccacuuggccugcugccucucuagagugcugcacucccacaccagacccggcgacgccggccagagcccagcuccaugccucacggcucugauucacuggccacauggugcugaagucacggcuccgacagcagcuccgcugagcucccaggcccggcuccuucccucuggucucuccuucugucucucccaucucccuugcugagcuccccaggccuggcuccuucccuccugucucucccgcucucucccuucucccuccugcacucugucucacacacggccccaugguccccgcucuccuucccuucccucccuccuucccuggcuuuucugguuucccgugcagcuguugugggaugugcacagcccccucacacucacacauggccuccugguccccguccccucccccuccugccucccuucccuuucucuggcaucuccugcgcagguguucccgggagcuuguucuccguucuuuauuccucggucucugcuuuuccuucuuacauaaguucuugugcuuugacaucucuucuugucacuucaguguggccagacuucagagucucuaucuuuggcuccaaccucucuccuaaucuccaugaucagauuuuccucugucccuggaagcugcuaccuugcuguuauugcuccugaccuuggggccaugucaggcgugcccugcugucuccccaggggucccgugaucucuguuggccacucgcaugaaggcccagccuccccacccugacggcaggugugucucccgcuuucccaccagcuaggccaggcggccuuccccucucuaaccugugcuccggcuuuucucccucgcacuuagcuccugcccccuccgccgggccugggccguugugcuccgccgaccacgggggcuggaacagugacggcggaccccuguguggaggacagagcccggaagagagaaguccuggggccugcuggcuggucgagggagugaaggggugcaugaugguguccugggcugcagugaugcagggagcgccccccgccuccugugugggguggguuccggcccgaugcggggauuuuuggcagucccugagacccacagucccuccacaggcugguguccuccagcugagauguguccugagguuucccgggucgcacgauggcguucuggaaauuggagaaguguugguggagugggacugauacguggaugcugugauuuucguuccuuuacgcgucaguuugagggaacucgauggacuuucgcuagaaccuaugauccagaugaggaaggggcaaggagcccaguguggcaacccuggccccaagugacuccucugcccacaggccgcuuuccaccaccggcucagagccuccccaccuccccaccccggcccagcuugucuguccauaucuguuuccaaacacccuucccgcuggcucugccauucccacccugcgucauccccaguccuguccuugguuccuggccuggcuccuggaccaucacagcagcucucuccucucucuuccugggcucaggcaucuucucacccuucaggaacggggaaccagggagagggggcacagagucuggaccuugggcaugcugagaggcagcugaggguuaaugaggccaagauauaaugucacaaagugcaggccacgucccggcgguaccgccugugagccagguccccuggaaugccacucucccccagcauuugugucccuaaccgagaaaugaggcgaaaacgucucccucccuggcagggagguucaggguguguuugaagaaauggcaguucccuuugcccaaccacacgcaucuucauugggaaaaucuggcuccgcaccucaucugaaugcacggcccugugcagccgacagcagggcugcucugcgacccgggaguuuccagcugccuggggauggacuuggcgucagagcccagcgcuguucuuugaguccugcucccauuuggaaaugaggggccccggaauccugggcuuccuaccagaggccugugaucgugggggaggcgcucugcacaugaggguggguggguggguuuagucagagggugguuauuacuguuuuugccuuugaauuugugcaucugcaguggccgaggcggggagccggcaggagcuugcucucuugugggggacaugcagucgcccggccucaggugggugggaacucaugucuuuaguuacccaugcuagcguuucuaaaccucauaucugugguauaggguagugguauaggguauugguugguaaccuuucucuguaaagagccguaugguaaauacuuuuggcuuuuugagccacgggcucugucacaggaaagcagccguaagccauaugucaaugaaugggaguggcuuuguuccaggaaaacuuuccuuacaaccauagguggugggcuguuugcugagcagcagugcagagaaagcccccagccucgaggcuggcccacccgccugcugccugccuguuggccauguggccccuuggggcuucuguccugugcauuaggcgagcaggcagccagcgcugacaggguugacggacgcacggauggucuccuucucucugaccucgggagacgguagauguguccaggacaccugcugugccucucugcgucacuccaggcaccggauuaucuucuguggcuucucuuuuuucuccaagucagagcuggagggcauggggcgguuguuuaguagagccuggggaggugacuugcccccuugucucugcaguucucauuuccuaaucuccagcagccuggggcggaagugaauuuauggucucccugcggccgugcuugccggggcuccccacccagcauuuggaggagcccugcccaggcgauuacagguugguagcugaucagcuaaacuggauuauucauuaugguugggagugaauugaaauugcaaagggcaauuuuccuucucacauuucaaggucagaugagaguauuugccguguggccucuguuuaucugggaaugcaaauugaauuuggugauuccaguugacgagauguugggaacagagcguucaucagaggcagagucggggagaagugaccgggaggccaggcugcagcuucagagccugcuccccuggccguuccuuugauugguaauuauuucagccuuuggucuucucauucucugguuuuguuuccgcuguuuggauuuuuauuuuuuucagaaaaauguguauugacacuuggaggcauuuaagauugggauuagauagaguaaauaacaacagcugcgugccacgcugagccugauguccuggggcaccugcccucucggagucccagccccuuccgagucugaaccugccccccagggaggagggcuugccccucucuuucaccugcaagugcccaccugugccacugagugcggcugcccggccccaaccucaugacggugugggggcugagcuggccacguggacuugaacccgagucuucagcgaggcauucacccccucccaaccgcuggcucggccaagccccugcacuugcccucuucugagagacacauggaacgugucaccuguguggcagugcuguugcuuggcccgacuggggcaucuccccccagcccuaugggggugcccaaggcacggcccuggagacccuggaggucaguacagugguguccugggggacacgguggcuucugagccccuuuguccuuggggauguggggacuggggccggugcugccgcuguccucccagauucugguggagauuugaacccaaguccucagcgaggcaugccaccucugagccccuuccuccucagggaugugggguggggguggcgcugcugcuuuccucccagauucuggugcagacuaaacgaggucauguacccaggagcacccccugcagccgaaagcugcucgggcgagagugggaaacugcucaggaggcucggccuccgaguucagacauggaggggcccuggccgccagccuccucugcuuucuucuucaguccuggguagaugagaagcauaaacucugaucugaaucuccagcagcuccugaucagggagcaucuccuggcucagccgcggaggccccgugagcguggggcaggggaggaacugggaccucuugaugcucucgugcuucacgacggacgcacgcgucugauccaguccuccccugcccauucgcagcgaggggccugguggccucaguuccauccaagaggaaggagaaggccagagguggauggagcgcucagagccuccggauaguggguugacgugggggauccugcagguaggcgggacccucucaacccuguaggucccagggcaguuguuucccugccucucugcagaggcagcuauugauucccauucucaggcggcuccucagauacacaaggagccugcgucugucgugccggucuccaggccggagcugggggcuucgauggcagagacggcuccucucuguggugagugggggcccuuccccgguguucccucuuagcaaggagcgaauguggaugccugaacaugcucaguguugcuucugcccugucugggaacccuggccuuccgggagaguauuucugaaaccaguucgugcuccauuuaaaauuuugccucuagauccaggcugcugcgaggcuccccgacgggcgccugugaacacagcucuguguacaguucuugugacuggaggacgagcacgugugguuugggagguuguucuguccagcgauauccucuuucagaaccugugggugcuuccggagcagagcagggcaggcuguccacuggggcuggagccuguccucugcucccugcuagccuccuggauccuugucuccugcucccgcgcgccuccugcagaacggcacugcuuuuugucucguguaccugcuccaggccaccaguuagaguucacugcuccccgcugggucgcagcccucccaaccgcuggcucagccaagcccgugcacuugcucucuuccugagagacacauggaacgugucaccuguguggcagugcuguugcuuggcccgacuggggcgucuccccccagcccuaugggggugcucaaggcauggcccuggagacccuggaggucaguacagugguguccugggggacacgguggcuucaugcucaugacucagucgcucaaggcuugaauuuacucaucuguaaaaucgagaugauuaaaaaucauacuugugggugggucuugaucuauguuccucagauagcuaagaauaaaggugcuuuuagagauuuugccaagguucgaauacaauuuuauuaguauuuuccuaguuucaugccagacgucaucacugaggaucaccgugcaugcggcuguguuuacaucuuaacccuugaggccacuggcaggcucaccgugcugcgagcucaccaugucguaaccaucucgggcucaccaugccgcgggcucaccaagucguaacucugucuugggcucaccaugccgcgggcucaccaagucguaacucugucucgggcucaccgugccgugagcucacugugucauaaccgucucgggcucaccaugcugcgggcucaccgugccgcgggcucacugugccauaacugucucgggcugaccaugcugugggcucacuaugucguaacccugucuugggcucaccgugccacaggcucaccauguuguaaccgucucaggcugaccgugcugcgggcucaucgugucguaaccaucucaggcucacugugccgugagcucaccaugucguaaccgucuugggcucaccauguugcgggcucaccaagucguaacccugucucagggucaccaugccaugugcucgcugugucauaccugugucucgggcucacugugcugcaggcuaacugugcugugggcucacugugucauaacuguguuggggcagucaucagcccggaagccucggugugaccccaugcccaugugugaacagugugucugggcguuauggguuaggagaccgucuguguucgggcucacuuaacaaaguaccauagucggggaucugaacagacguccguuucucacagcuguggagcugaggagugcaggauggcagugccgggucugaggagggcucucuuccugguuugcagaugaccagccccuguccucacagggcagagggagaggacucgagcuuugugcugcuuacaacuugcgcaucccauugggagcacuccgcccucaggaccgaaugcccucucaggggcccccguuuggucaccaucacauuggggaucuggguuuucacaggugaacuugggacgacacaggcauucugugcacugcccaaaacgugcugguuuugcccugggcccgggcguggcuguggaggcgucuucauacccuguggauccacacuccaggcaccacucagccuugugacuggggcgggaacagccgccucauaccaucccaagggucggaucaggucccgggagcacacaacugcuucgccuuagaccccagcaccaccuguccuggccucucucagagccugucucccgcgguggccacgccgugggcuccugugcuccagagccccaugguuucuggggagaguccagugaugccuguuugugcgaugccugcccuugccuuggcgggugcucacagugggcugggacuugggagaagguagacaaagagugugugggaggaaugggucgugcguggaagagcuggcucagcagugucuugaggaaggucguuaaaaugucuccugccacuuugggauacauuguguccuuucguuguuccuugaaagucgguauucuuaggccgggaguuucugaugaagaucacauuaaaguggccggcaguggcuggucacagcgcagauggaugcucagaagcucagagcuuguucuuugaguagaggcuggcucagagagccauugauugauaaacaugccuggcuucuccuugaggaacuaagaacuucauucugaacucccagaggcucacggaaaugccagugaccucagaguucaguccaagcauggaacuagaggcuuaauuuuuugaguuuucucuucuguaccucagaagaaaggccgggauugaacagagagaacauccccaacaggggagagcccgccgucgcuggugccgcuguggcucagcgugcugggucccggugcccugcagggccugaggggugggaggcagaggccaucuugccggagcgccucuaccugcacgccugggugggcagcaccacuuguuggcggugucugaaacgcuagauggggggccuuuaggcugcacucuggggccguccacuuugugccggcccuuccugcaccuccagggcuuggcuccuaauugccacuuccucgggucuucaggacagggcugccucugcuggaccuuccccuccucucgagacgccggcaccucauggacacaugccagccugcuccuugccuuccugccccucuggcucagcccgcucuccacgucccgugcagaggccguuccugguuugcucguccucuugugaccuugcccauugcucccgguuggcccaaccucgggcccacugggcugaccacgaaugagcacgccagcugcccauuggaagcguccccggcucugacaccgccugucucugacaccacaggcugucccgccaccccuccccgagggcccccccagccuccgguuuccccuccagugucaggaggcaccugcuugcugguuugcugauggccugucuucugcccauugugguuacugaguuguugccucgcagcuccacacucccuucucugagcccuacuuugcggugccagggcugcagcccacaccugcgcuucgccagggagugccuguccugggggcgcuggagagggcccggggucagccugcaggcaaguggggcagcucuuuagccgcuggccuugcccccucccagcagccugccagccugcagauuccguagcgccuagaggugccagcuccaugggcugcugcccuguucucagaggccuggguccaggcccuccaggguccccaugcagacaccagcauggccucccucagcagccucaguuccuguuccauggggcccaucucugagugucuacauuuuaaugaugucagccucugccccguguucccacagcccaagggcugggagcugcuuccugaagucacugcguccuuggcgccugagggucuuccuucugcucucggugaccucaguaccugcacccgccgugagauucucugcucaugccacacgcguggcuucuuugcuugagauucccaccccaguagaauggaggcccagcgagcccaggcuggcugcgguguuccgugcugccaucucugcugccuggaacggcauguggccguccucacccacaucccgugugcugaacagacuggguagacucgccugccagucaggugugaguggcaaacaucccggacaugguucuuggcgagcauuccacagugucgucuccuugucacgucuugguguuggauuuuuacagucuaguucuguuguucagaagauuucagugucagccaucaggccuuggggauguggcccugaugacgcgggcccgagugcuugcaccuggacgguccuggagugggugucucucugcugcccacgccgucccucagccgggaauguguguugcucugguucacuucucccaucuccguucaugauguggauuucacugccaggaaggagagguuugcuucacaaccuggcggaugagcuuuuccagccugugcucagccccacgccccuaugccucugucuacccucuggggugcugcagaacacacgcuucacgcuacauccugcagccacugcauuuccucagaccgggucuguaaggaagcccagguucagcugcucgaugcuugacagccagacacgagaggcgagaguggcggaggaagagcaggcguauucggggagccagcggaucggggagauggugaccuacagucacaaagaccaucugaagucaguacagaucccaggcucuaguuaugcuaaggguaggggcaagaggaggggguuggguccaagaggugacugacgaucguagagaucugggugccagcaaggguccgaggggucgggaacugcucuguccuuggccaggccacagcacuccugcagaucuuuaacaaagccuaguuagcuguuuccacacuuccccuuugaucccagagugaguuuuugcauuauuacucuuugcuauuuuugcauuauuaucucaguacucuaaaagcuaggaguagguaaagacccuuuaagcaguggcggagggauaugcuaguucugcugagccacuguuacaggccgagggccgggcuuggggcgccucggugccugccguccugccucaccgaggcggccuaggcugcagagagugggaugugggccugagggaagcagcucaggccacauccaguuccugggacccagucuuggccccuggcucuauugcacugagcccugguccucaagugccgggagccugggcucugaagcaagacagccacuguccugugggugugcguuacucacaucugcucugcguggcggggggacuccagccccacaugugcccccacacagaugugagcgcacccucacucaggaugcaggguguggguuugcugggcccccuucaaggcugcccagccauccugugcugagcugagggugcuucccagcgcagccccuuacccuucucucuggccagaugccugugcugugccugucaccugaaagacagcaccugucacauucuugccuuugcacauucuggcuuugaagcagaguacagggaaugguggcguucuucuaguuaaaugaccacacggagccgugauuuaaagcacuugugaacguucccaccugaauucagugauucaagaguagauuuuacagcccuugaguauuaaauuggcccaugaguaguuuaaaauugaacugggucccaaaguagccucauaauauguguuucccaugagcuuugugccugcuuuuuauuuugucuugcguuuuugguuauggagcgccuggagggggcaggggggccgcuggccagugcugcaccuggggccagugucaguguagggcuuuccgaggcggcugaugggauaggaaagacucagaacgguuuccucugcucucacgucgcagcagucaacacagaagacucugaccagaugugggguguuuccccacccaccaagcaagcaguugguucugccugggacaccagccguucagcucagucucacucaguucuguucugacacugucuaccuggaggugcugucagacccugggugagggcucaguccccaccuucuggugcuggucgcgagccgcaggugugcuucugaccggccagcuguaaacugggguuccuaccacccaguugggauuccccuuggguuugauaaauuugcuggagugucucacagaacucaaggaaacguauguucaccaguuuauuaugaagcuuacugcgaaggaugcagaugaauggaugcgcagggcgagaugugggggaagggugcagagcguccgugcccuccccacccuccaggaacagugggagcucucccaguucccgugagaagccuuuggguuuugauggaggccgccacccuccgggaagaguggaagcucuccuagcucugguggaaaaccuuuggguuuugauggaggccaccacccuccaggaacagugaaagcgcucccugcuccggugagaaaccuuuggguuuugauggaggccuugucaggcggacauaauugacuccgccccugcucauuggugaaccacucagccuucagccccucuccuuccccagcuuagggguggggcugaagucccgagccucuaguccggccucgaucuuccuggugucccgccccauccugcagcugcccaggggcugcagccaccgucagucauuggcacauggaaggccucagucgggaaagcccgaggguuuuaggagcuguguucugguagauggguugacgaucaguuacauauuucacaagaucacacgcggcugaaaugagacgcccgcguccuggacgccaguacauuggccccagucugugggcuuguguggcuucugcuggggccggcugaggguggccagguugggguucccgccaugcuuggcugggucaggaccgccaccaagucccuucugacguucugugaguguuggauucacauucacuuucaacuuauccuuuauuucaagacuucuacuaaguuacaguuaaaaaccccguauucacuucacucaaacaugaguccaguggagaccaccgcccaagaaagugccauccccccagccccgggaugaagcuuucccuuccccaaaccaccgcccaagaaagcaccauccaccagcccugggaugaagcuuucccuuccccaaaccaccucccaagaaagcgccauccaccagcccugggaugaagcuuucccuuccccaaaccacugcccaagaaagcaccauccaccagccccaggaugaagcuuucccuuccccaaaccacugcccaagaaagcgccaucugucaguccagggaugaaacuuuuccucaagucaugcaacuaaggccgagcagaagcaaucaauggcugggaaggugugaacgugaggguggaggucauggccccaucccacauuccuguuuccaagcagccuccuggcucucccugaugguugccucacagggcuguggucccuguuagcuuuucucuaucccagugcuguguuuuauuuccuugagauuuaguuaagauuuccuuuggaaagaaguuugugguacucaauagagucgugugcagcucccguguuccagcgccguuccgcucugcgccugccugggcugucugaguagggaugggcccucccuccgcggacucgcacccuccccgguguggccucucuucuuuccuggcuguguccuuuccugggagagcucucguaccucacuguggaguccugacucuccuccucucgggcggccucucaucucuccuggcugugucccuuccugggagcaccugugugcccggcugucccaugugggagguggaguccugacucacccucucccugggacagccucuccucucugcgccucacugugcccuuccugggagccccucccgugaggagguggaguccugggguucccggaaucacagaaagccguugcaucauggguggguucugcagucagggucaguggacgcugucauuuguccggucccaagucagcuccugaaggacagagagagaggggcaagauccaaaccccugaggcccgcuacugccaggccacgaacucggaagcucaccaagagugguugggagccaccaaaggcuuaaaaaucgcaugacccagccccucucugcugucugaggagacagcuuggugcccaguggcagaggggucuagugagagccguugggaggcuauugugguaacguaggugacaggcaacgagcacagggacugaggcaguggcuguggggaccaugcagggaaaagggagguuucaaaagcagaauugaaaggaaccaucagccacccgaaggggcggacagggagaggccucuugggcagccuggaguuggcccugccucuggcgucggcccacaggaggccucucggguucccagugcuuagcgccaggcugggcuuucaaccucacagaauguuuuuagaacaggccccccaaccaggcgccuggcgcuugcuuccccgcaccacgcugcacaucugcggugauucagaggggaagcgcuggcucugcaaucucgcucauucagaagucccgucuccugaagggcugcgucgccgacaauuuuucccauuguguguggaguugagcucccuucccccucccugccguguucugggaucacccugggagucuauuugaaauccagaaacuccugaaaggccuuaaguagcuauucagcagugcggaaauggcagugaggggguugcacgugcagcucuauuuuaggauguccuggugggcucguuccugggguggggcggggcuuggugggguggucaccccaggcuucauugcuuugcccucuugucucucccaugcagcgcccgggggcuggagaaggccaggcagcagcugcaggaggagcuccggcaggucagcggccagcuguuggaggagaggaagaagcgcgagacccacgaggcgcuggcccggaggcuccagaaacggguccugcugcucaccaaggugauguaugcccuuacaucuugaucagagucgcagggagcugcgggucagugcacaccugguuagcuggaucucacuguggaggcaggagugcugcagccgggucaggguuggcacuuuggcccuggguugccaggaggguucugggaaugccagagagugcucagccccggugcucccugugggacucucugggccugcugcgugccccacccuuuucaguuccuccagcaucucaguguccaccccuggccuggugcugagcucuggagaggguucccugucacugcggacccccugcaggcucccacgugccuugcagucagcacccucaugcuuucccauccagugaugccauuuacacugugugggucuuggccugggcuugggaugaaggcugucaccugcuuccaggugugccccaccuguggguggcuccauggcccgacucuaagccucagugccugcggggguucugaugccuggcaccgugagcagaggucgcuggagcaugaaagacgguuuuugugaguucuguuuaaaauguuccuugggcacugaaauuucagaagacaaggcgggaaagaagucaaucuguccccagaugcucucugggccagggcggguguccaguuugcugggcggagacucccccugccugccuccagcuagugcugagugggcggagggcugugccacccuggcccaggaugcaugcugcaccugucaaguacugggaguugugccucauggauguuuaccuguucuugaucguuuuugaugaaaaccaagccucuuugcugcugggaccucuugguuguggagcuuuuagaaaaugaguaacauuuccguuccaaagaugcuguuuuacagcuucuccagcucgcucugggcggcuccaugcugucuccuaaaggaaaaguucacaugggccuaggucccucgggcacugacugugugggcacccggaacacaggcugagcuggccccugcgcauagcucagaugcugaccccaaagcccuggcuuugcaggugcaccccagacaggggacacuccaaaauguucucacauggcuuuucagccggagcugucugcugccucuggcagaggggacacccagcccugcugcauggucaggcacgguacguuucuguggagcaagcucucgaccuuccucuguguucccuucucuuccacaccgugucugcuagugugugagcuucuaagcaagaugcgugaggugcacguggcguggaugugugggcacagcccuuggaggauucgcucuucuagcggggccaggcaguggcaccagaccagcaccugccacgcaccucaacagagguggacgccgugguggugccgcagaagggcuuuucucaggagguggcauuccuguggggacccaagaauuuccccuuugcgaaaguguguguggagaaccacggcggagggagagaaggcaggucaucacaaagcgcugcugcagucaccucgaggccuggagcgggaggagacagcggcuugggcccacaggccacagcacgcgggcugaccacugcggugguucgggcugaccacugcggggguuugggcugaccacugcggggguucaggcaagugcagcccgacccugccgccgaggagaggcccgggaagcagagggggcgacacuguguucuuucagaguggcgggacaccuuagcucggugaucuuugggugcgugaugacgugcuguggucccgugaugcuggaagcucagagcuuccugggggaggaagagugggagggcugggcugggagcugggccuuucucugggaucucagaugucccucauucucucugggucucaguucuccuuucugcuaaacuuugggcucaggccugaugaccccgggugccugcgaacguggccugaugaccccgggugccugcgaacguggccugaugaccccgggugccugcgaacauggccugaugaccccgggugccugcgaacguggccugaugaccccgggugccugcgaacgugcuguguucggguggcacccccuugagugcaccuuguuguugggcccaguccccgauucugggucggggcuggggagugacaucggcccacaccggccaggcgggcagcacuuuggguugguccuccaugcguggccugggucuuggccugggcuacaaguguggcccccacaggagggcagccccgcccggccucagcugaggcucaucccuugggaaccuccugguuucuuaagugaggccagcgguuggaagcugaugggcagaguucccuugacaggucacgugugggccugaguguucuugugugcugggucuggccugcagccugugacccacgcgacacuggugcugcugcccacacccucuuagugccagggcucccggccgugaugaggaguuacaugcagucacuggaugucuggugugguuuucaucccuguggggcucccucauggucuaguggagccccgcagccuucugggaagucugugcccggcuuccuuccugccguugcucuuugauggccaccccggcccgcucagggcaggaaguuucuguucuucucugcucugcuuugcagguggagagccucuggcacuuucuggcccgcgccagccucaccccgacccugcugugcucgcgggccugcucuguguuagcaagaagguggguauugaucgccgggcauggacugguuguuuauccugacgaaggauugaucccagucgcccguguagccccaggccagggaugcaggauccguccagccagccgugaugaagcuguucacucagccaucuggagggagcggcgugccugcugcucugggucugugugccuuggugucggccagugcccaccucagcucugcauggcagcccgcccagcugggguggucgaggagcgccuucucucaaggcgcacccaggagggcugcgagccuccggcuggugggggcucugggccucugcuucccauuggaggcucuccuugugugcuugacauuuuaguacacggugcuuggagugugugguuuuauuucgagaccuuuauuaaacggcucuagucuaaggauuuaauuguuacugauagcuaagaguauaauuaccuugguaaaauaucaugacuauuuuaagcaguugaaaauuggcuucuggaacugggugaacacaaaccauuuuccuguuugaaaugagccguuucuccagugccccaagcuuccgcaguauggcugcagagucuuguuucuggaauaucagugauacaagcuaacuuuuagcaagaaacuuuucaaaugacagaaaagccuccgcuucccaccccuuguugucugcacuccacccucccgcccugucucacagcagaucaguuacuggaggccccaggcuuggggggagcaguugacgcuggguguccagcggcgucggacucacgucguggcugcugagcacagacugugguugucauggugacacccugcccugggaacccgcacacugggaaagacagauuugugucuucuggaguuguugagggucugaguuucgagcucugggcugggguguugggucugggcuggcugaaugagcacguuccucggccaccuccuccgaagcugggguuggugacgacacacauuccccucucccacguccucgcugccuggggcaucagaucugcccacugccauaaaguuccuuuugucaaucaaaaaaccguccacaaacauuccugaugauccacggucucaaaaccaacguggcugggccugcugugggauugggagcggaugagcuuuaacaggagggcugggacccuggacacggcugccacccucagugaugggagaguguggagagcuggugucuguauucgcugggugcaguuuaggccagauccauccaggagacagcugaaggcagauggagacugggcccaagaaggcgggggcugcugcuguuuaagaaacaguuaaauagggggcagaaugcaggaaguacaaggggggaccccucagaagaguuccauguucuuccugccucacauccagaagagaguccuagaagaagccucuguccucccuugagaaucugcuguccuccugaaagaagccucugcucucccaugagcagccgcuguccuccuaugaucagccacuguccuccuggaagaagccaccauccucccgggagaagccucuguccucccuugacaaccugcuguccuccuggaagaagccucuguccucccaugagcagccaccguccucccuggagaagccgccauccuuugggagaagacacuguccuccuaggagaagccgcuguccugggagaagccgcuguccugggagaagccuccguccugggagaagccgccauauuccuaggagaagcugccauccucauccucccaggagaaucugguauccucugggagaagccgcuguccuccugggagaagcugccauauuccugggagaagccacuguccuccuaggagaagccucuguccucccaggagaagccucuguccuccugggagaagcugccacauucccgggagaagccacuguccuccuaggagaauccucuguccuccggggagaagccucuguccucuucggagaagcugcucucuuccugcuauguuccuggcccagaggcagcucuugugagccugagccaucccagccucuuacaggggccagagccgcuuccugaggccuccucuccaugcuauggugccuucccgagggaaucuggggcaggggagccaggcuuagcucagggaccccugcgcguucucaguugacucugccagggccuccucucuucuugggggucguuucugugcccaggaugcugugcuggagucucccaugcccuuucugguggagggcccgccuggauauugguguugauuguuuugaagacauguugcucuucguguccuguguauucacucggcugccugaggcugggcuccugugugcucccucgccaggggguugcugggcugcauccccagccuccuuggauucagugucucggcaggguuagccgcgaggccaggcccagaacaggacaugcguguuccuugcugaagcucagugucaucuguggagccggccugcuacgggagaggcuccaggcccccuucugguccauccuaggaaggcagugcaguccucgcugggauucucccaggccugggguuugaggaggccccuccauuuccuucugacugugucucuucuccucugcaggauugugugugcugagggcagagcgagggaggcuggcugccccgagggagcugaggccacaggugcucagggucagaguggcccguggaucaugaaggaguguguucugguggccgcacccuggccaugacaaaggcggguguggugcccacgggaagagggcagggccucgcuggcaccgugcccaggcugcgcagcgauuuagaaaugggcccacguugcuggaguguuuuuauuuuugaacagguuauuuucaucucuccuggaauagcacgguggagacacaccugaugcauguuuuugcucccauaggacguguggguggaagggacauggagcagaggcaagcgcuguuguuuauuuuguguucauacagcuugggcagcuuccacuuuggagaccaccccaacaagguuaauguagcucaugccugucccagccacagacaaggccgcuguuccuccagcugagugccacuucaagucacuggcuugccuuuauuucaaagcccugaucuucccugauggugucuguuuaaguccugggauccggcacagccuggagugaggacgcggagccagggacucccaggggcccaggacucugcccacucuuggaucagagagcaagauuuuggcgcagugaggucccacccaccccacguccagucuuucuuuucacuguucucgugaaacacauugcgugugcaaagaucauauagaacauauacauacagcucaaagaauacagcaaguucccgugucucagucccaguguaagaaacagaacagccuccgcugucagacggagccgugcucuaaacguagagcagucccuucccucauuuuucuuucuaguuuaauuguguguauaucuuuaaacauugcuccgcuuuucccauuuuuauguuuucuguacauagagccacgcuucuguggcuucucuuuguuuuuaucuuagcguuauccuuuugaccuucgucccugggaaugcagcguguuccuuuuugcugcuguugugaugcugugugcagggagugggucacgguuuagugaccugacgugugagguguuccaguuuugccuuccugcggugggugcugcacaguggguguggcucagccccaccucgggaggcuuguucucaguagucuccguguugaaguuuagugugcacaaauuacagacccaggacagacucuagaagagcagguaguuagcaaccccagcaagacccucgugccugguuccagccgcucccucagcuccagggcaagcgccuccugacuucacuucccuguuuuuuuuuuguuugagacagagucucucuuuguugcccaggcuggagugcagucgcgugaucucggcucacugcagccuccgccucccagguucaagcaauucuguugccucagccucucgaguagcugggauuauaggugugcgucaccacaccgggcuaauuuuuguauuuuuaguaaagacaggguuucaccauguuggccagguuggucucgaacuccugaccucgugaucccccuacuucggccucccaaucccaaagugcugggauuacaggcgugagccacuguguccggccuucaauucccuguuuuuuuuuuuuuuuuuuugucguugcuguuuuuugaaauggagucucgcucugucacccaggcuggagugcaguggcgcgaucucagcucacugcaaccuccgucucuuggguucaagccauucucucgccucagccucccgaggagcugggauuucaggugccugucacuauacccagcuaauuuuuuuguauuuuuguagagacgggguuucaccauguuggccaggcugguccugaacuccugaccucaggugaucugccugccucggccucccaaagugcugggauuacaggcgugagccacugcgccuggcccacuucccuguuuuuaagcgucacauauuggaaucacauaccuguacucuuuagucccuggcuuccauuacacguuaucuuugugagagucauguguguuguguauagcugagauuuguugauuuuucuuaauuacucuguuaaguuuuccauuguauaaaaauaccacuuuuuaaaauacacuuggcuguacccgacaucggaugguuuccagcauggggguguugacucuugcugacguggacguuuuaacacguguaugacguuuggugauccccugggugcccuugcgcugggcaugcccagguguggcauagggucaguucccggggcugccacccccgccagaguuacugugccagguggcacuccuguugggguguggauggugcuggucccuccggguccucaccuccugccuuugguuuucucccuggugggggccuguacucgaaagcuguuguucuuacuuuccugaggcuuggugaagcugagcugcuuuuuacaugcucacuggccgguuagacaccgacuccugggggcaccuggacaggcuuucuguuccuaccccuuugggcuuuuauuuuuauuuuauuuuauuuuaauuuuauuauuauuuuuugagacggagucucacucuguugcccaggcuggagugcaauggcucaaucuuggcucacugccaccuccgccucccggguucaagcaauucuccugccucagccucaugaguagcugggacuacaggcacgcgccagcacgcccagcuaaguuuuguauuuuuaguagagauggggucucaccauguugguuaggcuggucucgaacuccugaccucgugaucugccugccucagccuuccaaaguguugagauuacaggcgugagccacuguauccguccugggccuuuaaaugauuguuugccuuguucuuacugaguuguaguucuuuacucuggaugugaaagucuuuuguugaaacguauuuaguuaucuucucguagccugugguuugcuuuuucacucucggaauuucucuguugauguucaugcagccagcucaccgacguuugcugaugcuggugcuuuugagucaugauuaaacagucuuugccugccaaaguugugaagauacucagugguuuucuucuaaacacuuuauuguuuaccuuuuauauguugcugcuuuuguucugugaaacaugcuguugaucuggcagccucuauugcaaggccgccuucuccccacgcguggcgcugccauggccguggcccggggaccccucguggccguccacuucagggcuuucugguguguuccaugggcucuuuuuuuauuuguuuacgauuccaugcugucgucguugccuccuccuuccaguguuucccuguguccaggugaagcacagcauuagcuuaucuuggcauuagcguaucucgacauuagcguuaucucggucucggcauuaucucgauauuggcauaucucgacaucagcguuaucucggcaucggcguuaucucagcaucggcguaucucagcaucaguguaucucagcaucagcguaucuugacaucucggcaucgguguaucuuggcaucagcauaucucgacaucuuggcauuggcguaucucagcaucggcguaucucgggaucggcguaucucgggaucggcguaucucggcaucggcguaucucggcaucggcguaucucggcaucggcguaucucggcaucggcguaacuuggcaucugcguaucuuggcaucgguguaucucggcaucggcguaucucggcuucggcguaucuuggcaucugcguaucucgacaucucggcaucuuggcuucggcguaucucggcaucagcguaucuuggcaucagcguaucuugauaccucggcaucgguguaucucggcaucggcguaucuugugaaccaugaaugccacauguuccaccauuuaccuugauggccuuuaauuucucucagcaaguuugauggauuuuaggguagauucuuacaugucauuagacuuucugcccugcguauuugaacauucgacgcaguuuucauguugucuucuuggacuuugaucuucuauguauguguuccuggccuguggauguaccauuggguccugcacauugacccugcacaugacaaccuugcucugaugcugguguuugacgugcacacucauacucucugagagaugcuggccaugcuuccccaccaaccccaugccucucuucuccccuggcuacgcuucccugccagccccacaccucuccuguccccuggccaugcucccucuccagccccgcgccucuccucuccccuggccacgcuuccccaccagccccgugccucuccucuccccuccccuggccaugcuuccccgccagccccuugccucuccucuccccuggccaugcucccuuuccagccccgcaccuuuccucuccucuggccacaaucccucuccagccccacgccucuucucuccucuggccacgcugccucuccaaccccgugccucuccucuggccacauucccucuccagcccugcuucucucuucuggccacacucccucuccagccccaugccucuccucuccucuggccacacucccacuccagcccugcuucucucuucuggccacacucccucuccagcccugcuucucuccuggccacacucccucuccagcccugcuucucuccuggccacacucccucuccagcccugcuucucuccucuggccacacucccucuccagccccacgccucucuucuccucuggccacacucccucuccagcccugcuucucucgucuggccacacucccucuccagcccugcuucucuccuggccacacucccucuccagcccugcuucucuccucuggccacacucccucuccagcccugcuucucuccucuggccacacucccucuccagcccugcgccucuccccuggccacacucccacucuagccccgcgccucuccucuccucuggccacacucccucuccagcccugcgccucuccccuggccacacucccacucuagccccgcgccucuccucuccucuggccacacucccucuccagcccugcuucucuccucuggccacacucccacuccagccccgcgccucuccucuucucuggccacacucccucuccagcccugcuucucuccucuagccacacucccucuccagcccugcgccucuccucuccccuggccacacucccucuccagccucaagccucuccucuccucuggccacacucccucuccagcccugcgccucuccccuggccacacucccacucuagccccgcgccucuccucuccucuggccacacucccucuccagcccugcuucucuccucuggccacacucccucuccagcccugcgccucuccucuccucuggccacacucccucuccagcccugcuucucuccucuggccacacucccucuccagccucgcgccucuccucuccucuggccacacucccucuccagccccgccccucuccucuccucuggccacacucccucuccagccccgcgccucuccucuccucuggccacacucccucuccagccccgcgccucuccucuccucuggccacacucccucuccagccccgcgccucuccucuccucuggccacacucccucuccagccccgcgccucuccucuccucuggccacacucccucuccagccccgcgccucuccucuccucuggccacacucccucuccagcccugcuucucuccucuagccacacucccucuccagccccgcgccucuccucuccucuggccacacucccucuccagccccgcgccucuccucuccucuggccacacucccucuccagccccgcgccucuccucuccucuccucuggccacacucccucuccagccccgcgccucuccucuccucuggccacacucccucuccggcccugcuucucuccaugccccuuuccuccaggugcagugucauggaggaaugaugacaguaggcaccuugucuccuucaggcugugacgggcgcuuugguaauccaucaguaagcguggugugugcuagauguucugugugauacucuuuacugaauuaaugaaauccucuccaacuugugcuuuucuaagagucuuugucacgaaggccuaccccauaaauuuugaugcggguuguuuuuguuacuguugaguucaaaacauuuucugauauucucuguggauuuagaaagucuggccuuccagcaggauuuaacgcauacaaagcauauaauacagguggacuggccagcugaaaagggauugagaaggagaaacccagacucaguucacucacucgaucauuaauguuucauuccccaacuucuucuuuuugggggggcgguggggggaauggagucuuguucugauguccaggcuggagugcaguggugcaaucuuggcucacugcaaccucugccucccggguucaagcaguucuccccucagccucugaguagcugggacuacaggugcacaccaccaugcccggugaauucuuuguauuuuuaguagggauggauuuugccacguuggccaggaacuucucacgucaagugaucugcccaccuuggcuucccgacgugcugggauuacaggcaugaggcaccgcgcucggucauuccccagauucuuacugugcgucuccugugagccuggcacauuuaggugcuguggaaaacagcagggagcugcacagcagacucggagcucaagggccccucucuagguggggcuggggcaggugucagucgcguugaggcggugauggcugcugugaagaaagggaggcgcuuuagggcucgugugucagggagggugugggaagccggugaacaggcgcccuugcugagcccagaaggucacugcggggagagcuguguccaucugccgugcuagaccgugguggggcuugguuugugguaaugauagcugcacggguacuugggaagguuguggggcgaggugccacgucuccccggcuuccccguggcaaugccguagguggucguggugcagugggaagaccaggggcuuuggcguuagcacagccuguguuccucuccgcgaucggccgcuuguguagguuucuguggccccacaacagucccccugggcugccucuuggagccacaccaacuccuuguccugguucuaguguugaguaggacuuguccuucaccccucugugauaaugggcgcugggugggagcccgugggagcucuguggugggccuugguucgaggugagcaccgcccucgcucacguggguaucuccugggucgcuuugcagaugggucguggagccagucuuguacuuccuuccacgucuuuccuggauagccauucugugguuucuuccucugccccagugggagccuaaaucuggcugugugcuccucccuccccugagggugugagaucuagcccucuuucccuagagcagagcagagcagagcagagcagagggccuccaucccucccacagaagagccugcgcgagccccaugcugcuucugaucgccgucucuucugcuccacaccccucuuuaggucugaggcuucaugaucggcacgauuucucuugcucuuucuuuuuuaauacugaaaauuuuuggucuuagguagcacugaagggaguauuuauaacacccaguaccugcugugucaucuggaaagcaucauccucugugacccuccagggguuugugucagacagucaucauguucccuguggcgcccgcugaggcgucggggggucagcucuguggccccguuuuagcccagcaagucgaggcuuaagaguggcauagagacugcccaggccaugcggccagccuugaugcuagauuuguguuuuuuauuuauuuauuuauuuauuuuugagauggagucuugcccugucacucaggcuggagugcaguggcaugaucucagcucacugcaaccucugccuccuggguucaagcgauucuccagccucagccucccgaguagcugggauuacaggcgccugccaccauguccagcuaauuuauguauuuguaguagagacgggguuuugccauauuggucaggcuggucucgaacuccugaccucaagugauccacccaccucagccucccaaagugcugggauuacagcugugagccacugugccugguccuagauuuuuuuuuuuuuuuuuuuuuugagacagggucucucugugucacccaggcuggaguacaguaguguggucucggcucacugcagccucgacaucgcaggcuccggugauucuccugccucagccucccgaguagcugggacuucaggugccaccaccgugcccaucuaauucuuuuguguuuuuguagagaucguggaaaucugagugugacuugguagcucuggggugcagccugcgguccccaugucucaccgguucccugguggcgcuccugugcugcuccgggccaguucugucagggguggcagaggccuggaucgugcccuacgaugcgggccacaggggccgggucacacagcugauguggaugcugcugacuggcccuaggccuggcucacccccagcucccucugaagaccacugccuaccugcuguccucacugucugccuccgagaggacacacguccuggcgugugcucauucacucccugcuuucugucaggguuuguggcgugccucugccuggugcugucguggcacgcaccgccucgcugugcugccugccuagugccuggagggaggcuuggccccgcuuccucugucucugcugcccccgcccuuugugacaagcucugcacuguguacgugaacacaggacagauggaguucgggcccugccgucgucccugagucccggccccaccgcucggcuccuccugcuacugugacccaugcaacccaucuugucuccugggcuuuagccucuggggauguccaaggagcagcccugaguaccgcauguguuccccgcucucccaucacugcgagggcacggcccagccgagcgcagcucaaguucagcuucagaccuugcuuuguucauacuuaaagcacaucccuccacguacaccuggaucggugcaaagccugcaggaggggcccugagacgcuggccagcccggcuuccagggucguguuugcucugcucagugagagggccucuucccuccacagauaagcaggguucucucggcuuuggaauuuaauuuccagguguuaauauaucgcccuuucccauuaccuuucuagacugacauuucuauuacauccauucaggaaagaauguccacuuuguuaugggacaaagccauuugcacaguuauuagaaagccaaccuugucacagacacugcugcacucucccuccgagagggagcuggaccuggcuguggcagaaaaaaauuccagggagaaaagcaauuuuaggaaauacggugaaaucaaaacaaugcauuuuacccgucuccagugugaagaugaugaagguuggguugugggagcguggaccgccuccaccagcccgagcccuccacgugcgcccgaccgccgucucugccucaggugcguggaguuuggaggcugcguuacacuggauucaggucacccaucuuuacucuuggcucuuugaaaagaccacaguccuguccccacccgcccaugggugggacuuucuggacaguuccaggugaggcuguggaacuccuggcccuuucagggagauuugaggagauggccacagcacuguguugggggaggugggcugggagcagcagugcucgugggcucuggcccuggugggagugcccugucugcgggcacccgggugcagcccugaccccucccgcccugccucccucugcagaagggugcugguggcaggugugucaucagaaaccccgaugagggcauuucuggauggugcugcugagauaaggcugucuccucgggucuccguguugaggguggcuagaaucgggugccccuggagcacuguggaagccaggucuacuuucuuuuuugaggagucauggccugcguccacuuaaugguggcaaaucacacuuggagagcucggucacaggagccuacugaaaccugcagcccagaaugcagggccugggucacaggcucccuggcuucacccaggggcugucccuggcccuguacccuguuggccuggggcacccccauaacccguguccccaggcccuggcuggaacgugcugugcggggaagaugggccccaccucugcagccuccucugcuuccccguugcuuuccugccgcccgccagggccuuggggccuucacacagcuucucuacuucccggaacccagaucauccccggcguccggcucauagcauugaggcaggcccuuuucucccuuguucaccggcggcuggcacaguuccuugcauacagcaggcucugaguaaaugccuggugaauauuggacuccuucaccuacaggaggugcugaggccuuuggaguggccagggagcagcucuccugccucugccucaccugcccugugcucugcccccgcccggaggacucuuggucccagccucaccgucugcaugggccuccgcggcccccaaacucaccgguuuucaggaagggccugcuaccagguagcagaucccgaggcuucugcuucugaugccugagcuaaugucagcaauguggaagaggguguuacuugcuuucaacuuucccaacaaccaaagucgcaagacguguagcugucaguggcagagcaggaggguaggcaguggcugggagcaggugccagggcagggacggcucggccuucagaugcaggcacuggaggcggcacccacccguucccuccucaggcugguggaggagccuccgcugucccgggacuuggggcagcucucccuucuggauuuccuccucccacauguccugcuggggacacauggcuuccuaucuccccauggccccggagguccagcgccucccucccccaugcuccaggcuggggccccagcucccucccgguuccucugucuguuccgggcagcagucuguggcgccagggccaugcccaugccagcugccguagcugugucccagcuguuugcuccagguuuauuuugaugguguaccccuuuauaaaaacuguggaauuugcacacugauacgugcauauuuguuuaaaaaggauagguaugaccugcggccaauaaugaacacacccauuuauuuguaagauauaaggacuuauaaacguaaguaggguuuccacuguauaccuaggccccagggagcugucaggugcccucccugggcaccgugcccgggccccagugaguguccagcccccucccugccugcugugccugggcccuagugagcuguccggcgcccucccugccugcugugccugggcccuagugagcuguccggcgcccuccugggugcuguugcuugcugucuguugggcauucugucuguguggucuuccugaggcuguuaccaacugugguggcggcaggccuggggcuccuacuacgccgcugccugugcucuguugcucacaugaaggggccagggaagccuguuggcauauggagucaugccauggcuggcuguggcggagcuguggcugugcgcguggcgaggacgauaggguucugcccuuguccguggucacccugcuccugcucucgcuucucugaggccagccccuccucucugaugugugcggagcgugggucuuggccugccgggggcuccuucguggaaugcagggggugcacagguguugacucugcaugaaugguugucuuuccgccuggcuguuucccugccugacgccccuguaaacauccauucccaacacgcuucccagaggacgcuugcccuuggaguacuccuaacaaaagacuucccagugaaaucaguuucuggcaccccaugugguauagccugacacggcaccugcugcucagcuuguccauggcucugaggagcccucaggggccccaggcagcuggugggggaugggguugggggguggacagcaaggugaccuggcgggcgcagggcagcugguggggguggugggggguggaaagcaaggugacccaguaggcacagcgcagcuggugggggguugggggagguaggggacagcgaggugacccggcaggcgcagggcagcuggugggggggugggggaggugggggacagcaaggugacccggcggaugcagggaaggcccagucuucaugugcgguuucaaugucucguuccugggcuuuucugcauuaagugugaguuucuaacauaccacguugaaacgucuuggaucuugccugcugagccacguggcucuuccugaaggacaaggucagcgccccccucgccaccacuucauccagaucccaggagccccuucuguccuguaggccaaggcuccacagcaccacguggguuauggacgagaaaccuggaguguccugcuaggagagaggcuguggaauucccagucccccucagcuuuggagguuuauaccagagagaccgaggcuuagagaggagcccagggaggcuccuccagugcccaggccaggcaucauccagcuggcacagguggcuuuagcccagccucggggggacacaagcagggccugcagggugucugggaagggcuggagggaccaggcccggaaccuuguccugccuacccaggcuuuggccugacauuguccuuguuugugcuuuaaaauccccuauccuguuugguagagaaacaugcucucuuuaaacucaguuucgaagaaauccaaaucuuugaauaaccuugaucuugaaaggaaaggaaguuagcugcaggugaaaauugauggucaugcucaaaggcaugguucccugccaaggaagccucuugagucuuucuacuaaaaauagcugcagcauccuggugguggugucugaacccucucuaggccccuccuggagacauucagagauguuaaaggugacagccagccucaccuggccguuccgcacagguguguuugcuccuggccugugaggcacaggugggugggccugcugaggacugagccgcccucggggguacugggcugcucccuccgcagccucugccccuucaguuguccuuggugucacggcacacccaagagccuuguaaguucccugcaccacagucugggugggugccugggucccuguguccaugguccugggagaggucccuggccucagucagaaggugugaagugucuggacuuucuccaggccggugauaggccacuguuggcuuguggucuccaugguucugugggugcuucaacggagcugccagaaaggucaagccacagccugacaccagccagaguggaggcggcccaggaacccccuggcucaccacccucagccuggugcuuccgucugcccguguggguguggacaugggucugaggcacuggcuaggggauucccugcuuccagcaggcgcgugagguuccauccuggucucugguuucuggucuggccucauaccuggcuuagcucucguaggagugcaacagguggaaggggcggugaugcccgcagaugcugggugaggugccccgugaacguguggucuggugcccgcagacgcugggugaggugccccgugaacguguggucuggugcccgcagacgcugggugaggugccccaugaacguguggucuggugcccgcagacgcugggugaggugccccgugaacguguggucuggugcccgcagacgcugggugaggugccccgugaacguguggucugguguccgcagacgcugggugaggugcccugugaacguguggucuggugcccgcagacguugggugagguuccuugugaacguguggucugguguccgcagauguugggugaggugcccugugaacguguggucuggugccugcagacguugggugaggugcccugugaacguguggucuggugcccgcagauggugccagcagauguuggaugaggugcccugugaaccuguggucuggugccugcagacauuggaugaggugcccugggaauuacagugcucgauaguccuccuggacacuggugcugaugaagcgagucuggccacccacgccaggcagugcccagugccccuuggguggcuccugcccuccagcaagacauggggaugcugcuggacccaggugucugugagguccaggcacagaucuugcuucugcaggaggccccugggcggacuaggugaguccuuccuccuaccgccucuuugaaaaucuguguguguuuaaacuaaauuucuugagugccaucagaaggcccgugagcuggugagcugcccccgagccuuuugccacccauggugggcaugagccaccuacugagucggcuccgagucagcagaggccauggagugggggcccccacugugcagggagagggucugacccugggcggggcaccgggaagggagguggaggccugaggccagcccugcuggaauuccucucuucuagggggaggaagccuaggagcuggaaucagaaaaccuguuagaaccugagcucugucacucucucacuugugccuggcgccagcucccuuucccucucuuugccuuugcuuccucucuggaagaaugaagcaugcacgccucaccccaucugcacggggagccgauucacagauuacaugagggaaugcuuugaaaauauuuuuaaauuguaauguucaaauauaugugugagguaguucaucaucaacucacucaacaaacauaugguuaguucuauucuaaggugauguguguuccuaaaagucacccugcuacacaaaaucacauuaaaaauaagaugggacccugaugaaaauggcagcaugguugacgcggucaguggcuggacacaggcaagugugacaaucggcacagcucuucgccucgagaaggccuggcgcuggcuuggggaagugggagugguggcuugugagucacuguggaguggggagagcaccugaagcuggagggguguggcacagggggcucagccaggcucgggaggcucccaucacagcuccguucagcugagugcgguuuucugcauucgucuuggaggagguucuucacagaggggcggagggggacuuuuuggccaucacucaacauccuaugggacagccccuuccuggcugacccaccugccugcccugugccaggccuuaugcagugugguugaugcuuauuaccauucaucaaauuuauuuccugacaaauccuauguuaaauaccuggcaugggaccugcagugagugggcauucgauguauagcggucacugcuggcauucgucagaguaacuucucauuucauuaacaucccucuaaucaucucacuuaaaacucacuuggagaauucugagcucagauuuggaaaucccguguuugugcaacaggaauuugucguuggaugagaugaaggaacuugccugggugaacaggcaggauucgcagcccagguagcugcucauucuccgagucccucuacaccuaccccgcugcccgacuagggugcuggagcauggugucugagagcacgcgugugcgucagugugcacaugcgugcacccggguguucaugaacacacccgugucggugcucagugugcaugcaugcacacaugagcauuacugugugcgugucugugcugcaugagcucuguguaggagacgugugugcauaucuguguugagugcuguguauguguguguccauacguguguacuugugugcgcauguauguugugcugugugaguucugugugcacaugugaucaugugagugugcacgugugcuuugugagcugugcaugcacaucugugugaacugugcauugagcaugagugugcauguaucuguacuggugagcugugugcacgugagugcacgugugugauugugcaugugucuguggagucagcucucugcauaugugagugcacgugugugagugugcaugugucugcagaggcagcucucuguaugcaugugagugugcaugucugugcugugugagcucugugugugcaugugucugagcaugcacaugugugagugcugugugcgcacaugugugugcaucugugcuuaccauucuggaacacugguucuuuuaugcauuuuggcuucuuuucccacgagacccucauggaacauuaagcccagcagacaaggccagccccaaccauugugauaguuauuaaacagcaauaaagcaggaucuguauuuacagacccagagugugcucagacugggagguauuaaacaucauccaucaucaaauggaaaacagucagaugcagggaguguagaauggaguuaauauucuuuugguuaacuucacccauaaagagcuaaacugcccccaauaaaacaccaaggggaggaagggagguucuuccagacggaagcaaucaucggcacggucugcagacaggcccccaggguuuccucgugccgguggguuuucugcagcuuguuacgcagcugcggcucagagcaagcggugucucagggucccuuuccacaguucucauugccugcuuugccuuaggucagcucaucagcagcccuggggagcuggggugaacggaggaaagacacugacuuguagaaccugagaaucugggaagggagggccuuagccgaagacuguuugcccaggaggguggcacgcaguaaacaguucaacccaggaguucaacccgggagcuggcauuggggcauggaugugcgcgcugguggccauucauuacugauccuccaguuuccuuugucgucugugagugggugcgcucagcccaggggguguugugugcgcagcguguggugcagagguagcaccugggacagggggccgggcacugugcgugugggcacagggagcgcugcuccuccuccuuagaccugaggcuccugucugggcaaggucuagcccuccaccuaggagcuuacggaaucuucaguggggacagauggucuggaaaggacucaccucuuuucccacccuugguugaauguggccccuugggcacaggcgggcagcgcucaccccuuuccuacacuaagacguccucacggcuuaguguagggcaggcgggugaggcgggguuugugucgcuucugaucuggaagggguuuagcagcugaggagaugaucgccacgcagaguuccgucuccagaaaaauaagaggauuugcacaguucuugaacuucacccuuccaaaguuuucaccucuuguagacuagaaguuuuaagugagcuucugugugucgaaaucauuucaugggcagugccccagccggagccugucuggaggggaggguugggugggcacgggcgccgggccugggaggaggaggacaacauggguuuccuagcucgcuggacggcccugagguugugggggccuuugguggcugaaaggggucuuguauuucugugcacauugaaaggcgaucuuauuugccugcgcugccguccagcugaggacagggacauagggugccugugagugcaggccuggaaagggaugggacuccccucuguagggagggcggggcuucaguccaccuggggcguggggccugcgccaccacccgcaucccaggagaggcacugauugcagggcucggccuggggcuuacaugggacccuccuugacucccuagaggcagccgagguggccacugcagcacucagcuggucuuccccaggaaguccuucccuuacagggccuccacugccgccucugucaugggcaggcccucagggagcagggcuguggcggccuguggugcaggggacgugugccaugucuccuaaagaugauggcucagcuccauggggggcccucggcagaacguuuggauuuaaggacuacuuggggcucaccaugugcuccgaggcuuagggaaggccugggacgggcccugaagugcugucuggcugaggcugggcuccucaggugagaaauuggcucccaugucccgcuccccucccccaccccacucuccuuccuucaaggaauccuguuagacuuuucacuuugcuccacggccuccaaaucccacuaagcgacugucgcuuuuccagggcaucgucaggugcuguacuaagcuuuaauaaagggcuuuauccacagcuucagaaaagucucuaaauaaauuagauccacugguuagccuccaacggugauuuuuauuaaccuccaguuaaagaaauauugcugguuacagaagcacaauuuauuucuguguaagccaggcuggugugacccugcgggcucccgagagggauagugcuauguacacgcagagugcugggcuggccaugagaggcaccugagagggcacccggcagccugagggcugggagucacucucacagggacacagagacucucacagggacaugggggacucucauagggacgugggguaucucacggggacacagggauacgaggacucucacagggauacgggggcucucacagggauacaggggacucuuacagggauucacagccacugagacacgggcuggugcuccuggccuggagcagagagggguguggaggccgggugggaggccggagccuuucauguccuuucuggccccugguggcagcagcucccuugcugaauggcuucacccugggaggugaucagaggccggggcuugccgucagggcgcccuggcucagaucgugccucugcggccguguggcuugggcguguggccccugucagagccucugcuuccucugugaagugcggagaaugguugcugcugcucaucagaguggggaggugacaggccuggcccggggcucggguuuuguucaugcuguugccuccccugggcuccccugucuacaccacuggcacaggagcugagaggguguccacgccccgggggacuacgccauacugauggccuccauuucuuggggucugucucacugagcugggacuccaguuccaguucuugucauccucacugaaucucacaaagcugagcgggaaacacgugggcugugcugagucgcccucgcuguacaggaagagaaaccgaggcuggagcaguggagaggcuuguguggucgaucgccuggggacuucauguguacucaggacccagaccucccggccgcacccccgugcugguucugugcccugcugaaccauuugggaaauuguguuaucaucucacacaugcugcgggcuccucugggauucacugcugcuguuucuaaagcacuguucccaguguguucacagcguccccaccuucuuccacgugcgccgggcagcuucucuuuggccucucacaccugaggugcuuuguggcaggagcguccucucaggagccugggugcgugaguucaaauccuggucccaggugcuggcuguguggaacccagccgaagucauucgucugugucucaguuucguugcuggagagagcggagauugucccagcguguccucacaguguuguuggcggacugaacaaguugggaggaaugagcaagagugacccuuggaucaggaccuguaguagcugccucuguccugugagcauucgcuaugauuuuuauuccagaccguuggcugcuccccuuccugcggcgcauuguggccgccagcucuaggcagcucguccucccaugcugcugucuccccuccucucuccaucaggccuuugcugugguugcuggagcauugcugccgccguccauugcgugugcucucuugacgggacgggcacccaucugugcuugagucacguccgagcccgcggccgccacccacacccuguuccugcacggugaggucugccacguuccaggggcaggcuuugcccggcccucccuggcccuguucaguagcccugggcccagcuuaugucuauguugggcagugcgggguguugggaggagagaaugggcagaggccccugccucagggcucccuggggccuggcaggaggccugggguggugcugcccccacucucgagaaaaaggcuggcacuccgcagggcuguuuguggugggaaacaggcgcucagccagucuggauccccagcccccccaggcccuccgcgugccuccacucugcagggcacccguagccuccagagaacagucaugacccagcguccuuguaggcacgguacccgggcaucacguucccaagcccgcccauuccggccaccuccagcccacaggaugugccaggucgugccgagggccuccuaaggagcgugggauugucagaacagauugcagcauggauuuuuggaggauuaaaguuaauuaaagagcucuuccuugcuuucacguccuugugucugccagcuauuuacaugcuaaugcugcccugacaccgaggaugaggggugucugccgcacugcacugcgcugucaggaggggaaccacaggagaaggaggggagcgcagugcuauguauuacccugugccccuccgaugggacaggggcguggaugcagacacauucgaaagucaguggcagggucguuuucuuguauuuccugaagugucuucguggcugacuuggauguucuccauucaggcccccccuuacacugcauaauugaaugcauucugcguggaaauaucuucgcauaagcaauuuuauaaauaaagagauuguggagaguagggucugaaguuucuaagugcagggcuguguuuuccagaagcccauccuucuuggcgaaggugacuuucagcuucacggggucggccuguggcagcguccucuggcccucagcagcacugccuugauguggacguggacguggauguggacguggacguggacguggacaugugugugcgugaaggcuccucagguguauuaguccguucuugugucucuauaaaggaaucccugaggcugggucauucugcggacuguacaggaagcacagcgccggcaucugcuucugcugagguaccaggaagcuucugaucauggcagaaggcaaggagcaggcacgucacauggcaagagcaggagcaagagagacacuugagguuccagaaucuuuccaacaacacuccucacucgggauggcucugggccauucgugagggauccgcccucauaauccaacaccucccaccaggccccaccuccaccuuugggaaacauuuuucaaccugagauuuggagggagcagacauccaaaccauaucgccaaguauuuguugaaugaauaaaugaacguugauaccaucauuggguguauuuuagcugcagauucuaaacgccaggguucugggguggcuggagugugaaaaggucggugguggcaguuaggaaugccgugugcaugcccuugugccugugugcccaugugugugucugugcguguguccgugugccugugugucugugcacaucugcgugugucuguguccaugugcgcgugugugugcaugugcguaugugugucuguguacgugugcgcaugcgcuugugugugcacgucugugugcgugucuguguccaugugcgugugugugugcauguguauguguguacauaugugugugcaugucugcauguccgugugcaugugugucugcgugugugugugcacaugugcguguguggauguguguguacauauguguguacgugcaucugugugucugugugcauguccgugugcgugugugugucuaagucuuucuuggauggucccuugcugcuuucccagggagcuaguucucucuggccuuggcuggguaggaugcaggcucugcucgccucucuggaacagagcaggaggugcugcggggagcugggugcagcguggccaggccaaagcaggcaccugagugaguuuuguguucaguaucccuccccccugugggcugccauggugagaguugacauuuuugcagcguggaagugagacugucuuguggaguuuucuacuccucucgggcaaagagaggguuagugaccugacaccugaugguaugccuucaaagcucuuccucaucugguuucauucaacucaugucaagcgucagucgugacccaugucaaagguauaugcagcuggauguaaguuaaaguggagaaaacagauuuuauucagucgcugcugacagcaggggacagagcugagcuccuuucagguuugugcagaugugacugggcauuuuaaagggaguguggggaacaggugcccaaauggagucagggaagugaaaaauuacagaaagcagcaagaggguuggguagcaugaaugugaugagcugacucugcuacgagcuggcagguuggggcuggcagggaugggcuccugcuccccuuccccagccccagacuaggagacaggccuguuuuccugaugauuacguuccaaaggguuggcucucgguccuugagaaggacaucccagagcuguaggaggugcgggcaugugugucuccaagggacugaggaaggauucacaguugucagcucggauuuucugaaguaacugugcuaggaaggggaggcagggcaggggccuguugucaggugugguagaaccaagggcaaauccuccugacagccuugagcuuuuuccgacaggaacucugggggugcuguagcucaggcuucaggaaguccugcuguggugggcggugucucagugcaggggguaggauggagcccuugugugcugagagcucuucugugguucucagcagccaacagugagagacacacgugauugugaagccaggcuucucagggcagccccuaugacggcacacaucacguagaagguuuaaaucagcauuggcugaaugagcgauuccaaagagcagccaacaccucuguuugcaggaagauggaguugacgcauuuucuuugauccuucuguuaaguauaaugaagaguccuggacauuaucuauggaaugagcauagugagccucugcgggauggaggccaggggccuugggccucggaacagccuggcggggagcugcccagguuuccucgucugccucuuucaucccagacuuggagcuaaggaagcacauccccaaaaugccgacgcuccccagcaaaggacuagguaaauagcagcugggaagacagaaaauguaguuaaugccuagcaauaauggaaagaaaaacuuaauggauauaaggucagcagcagaauggaggcgacaggagcgcguucgugaacucagagauggaccgauaggaacugcccaucugcccauucugaacagcagagagaauacgauggaauaaaaugagcaaaguucccgacaccgaugagaccugggaauacgauggaauaaaaggaacaaaguccccggugccgguggggccacaacacaagauccagcauuccaguuguggggaucugggaggguccggaggagcugagauggagccgcagaggcagcaggcagcgucuucaaaacuaauccagugucuuugcuguucugugggucuacucagguugucuguguuucucuugagucaguuuugguagcuuuugucuuuucaggaguuuguucauuucaccuccguuauuaauuuucggcaugcagcuguucguaguauuccuuuacagccuuuaucucuggaaggucagcuagugucucuuucacucccaacugcagugaucugcacccucuuucuuguuuccuugguuggcccagcuaaaaguuucugucaauucuguugcuauucucacagaaccaacuuuaggcuugaccgauuucuuuuauuguuuuuguguucuuuauuucacuuauuuuugcucuaauauuuauuauuucguuccuucugcuugggucaacugaaguuggacuccaucaagauuaaaauuuuugccccgugaaaguuccugugaagagaugaaaagacaagguagagauaaagaggaacuauuugcaagcuucauaucugacaaagacgauuuguuaucuguaauagaugagaaaacucucaaaacucaguaauagaaaaacaaaacagacacaccuaauuagcaaacaagcaaaagauauagacagaccuuuuuaccaaauaacauauacagaugacaguuaagcccguggaaagauguucaacaucauuagucaugagggaaaugcaaguuaaaaccacagugaggugucacugcacaccugucaaaguucagaaacggacaccaucagaugccagucaguguguagagaaacuccaucucuggugccuugcugaugggagagugacagggugcagccacccuggaaccagcucgaggguuucuuaaaaacugcacugcagcucccauaugaccagcagucgcauuccugggugucgauuccagugaaauaaaaccgagguucggacaaaacccgacagaggacucuuccuagcagcuuuugcauaauggccaaaaacuggaaagaauucugauguccuucgguggugaugguuaaacaacgguagugccuccgucacacagaguaauacucaggacuaagaaggaauucacuguggauaaacauacuugaauagaucuccagggaguuuagcggagcgaagagcccagucccugaaggucgugugcugcaugaucccauuugcaugacguuauuaaaaggcugaagugauagacagccuguggauggcugccgugaguuacggagacgcacaggaggaaucguggcugugaacggacaacccgagggguuuuuguggugaugaaaugugcuguaucuugacuguaucauugucggcauacggguugugauacugugcuguaguugugccagauguugcuauugggaggaacuggaugaaugcuacuugugaucucuguauuauuuuuuauagcuccaagugaaucuguaauuggaucaaaauaaaaagcuuagaucaggcacaguagcugaugcauggaaucccagcacuuugagaggucgaggugggcggaucacuugaggucagcaggaguucgagaccauccuggccagcauggugaaacccugucucuacuaaaaauacaaaaaauuagugaggcgugguggcacacacuuguaaucccggcuacuugggaggcugaggcaggagaauugcuugaacccagaaggcggagguugcagugagccaagauugugccaccgugcuccagccugggugacagaaugagugagacugugucucaaaaaaaaaaaaaaaaaaaaaaaaaaaagucaucagcuucauuaucuccuaacagcaucagcuuguccucugaaacuuugaaggcagggaucgacuucuccucuguaacuguaaaagcccuagacggcaucuuccagcagaaggcuguuuuaugugcacugcaaaucugguguuuaguguggccaccuucauuggugcucuuagcuggaucuucuggagaacuugcugcagcuucuccgucagcacuugcggcuucaccuuguacuuuuaugugauggggacugccucuuaauguaaaccucaugaacccaccucugcuagcuucagacuugaauucugcagcuuucccaccucucucagccucguggaacuugcucugacuuaagggaauguuggggcugguuugaucuauccagaccacucagacuucuccguaucagcaauaagacaguuucacuuucuuaucguugguguguucaguggagcagcacuuuuaauuuccuccaagaacuuucccuuugcauucacaacuuggcgagcuguuuggcacgagaggccuggcuuucggcuuaucuuugcuuuuggcacgccuuccucacuaagcuuaauccuuucuagcuuuugguuuaaaggagagacaugcgacucuuccuuucucuugaaugcuuagaggcuguuguaggguuauuaauuggccugauuuuaauacuguugugucgcccagggaauagagaggcccaaggagagggagggagggagauggcuggucagugaagcagccagacacaagcagcguuggucggugaagcuuuugccgucugaggagcauaguguguggcgucccagaaucaaugacagcaguaagaucggagaccgccgaucacagaccacaacagacauaacagugaugcaaugucggaaguacagucaggacguggcgccccagaaucaaugacaguaguaagaucagagaccacccauuacagaccacaacagauauaauagugauacaaugucugaaacgccaugaggauuaccagaugugacagagccguguagggagcacaugcuguugggaacauggugccucgccgaaggcaggacggccacaagccuuccauuuguaagaagcacaguaucuguguaguccaggagagcaaggcgugccuggguccaugcuggcuccuuauuguggccagcacacugugcucguguaagauguuaacaguggggcaccuggguguggaauaugugaaaagucucuaccaucuucuccauucuucuaaaucuaaacccguucuaaaaaaaaaaaaaaaaaagaagagucuauuaagaagacaaagaaggagccgaaauuuccacguggcagaaggcacuggaaccggugagaucugauguguaccugggccugauccacguuugcugcauggcuggacaccuucgugggcgcguggaagcucaugcuguggggggagcugugggaggagcaugcggcagguggaggucuucugcgcgugggugggcacgcggaagcucgugcuguggggggagcugugggaggagugcuggaggagcccugggaggaguguucaggaggcggagcgugccucgugcgcguugguggguaugaguggcguuggugggaucuagcugaccaccucccaccugguuggucugcaucuguagacagcuuaguucuuaggauucuagguacccagugucauuuccgacaccugcuugggcucccuguacugccagggcuguugagucuuuacagcaccucugaucaggagcccuggccuuggggaggugggacaggcacacgucuggguugcuggguugccuuuagggguaagcucuuccuuuugucuucuguucaaaagagggcccacaguggauucaggccucugauuuaccacugccuggagcuuggggaaugcucuccagugacaaccugggcuuccgugggauuuaauuuugauauauuggccuuuguguguaggaagaguccaaacucacgaccggauggauuguccuccucagacuagacacuucauccagagaggacucugagccaacccuaagggauucaggcuggagcucugguuccccgcacggagguggcgcaggaaugcaucguccuccccuguccugacuugucagcgcuccugcgcucaugccugggagccuggaccccagcucugucccgacuugucagugcucccgcgcucaugccugggagccuggaccccagcucugucccgacuugucagugcucccgcgcucaugccugggagccuggaccccagcucugucccgacuugucagugcucccgcgcucaugccugggagccuggaccccagcucuguccccacuugucagugcucccgcgcucaugccugggagccuggaccccagcucugucccaacuugucagugcucccgcgcucaugccugggagccuggaccccagcucugucccgacuugucagugcucccgcgcucaugccugggagccuggaccccagcucugucccgacuugucagugcucccgcgcucaugccugggagccuggaccccagcucugucccgacuugucagugcucccgcgcucaugccugggagccuggaccccagcucugucccgacuugucagugcucccgcgcucaugccugggagccuggaccccagcucugucccgacuugucagugcucccgcgcucaugccugggagccuggaccccagcucugucccgacuugucagugcucccgcgcucaugccugggagccuggaccccagcucugucccgacuugucagugcucccgcgcucaugccugggagccuggaccccagcucuguccccacuugucagugcucccgcgcucaugccugggagccuggaccccagcucugucccgacuugucagugcucccgcgcucaugccugggagccuggaccccagcucugucccgacuugucagugcucccgcgcucaugccugggagccuggaccccagcucugucccgacuugucagugcucccgcgcucaugccugggagccuggaccccagcucugucccgacuugucagugcucccgcgcucaugccugggagccuggaccccagcucugucccgacuugucagugcucccgcgcucaugccugggagccuggaccccagcucugucccgacuugucagugcuccugcgcucaugccugggagccuggaccccagcucugucccgacuugucagcgcucccgcgcucaugccugggagccuggacuccgguuuacauuucucagcguguccuugggcuguguguggucugcgugucccugggguugucuguggggucauguggccccucugggcugccugguuuccuuuucucccacaucgugucuggcauuucuuuauucagaaaugaggcaucuguuguuggcuucccuguggaguuugugucccucccugagcucccgccucuguggggccagccccaguguggacuuguggcccccugugcugcugggccucagguuugggucugcggaguacaugggugugagugcucugaccacuggacucuuaaaacaugcagcccucuuugacugugacacuggacaugugcaaagcuuggggacugaucaaaaaguauaaagaggccauugaaaaagaccuugacuccugcacccagagguagcaccaagaacauggcaugcauuucaucuccacgucucccuucucuccuuuccuccccuguucauucauucagccaaucuaucagccaaccaguaagcacucacggacacccacgugcgcaggugccauggaggcagccgaguguggggacugcuguggcagagcuggcagccuugugugcuuccugcacuugugacauuuuauugcagccagugccugugccauuaagcauuccuugaaaauaaaaucuuuuuuggcuguacgauguuucuucguguagacauaccaaaaguaaacucuuggccggcugcgguggcucaugccuguaauccuagcacuuugggaggcugagacggguggauugccugagcucaggaguucggaccagccugggcaacacggugaaaccccgucucuacuaaaauacaaaaaauuagcugggcgugguggugugugccuguagucccaccuacucaggaggcugaggcaggagaaucgcuugaacccgggagacaaagguugcugugagccuagaucacaccauugcacuccagccugggcgacagcgagacuccgucuccaaaaaaaaaaaaaaggagacucuuuauuggaaauuuagcuuuguuuuuaauuuuuucaugauuauugcuaaugugugcaacauccuuggacucagugcuuuccccauaucugauucauuuguuauuuauuuauuuguuuagacacagggucuugcucugucgcccaggcugcaaugugguggcgccaucuuggcucacugcagucuugaacuccagggcucaauauauccuccugccugagccuccccaguagcugggacuauaggugcaugccgccccgccuggcuaauuaaaaaaaaauuuuuuuuguagagauggggucucacuauguugcccaggcuggucucaggugauucuccugccucggccucucacagugcugggauugcaggugugagccaccgcagucugauuacuuuuuaggcaauuguuacugaguggaagggugugaacaccuucaggacccuuggccaguuuugcugacucguuuuccagaagcgcccgugacugcugucccagcagguguagcgugcagcccucauggccucacucgugcugaguguuagcauuuuacuucuugccacuccaggugaggaacgggucuuaaugaauuuuguguuugucaguuacguuucuucuguugauuguugauuuuucccaguuuucuauuaccguguuagugauuuuccuauugauuuguaaaagguuuucauguauuuguggcacguuuuccccaguuugucuuuuaccuuuuguguuuuuaaguggcguuuugggacccacggagguguugguguggcgaagcgugcuggucuuucucugucauuccuuccacugcuucggggcccacagccuuucagggccuugcuccauggaguauccaucuuguuuccuuuaguucuagugcagugaagcaggcgagggcaggggugaccgggucaucugggcugguucaaacuggggcuccgcacccagguguucugugcccccggggugcguuacucacaccugcagcacccgggcugucucugugagaaugggaugaucgaagggcccaccuccuggccagcacagggccuggcacguggugccuggcuggcgaguguaugaguggggugcugggcugggagcgugagcucucggaguucugcgucuguuuaucauggccagucaguggcagcgucagcuggguguccucagcccacgcugcuguaccccaagaaggcaguagacacgugauaccagugggcugggggcaucuucucagcuggugcccucuccacguccuucugcgggggcgccuugccccccugccccaugcacacucucccugugugcagagugggucuuccuuccugguguggggcucccugagugcccugccuguccucgccuguucuuacagugcucacgucugccucccucuccaggcugaguucugggagagcaggccggcgccaccccccucaccacuugcuaggagcuggccugacccuggugggagcccacagcccugggcgcgaauucaaaaugccagaagcagcacagggucccucgagccuggugggagguacuucccaugggcgagucaucuuguuuugaauucuccucaugcugauuucuggccccacucagcccagcacagcucugaaggagacgaaggcaaggccagcucuccccagcugagaugagcuuucaguugaggaaggacccugaugucagagcuguuuggguaauggccugccccuggccauggaugugcaccaaaucuuuucaggacucguggggucacugcugcccgggggcuuuagguagcuauuagagcccagggcugggcaagcgcuuucccaccugcccguuagcaugauggccaagagcccaggcucggcuucacggaggcuggagaccuggggcgcgcgccuuccccuggagccuuguccucaucugaaagggaggacuccagccugccucaggaggugguuccgaggacugauuggcugaugguuucacucguucauuuuuuaauugaacacacaguuccugagcaccuguucuguuccaggcacuggacagggacuggggccgggcgucccgcaugaaugaggggucagggagcugaugcauggaaacuccuuggcacaaggcccggagugugccuggcacccugggcacuggcugccugccuguuacccgucgguggagaaagccaccuagacuuugcagcacuguaagauuuuugaacuguagaagaccaaguccaucuaauucccuguuuugcugauaggaacgcuggaggccuagagaggaaaggaacccgucugacugcucaggcugaguaguggccccagagccgugacuccacugugcugucuguuucccacguugcccugcucuccuuucucccuguccugucaaauaaacugcacucaaaauagagccaugcggcacagggccugucucaggcccauggccccauauccgcgugggucaggcaugcuggcgagaccuugcgagggucacguccuccucccuggugaggggccgucugcagccacuguggcuuggguauggcuuccugucaggauggucccagugcccucccagaugugcacggcacccacgucgucauagcgcaggugugagcagcugcuguaacaaggcuggugcugguucagguggaugcuggggaaugcauuuauacagcgaacacaaaugaaguggaauuugucauagagcagugugaaauguaaguaaaauugccucgggaaaucauaauugauuccacuccuuccuacaauagguguuguagagcuuuuuaucagagguugaaauuguaaaaaccaggcuugcugguggggagcccagaacagccccuuuucccccucccccacagcuacacgugggugguggaggccaguggggagggugugacggcaggaagccagaggaggagcuggcugaggguaaccccaagacagcuguggggcagggaagggagcgugcucugugugccuggugcagcugcaggcagaggggugaguagugggagaggaccccgugcuuccucucugagcggccugguguucagccuccugcugccuucaggagagcucgcguaggugcaguucauggagaaugcacagcuggcugcuggagggaggaugcugcugaaggcuggggaccguuuuuucuccugggggcuccuccgaauccagucgcccagcagaaauagagcuuugucaacaguaaaccggguuuauuggucagauaagauaaccuuguaaugagacuuguggaacuugaggcaaaaaugaggaagaacagagaggauggaaugggaacaagggagagacaugguaucaucaagcucugagcaagguuggccgagagcaccaggcgcagguugggggcugaggaggacagaaacgcgucugacagcagggcgccucccacggggccccggaaacccucgcugacccacaguauugcccuucaaaaccuggucauuggugcccauuacagagaacccuuucaucgggaaaagagaccguuucuccucauucucaguuuccucugccggggcggcgucugguuuguuuuggaggcauuuucgucaagcgcagaugggcagguuccacuccugcgggguccggccaccugucacuggcgcccuggcuuacccaggggccucugcacaucaaggcuguucaggggcccgcguguaacaggcucuaauuagcguaagcaagugaauuagccuuaucuguucaugaaagaagugaagcaagaaaugcauuuggugacacuuugucagugcuuuguucgagcugcuauacggaaauuauuaauaguagaauugcauucuguuacaaucgcccucuaauucagucaccauccauugaacuggacuuuuuacccaguuagcaagguaaugaguuuggaugacucugaaaacuuugugaccuccaccccgggcgucacugugggcugggggaaccuccucaggcuguguguggaccuuccguggagcgcggggcggggcguagcggacaugcaccuguacacagcucuggguuccgcguuucuggggcacucucugccagccaggggugcccugcagaaaugaggcuaggauuacacggggagcagcuugggccaaagacucgauuuccaucugcucccugaauguggugagcccgguguccacaggacuguguaggaggggacagccagcaucugcccuuuccagagaccuuucuccuggcacucgugucugggcgcuagggaugaucuuguuucuguuccuuggauuuuuacuucucuucagcuccaucugaagcuuuuccccucucucauuucauuguaaucauaacucgcacaucaaccucaaauuacccucuaucaaucacucucuugccuagaaacuugcugggcuccuccucuucugcugcccugggugugucaugcagagugcccugcgccugccaccaacucccaccgcccuugcucucccacugccagaaaguuaggccuccaggccucuggaguccgaguugggcucacgguuccaucugaguguguuugcccugagcuguuuguaaaugggacuuacaaccacagccaagcucuucaaauuauggaguuccguuuaaaaaaaaaaauuacugccuuuuaaucuuuuuauuagagcauaacagacauacagaaagugcuuuguccugagaguacaucuuagagggcuaugaugaaaucaguccauccaugucucagcuccacggucgggaacacggugucaccagggcucccaaguucaccugccggcuccuccaccucccccaaagcccugccuucccgauucucacacgccaguucugcccauuuaaaaauguugugaaauggagccaugcagcguguaaucuuucguguuugguuucuguugcuguguuauuucauuucuaucuuauggguauaucacgucauaauuuuuaaaauuuucugugaaugggcguuugaauuucuuuauuucuuggcuacugugacuaacacuacagaaugggagauuauaucaucuuuuguuagguauuuguauuucaaaugucuccucucauucuguagcagcuuuucacacucuaaacagaaauucuuaauuugaaugaaaucuaauuuaucaaucuuuaccucccuuugugguugugauuuguguguguccuguuuaagaaagcuucgccacccuccagguuguuccaggguuucacuccugucuucuugguggcuuugcuucuucacacugaccguggcacugcgcagccuuguugcccugcgcagccuuguugcacugugugaagccuuauuuuuuuuuucauuuuucuugucaacguggguauccaguggacucagcacuccuuacugcaaagcugcuccuuccgccugugccacagugcugguuacaccuucacgugagguggcucugucuguauuggcuguuucuggaaucuguauuguuucguugguguguucaucucuuuuuggcaaaaccacaaguuucaauuccugagaauguuagagucucguuaccugauaggguggcccucucugcuugucugcaucagggcugcccuggcucuaccuggccauccgccucuucacguagauuuuacagcucaaccugucagucucaccaguggacuugcuagaguuuuuauugagaaugcauugauuaaaugacaucugcacaauauugaaucuucuaauccauggacguacuauaugcuaacauguguuuaggucauacuuuuuuuuuuuuuuuuuuuugagauggagucuugcucugucgcccaggcuggagugcaauggcaugaucucggcucacugcaagcucugccuccuggguucgcgccauucucuugccucagccucccgaguagcugggacuacaggcgcccaccaccacgcccggcuaauuuuuuguauuuuuaguggagacgggguuucgccguguuagccaggauggucucgaucuccugaccucguaauccgccugccucggccucccaaagugcugggauuacaggcgugagucaccgcgcccggccuuaggucauacuuauuuucucucgaaauuguuucauaauguuuucuggguggacauaucauggguuuuguuguuuugaauaauaauguuugugcuuugaauaauaauguagaaaucuaauuggacuuugauuauuaacuuugguccugcagcauugcuaaaucuacuuauuuuaauaauuuauuuguagauuauauugacuuuucuauguucauaauugagugauuuaauaauagcuuucauugucuucuugaucuucguaccuuucaugccucuucuuaucuguggcuuagcauagccagugcugcuuuggacagacaugcugauagcugguguuuguuuugcaucaucagaagaaaagcuuucaacauuucacuguuaaagaucgugcugacgacuuuaguaaggaaauccuuuucagauuaaaguucucccuauuccucauuugccaagaggguuuugcuuuuguuuuguuucauaguuuuuaucgugaauagauguugaauuuuaaucaaaugccuuuucugcaaauauugagaugaucauuugauuuucuucuauauuuuguuaaugcgcauuaaauuaauugauuuucaaauguuaaaccaaacuuacauuccaggaauaaaugagcauggccuauggguuaugcucuguguguaaugcuuuauuugguuugccaguacguuaauuagggauuuugcaucugcauuuauuggggagaaaggucauuacuuuucauuucucagaaugucguuuucagguugugauguuauggcuuuucuggccuuagaaaauauuagcaaguugucuucuguuguuuucuguaaucguuuuauaagguuggugauauuucuucuuuaaccgcuugguggaguguaccagugaaagcaucugggccuagggguuucuuguuuacaagauuuuaaauuugggcuugauuuauuuuaauagcuuugaaacaucagauuuucuuuuuuuuucuuuauucaguugugguaaaaguuaguuuuuaacuuuuaaaacuucauuuuaucaaaacuuuaaaauucauuuguguaaaguuguuuauugucauguuuuuaauauuuuugugaucucuaguuaugucuuuuucaauauuguuauuugcuuauucuuuguaaucugucucaucaagaguuuaucaauuuuauuagucauuuggaggaaccaucuuuuggcuuuauugauuuuuucccauauguauuuuauuucauuaauuuguuacuuucuuugagucuaauuugauguuauucuaacuuuugaguuguauauguagauaauugauauuuauccuuucuuguguuacaguauaugcauuuaagguugucaauuuaguugcauaccguacguuuugauguguuguauuuuccuuaucauugggcucaagucauuuaucaauuuccauugugauuuuuauuuugaccaaugggcuauucagaaacaaauuucucaaauucccaacaucuggugauuuucagguaucuucuuauugauuucuagcauuaucucccugugcucagagacuauccucugaaugaccccagucccauaaaacuuaccaagaaaugcucuauggccccaucggaagucaguuuuguaaauggcccauacacacuugaaaauaguauguauucugcaauuguugagugcaguguuuuguaaauagcuacauaucauuuguuaaucuuauucuucacauuucuuuaaugauguuuuuucucagcuccugcaagaguuguguugaaauuucccauuaugauugugaguuuugucuauuucuucuuuuaauuuugucaauuauugcaguaugucuuuggaugcuguuuuauuaggcacauauaaauugugaauuaucuuccuggugaauuuugccuuuuguuauuaugagacauucuuuaucucugcggauuguuuugauuuuuaaaucuccuuucugggauauuaauacggguaugucagcuuccaguguuuaauagcauuggcaccuuuuacuuuuucacuuuucauuuugagcauuguuaaauuguuucauuauaaauguaguauacuauaaauauauaaguauuuauauucagcguaaaaaucauuucuuagucgaaauauuuaaucuaauuguaacugauguaauuaaugauacauuugcauugaaauuaaccaucuuaauaguugccuuuaguuuuuauucguuuuuuaugaaaacaucuuaaucguagaauaaauuuuuuuaugaucguuaucuuguuaugugugcuuuuauguaauuuuaguggcuauguuggugauuauaagauagacuauuauuauauacuuaacaaagucuaauaaaauuaauacuucuuuuccuucuagacaauccaagggucuuaaaauccuuucuucuguuuacauuuugcuccauucguaggcuauugcuauaaaguacuuuauucauacacuuacguguuugaaaagauacuguuuuuguauauucauuuauauguacacauuucuaacccuuuuuauuccccuguguugcaaccuguaucucugagcauccaucugcaaucguuuuucuucugucugcaaaauaccccuuguuuccuuugauacagauuuaaugcugaggaauuaucuaauuuucuugggguccggaacauauuuaauucacuuuuauuuuugaagaacaguuuugcuggguauaaaaucauagguuaucaaugccuguccuauccaccagccuacaacccuuugaaccuaucauuccacugucuuuugacucccauugguucugcucggaaacaagcugucagucucacuguugcuucuuuuaaguuaaucugucuuccucuccucuucccuagcucuuuugauuguucucuuuuuggcaggagaaguguuguugaaauguuccucuagaucuauaauuuuuuaauuaauaaaguuuguuuucgggagaguuuaagguuuacagaaaaacuaagaagacagcauagagcucucauaugauucuuuccacagcacaguuuugucuguuacuaaagucuuacauuacugugguauauuuguuacaguucaugaaccaguacugacacauuauuuuuaaccaaagcccauaguuuacauuaaaguuuacucuuuguguggugucuuucuauggauuuugauaaguucauaauaucauguuucccucauuacagugucauacagaauaguuugcuucuauucucuggaagagauuuuggagaauugguaucauuucucacugaaguaguugguagaauucaucagugaagccaucuaggucuggugcuuuccuuuuugggagguuauuagugaucaacuuaauuucuuucauagauacagccuguuuuuuuucuggcugaacccagggcuggggucgucgccaaagugacuguaggaagugcccacaagggauagccacaaacccgccugagauggggcuggcugggauuccaaagagagaagcacuaaacccugagugaucauuugaagcguuuauuaggggaacuugccuacagagggggcagcagcuuccuugugaccacagcaagaccugaguaugucuacagggaggggucucauuguggaguuucuaugggaguugaaggaaauuggcucaccgccaauuucuaugugacagcaacaugcugaucuuucuguuucaggcaguaauggaaugcucaagcccacaggggaaguaugcagcugccuggcucacaugguggugaaggcccucugugugucucagucaggaaagagaaagggagcugggggugggcaggccacuagaaagaccgauucaugugaucucuuccuccucaugugaguuuuggugguucgugucuuucaaggaauugguccauuucaucuaaguuaucaaauuucugggcguagaguugcucauaauguuucuuuauuacccuuuagaugccuauaggauuaguagugauggcuccucuuucacuucugauguuaguaauuugugucuuccuuuuuuuuauuuuuuuuuuuuaauguugguuaaccuggcuacagauuuaugaauuuuaaggaaccagcuuuugguuuuguugguuuuucucuauggaguuccuguuuucagcuucacuguuuuuuauuguaauuuuuauuauuuauuuuguuuuauuuuauuuuuauuuauuuauuuuuuugagauggagucuugcucugucucccaggcugaagugcaguggcgugaucucggcucacugcaacuuccgccucccagguucaagcgauucuccugccucggucuuccaaguagcugggauuacagguaccugccaccacgccuggcuaauuuuuguauuuuuaguagagaugggguuucaccauguuggccaggcuggucuugaacucccaaccucaggugauccacccaccuuggccucccaaagugcugggauaacaggcgugagccacuguaccuggccaauuuuuauuauuucuugcuuuaggcuuacauuguucuucuuuuuuuaguuuccuaaugggaagcuuaguugauugauuuuagauccuucuuuuuuucuaacauuuacauucaaugcuauaaauuuuccucuaagcauggcuuuuguuucauccuacaauuuugauagguuguauuuucauuuucuuguucaaacuauucuuaaacuucucuugagacuucuuugacccaugcguuauuuacaaguggauuguuuagucuccaaauaucuugggauuuuucaguuaucuuucuguuacugauuuccaguuuaauuuuaguguggucugagagcuuacuuuauauacuuuauauucuuuuuaauuucuuuagguguguuuuauggcccaaauguggucugucuagguaaauuuuccauaugaguuugagaggaauauauauucugcuguugaugcaguguucugucauugucauuuagacccaguugauugauggggcuauugaauucugcuguguccucacugauuuucugccugcgggaucuguccguuucugauaagaggguguugaagccuccaacuguaacagugaauugagccauuucuccuuguaguucuuucagguuuuccucgcauauuuugagacacuguuguuaaguagaugcauguuaagggcggucaugucuucuuggagaaaugaccuuuuuaucggaauggagugccauuuuucauuccugaucguuuccuuguucugccugagauugaucaagcugcuccaccguucuuuuauuugggcuuaguguggucuagcuuucuuccuuuccuuucaaaguguguuuauauuuuaaguggguuccuuauaaacagcauauaauugggucuuguuuuuuuaauccauccugaccgucuuuuaauugguguguuuagaucauucacauucgaaaugaucguugauacuguuaauaccugccauguuuguuacucuuuucuauugggacacuuguucuuuguuuuuuuuaaaucuucuuuucuuuaucugcuuuguuugguuuuaacugagcauguuauaugauuuaauuuuuuaauucuguuagcacagaauuuuuuuuuucuuuuggagacagaguuuugcucuugucgcccaggcugggguacaguggcgugaucuugccaccaugcccggcuaauuuuuguauuuuuaguagagacaggguuucgccauguuggccaggcuggucuugaacuccugaccucgggugauccaccugccucagccucccaaagugcugggauuacaggcaugagccaagcacagaauuauccuagaguuugcagcauacauuuagcaugaaucuaagcccauggucagauggccuuugaccaggucacaggcagggugggcgccucccgcagaacacgcccauuccccuugccucccgugccaccugcugcuucauuucacccaucccugcaccaucgucaccccacacauugcugcuccuauacuucaaacaaucguccauuagaugaacgagacuaaggaaaguaagcuaggcucagcggcucacagcugcagucccagcgacuugggaggcugaggugggaggaucacuugagccccagagguagagguugcagugagcuaugaucacaccacugcacuccagccugggcaacagagugagacucugucucgaaaaaaacagaugaauaaaguagauuuuauuuuuccuuauuuguuacuucucugcucugucuuuccacauagaucugaguuucugaccucucaugggauucucuggagaauccaccucacacugcuuacaggggccagggcugccaaugaccaaucucccccaguuuucguuugucuaagagaguguuuuuuguuuguuuguuuguuugagacagagucucacucuguugcccaggcuggagugcaguggugcgaucuuggcucacuauagccuccacuuccuggguucaagcgauucuccugccucagccucccgaguagcugggauuacaggcgccuauuaccaugcccagcuaacuuuucuacuuucaguagagacgagguuucgccgcauuguccaggauggucucaaacuccucugacaccagaccaucugccugccuuggcuccccaaagugcugagauuacaagugugagccagugugccccgcugagaguuuuucuuucugcuuuucuuacagaagaucaucuugcuggaugcagaauuccaggcuggugcuguuuuguuucaguacuuggauaccucccuccccucucugcugccugaguggcuucggucaggaggucugaugcauuucucacucucuugguugauaaugaagggcucucccuucucaggcugucuuauuuuccacaguugaauaugauauggcuaaguguggaguuuuugguauuuuuccugcuugauguucucugagcuuccuggaucugggguuuagauuugacaaaucucggccauuaucacggcagauacuuacuguguucgcuccucgccuccuucuccuucugguuuuccugucaugaguagguuccaccuucacggucaucccacuguucuuaggucgccucuucuuuuguuuucauugcuuuuuccucagugcauuuuaguacgggaaguuucuguggaccuguuuuuacauuugcucauuuaugcucucaucuuuauuuuuauuccuauacuuucugcauauguuguuuuguuuuuuuucauuuuuuauguugguuaguuagcuugcuacuuucaguuuuagccuuucuacucuaaccauuaaauuaauacauuuucuucuaaguuauucauucuugagauugugccacugcaccguagccuagacgacagagcaagaccuugucuuaaaaaaaaaaaaaaguauucuuuuugcuuaggccgcugucgucucagaugaaguuucuccugucuuguguguguuuuuaacuagugccugaaguccguccgauguuuuccuucgucucugcccacagccaccgggucagccucccucccaggaggccccuagacuccggguaccagggcagcccgggcaggugagagaggacccagggagcuggcuuugcucucacagaggcgggguccucaugguguucugcucuagcuuguucccaugaugucagggccgggcgucccccugcggcucggucucacagcugccgugugcccauggcguuccguccucugaaggcugcugggaacugcagggucagagccgcaggaaggcaagggugggggccgcauggugccggggccgggugcacgccuugaugggaaugcuggggucacgcuggggcuguggauagcaaucucgggccucgugaguuccuccuuccggcagcccagagcggggguuagugccccccccgaucauggagagccacuuccaguggucucaccagugaggcuguccauggcacugccuccccgggcugggcgcugaccccgggacuguagggccgcagccugggcggcuccucuguuugcagcaccagccggggcucugccccuccguggucugagcgacagggcagccacaacagcucgcagcugcugaguccucuucccucagcccugugccugccuggcgguucugaagaucaaaugagguaacgugugcuuaagucauauguagcauuagcaugcugugcugaugucaccaauuaaaaucugccugagugaaucauacuugaaaacagucaguugucaaaaaaaaaaaccucguuuaggggcagcaggcccaggaaagagaagcgagggacagacaggaggcgaagcguucuguaguugguugugggggccagggcauccggcccaggagcaggcgugggccgagcacagggacgccgccucaugugcacucagcacuguggcguggcgaggcguggccuugcguuggggguggugaggcguggccuugcguggguggaggguggcgaggcguggccuugugugggggguggcuggggcugggccgggcagcccgacccccacccccaaccccuguggccguaaguggcccuccuugcugcccuuuccauugacgggugcugucuccauguacuuauuaauccuggugcaccuuuuaagcacucuuuggggcauucgugcccccguuuugcacaaggaggguggguucagagacguuaggucccuugcccaagggugcacagcuggucugugucagauuggagcgcaggacugucugacccgcguggguccuccgaggcgcuuauuacugccgcuuucgccugucaucauguucucgaugggccccacggaugccagaguccugcucauuugggaaacgaccagcugggaugaggguuccagagagaggccuccugccucucccagccucugucccagcagggccuucuccugucuggggcgaucuugcugcuggggucacagcagaccuguccaggcuggugacugggggucuggggaaagagugggcagaggacucuggggaggcggguggcagcgaggagauggugccggcgucagugggcagagccgugucugcagccccacguucccgccugaaucuauucaguuucuugugguggcuccaugcgucgggagagguaauuagaacagggcuuuucagcuauuuaugaccauacauuuccuuuucuaaaaaaaggagaaguuguggagugacucagaguuggguggagguggcugagcugaggugggaugggcuugggaagaggcccugcagagaaugucgcaugugcagaacagccuuggagcccuugcagagugggccucggccuugggcuggagggggcggagggagggaggcaggcuccacagcacugguggcagaggccgggcgggaguggguggcggaggcugggugagggaggaagaugggugaggggcugcugcuucauuggagggggcacgcgguacucagcuuacuucugggcuucucuggaaaguggggguuggugcuggggcucuaaggaggggccucugcauauggagcugccugccugccucacacagccccuucaggcugccacugacucccaggagggaagcccucuguguccaugguguggacuuagggagugcugggcgccugccucaccaggcguggccauggccagaggcuguccccaucgugcgggacgcgccugccccaccugccugcucuccuggccaucuuucacgagcagcuguagucauaguggaagaaccaggcagacagcagcgaggacagaagugaccaccguggcugccgugcauucaucgccuguguaugcggguuccgugugccugguuuucugugccaugcugcauuugaacuucgcagugaggcugaggcguucucugcccucuccugugugguugaguguccucacacucagagaggcucuuuguuuuucccaaggucacacaucuaguuacgguccaggcaggaugugggcuucguuggguguguguguugggucugacuugggggcuggccugggcaugcacaccucaagugaccgcugcuugggggccacggggccggucucugcccacugcggugccuccguccauaucuccccugccugcagcaccuccaacagggccggcguccugcagucucccgcuccugugggugcucucaccacccgcagcccuggucucugucucggcuuccuggucucgcugcucugaucuccccugcccuucccaagcccaggcccaagggcugugcccuggguuucuucuuccaagggcacugggcccuauucugcccacugucucagccccugcugcccagguguccugcccccugcuauggcguucucagccucuuugggaaucugucucucauugcgugggaaucaucggcaugcuuggggcuuauacucaaaagcucugugguaauuagcgcgccggagcaccugcugaugagggaaugagcgucauuaucucucuugcucuuucgcaaggguccucugggcgccuacucaacgcuguucccucugauuggagugcccuuccccaccgcugccucccagggcgcccagauccuuccugcagccucccugggugagcagccccucugcccgacuaucgcaggccagggcagagccgcccucuacugcugcccccggcccccaucggccgguguauccagggcaccgaggcccuguccucagcugacuucuuccaggugaugccgacugcucaccuucucuucacauggccguucguugcaugaugagcacauucuauuccuuagaaccgggacguuucuguaccuaaggaggagcagccaguggacaauguaacucugcugggugcuucuuaaagcgagucugggacgcccccgucagcacugccagccgccuguuuguucagcaguuaaucaccgcauuugcugagguggaaaugaaguggacuugcccgcagguggagucagcuguuaaaaagucauagcaagucacacccacaccgugccugcuguuucacuaccggugacaaaacagguucuugaaaggguacaaacaacaaacuuucuaaugcuuuucuucugugccagccagugcuagccuggaguuaggcugaagagagccgucacgaagagaagcucucagagauuuacugaucaauaaaagagacaauuacagcuuguuuaccaagggaagucccccgccccggccuugcgcggcguccgcgcguugguacugacaacuccgguaacuggcuugaaacgauaaaagucaaugggaagauauaggauuucaauaagauuaugacacacgauaaaccuuccugugcaaacaaauuuuccacagauacgugacccguucuaguuggauuuguaacuuuaauuucucacuuauugaauuuugaauuuuuugucaucagcuaauuaugaaguccacaccaggguggcaccugugucccuggcucaagagacagacggcaggagagccccagacguggcggccugagcuccagggucuucugagagagcaggccgggguuuccugagccccugcagccucgcccuccucgccugugggggauagaccgagggccuggcaggggccaggcagucaucagugcuggggagcacugggucggucucuccuaggagccaggcggggccugggcgggggcucagcuuguguacgugcagacucaggaggccgcacggaagggacccuggcaguuuugugcacuccgcuucugggugggggucuugcuccccaggcugccugagugagcuggucucuaucagggccaugaauuugcccuuucagccaguacuggugggggcgguccccacagcucuccugcccucaccugguggggagcacgcuggccacaacucaaugagguggugcagggcugugccggagcauuggccccuugcgcagcauguguguugggaaggggugugggccaguggagaccgcuucccggguuugugagguccuggcucucgcuucuugagcaccuguuguuuccagggcagcuggcuggacaguucauuccugacagcaucagucuucauggccaccccauuucccaucuuaucaacaaaggaacugagacuuggggagggagguugaauagcuggccucaggacagagcuggggcuugaaccugcaucuuauagauacccauccgcuucuuccugggcucuacuaccccagcauccucauccuccaucucucaagaauggggcagagccccucagcagaggcugcugagagcaucaguuagaugucccuggggcacauguuagaagggcagauucccaggcccacccugaaucuacguccagggcauccagaugcccgugaagaucuggaagcugcccucccgcacaccugggugggugucuggagggcuggcucccugaucaugugguuccugugggcucacgcagggcggacaggcaggagaaggucgccagccugcgccuggaaucugcuccauccagacucagcgucugagaccagaaggguccgggggcugugguucaggcccacaccuggggcagggagugcaggcaaugggaggccagagggaagaccacacuuccccgcagcagcacguccuuuuugggggccaucuuggcagcucaguucccgacccaugggcacccgcagggucuggaggcagcacacagcucccggggccccugacuggcuggcaggacacaacugagcagggguuucugcccggcucuaggaaucagcccugacacuguggucagugucaucccaggaagcugagcccugcugggccuggcugcucuguagggaucugcguguggccuccgacauccugggagcucugugggaagacaaggagcuccccagcccagagcugaaaagcggggacucagccuucccgagagcccugggcgguuggacgagcgauggguuuccugucccauuggaacgcagcagcuuccuggugcacacuguccccucccucgacagguccgggcagaggucccaggaagagggggacucacccagcucugggccugcccacugucguuucccugggcccagugugacugggacucagaggagucacgcagacccaauagaacaggcugggguggggaaccugggcuucugcccacugugcgcccucgccuugugugugcuguguccacaggggcagaggcgucugcucccagccgaccccauagccauacugccgguacgagguggagcccacacccgcuguagugaaggccugacguggucagagcgggugccgaggcaaagccagggcugcuggcauuuacugggucuggggaugcugaacucuggggcccucuucacuuuggugggcccucaggggugggcucugagugcuggccuggguccucacgagggagcccccgcgugacccagcucucguggggccuucccugagccgucuccaucauuaccucaucccccgucccggguccugaucagcugcccucuguguccacaggagcgggacgguaugcgggccauccugggguccuacgacagcgagcugaccccggccgaguacucaccccagcugacgcggcgcaugcgggaggcugaggauauggugcagaaggugcacagccacagcgccgagauggaggugaggggccgcgggcguggggcucacgucgccagguggggcuucuucccggugggccuuggcagagccugcggcggggagguggaggucuggaccccgccuccccaguucccggcuggcaggugucugucagggaggguguccacgggcugcuuccucugcauguggauccacguuaauucucacgauggcaccugcagcauccuccgcugucagggugucucagguggucccagccugcaagcggaugacagagggacagugccccuuugacugguuaggaccgccucaugaugccugccaaaggggcacucaagguccuuccccugugaggggcaucugccaaggagaccuggucuccgggugcucagaguuguugccagggcucuaguccccgcugcuggggaggcucugcuggggccugacgggcagggugugaggcccagggcgcccagcucccuguggaacugggagagguguuccuccuuguugcagccuccaggcugcaucccucuccuggcuccaggguucucccaggagagguggccucagccuuggcuucugccuuuucccugccccaugggccaccgugacgcuccgugcccuugucuagcucugagcagcucucaccugugcagugggaagaaggagcuggguaucgcagggccugggcggaggccacguccacacuccccauccacacuucucaucuacacuggggccgggggcuccuagcacaccguucccagccuggagcuugaaaggcccguguucuccucucaggauuugcaccacuucuccgugggcacagugcagccccgccugggcguggugggauaccugccagggucuucuggccucgcuggcacacgccgccgccgggugccuuaccauucugcucugccuggcccuuuaccugacugcucagucucauugucaccguauccuauggagugggugccguugugauccgaauuucgcucacgaggaaacccaggccugggggcgucaagggacaugcccaggucaccgagcuggugugugacaccgccaggccacaucucagagggccugggccuguggugucugcgagcacagcugaacagccgagcucugugagcucuuuggucucaagggucacugugucugggcugggccuugaugguggagacugcggugagauggagaugcagaugauggcaucgguguggccuguugcccuguuguaggcugcuguguccuuuccucauucagccagugaccagcuggaagaugaccugggucccccgauggagagccagccucacaggcgugaccacagccaccuuccagccgggcugcugagcacacacagcaggcugggccgugugccagggaaagucugacagagccucuggccccuggagccgagcugcuggguaggggagacauuuaaugaacaaacauaauucaugugggauguuaggaggagcugaauuucuggagaaaggauuguaauggagggucucagggagcugcgcugcaugggcgucccagcagcuguucagggaagaugggagaaggaggucgccaaacuacaucuagaaagcugcuuggcagaugguucagugguuuagagggggcgugggcacagaggcucaggcacuggggauggcacuuggcgagaaugacaggucccagcccaggaggccccaggcccagggcccacaugcacucgcuaccccuugcucacauggaggccacgccgaagggcccuggaacuaugccguguccccaccuaugggugagcccucaaccaccaccacgcuugacaagagugaacccugggugugagaccacccucaggcacugguacugcccccugguguguucuucugaugcccugcccccucuguccauccuccuuccucccgcuccuggcuuuccuuucugugucuagccaucccgugcgugcagggccugcugcggagggcugcacacugaccuucagucgucacgggaaaggcuagcuccggcuguaccugggagcugucguaaaccuaagugcguuaauagccaucucauugcaacacccuuggcucccugugaagcauuaaugaagagagauuugcggggagggucucugaccccuucugccgucccuggcguuuuccacguugagcgauuucuccagccugugcuugcccucugcacugugauuggcucgucacgggccuggccgugggcacauccagaguccuggguucugguguuuuguguguuaaggcgaucagggcugucagggaccucaggacucauugaccagaugcuggcacuguuugggcaccgugcuugcccccuugccgggcagcuuggagccucagcccucacccugcuagugggauguauguugcggaccuugccccucccuucccaugguggggugugggggcagguuacuccccuuccugucugucuccugggguuucaggagaauuaggcacauagaagaguugggcccagcagggcuagagcagggucagacuccaccagcacugacuaguccucacugugggaguucacacggcugguccucccugagcccucacagccuccucugcccaucccccuggguacccuccagaagcaggccagcaccugcagucuccccccaggaccccgcugcacuggccugucuguguugauggagacagccacgguaucggcugcuggcacagauuccagagaggucuuccaggccccuggcuguucccugagccugugcaggugccacugcccucuggggucuguggagcagccaccaccacauccugcaugacagcgugaccugaugccuugccucaucagagggggcaccuccgcgucagcucuuuccucccaggagccugggagaggugucccugccuuucugccucagcgggaccaggucaccugcggagccugugcccugccuuucccugaagugacagucgggugggaggcugggggugccgccagcuccugggcuggguuccugccucaggggagcaucugcugggggcuccccaccuccucauggauguggcgcaaguucgggagaacguggccccaacucugggaacuaagcauguuugcaaggugaaggcgggggcccagcaggagugcuaugcuccagggaagguuggggcgcggcugcacaugaaguguggcaaggguggcugcacccucugugcacagggagccccuggggcagggacgccagcccaagccagggaugcccccguggagggccaaggggcugcucuggagacccugcacaugccgcgugucucuggcuguugguuucugugaagggcccgucuccucuucuccucacggucgggggguggggggccgccaucgccccagccggggagggcuccugaccccacagagcccaggugcuccccccgaacccccugccucccucucucccugcuaccuccacccgguuuuucuuuucuuucuguuucccgucuccuuuucccuucuugauuuucuuucuguccucugcacgcaugucugauaguuccugucuccaucuuucccucucccuuggccucuguucaccccucugucccccacucacacuccuaugucuucugaccucgggccucgcaagccuucccuggaagcuugcccggcccugcgcaugccccuggggaaggcgccucucggggcaggugaggaucugcuaccugaccgccaggugggcucgggguagucgccagcgggaggaugcagcaucgcucugagagugguucccuuccacccacccguuagcuaaaccagacaccagucuguucucaucuggaccauguuuucauucuagcagagacguugcaggaaaacaguguugaguugggagaaccccagacccgucuggugaaguuuugccgucuugcacgguguuauuuauuccauuuaauaaagcggcugcgggagcccguagcaugugucaggaguccucuguggauagagcuauaaauacgcagugcacgccaccuugauucaacacauuggccugauuuguguuuccgauuuauuuaauuaaaagcgauuacugcgcugcuggccguguggagguguguggagaauccccguuucagguugcagggacucugaaauaguuccuaacgauuuaggcagaaguggccgucacgguguuuccgucuucccuuccuccccgugaccucccagaggcucgggcagcucugcgggugcugucacuuggcugccgugggugguuuggcuccaggagggcuggggagagccugaucuucagggccucggguuguucaccaggcccaauacuugugaguguguuggugauguuucccucauugaaagaacuugagaugacuguacuguacgaagcagagauaaagccaaaaaaaaaaaaaaaaaaaaaaaccuguuaaaaaucaugcagugaagaaaagugggccaagggguuuauggaaaccacccuggagucugggcugugggagccucugcuguguggccacagguccucagugggaaucgcgaggugcuggcuccauucccagaacggggcgucugugcaguacagaacugcgcugagccgggcuccccgugacacgccggugccacccccggcagcacacacuuagagcaccgcugcccagcacaggagcugacguugcugggcgugaggaauaagcccagggcaggcucuguccucuccaccaugggaggaccugcugccacccucagagcaucccccagggccugggcguccacccccuagccuuccuugcaucaggggcugcaguggagccccugaccgugcacugacugccuguugugugcucuguggccagcgcugggcucacagucauccucagaccuccacccacagggagagcuucuguguacagccucacccaggggcaggugcuggggcuguggccugguuagcccuguggggacccuguggugugccgccuccugcuucuucacguugugucacaagccacuuggagaccuggccaggaagguggaggccugagcuuccgucccauccuuuuccacgugaccgugaccaugaccaccgguggggcugccuuccccuagcuccagccuuuguaccguguguggggucugugccuggugcccucugguccuccucaguccggcuguccuguggcugcuggggucuguggcugccuguccuagccauuuucugccauguccuggcuggcaggaguguuggaucacaggcagcaacuucucaccucaggauaaaaauagcccggcugaggccucugugcagcaccucgguggugccaagggcgccagggcccggggcucgugucucagcacacguagccacccgggacacguggucccacccggaaagagcugugugugacccuucagcugcuuggguggaggcagcucccuggucacucggugccaggguugcggggccggggcguggcugcgcugggggccugcucguacugguuuucccgccaugugaugaaacccucuccccacagccuccgcaccccucagugcucccuggugugugccccugaagccuggcuccgagugggcuuggccucuccuggggaacccgagcacugcgucaggucguuugggauggagccguguuccuucccaccugagcuuccugcgugucugcgucugaggcuguuugggauggagccguguuccuucccccccugagcuuccugcgugucugcgucugaggcuguuugggauggagccguguuccuucccaccugagcuuccugugugucugcacccagcccggggugggcuguggaggaggggcugaggcuggggaagugccuggccugccugcgagcaggcuuggcaucugguguucccagccgucagcccagcccccaccccgggccuugggaagcucucucuccaucccaccaucuccgcaucagaacaggcugcacccuacacugccuugcggagccaaccugagcuuggggagcucuugucucagaggugaggacgcuguggccagggccugggggcuccacccggucacccagagagugagaggugucugugucccccgaaggugacugggcagccccacagucagugcuaaagugcacuguccaggguguuuccacagggggugcucugccgcccacccacugccuccaucacagaugcgguuuccuggaggaacccuaccgagaccagccuggaguugcgcugucugaggcccugcgggagcugcucuccagugcacacacgggcugugccagcuccucgcccuugugagugugguucuccccgagcucuggggauuccauguuuuaaaggcagccuuauugaaauaugauuuauacucaguaaaaucccccagcuuuaucuguaugauuugauccauguugaccgucaguuuccugccaccccuggcucguagagacaccggucuggggccugugacuguuguuuugggcuuucuuggaacuucacguaaacagaguccugcaguugcugugucugucaucucugacugagcacagagcuuuugagacccaucaacguuguaucagcaguucauuuacuuuuauuacaaaauaauucucuauccugagacucuaccaaaauggucucgucuguucacccacugaccaauaccagggugguuucccauucuugccagcugggacagagcugcugugaauaucugcgugccagacuuccugugaaugcagguuuucauuccuuugggcucuacauccaggaguaggauugugggguuuaacuuuuuuuggcggggacaguguggggacagagucucgcucagucgcccgggcuggaauguaguggcgugaucuuggcucacugcagccuccgcuugccggguucaagugauucuccugccuugguauccugaguagcugggacuacaggcaugcaccaccacacccagcuaauuuuuguauuuuuaguaauuucaccauguuggccaggcuggucucaaacuccugacuucaggugauccacccgccucggccucccaaagugcugggauuccaggcgugagccaccgggccgggcccuaacuucuuaagacauugccaggcucuucccagcggccauaccguggcaacacgcgggguccagugacgcguuacugcacaggcugucggcaccagagcugggagaacgcuccgcuguggcacugucggcuuugguaucuggauccagcggggcagcagcacauuuagcccuggcuucaaucugugugucuccagugacugacgugcccagcguuucccgugcuucuccaccucggcgccucuucucugguggcgucuguucaggucccuucccucugucuggugcuggccugccaggcccagcugcccaucugugccuccuggaguucccauuccucucuccucacccagcaggccugcugggcucugucuguggcacugccccggccugcguccugggggacucaccccauccccucccgcggcucugagcucugagcugccugcccucccucgcaggaaucccacuguuccuuguguuguaucuggugucuggggacugagguggggggugugucugugcugguuccuacagcuuguccagaaggagaaguucuagcgcauuuuggagcccaugagagccugucccccaaagcuuccuggugccccaucugggagccuccucugcgcacacagagagcgucgucuugggucucucgggaccccaauguccugccucgccucuccugugcugggccgugcggguuuagugauguccugucucuccuguguugggcuguguggguuuagugaugucccgucucuccuguguugggcugugcggguuuaaugauguccucucucuucugugcugggccgugcggguuuagugaugucccgucucuccugugcugggccgugcggguuucgguguuuucuuuguuuuucuuacuuuagcuguguucuuggaacaauaaggugagggaggaguggacguuugccaaaugcuccucggugcugggacucugcugugagcuucucacacccucccuccacagaaccuggggaggcccaggacaggcacgcauuguggcugacaccccaggccacagccaccuucguucucccaacucccuccugcccuguccacacccgcucccauguaaaacauucuuuuuuguuacuuggaaacuucaugucugaccacuuacccuguuggagcugcagacagcaguguguguccuugaauggccacagggccugcucgucuguguucucucgguguuccauggcucuguucuuaggagcacccacacgugucuuuucagguuaugagugagagguggcugagguguccugcacccacaaaccuugugcuguagaaugucuauaagccagaccugagcucccuccugccucccugccgcucccccaucuccaugcccauggagcgugcucuccauuucacacuccuggaauuccggccccucugcgugcugagcuucugucugguggcugcucugcugagaacccuccgccuggagucaccucugacucaggguugugcagugucccauuuggccauccauuugggaagaugcagccgguuacaaacgaacuuuuuuuguuuuguuuuacaucuucguuuuuguuuuuuugacacagggucucacucuguugcccaggcugaagugcaguggcccagucauggcucacugcagccucaaccucuuggucucaagagauccuccugccucagcucccugaguagcugggaccacaguugugugcuaccacacccagcugauuuuuaaauuuuuuauagaaacaggaucucuguauguuguccaggcuggucucgaacuccuaaccucaagcaguuguccugccuuggccucccuaaaugcuggugucacaggcaugagcacggugccuggaugaaaccauuucucuuuaugguaacagaaccguccuucuuuuccucccuaauucgucccccagggugcuagaguauauguuuuaauggaaauauaacacaauacaccaaagugcacagauuguaaguuuucagccugucggacgacagagcgaguguguguguaaccccccuaaugcaggcgaagacacagaacuuccugggucacacaggaccccguggaugucucuuugcagucugagugacaccuguguguucagucuucagugaaagguggcucucacugucuguaagccgucugucuucauggcuggauggcuccugugaugcccucugcuguccuggucgccuccuggggagcacucagcucgucgaugucugccuucuugaacccagggcccugcgugugagccgagccauagcugcuccugcugacgugcggucguccuccuggccgcaucccggggcugcacucucacgggagcugcuccaagcaggcccugcccagguacccgagaccagugcgcgagucugaguucagggcuccuuggcuccgagucaccuuucgccagcgacuguggcuuugaggauguaucagaaaucucacuggugucuguguuuccaggcccugggucaugugaggauuucagaugcaugcguucuguuuuuuccagccaucgauggaagugcuaggcugaauggggcugguacggagguggacgccucggccucaggcugaugagccgcuugugaaugaacuugucuucagacacacaucacucagugcuguccucacagaaaccugaugaagccuucggaaaaugccugcagccugcccgcguggcgccggaggcugugaaggcugaggcugcuguggccugccuggccucggcaggacccugggcuggccaccguggucacggcuccacccugcagugauucugugucgggaggcacaggagagcgugguugguccgggccucgcgcacagcucucagcccugcugcuuccggacgacccugccucuucuaagcugcuccuguaaagugccuuugaccuugcaagguugccaugugaacugauguaaauggggaugacgaugugccucaccuguagcugucaccugaggccggugcccaucgugccagccgccugugugcccaggacagugugccggguguggcggacauggacgggcugccagggguguggguggcucuaacgggugcaucucgcugcccaggccagcucagagcuuugccaggggugcgggcagcucucaugggugcgucucacugcccaggccaccucagagccuuguugucguccccccuguuugggcugcucucuggccugguggccugugggugcugguagaccugggcgggguguagggcugcgugaggagagccugaguguggacugcagcugccucccaugugcugaggcucugcccaggggcauggggugcccuggaugccccgacccggcucccugugcccccgggagugcccagggcugcagcucggugaagugcguugugucuaggcccaguuugggggaugucccucuuccaucugccguucccagucccagcugcuggugaccccagcaguggccggauuauccaggguucagcuggcugugaggagggcagugugcugcuccuaggccucgaggcaccaagcuuuccagugugggguccacacagcccagcguggccacggccaccugccuccugaugacaguggcuaggcuggcuccagggccucccccagggcagugugagggcagcaggcggggcuggucaugggcagagcucaaggccuuccccucauccacaggcguugcacagggguguugggcaaugggggucccuccgguggccccacugagugaggccccacaccagaggcuugggaggcucaggugcucacaccugcagccuccacgggagcaccuggagccuggguuugacucugcuguggcguccagaaccagcaggcaccaggauagcccgugggaaguccagagccuggcucuggcugggccuguaggggagcuugggggcccauggucugcagagcggacagguugaggacugugggcuguugccucagccacuuuccccaggcuguguccccaggggcuguagugccuuguuuucugugucuccaaacauacuucccccauccccaccacaugugcacaugccacacacaggugugcauauacauacccacacuuguguacacgcacauacacacgccuccccgccucucucccguuucuccuggugacuugccuggugguuuccaguugccgcugggccaggcaucugccugccucucgauuucucccucacccucaggccugcugggccuccaccccgcagaucccacaccccaccacagccaccugccucacuccugggcuggcccuccaucuccuucccggacuuuccugugugcuguggccugggggggucucacaaggcccccugccucgcccuuccucccagguucuaggacagagccgcaauguguuuagguggugggggcaguggggagccaagcggggucgugggaaggagucaggaaggggcagagggagaggaugugggggaagguaggaaccgcaggggcagaggcccagggcgggggucuccgagguccugagccccaugcaccgugcaggucaugggugcagggucacuguccccagcagggagcuggacugcugacauccuggccccacaaccagacccagccuugcugcuccaugaggccuguuaggaggaggcggcuggcuuuucauugcuggcuuuucuacccuuaguguggggucaagccuggugcccuuuggggagugugucggggcaggagacccuuccugccugggucgggguccugcuuggggguggccgugguggaggagaugcucugagguggggccucugccuggaaggucaccugauucuguucuuuaagcacgagccugccagggagagugaauugauuuccucugacugaaagucccaugcugaaccuuucccuccgucucuccccaguuccacagucccucuugggcccaccccuguccaccccauucacagucaguuuccugaggcagguuuuaggaauggaccuugguucugugaagccucccgcagcccacucggucuucgucuccaucaguugucuccaucacugggcucucggccucgcggggcagccacacuggccccugcccacccucuggcugcccacuucccagcuccugggucccguugcuccccagagaguggaggcugcggggugguggggguuguguucccugcaguccuagaaauggggccuggcccaccacagucucaggccgaauccugucuugucuugcaggcucagcugucgcaggcccuggaggagcugggaggccagaaacaaagagcagacauggugagucagacgcgggaguggcugggauucagggcaccuggacccugggucugggcagggacgccuguccccauaagccuuuaggcugcaggcgccagugcauggcugccucuucugucgucggaagcugcguugagcggggaagggugugugaggagccugagucccaucucuacuagugacagguggcaugcgccggcggggagcacagccccucgggccccaccaccguguuuguggcagggggccagugacauguuugccgcaugaggccacggugucggggcaaagcaggugugagagccuacgaggggucuguccagcagcgaacuggacaucagugcuguggcuucauggaccccugucccgaccacacaggacccgaguccccagugggacagugccucagccggggcuugggcgccacucagcauggguccugaccaggagagggacgucucuagugagugcuuaucugcccucugugaaugcagcaggcgugcuuuuaagcuguuuucuccucagcccacaugggccccacucuccuggcugccuccgagccuggguggggggcccgcagugugggcccgugggggaccaggcaggcucuccugguuucuggaccuccagugucaaaagcuucccacuguuuuagggaacaaaugggcuuugcuuuugaagcguuuuggccuaaacaaaguguagguucccuccaugcugcccuggccuuggccaugucugugaaggacaaggacggcccuggggcaugcgugcgugcgugugucugcauguucugcccugggccaugcgucaggcuggccugggucacaggcagagcugcugucggcguuguacggaccccagggccugcagcccaggucgaggcucccgucgggcauccuugcuugccagcucgugacugugagccgguguccuggcucucagggccucagggccuuccucuccacccggcaggggugugcugaggguucauugcuugacaggcucuggggcuggcagcacagccuguggcgguugugggugcggccaugguuacaggcccuucucaugggacaggguuggaugggguuggaaaucaccgucuugagagguacgggcaccagggccuaggcugggaaugggcgagggcugucugcagacccuggaagaagcugcccagcggcgcagagaggcaacagcagggcaccgcgcgggucugggcagagcuggcaucugcaggaccaaggccaggugggcuggcaacagcuguccugagccucuggaauggucgcuguucacucagcagcugcuuaaggacauucuucuuggugcuggggacgcggcagccagcaacacaggcuccugcccuccuggaggcacacuguugccaagugaguagucaguggcccauaggagagugaaagacagaacuuccggugguggcgaauggaggagccgcauucucccggggccgcucugcagagcguccugagccaagccugggggacccgacuguuggugguggaaaugguggggcaggcaggucccggacccaacagugagguuaggggugacagaagcgggguccgcggugguugguaguccaaccuugugggcccuguguggucacggcagggcugugguuucauggguggaggagguggugacacaaccugguguccauucguaaaggaugccuggcugcucugugcagggccgcaaugggugggaaguggcaggccggggugggagacgcaggugcccugggcuaggacugcaauggcgugcggaggcgugguccgaguccgcugcguugaagggagaugcaggugagguagagagcgugagggcugggaaucaaggacggcuucggcauuccgccccgggugggcucaugguaugggguggggagauugagggugaagugugggagucucacgccugccacacguuggaugcacagggcuggaggcuuugagucggugcccuggggucagaggugcccaucugcucugcaugguguuucuguuguugggaaugaguagguagcagagaagucagaacuggaggcucaagccucuuuggggcauuccagcauccuggcaucuagucuuggggagcagccaugaguugggguacuccguggagggcaggugcagucacagagcccuggagaaggaaguguuuucaggggacagucagacugcagagaagacccggaaggggagcagaggauugcccugggcccugcggccggcguuucauugaugagaggagaggcccagaagggccuggucaggggcugggccuggagccgggagggaagauucgcuuuaccgaugggcagugggagagcgguuuaugcugaagggagccuuacuguagugacgggcaugauguagggcuggggcaguggaggggcaucgaaaggggcuggggccagcagguugcuggagcuuccugucuccuccugaagugggcaugaggcgcacuggccugugaggguccccgcagucccgcugagguuugugguguaaacuuggagccagguugggcgucaggcuucugucugccacgcucaggugcuucccagcagacacagucauggggaaugggguuuaccagggcggguuugccaggggagcgcaguggagggagggaggcggagaugugacgcuuugcucagcggagggaaaaucaggcuguugggggcuccaggacaggccuuucucaggucuggguuuuaaaauuggagaaauuggaguaucaaccauguuuuucuuuaggcuguagaaauacuggggggugggguuguuguuuuguuuauuuuccucucuguguucugcugugaccuuucauugcugauguaguuugcaggggaacccauuguaacuguauuguuuaauggcaggucugagacucgguuuccauuccucugcccucaucugagauggcucagggcaggccugaaagaugcuccugcuucagugagcggguuaguggggacucuguggaguguggggucugguguccagcagugugugggguuagggggcucuguggacuguggggucuguggacuguggggucugguguccagcagugagugggguuaggggacucuguggacuguggggucuguggacuguggggucugguguccagcagugagugggguuaggggacucuguggacuguggggucugguguccagcagugagugggguuagggggucuguggacuguggggucugguuccccugagugcagguguucaggaaggaugccaggguccucuucugccugugugggggcuuggcgggggguuggcaggggguuggugggggacacacccagagccuuccuaguucccagcccugagggcugucggugcuuccuucucagugacugagcuuucuggacccuucagugaggacccuuuuccuguugccucuggaacagccugggguggguggagggaugcucccaucugaagaugcccuguggagacccugguguucugugugucaacacgcuggcugccucacuguuggccugaauugaaacgugccugggggccaugcuucugcaugugcaggaggccaggaggguuagaaauggaguugucugagcacaggccaagcccucggcauuauggcugagccaccugcccggcaccugcagcugcccuggagcauggacuccccauguccaacagaggcacggacgccucggagcuggcaucuugacccgggcaucggcccuugucuggcugcaggugguuuuggaggagcugcucacuccaguccucuuuuguggggagagagacagaaacuggucuugggcccucaggugggguggguguggccgccccuggagugcuggcuucuccagauaucugguucuggucagggggcugugaggugcgcuuggugcagcgcugggcuggagguuuggcugcuuuucaaccuguguuuuuucucuuuuuuagcccauauaauuucuguuccuuauucaucguacgcagcaccguuuaagcgcuaaugccugggccccaagcugcagcauuugacuucgaauuuggugggaggauugcccccaagcagaaucaugauuuuaccccucccuggguugagcuccuguuccuggccccguccuuuguuuggagccgcagggcucccgagggacgagaggaggggucucgcuggcugugugccccucuugccaugcaaagcccuucagaggagguccuggggagagcagugccaggcaagggggcuacagacaccgugguuggggcuggccccugccaggcaugccugaaggccaguggccucccuccccugccccccgccaccgcacugggcugugcagcccugggcuccagguugccccuucucugugugacccagagcccucagugucauggcuucuucccggggguuacaggugcauguuccugucugaagggggucucugggcugcgggacagccugacucccuuuucauuuuaugguggaggaaccugagcgggagcucgcccugagcugggauggcuggagucacccaggucuggcucugaggccccucccacccaguucccugugacuggcucggcagugggugcugucuggggaaggggcucccuugucccuggaaaggcuggggccuagguggucugcacccucagggcuuguguggagaagccacauucuaggcagggcugacugugucacucacgccuucuguccacaguggucugggacauggcccuagugcccgucccgucucccagccugcagcuccuuuaccugcuauuuuccaacccaaagucauuuuguuauuuaggaaaugagaaaagagagaaaaaagaaaaauuuaaaucuuuaguuaauugccaaugacaagacaaaggcacucugacuuucuuauuauuaauuagcaaacccguacuaauuaguaagcauaaguacaauucauguuuuuuucuuuaaaugcaauuaauaucgcaaggagagauuuccugggccaucgucguaucauuagcgaaccccccuaauuagcuaggcccgcaguggcuggagaugggagucuuuugauuacagcucuaaaauauccucuaauauuuuauagacuuuggggagugaggagugaagcuuuauuuuccgauucagagggaauuacgccgcucucagcucuaaaauauccucuaauauuuuauagacuuuggggagugaggagugaagcuuuauuuuccgauucagagggaauuacgccgcucucagcucugauuaagcagcaucuuccuugauugcugauuucccuuuguggccccucugugccugcuccuugcucccaggggcacccugugccaagucugccucaccaagggccguggcuacagcagcacugaggcccggacaggcugcuucccgucccccacccuucuuuguccaucucugaaaugggaagggugucgaggcccacucugagucgggccuagcggcaggugcuuuacagacagauucugaaaucuggcgaccgugagcagggcaggucccgugggcccaugaagaagcucuaggcucucuggggucuccugugcaggagccugugguccguguggcucucagagccucuggcuucucaugggaggcugaggacaccggcggagcuucccugaagagacucccagugaggcauguguagacccgggggacccugcccgcccagcagccguguguagacccggggggacccugcccgcccagcagccguguguagacccggggggacccugcccgcccaggagccguguguagacccggggggacccugcccgcccaggagccguguguagacccggggggacccugcccgcccagcagccguguguagacccgggggacccugcaugcccaggagcuguguguagaccggcagggcccggcacacacgggaggcguggcuggugccucuaucuucacuggugcugcuacugaagauggaccaggcagcugugagccccucgucagugcugguccucauggcugugcccagcccggaaucugucuggucacauccagcagcauggccagugccugcagaugaaugaucaugagagccuccuggugugguaacugacaguaccucauuucaccuuccggacccauccugcuccacgacgaagugcuacuucugacuggagugcuucgugcuuggcaugcuggaggggcuugcugcuggcaccgggguucuguauggcugguggcaccgggguucuguauggcugcuggcagccuccuggucccuggaaaccuguucaguucacgcugcaccagcauguauguccccgcgcgcgcuggugugcagguguccugagcuuggagaggcucuuuggggccagggaugugucuggggcaggucuggggaauggcucaaagucugagacuguguccuuagcucacucuccuccucuccagcccuggaggcggccucuccugggccccccgccuggggcuccugcgcccgcccuuccaucccacacaacuggucccuucccucagccacaccugucaccucucuugcuguguggccacaggcaggugcuucacugccugguccucaggguggagagaggaagcggggagccucccuggagucucacaaagcuaagugaguucgugugcugggaagauccaggcuguucugggaagugauucugggugagaacaggggccugaucuuccucagcagccccggggcugguuccaggcucgcugcccguucaccagcucagguuucccugcguccagccucauccucagugcgugccccgaggugccccccgaggcuucuccacagaguggaaggaaucgugcuggccacagcaggugucacauggagcaaccuuugcuuuaaaugccucuugcauuggagggaaguugucuaauucagcaagcauuuguugagugccucuucuaggcuguugucugagggaacagagacccuguggcugcgcaucugucuauucagcugcccuaacaggaacaccgcagacugggcugcuuaaaguagcagauguuggccgggcgugguggcuuacgccuguaaucccagcacuuugggaagcugggguggguggaaaucuugagcccaggaguucgagacuggccugggcaacagagugagaccucgucucuguuuaaaaaaauaaaauaaaacaaaacccuugcagacauuuguugcucacgguucugcaggcuggaaguccaggaucaggaacuggccggucugguguuugcugaggcuuccugguuccagauggcgcccucucacuguguccucacacggugggaggggcgagggagcucuggggucccuuuuaugagggugcuaaucccccccccgaggcuccgcccgguggccuccucaccuccccgggcucccuccuaggauuucagcaugagagcgggagcacacaguccauggcaugggcccaccuccuuccugcugugugagacccggugggcgcucacugcccugcccaguccuccuacuggggggucucugccuggucccucagugcccgaugggccugcccugccuacggugauguccccacccucugagcacaucuucucacgcccuuccaagcaaucccugugcugcucccccucugaggaugucuuuucaguucagcggagccucaggcccccugggaauugagcuggacccgugcugcugccccugcaucgcagacacgcucuucccucccugccuucacggggccugcaccuucaccaucaccgccaccaucgucccugugcugcccuggguguggcgguggcacgugcaaagccagugugugcuguugcucaccaugucaugaguacacacuuguuguuuacacagauuaucccccugugauccuggcagcaaacccacaagcugguuguggccccagauacucagacgaggaacaggggcagccaggauuagugaccugcccguguuggcaccggcagugguggagagugcuccaggguucacacccaggcaggcugaccccagacccuguggccagggcaguugcaggggcuuccucauaucaggcugucugugaaauccaccaggacaggacccagggcuuucuggggcuccagcguuagcccagggccaggcauucagcuggggaguuuaaagcaucugccgagugcugaguggggacaggugggaggaggaugcuucaucuucccucuguccccuuucccagugugaggacccagccuuuucaguuuuuaccaguuugcaaagaucuuaugagaagaugcuggugauuuaaugucguuaccuuguaaggaucaucugcauuuuagaaaaaguagcugagaagaugguuucuucgcccagaaaauagauuucucaggcauaaugucugagccuugguuguagaggauuuggaucccugcuucuccuccaaaaaacagaagaaaaucucagugcagagggaaggcguaagcuuguuuucuaucugggccagugccacagugugugagcuagcagagccucagagugugucugauacgucgugaccuuuguguuauuuucucuuucagaaugaucuuagauauucuccaauguuuuuuccgguaaacuuuagagggagcuugccaagguuccugccaguccucuugcauugccuuggucugcggacugacaugggaaggcaagcugguugcauuguggcucccccagaagcccugugcccucccugcacuguggguccugcccacugcuuacuaggguuauuccugggugguuuagaaucucagucaccugcaugucacugcugucugcacacuugccauaugacccaugggggcaucuuuugggcguugggggcggggaugaggagaaggugggcacuucagacucagagcagugaagucccccgugcauuccacuccacgaaacuuagaucgagucuauaauaaccacgagaaaggaaaucgguucauuuaucuugaaaaauuaugggaguaauucuguauaggggaaauauaguacccucauccuaaguacgaagcauuuuccugugauuuaaacuugucgugucucugcaguggcccuuucuggcuuaagcuuuuucucagcuacguguaucuuccauaagcugaucccguucuggccccaggcccacaauggugucaccugccccugccccugccccugccgccugccucccugacguagagcccaugccauccucacauccaccuguccuggagacacugggacuuucccuuggacugggccgccugggggcuuguuuuugccugugauucagccagcagcccuggcagacagccuuccccaagcucccccagcagaguuaacuuccacagugagaggcuucacagggacaggagguggccucagauguccuaaaaaggcagauguaggauuggagcugauaggagggagggaggcccuuucuguagggagaacuuucaaauucaggcuuguuucuaagcaggggcucuuuauccagcaucccagggcaggugcucaguucuccacaaagcgcuugaggcugcauacacauuuccguuacuugcacacguuuuucuccagagagcaguugccaucuucaaaagguuucugacaccuguuccccuuccccagcguuaacaacugcuccuauugaggaggcagccucauugaucccagugaagguucuggagcccuuggaagccacauagagagacaccacccaucuggcuucccaacgcuccuccgugaguguaaauggggcuggguauccagcguggaagucagagcaguggcgcucugguggggcaggugcucaggcacccagcggugcucaugaggccagcaguggcgcucugguggggcaggugcucaggcacccagcggugcucgugaggccagcaguggcgcucugguggggcaggugcucaggcacccagcggcgcucgugaggccagcaguggcgcucugguggggcaggugcucaggcacccagcggcgcucgugaggccagcaguggcgcucugguggggcaggugcucaggcacccagcggcgcucgugaggccagcaguggcgcucugguggggcaggugcucaggcacccagcggcgcucgugaggccagcaguggcgcucugguggggcaggugcucaggcacccagcggcgcucgugaggccagcaguggcgcucugguggggcaggugcucaggcacccagcggcgcucgugaggccagcaguggcgcucugguggggcaggugcucaggcacccagcggcgcucgugaggccagcaguggcgcucugguggggcaggugcucaggcacccagcggcgcucgugaggccagcaguggcgcucugguggggcaggugcucaggcacccagcggcgcucgugaggccagcaguggcgcucugguggggcaggugcucaggcacccagcggcgcucgugaggccagcaguggcgcucugguggggcaggugcucaggcacccagcggcgcucgugaggccagcaguggcgcucugguggggcgggugcucaggcacccagcggcgcucgugaggccagcaguggcgcucugguggggcgggugcucaggcacccagcggcgcucgugaggccagcaguggcgcucugguggggcgggugcucaggcacccagcggugcucgugaggccagcaguggcgcucugguggggcgggugcucaggcacccagcggugcucgugaggccagcaguggcgcucugguggggcaggugcucaggcacccagcggugcucgugaggccagcaguggcgcucugguggggcaggugcucaggcacccagcggugcucgugaggccagcaguggcgcucugguggggcaggugcucaggcacccagcggugcucgugaggccagcaguggcgcucugguggggcaggugcucaggcacccagcggugcucgugaggccagcaguggcgcucugguggggcaggugcucaggcacccagcggugcucgugaggccagcaguggcgcucugguggggcaggugcucaggcacccagcggugcucgugaggccagcaguggcgcucugguggggcaggugcucaggcacccagcggugcucgugaggccagcaguggcgcucugguggggcaggugcucaggcacccagcggugcucgugaggccagcaguggcgcucugguggggcaggugcucaggcacccagcggugcucgugaggccagcaguggcgcucugguggggcaggugcucaggcacccagcggugcucgugaggccagcaguggcggcccugggcacgcugcagcccugguggugaggccccgguuccuccaagcacagcugcucugguucugcagcggccucaucccaggggcggugcaucaggcgaacauucggccgggacaugcccuccggcugggcuguuuuuuucugaggagaaagcauuucccagcucaggcgcacaucugugcucacgaggaaaugucugggugagccaagggggcuguccauggcccacagcgccugugucuccuccaggcuggaaaggaagcuggagaguggacuccaccuaagauccccccgaggccuccuuaggaagccacagccacuccagaagccuuccuggugccagagggugcagaguugagcggaaagguggccucuggccaggaugcccagcugugaccucagcacccucucaucucuuggagaccuggagccucugccccagucagccccagggagcccugggaugugagcccucaccuugcagccaggguucugugaggcucugggccucagccucaccaccucccgggcacagguugcagcugagacucagcgaugccacgugaguuggcgaugaggcggcgggugcacgcgcauguggacgcccucacucuggcacucagcggcagccucguuaauuagaauugcgguggggggaguuacccagcuccuccucuuguuauuaguuuguggcauuagggaaggccccugggagcacacccugcaucuucccaaauuaaaccgaaugcaaggucucuauuuaaagguuaugcugcgcuagugaguuugccacaaggaccauuagcaugaauguuucaugaagguuggggcuaugaguggaucugguaggccaggccuguacuccaggagggagggaccuuguaggcagaggaacauggggccagccggccuacacugaggcugggccaugccgaagccgggccacgcuggggcugauccaugcugaagccaaccugugcugaggcugauccaugcugaggcugguccacgcugaggcugguccacgcuggggcugguccacgcuggggcugguccacgcugaggcuggagcgcugccgggacgucugugcucgcgcucaggcugcucucccaggguccccacaccuguuccaguuugggucugggcagcgcacaugcugcugugcgagcuccgucuuccagggugaggcggcucccgccgccgagggcucccagcccgugccuggcuuucugcuccccucucccugucggccccaccggagaucaacagguugcuucaucucagucaaacauacaguugaguuccguaaaugagaccaaaaucuguuucugugagauaaaauugauaaaccucuagccagacuaaucguaacuaagaggacacaaaugaacgcuccugggcgugagagaagugacaguggugccgccauuuuccacguuucguuagagccguccuggcgggugugaaauuuuccacguuucguuagagccguccuggcggguguggaguggcucccguggcuuuguuugcguuacccugaggccagugguccugaacuucacccugugcuuaucagccacgcaucugucuucucuggagaagugucugccccauccauugcccacuuuguaaauggguuguuuuguugguuagugguaagucuucauguguucuagacacuagacccuucucagguaugugauauaaggggcuccugugaggcagcccaggaagggcucucagucuugcugggcaucagggccuugucagggaggagauggccaucugugggccuugggaaggggcauggaggggccaggcacacguggcccugccuccugcagccuggugcgggcacaggguuuggccagagagaaugauuuccacaggauaggcucagugcuaggacugcccggagcacacgcagggccccuggaaggcagcccuggccgccgggaauccuguccuccaggcuuuugccgugggaucacggcccuucccaagaagucugccuguggcgcugcccuccccagccacgcugugcgccugggccacccuggagcgcggccggguccuccagagaguccgucagggacugugcugcugcuucacagccaccgugacacaggcaugagggaguaaacacagaaaacgaaguuuuagguacugagugcucugugccugggccaggcccagagcagugucuuguccccaggccuggcuuuggagggcuucccugcccugucacugcauugguggggcccugaucugucugcgcugaagucuuguaggcugggcgcuccacaaagugccugggccucaggucccugugguggggauggcugggcugcugugugccaccugaacgggggacggccgggcugcugugugcgcugccugaugcagcggcagaguugccccugggaggugugggaggugagucuugcucugugaccauuggaugaauaaugaaugggcccuccgccaugucaggaagcguucagcagggcccucuccuuguccccagcgcccucuuccuggaucccaccuucccacccgugcuuccgcacgcugcuccaucuaccugcuacuccuuuucuucugggucuccccucccucacgggccuccugccgcuccucgccucucaugggccugccccgggugugaguagguguucuacagguccucggugaggaugccuccuaggggccugccugacuuccugccagcucagccuccucccuaggcuguaggcugccccagagaucggagcuucagacauggucccgugccugggagcccggguuucccacccagggacagguggugguauccccgucgucacggugagggcuggaggcacaggugccugugaguuaccucugagaacgcugcugccccgggccugugcccugccagcgagucccacagguccucacaaggagcccucugcacccuccacucucggcugccgagcccgcaggagaaaagacguggagccggggcugccgggcggccguggcccugccgugcgggcccggcggcugggcgagggcacugcaguuggugccgagagcaccccgggaccauccucgcauuugcucuucccccaccugccucucccccccuccccgauggcuuuccuucccuuaaauacugauaugucuacacggcuucucaaauuggcggacagcagagcagacuccggggcuugugugcucagcaugggcggcucucuucgcuucauccgggauacuuagacccgccccaguaccuccccguuccgagcucggccgcacacacgcuggacgugccugggaaguggccauugccgcgucugugcccaccaucugcccacccgugugcccguccaagcaccgacugugugccagguucugugcuggcaauggggcccuacaugguuaccacgucuccuccagggaacgucccauccaguggggaggagagucacgugcccagucaccauguggugugguggaguagagggugcggucacagaggagugggggugggcacuuccagcuggcaggggaggggugagggagcugccaggacagauuguggggaaggcggcauuuccacuggaucuaaaugguggaugggagcgggggguguagguggaagguggcccacagacauggaucaugggucuggcccucuguggcuacuguccugugccaugggccuggagggggauguaggggugagagcuggccuggcggggaggugcaggguggguggaggaccugcagcauggcugggggugucgggcacaggcucaagggggcaggcauuggcuacucugagaauacaguugggagcuuacuuaugagucuaagguuacacauuaaaauaaaagggcuugauuuuuugcucugaacauuguggcacacgucagcauuucccccuuguuuccuggaaaucaucuacaaauaacaagaagcgugaaaaccaaaauggcacuuaaauuuugacaaaacagaaaugcagcugcaaaccaagccccaggcagaggcaggaagcccguggugcaggagagugcagugagcagacgcagugagcagacacauccccggggaagccuggagcagugcggguggaggcagcuccaugagggagccgcggaguagaacccccuugccggcgcgagggagccgcggaguagaacccccuugccggcgcgagggagccgcggaguagaacucccuugccggcgugagcccuugcgagaggcggccccugacccuggcuccgcagugcgggggccggcggcagcuggaacgggggucccuggacuggcgugugguuccaagcuggacuggcgugugguuccaagcuggacuggcgugugguuccaagcugcagcagagguuggugcugagcugaggggucacacaggugcaucacacguacuugaagccgcaucuguggcagacagaacauuugcucuuaggaaaacucacgguguccuuucucuccugccggagggagcuacugggggcugauuggacucgcagcaaaacugucacuggauuucagauaaaaggaagcaggccuguccuuccccacugugaaccugugcacggagccggauucaauaaaacucaucuucagcagugagcaguaaagguuacuccaugcauuuguguuagagcaaaggagaaaaagaacaaaaacaaguggcagaaaaaguuucacagaaaaacgguggacauugagcagaugaaaauucuauccagacauuuugccaagaaacaaaaguuaacgaggcgguagagucugugaggcuugggcggaacgcacacgcuccaagaagagacggugaggccggggguugcaugagacaggacccggagggucucagagcaggagagggggcaguagggggcaguacaggaaggaaggugaccggaugcacggggaggcgaaucacggggaaaacuaccuaaagaacccgcagcaagaguuccaucuccugaauuggaagaugaagugaauguggaagccuggaaauguaagugcuacaugucauguauucaaaaagaagugucaggauggcagagggaggagagaacaugaggauggcggcuucgcuguugagagccgaagacacagacacaccaucuaaagguaguaucagguggggagagcagaucgagcugcauguuaggcucccuagagcaccaggugcgguagacuggucuaucccgagagagugacugugaggcccucgcucuuggccauggagccaggaucccguggucugcaucugugcacagcagaccuggaagagccugugcugugcccaguccgcucugcaggccugagaaccagcggagccuguggugaaagccccaguccugggcggaaaacgggagcugccccgcucaggccaccaggcaggcaagggaggaacggucgccuccuccaguuuucauuucauuccggccucaagggguuggaggaggccuacccaugcugcccggggccgucugcugaguccccgauucaaaugcugaucucauccacaaacccucccagacacacccagaaaguguuuugaucugaguaccccagguccuguccaguggacacauggaaugaaccgucacagacuauaaaguucaacagggaggaugauguaucugacuaguuaggcacccaacauaggagauacaguagguacugucuaguaggaaaguaucggugugaaacaaagcugaguuauaaaagcaaccaggguaaaacaugcacacuuuucuaagccucgagagaauuacacgcaaaaaaguaaacuagauuaaaaaggccacagaaugagauagauguaaaagcuacaaaaucgaaagcauaacaacauaauacaacagaaauagacacaaauccaguuauaguuggacuaaacucuccuauuaaaaggaaaggacuuccugauuggauugcaaagcaaaaccaaacauguuggaaaguacgggaagcaaaggcauccuggugaagugaaccuggaaagcaggagcuaugaucuccaugcagugugaguucaagccagaagccgcucagaaacaaaggugggcgcuuuucacagugagguucagauggguuagccaaauaacacaucaccgcuguugggaaaagcagaaaugaggaaagauucaaggcgaaauugucaaagaugccaguagcaggauuuauguccuaaucugcgauauagcaagugggcaaagaauaauggaaaacagaaaaauacauaugugcguaaaacccauaucccccaaauuagagaauauacucauguuaaaaggagugcauagaaaacauucacaaagauuaauuguguauucgguaauagagaaagccuuuauaaauuaaaauaaguagaacuaauacaacuucuugugauugcagugugaugugaaaucaagaacaaaaucagggaaaaaaaagcuccuaacacuuggaauuuaaaaaacaaaacccaaacagaacaaaacacugugucuuaaacaauucuugguucaaagaaguacgauucaaaagugcauaagauguagaaaauaauugucaugaaaacacuucucaucagagccugugggaaccaccuaaauucacaaguuuaaauauuuauaucauugaacaagaaagcauguaaauauauggauuaaaccuucaacccaagaagucagagaacaaaaggaaaguaaaccuuagugaaacaaaaagguaggaauuuguaaagaucaaagcagaaguuaauaggaaagugaaaaaugguagaaauaauaaauaaguccaaauaccuguuauuugaaauaaaaccaauaaaacauaugaauuauucacaguucuaauaaaaaauugauagaaaguaucaccauccaaaauaggaaacaagacuaauuaccuggagcuauugacugagcaggagcaugcgagagcuuucaggcgugcugagaauucuguguccugaucuggacgguggauacguaggugaagacauguauaaaaagccaucaggcugugcacauaagauugagaaguuuacugcguguaaauuauguauaccucgaugggaaagaaaagcaaaaauuaaaaaauugagaauuaugaguuuugucugauuucuauaaaaagaauuaugaauuauaucucaguuccauuuuaauaaacuuaaaaaucugugggaaaugaaugacguuuuagggaaauguuaccuaucaaucccaacuccagaagagagagaaauuuuaaacagaucaauuacuguagaaaaacguugucccaaaauugccauggcugcucucccccaccacaagaggaaagaaacagaagaugcaucaggccaagccaguuucaugggaaaauucuaccagaucuucaaagcgcagauacuuugagcacuguguaaaccaguucagacugugggaaaaggaggggaaggcauucuggaaguguuguauugacaccaacaacugcaaaggccuuacaagccugugugugugugugugugugugugugugugugugcgcgcgcgcgcgcgcgcgcgcgucugugggugugugugcgugugugcacgugugugugugugcaugcacgcgcauacguguaucagugucauuguuaacaugucacgagugaaauucaacagcagguugaaauacaucauaugcaguaagauuuauuccaggaccagccugucagcuugauuuuaggauaucaauuuauagaauacccucuucaugggggcguuugacaaaauccaacacucagccuugauuaaaaacucuuaauaaaauaggaauauauggguaauuucucacugugauagaaaauaccuauuugaaaaaaaaggucaugugcuguaaauaagaaaguauuggcuucagcuccagugaagccacaggccaccuaaggauguccaguaucacaacugugauuucguauuauucuggagauacuagucauccaaaguagacaagggaaagaaacccaagguaucaauauugggaaggaggaggaaaauuggaaaaucgucccucuuugcugcugauaagauuaugugccaagagaaucaacugagaacugcugcugucggucggaauuuagugaagggggcgggaaacaaaaauuuaaaaucacguauacaaagauaaguuagaaagaagaagaaaaggcugggcgcggcggcucacgccuguaaucccagcacucugggaggcugaggcagguggaucacuugaggucaggagaucgggaccagccucaccaacauggugaaaccccgucucuacuaaaaauacaaaaauuagcugggcuugauggcgugcaccuguaaucccagcaacuugggaggcugaggcaggagaaucgcuugaaccugggagcugcagugagcugagaugacaccacugcacucgagccugggugacacagcgagacucugucucagaauauauauguauauuuauguauauauuuuuauauuuuauauauauagugaaaaaaagcaagguaccaaaugauguguaggacaucuuaccauuuuuguuaaauaaaaugaaguguggugggaggaagaacauagacauguugcuggcaugcgcaccagcagccuccggaaggaacauaugcucaaaccucagaacguuggcuggcugagagucgggggccuggggcgcugggguuggaaguuggggacaggcugcucagggcaugggcauccguguuuguugucugaacuguggaucuuucuuuuuaauggacccaugauaauuguauauauuuaugggguacauagugauguuucaguacauguaacauauggugauuagaucaggguaauuagcauauccugcccuguugcacacugugcacccccugccccagugccuuuuuucccaggcuccugcuggcccccagcccaggggguguugucccccucacaucauuccacccugggugucuggcaggcuuugcagcuucacugcugggggccuccggcugccgugguaccugcuggcaccuguccuucccucccugaggccacacugcccuuccuccucccuucgugacggagugagcugggcuuuggagugggucaggacuggugggaacaagguucugacuugggccaggggcaggauuuaccucccuaaacccaucggauccuguccaugagacaccccaggaguggugaggggcgucucugggugggccuuccuuagcacccccgggcccuggagcuggugccuacguagccccucagccugcgccagccugccugaccaggcccccgucugugcccugcucuuccuugagcccgcaguccguucuggcuccuggccuccccaccgucugcugccccugaugccucccacccuagguguguaggggcgaguuagaauccacacuccuggccgggcacaccggcucacgcuugucaucccagcacuuugggaggcggaggcgggugaaucacccgaggucaggaguucgagaccagccuggagaacacagugaaaccccaucucuacuaaaauacaaaaaauuaaccaggcguggcagcacgcgccuguagucccagcuacucaggaggcugaggcagaagaaucacuugaaccugcgagguggagguugcagugagccgagauugugccacugcacuccagccugggugacagagcgagacuccaucucagaaaagaaaaacagaauccaggcucccucccgggcggugcagcaucucacgcuguucuguagaggaauuggaaguagcggaauaaacgacggcuuguggcuguuaaaccaaaccgacggcagcguuggagcgugcucucuccccagcugcguguccacucuccagagacucucacaugcaccccacacaccucaccgugagccugugcaucuguugcuauucaggagauggaagugacaaaaaaaugagagaacuugaguuugcaaaguuagagugcugucuggccuggcagcuucaggcuuccaggagagaggucucucccgcagcucccagcccagggcgggggugcugccagggguggucucaggggccugggcugggguuccccacacaccugggugcgcucgugucugcugacccucuauccuuugcuuucuccuagcuggagauggagcugaagaugcugaagucucaguccagcucugccgaacagagcuuccuguucuccagggaggaggcggacacgcucagguacgucccccagagaggaggcggacacgcccaggugugucccccagagaggaggcggauacgcccagguguguccugcgggggaggaggcagauacgcccagguguguccugugggggaggaggcggauacgcccaggugugucccacggaggaagaggcggacgugcucagguguguccugugggguggggggaggugggcacgcucaugcgugucccccaggaaggaaguggacaugcucaggcgugucccccagcggggaggugcgcacgcucaggugugcccuuuccagaggaggggagugcgggagacacguccaccggcagccuccugucccccucuccaggccgugaccuucucugugugcucccccguggguggcuggaguaaagucuugcuccucugcugccuuccuggaagggcuuuucuuuguaagucccaucccauccaccuagguuccucucugcagggacacucgucucugcugguguggcccuuucuucagcagcacuucuccagccagcacugacagcaggggucucucagugucccugacgcucagaagggagcagguccuccaucagggggcggcgcuggagccgggucugcagccgcaggggcugcauggcagugcugugccgagauggcugcacgggaguguggcucagagcagagcccaggcagugcagcagccaggcguguccagcagcccuugggcuccgcuucagacaugcugccagcucucugccacugcacuguccuaggccacccucaccccagcuccugcuugcacacggcgccccuagagcagggucugcaggccgggcugcuuuucuagagcucucugccucucccccgccuuguggacccaucaggguccucaggcaagagguuuccaggcagaugcagguggagcuccgggcuccgcuuuggugccuguguuggcgcugccccauccagugcggauugaaaguggcuguggggcaacccgaguauccugccagaauccaaugugggaggcgguggcugugggcacagggugggguggcaggaggcccauggcuuuccugcauuggccacuccucugcucugagugucugcagcaggccaggcccugggcauccaggguuucuccuggucaucagaggaacugagaacaggggacugagacagcuccaggggacaucaaauggcccugcagugagauggggguggcaguggggagagagcacccuuccuaggccacacagcuuuggugugugggccccuggaccccccgcggcagcagccucugcuucguccgucacacccacucccugggguuccaguuuucaccuguggauggccccucuuucucaggguugccgagaguaaagcaggaaaagggcugccuuuaguguggccccggcccaggaagugcucugcacauggcagcuaugaugccuucuagauucgauguuccuccagcgucucugaagcauuccucaugcaugggcugugccuuacacaucgcccucucugggaucugccggagucugagcgguuucauuuacaucugcucagccguucaaguguucagauacugagugugugccguggcguccuuagggccgagcauggaggcugauggaguggugagugggccccgacgcgcucuccgucuucaucugcgucuccaugucucggggaccugggggccauucuucaccuagaggcucugucguuacagccugugaggugcacgugguccugugacaguggaugucucccccuggaagugcgucugcguguggucuucggguugaugggguugggggcugugugugaguguggguguggggugggggaagcuggagaccgggcaggugccauggugagcaugcagucucuuuccuagcagcagugggaggcacuagaggcuuuaaaguggaagaaugugacuggagaaagcacuggcugccaggccuggggaggggaaggagaguggcagaggggccguccccaccaccugcucaccaagcauuggugcugggagccccuccgaagccggaguuggcuuuuccuuugcagagaugagcaaaauaugccucccacacacacccugacuugcaagagcagccccaccuggggagaaagacccuugccacacagagcagcgggccuggaggccucggagaggggguaguguguagugagacagaaggaauggcccagaagggcagcccaggcaggucaggagcucaccaaggccaaggcuggaugacgugccagacaggcuucaaugugugucugcagugagagggggagcugggaccagcagcagaggccacaccuugucaucauggagaaagggccucuggaggcacgcgggcgcagggggagaggccgugcacagcagcgcaucgggaaggucugggcugguguggcuggugccugacccugcaagguccugaaugccacgcgaggcaggguggucuccaccguuguccuccaguccccaggagccacgugggaggugguggaguagguucuuaaaucuggggaguugcagcuguggcuuccagcaucugugaagguuucaggaaggucagcgugucccggcccguggcugcccacgcaggagccugcgucacgcugcacggcuccccgcucucugagauggcacucugcuuucugcugggccuuuuggcaccuagaaccucucguucugcaguugaugggagcauggccaggcgugugucagauuugugugggcuggcaugcuugggguuuauucauuuuuacaauuuaagaaaaggccuuuaucauugauaucuuuuacaucaaggucaaagcuucucguccccaccauuuuguuuggagcccuucagccugccacugcacugugggagccccucucugggcuggccgaggccggagccggcucccucugcuugcggggagguguggagggagaggcgcaggcaggaacugggguugcgugcguggugcucacaggccagugcgaguucugggugggcgugggcuuggcgggccccacacuccgagcagcuggccagcguugccggccccgggcagugaggggcuuagcaccugggccagcagcugcggagggugcacugggucccccagcacugcuggcccaucugcgcugcagucgaauucucacugggccucagccgccuccccguggggcagcgcuugggaccugcagcccgccaugccugagcccacacccacccccagccgugggcucccacgcagcccagccuccccgacggcgcggcccccugcucugcggcgccugguccuauugaccacccaagggcugaggagugcaggcgugugacgugggacuggcaggcagcucugcccccagcccggcgugggauccacugucggaagccagcugggcuccugaguccgguggggacuuggagaaauuuuaugucuagauagaggauuguaaaugcaccaaucagcaaucugugucuagcuaaagguuuguaaacgcaccagucagugcucugugucuagguaaucugguggggacuuggagagcuuuuaugucuagcuaaaggauuguaaauacaccaaucagcacccugugucuagcucaagguucguaaauucaccagucagcacucugugucuaccucaagguuuguaaaugcaccaaucagcacucugugucuagcuaaagguuuguaaacgcaccagucagcaccgugucaaaacagaccaaucagcuuucuguaaaaugggccaaucagcaggaguggguggagccagauaagggaauaaaagcaggcugccagagcuagcagcggcaacccgcugggguccccuuccacgcugugggagcuuuguucuuucacucuucgcaguaaaucuugcugcugcucacucuuuggguccgcacugcuuuaugagauguagcacucaccacgaaggucugcagcuucacuccugaggccggcaagaccacgaacccacugggaggaacgaacaacuccagacgugcugccuuaagagcuguaacacucaccaugaaggucugcagcuucacuccugaagccagcaagaccacgaacccaccagaagaaagaaacuccgaacauguccgaacaucggaaggaacaaacuccagacacaccaucuuuaagaacuguaacacucaccaugaggguccacgguuucauucuugaagucagugagaccaagaacccaccaaucucggacacaggaggaccagggaugguccucacacacacaugcacagccacacaugugugccugcucuugcccagaugcacacucacauuuucacauccauuuauuuguuguaugugaaugacauguaucacauagcaucguuuuucaacacugaagcuagagagagcgucgguggggauuuuuaagaggcagcagcugaggagcccuuucagccagaacaaaucugagcccguccucucugcugucaaauagcagcucuagcaaauccuaaauguugccuguagauucagcaacugguuagacgcuugcuaauuccagaggcuugccuaucugugccagugccugcuagucacacucggacccucgcuucccggccgugugaugucuucugggucccgggaggugcugggggcccuggagacgccggccugccucaggggacgagaggugacccaugaccccacucacccgagguccccacucuucaggacacucugugaucuccacucacaccccagggacccagugcccaggcccacguccuuuccagagggccaggugcuagacuuuuaauguucuuuuguagaaauuaucaucuuucauccaacaaaucuccauuaaacaccgcugcucuaaguccccucaugaaacuacauagagguaacuggaaagacagucccugccugccaagcuucuagggcaguggguugaucuuugagcucaccgugcccagcccaggccgccagggagaguucagccugggaaaguggaacugguuuucccugguucuguccuguucugcagccgcuccugcugcccaccguggagaaccugcuggcugggccgggucuggaguacaagugauuggucccauuggaagggcagcuguggcuggaaagaggucacccucagaugcuauggucccaggugggaaggcguggccccgagggggccuggugauggacugcccagcccaucuggggaucaggagcccagggcaggaccuggggagccuuuguggccucauucucccucccccgagcagcuucaggagcaggcugaggcagccaggucaacagggugaaggcuggugagcugccuccaccuggcugggcagcacugucagcaggcccgugaccaccagagcuguccccagcccacugccuggcugccgguagcgacagcggccccugcgccugggcucugcagguggugccggugaccacagccagugaaggcaggugcgcuccccagguccggccugcagcuuggguccucagggcccugccugccuggguccuguaccccggaccugcuucuuucucuccgaaagccugcccaccuccccugguccccugguccccagcauccucagguuacccgaacacucuggccggggccugcucugugcgcugcauugggcacuccaggccuuuccuucuggcgucucacgcccuuccgcucuugagagcuuuccuggcucuguucacugaucauuuccucuccucuguuuucugugucuucuuucugaaacuguuacuuggauguuggauuuucgaauaguuuucucucucuuaaaucuuuuugauccuauuuuccuuauuuuuguccuaccuucuguauuuucucagcuuuguuaaccuguucuuauuuuauuuguugcuauacucuucguuuccugagagucuguuucuguucucugaggauucuuuuauguauaaagcauccugucaguguucaugagugcaguggggucacugugucuuugauguuaauaauagugcuuuuuggaguuuucuucuccuagugaacccuguucucuguugcucuaaguugcuguuuuucugccaguguuggaccuuacucuuuucuuucuggaugauuuccuuaagcguuugguggucccagcugccugugccaggguggguuugcccugugcuucuccgaggaauccggcugggucuuccacuggggagcccuugggaggggccucugaucuuuccucuccagccugggugacucuggcgugggggccugugcugccagcuccugggggcugagcagggaagugugucgccaaugcaggacuccucuugcgguggggcacccuguccgugccuuaccuaagggccugucucagcccggagaucuuaugcaggaugugcagagugacaugcaggcuccugcccuucacucccagaagcagaagccagcagagugcccuguccccgcccagcagcaucagcguggccccucggggagcgcgucuccugccccagccuucagcagccggcacugcuccugugucugugcugggcagggucagcagggcugauggcagggaccuuggugccauucagcagaggcaggcccagcucuggcucucugguccaguaguguugccaugcccaacagggaucggagccuacaccucacccagcaccgaggcagagcaggauguggaggggggucuucaacccccaggaccccaugucagaggcucagcagggccuuccccacacccugcagcagggaggcugccgcugcccuucaugccuccuguccguggugguggcgagacaggcaggggcccagcucgcaccccccugucugugguccucgugugugggguacacauucccgcucuaggggcugagcucguacccagcugucugcggcccucgugagcagguacacauuccccacuguaggggcccagcucgcauccacccuuccguggcccucgugagugggguacgcauccccacucuaggggcccaguucacaccugccugucugucgcccuugugagcaggugcacguccgcacuccgcguguaccaggaugguguccgccaggucugugcgguggcagaacucccacucugcccccaggucuggcacuccuagauguacacaagccaaauaacaguuagaaaacccaggacgcagaagugucugggaugaacagagaaucgggcagaucuacauuuacaguugagaacucacaccucagccuccacgacugacggaacugaguguccucaucagcccgcaggaccuaaucagugucuguggaacacccuguccgagagcagaggacucuugccucugcauucaccugggacagucacaacagaucacaucacgggucaucaaagagaccccaguaaauucgaaagaaucgaauucacucagacugugugcucugaguguaaugaacccaaacuagaugucaguaacagaagaacaacagggaagucucuaagcauuaggagauuagcaacacaugucugcauugcccgugugggggaggaggucucccgguacaaauaaguacacugggcaauaauggaaauacacacaucuaaguaagugggguccagcuagaccggugcugagaaggaaguacgucaugcucaguguucacguugagaaagaggaauggucucuuaauuuauguuccuaucucaauaaccuggagaaaggagaguggaauagcccagagcaagcauggaugaaggaaauaacaugagcaaaaagcaaugaaauuaaaaaaaaaauagagaaaauuauuaaaacaauaaguucuggcuuuuuuggaaaaaaaauucaauaaaauugacaaaucucuagcaaauuugacaaaaauaaaaagacaccaccaaaaucaucaauaucagcaaugaaauaggggccaucacuacaggcccuguagccauuaagcagaggguguuaugccacaaacaacuugaagcagcggacucacuccucagaacccacaagccaccagacucgaccaagaugaaauagguuaucugaauaaucuuguaaacuauuuuuuuaaaaaaaauugaagucauaaagaugcgaaggauaucccuaggcccaaaugguuucccuagagaaaucuaccaaacaguuaauaauuaagaucaauuugacacagaaaauugaagagauugcuaggguuuaggcacgggggugcauguguguacaaaaggacagcggggcgagccuuccggugucaggacaggccugugucuggauggcaguugugggcgcacacauccacacauaugacagaucacgugggaguagacauggagggaagugucugugagcuggcggcaggcgagcagucucuggauuguacccauguuaguugucccguuuuugauauugcuguuuaaguuguuaccaucgagggagauuggguaaagaggacacggaccuccuuguacguuucccacaaauugcugugaaucugugaugaggucuucauucuguuuuaaaggucuccagccagcccugcaguuccagcgcucccuccucccugcuuccggaaauuguugcugggguggguaucccugaaccuggggagcuuguggugucaaagcuucuuggcuguuccauugcuggcgugggauucagcuuuucuggggucguuugccacucaucugucuggaagcuuuccagcuuccauuuuaaaggcuauuugaugcugugccuucuuuucuuugucuucagguaaaugccucaaaaaaaguaagcaaaaccuuuacccuuguuuuaccgggauuuugagagagauuacacuuaagugcacguguucaagcuaccgucuuuaacugaagucuuugaugauuuuuccguuuauauaauauauauuuuaagugaaacacacaucauuugcauccuguuucuccacuauauauuauaacauaaacacuuccccauguuuuuauagguuuuuguaagucuuaauguauaguugauuaaccccuuuuggagcuugagugguuucgcguuuucaccuagugagaaugaaggugaacuguuggccauguuuugacuucugugcgagagaauucugugugucuggaaagaccaacuguagccuguaggagccuggcugcacugagaaaucccaucgcuuguguuucuuacuggugacggcaacagcccccagcagcagcgguggccaugauugcagugagaggcaagugauguuugugcggggcucacugugggccccgcauggcacugcgugcaucuccacguugaucgaguucuaacugcgggccugagacgggguuuaaggauauucacuguauugagguggaacucgcacaccgaagggcuggcugugggccccggguggcacugcaugcaucuccacacuacugaauucuaacugcaggccugagaaggaguuuaaggauaucuacuguauuagcgcaacucgcacacaauggaagggauucauuuaaaccugaguucauggucggcgaguaccaagggcgggcggugguacccuuauccggggagcaggucauagaggcuacauuaucuucagaguuuuaaaacaauaaguaaauaaaaguggaugcacuucuuaccaccacaugccugcaguucuaaagaaugccagcaaugaucuacaauucuaccaccauucccccaccagaugccaccgucacgucucaauagauguaugcacaagcaugcagccaccacaguaagauauaggacacagcccagcagguguuuaaauuuuuuacuuuuaaaauuauauaauaggcugggcaugguggcucacgccuuuuaucucagcacuuugaaagaccaaggccggcagaucaccugaggucaggagauugagaccagccuggccaacauagcgaaaccccgucucuacuaaaaauggaaaacuuagcugggcgugguggcgcgugccuguaauuccagcuacuugggagguugagacacgaggaucacuugaaccugggagguggagguugcagugagccgagaucgugccacugcacuccaaccuggguaacagagugagacugucucaaaaaaaaaaaaaaaaaaaaaaguaaaaauuaaaauuauauaguaaaauuaacuuuuuucuuauaggauacagcucuaugaacucuaaucacccuguaaucagagugcaaaauaacaucaacccuucaggaauccuccauggucccccuuuccauucacccagccacacagggaccucccggcagcugcacaugucugcucaacucugcggcucggcuuuuuccagcccaguccuacaacaugcagucuuuugagacuggcuccuuucauucagcacaacgcccucgagcgagauccauccagguuguuuguguauaaaagucaguuccuuuuucacuuagguagcuuucucauaaauuuugaggucaggagcuaugagucucccugguggugguucuuuuucaggggguuugacuccgcugacggguaaacagugggcagucuucuucucccugacacagauggcuuuacauuuacuuagguuuucuuccauuucuuuuagcaauguuuggcaguuuuuaggguacaaaucuuaugccuccuuggguaaauguauugcagaguguuuuguucuuuuugaugcuguuaugaauggaauuguuuucuugauuuccuugucagauugcuuguuccuaauacagggaaauacaacugaucuuuuguguguugacuuuguauuuugcaacuuugcugauuuuguuuauugacuagaacagguuauuugcagcuucuuuaggguuuucuguagccuggcaucugcaaagagagagaaguaguuucacuuuuucuuuuccaauuuggauacaauuuauuucuuuuucuugacuaauuguucuggcuauguugaauagaagcagcaaaagcagacauucuugucuuguuccugauuuaggggaaaagcuuuuagccuuucaccauugagauugacauaagcuauagguuuuuuguuuuauuuauuuauuuauuauuuuugagguggaguuucgcucugucacccaggcuggaguguaguggcaccaucuuggcucacugcaaccucugccucccggguucaagugaauccugccucagccucccgaguagcugugauuacaaucaugugccaccaugccuggcuaauuuuuguauuuuuaauacagaugggguuucaucacguuggccaggcuggucuuaaacugcugaccucaggugauccacucaccucggccucccaaagugcugggauuacaggcgggagccaccacaccuggccaacagucgauuuuuugaaaagauggaauugccacacuguuuaccagauucaauaggcaaguugcggaaauuggacggagaguucucauacccucuucacccgguuucucucgcuguugacaucucacgcugccauggugcucgucaccggcgugugacucugggccugucuccagcccuuguuuggauccaccaggcuuuccugcauguugcagccagggcaccguguugauuuuagucgucacaucucuucugccgcuggucggugacaguuuugucuuuccucgcuucuccugaccucaguauguuuaggagucccuagaacgcccccgaagcgagcuugugugauguguuucauuguuaaccugagauggugguuuuuggaaggaagaucacagacgacaaguccuuucucaccacgucccaucagggagccccugacauccacgcaacagcagguggaccugaccgcuggacugaggcguugacagcggaccugacugccggacugaggcguggacaguggaccugaccgcuggacugaggcguugaugguggacaugaccgcuggcauugacgguggaccugaccgccggacugaggcauggacaguggaccugaccgcuggacugaggcauugaugguggacaugacugcuggcguugacgguggaccugaucgccggacugaggcauggacaguggaccugaccgcuggacugaggcauugacaguggaccugaccacuggacugagguguggacgguugaccugaccaccagacugaggcguugacaguggaccugaccgcuggacugaggcguugauguggacaagaccgcugguguugacgguggaccugaccgccggacugaggcgucgacgguggaccugaccgccggauugaggcgugcucugccgggugccucguccgcgaagcuguuugcacuuucuccagucucuuccuuggaagcgaaucccucagggcacaggcgacgcucccccucuggagggaugaguucuacauguaugauguggaguucugugagggaggugucuccucuuccccauuuauucacuucuucauuuauuaccagcaguguggacuggagggaguuugccacgugcucuguguucugaucuggugcacgcaccaggacuuguuuauuaccagcaguguggacuggagggaguuucccgcgugcucuguguucugaucuggugcacgcaccggaacuuguuuauugccagcaguguggacuggaggguguuugccgugugcucuguguucugauccggugcaugcagcgggacuuguuucgcugcgugaucuccccgcggccggccgcgcccugcugugccccgucauuggguuuucugagcccuuccucacucucuggcaccacagggugcuccagacucaccucguguccucugccccagcuuuccaaucauccguuccuccagggagcccggagccuucucuuggcagcacaguccugagcagcccaggucagggucuggguaugccuguggcuccugggacggcacugcuucuacacccucccgccagcugccuuuaccguaguguuugcgugcuguaaauauuucuguccuuuuacuugcagcguaccuguacccguucuuugaguuucuguauacaugaugucaucgggucaguuucuaaaccaucauggcaaucucugucuuuucauugcuaccauuuuauuauuuguuugugugucuccuccauuuuuguuuuuccuuuucaugcuuccugcuuucuguugaguuacuugaaugguuuuuaguauuucauuuuaauuuagcagaugggcaucugacuauuucucagucugauguuuugaguguuugcucugggaauuagaguacuuaucacugccuacugagaaucagccucaucccacuugaagucacaccuggaagccccucccggcaggucccuugcccucucccuuccugcugucccucuaccuacauggaaaugccacagguuuuguuuucagucauacaguguuuugaaaagggcaguaagagacccggguauuaucuguaagcccagauagcugccaucuguuccuccuucauugucgaugcuccagguauccuucauguccucuuuccuucugaaggauuuccggcagccucuccuggagagcagguggcuacgauuccucacgguuucccucggguggguccgucuuuauuccucucguguuccugaaggagcucugcccugcgcacgcagcgcggcccgcggcccucgccucccagcacgccacgauugcggcguuccuccuccucaccgcgguuccugccuggggagagauuugcagacgcucgaaucgcuguucccuuugaggucacacaguuuuuuucuguuuucaccauuuuuuuugccuucaguuuucagcaguuucguuuggaugugucuggguguggauuucuuuggguuuauucuguuuggaguuugcucagcuucuugaaucucuagggauuuuuuuuguuuuuuuuuuuuuuuugccaaguuugggauauuucagccauuuauuuccuuaaauacuuuuucagcaauucacuuuucugugaauuugcugagaccuuuggguuuccgugugcugugagagcgugcacacucgucugcaugggccgucuuguggccccucuccgccgcacuucccagauaacccagccccaucuccucagccccagcagcuggaacugccucucuccaggcugacuugaaaucucugugguucuucaugugccgaguaauuugggguuauguccugagcauugugagaagagguuuuguguuuaaguccugugagaaaugagaguguuuuaguuuagcagugagccgaccugggugguuucuagcccaggucccagcgaccuucuguggggcgcgguucccaucccaguucagguugugaagccuuggcagcgcuccuggccuuggccugggacauuggcagugccugucagcuuagcuaucaucagcuucagaggccaguguggaugggacccaggcacaggccaacccagggacgcccucagcucucaccggcuucagaugccaguguggaugggacccaggcaugggccgacccagggaugccccccaacucuccaggacuacgcuuuucaguccuuccauucugugaucuucggguccuuucacguuucugggucuccccuuugugguccuccagggacguggggcucucuucgcaccgucuguugcacuuugcuggugucauggagguugggcccacgcccggcccugcaggagggaggacagggaggaaaacgcagcuagaguuuguccugcccaucuggaacgacagcagcuucagacagagagcacggcuccugccucaggcucccugccgccacugcagcccugugggcugagcccgugguagugugcgaagagcagaggcaggggccacgggggccggggaguccauacuccgagcagggagggucccacgcuccugaagcucaguggcuuucuuuuccggcccccaggugagugcuggaggacuucgccuugagcuccugguacagcagccucaccacugccuggaugguggcacgagguugaggucaggggaugcgagagaagagccacgauguucccuacccaccagugcggugggccuuccagagccgggcacguguccaggcauuguagcccugucugugggagaggaagggcaggcgugggcacccgucacacugccaugucugcgcggcuuugucacgugcucucuuuaugacaaacaagccuggaggggcgaggugcuccgugucaggacacgcagcgaguguuggguuaagcugggccccacccacccuugugugaccaucuccagggcuggggguccuacguaccccacucgccagccucucuggugggguucccacacccguuguucaagggaaauggucaucaaugccugcugugagccagacaccaugaucagggcuggaaacguggagcuagccauuugaugaaggggacagagaaguaaaaugugaagugugguggucaaggcccacuggggaggggcuggcgggcagugcaggggucugggacccgugggaggcuggccugggugaggggcuuccuggacuggaugcugucugcccguugggccucgggucucccuacuguccccucuccaggccccaggagccucaccugcggcacccaggccucccgcccccauuaugcaucuuuuaguucagcaaaaacaacuaaucauuuuucuugcaaaaguuucccccgugugugauggguuuguuauaagcaagaucccggcuacccuccaccugcuuuccacgcacacgcucggagacaggcaccugcuuugauuggcgucaucuucucgaggaaagaucuaggcuggcagcuaauuuauguagcgcuccucguguuuaaaaaaguugcaguaagucaauuucaagaagcuuaugccagaacugauugcuuugagccauuugaaggcaaaccagaauucugagcuuuugagcaccauccccccaacuuguuuauucguuuguucucuuucucgcucucugugcgguagcaguuugucugaaaggagggcagcagaagaaagcgcaccccuucggugcacaaaugagcccgcaugugggcuugcugucuggcggcgagggugggucacgcaggucauucuguuaacauggcugcagcuacacgcgugcgcucauuccaauucagcccuugaaagcauuuugcucccaagccuucagaauccauaauaucauuuuaaaaggggccuuuucauccagcgucucccuaagucaagaagccccugcagaaggcagcuucucggagauggccuuggaggcccccaccaugucgucacucaucaccuugggcagguucacuccccuaugaagcccugggaggcgagggucaggaacacccacccugggcccucggccaggccccuuaccagcucugugaucaggggccucucagauggcuuucugagccucagucuccccuuuacucaggcaccaggacuucccugcuagauugaugugaagacugaggggguuguuuguaaagccacagcacuugcggggcucccaaaaccucuccaggaggcaucagcuggugccggaggugugugcuaggucucacacugcacggccacccugccgagagacggugacacugggcugugcucagaugucuccccugccggcgcucccugccucaagaggagcgaagcauuguugcugcagaaguaccuucuaggcccaugcucaggauguuggugugagugggagugccccagacacccagggagggcagcgcacggcgucugcugggaugacagagacacuugccccuggccagcagccucgccuccggaagcauguccugcaggugcgccguacaagcaggaagcagaugucagaggucauucacuacaguaugguuuuuacagcuuuccugagguauaacuggugugcaguaagcugcgcgaugucaagugcaguguggugaauuugcauguacacacacauacacccauggagccguuaccacauucauauucaagacccccagacaugugcucuuguuugacaggaaucccuccucccugccuccucuccccaccccaaacccgccgacgugcuuuccaucacuguagauuggcgggcggcugucgagucuucugggcauggcguugguccuggagcauguggucucccucuuuuugcuucuuccacgcagcauggcugguugggggagagaucacugugcacacagcuguguugucuucacugcugaguuguguucugucguauggagacaccaguuuauacguucccuugcgauggacauuuggaguuuuucugguuuuuggcuauucugaaacugcuggauauuauaaauaaagucccauguagaaaucgacuucguuuucuuucagguaaacgccuaguguggaguggcuggcggucacguguguaacguguuccgagguugcccgucuuccagaguaguuggugugcagcuucuccucaccagcaugcagcacagucuuuuuccuuagucccucuuuuauuuuuuuaaauguuucuuuuacagacagggucuugcucuguugcccaggcuggagugcaguggugggaucauagcugccugcagccucugacuccugggcucaagugauccucccaccccagccuccugaguagcugggacuacaggugugcaccaccacacccggcuaguuuuuuaaagguuuucauuuaggcuuucuaauagguuggcagucaugucucacuguggccuuuuauuuuuuauuucacaaaugacuaaugauguugaacaucuuuucauucagcucacuugucaucuguagaucuucuuugguaaagcaccuguuuuuuuguccauuuuaaaauuugauuauuuuucuuacuguugaguuugggagagcucuuuauauguucuggauacaaggccuuuaucagauuauuugcuuuccaaauauuuucucccagucugugucuugucuuuucguucuuucaucagguauuuugaagagaaguuuuuuuaugauaaaguccaauuuuucaauguuuucuguuauauaugauccuuuggauauuaguccauuuucaugcugcugauaaagacauacccggacugaguaauuuauaaagaaaaagagauugaauggacucacaguucuacauggcuggggaggccucacaaucauggcagcaggcaaaaggcacaucuuacaugguggcagacaagagagaaugagagccaagccaaaggggaaaccccuuauaaaaucagaucuugugagacuuauucacgaccacgagaaugguaugugggaaaccaucccugugauucauuaucucccaccguguccuucccacaauagaugagaaugguaugggggaaaccgcccuaugauucauuaucucccaccacaucacucccacaacacgugagaacgguaugggggaaaccgcccugugauucauuaucucccaccacaggccucccacaacacacgagaaugguaugggggaaaccacccugugauucauuaucucccaccacgucccugccacaacacacgagaaugguaugggggaaaccgcccugugauucauuaucucccaccaugucccucccacaacacacgagaaugguaugggggaaaccgcccugugauucauuauaucccaccaugucccucccacaacacacgagaaugguaugggggaaacugcccucugauucauuaucucccaccauaucccucccgcaacacauggggauuaugggagcuacaauucaagaugagauuuggguggggacacagccaaacccuaucagguaucauagcuaagaaaucuuuggcugucccaaauuuacaagauuuucuccuguauuuucuuuuaauaacuuuguaacuuuugguucaggauugagcaggauuuucauuuauuguacaagauuuuaauucuuuauuucccccaagaacacccaguuguuccagaaccauuuguugaagaguuuguccuuucuacgcugaauugccuucauauauuuuucaaaaauugguuguguuugugcuccuauuucuggacucuguuuuguuugaucggucugucugucuugcagaccaguacugcacuguugugauuacuacggcuuuaacguaguuggugaaauuagguagccccuccuuuuucauugucaauguuguuuucucuauucuagguccauuacaucuccauaugaauuuuagaaucagcuugccaauuuguacaaagaagccugugggauuuugacugagguugcugauucuguggauuaauuugggggagaagugcguucccaacacccagagucucccagccuguggacaaggccucucucucucccuguguggagguugcccuggagcucucuucacagugcucggagcuugucacgugcagguuuuucuuggccuguuccguuccaucucuguguauuucaugguguuggaugcuuuugucaguaguauuuuccagaugacuuucuggugcugauugcuaguuuaauuccaugaugguccuauaacauaguuagaauuaugaaauuccuaaauagacugagccuucuuuuaugguuuagcaugaggucuucuugguacauaguucaagugcuccugaaaagacugggucuccugcucuuaagagucgaagcauuuauccaggugaaauaggucaaguuggcugaucaugugguccuuguccuccugauuuuuugcccguuguucuaucagcuauugagagagggauacugaagucucagauugucauugaggacccgucuauuucucccugcauuucuggcugguuuugcuucauuuguuuugcagcucuuuuauuagcacacacauguuuaggauuauuauuuuccuuugauuaaucaaucucuuuauuauuauaaguuaccuucuugguaauaauaugugcucugaaauuuacuauuucugguauuaguagcgucucuggcuuucucuugcugguuuucuuagugauggcauguuaugucuuuuugcaucuuuguauuuaaagugcauuauugucagcggugucugauuggguguugcuuuuuaauccaguuugagugucugccuuuuaauugugguaguuaggcuacuuacaucuaauuuguuuaugauauaauuaguuuugaucuugucauuugacuguuuucuacucaucugucucuucuucauuucuguuuccuuuuuuuuuuuucuuuuuaccuuuuuucaauccacuuugguauuuuucugauuuuguuuuauuuccuuuuuuggcaucuuagcuauaagucuuuguuauuuuagggcuugcuguaggguauauaguauacaucuuuaacuuaccacagccuaccuucaagugauauuacgucuucucacacacaguauaaucaccuuacagccacaguguugguuuuucuccuccagccuuuauacuguugucauacauuuuauuuauucuauauauuaaauccccaauauauuuucauuaguuuuguuuaaucuauuaaucacuuuaaaaaguuaauaauuuaaauuuuuuuaagagaccugaauguaagaaagauccucccuaaaugcagcugcuguuccagcccuccugguucuccgugcagaucuggguguauuugccccgccccgcccucguccucccucaccugcaggccuuaccugacauuucuguagagcaggucggcugaugaugaauucuuuaagcuuucgugucugaucugaaggcaucuuuauuugcuucuguuuugggagauguuuucaccguuaagguggcgguuuuuauuucuuucguuauuucagaaauuucucccuccucuuuucuccguugcacuguuucucaugagaaccccgccuugugccucuguagguaccaccucugccuuuaagaugguuuuccgugccgugguccugagcaggcuuguccugaugugcucuggggcugccagcgucuucuuuccugggccuguguuccuugcgcugccucgugucuguugagcuuucuacaucuguggcuuuauccuuuccauugaaaguggaacuuucuuauaguauuugucccgucgcuuccucugccuucuuucuuuuggggacucucguucaugaauuuuaugccucaugaagcugucccacagcucagugauucucuuuucauuuuucaggaaucuuuuccucucuguguuuguuugcuuauuuauuuguuuuugagacagggccucgcucugucagugcuggagugcacuggggugaucuuggcucacugcagccuccacccccuggguucaagcgauucuuaugccucagccuccugaggagcugggacuacagggguguaccacgacgcccggcuaauuuuuuuauuuuuaguagagaagggguuacgccauguuggccaggcugguuuugaacuccuggccucaagcgauccagcugccuuggccucccaaagugcugggauuacaggcgugagccaccgugccuggccucuguguuuuguuuuugauaguuucuauugcugugcccucgaggacauuaaacuuuucucuuacggauucuaaucugucauuaaucccauccagcauguuuaucugacagguaguuuccacuucuaccugugucucuuccgagucugaacuguugcauuuuuccaguaguuuuaacaacugucuaaaugucccuguuugccaguguugccgucugugcaaugcugcgucuugguagguauucguuguuugguuaaucucuucauuauaggccgugucuuccugcugcuuuaaaugucugguaaucuuugacuggauggcaggcauugugaauuuuagcuuguuguguucuagauguuuuugcauuuguaucaaucuucuugaucuuuuuucagagaugcaguuagguuucuuggaaagaguuggguuuccucgggucuugcuguuguggugugcugggacgcccuggagcaguucucaggcuggaauagcugucccugcuccugucccugugcggugucgaguaaucuuuccaucacuacaggccuugacagacuuuuuuuauuuuuaaaccacaugaauauguuuuccauucaaaauauuagaucuagaaaugaagacaaaacuagacagcuuuuuacagugaacuaaaacuggccccauuccgguugcggccauggagguuuguuuuguauucuauucccacuguggagaagggaacucaccaugggucgccuggaagcgugcuuuuguuucucaucugaauugugccucugugguccccugucaucagcuucuuccacaccccgcaguagaaguccuuuccugucuuuuccucauuucugaagaugucccgagguugcuuuccugucccucaguguccccugcacuccgccaucacaucacccucugggaguggcugacggacacggacacacugacucccaggcguccugccucgggcugguucccucugugcuuccagccaagguguggucgacagagacuuucuccgcacaggcuccuccagcugagcaggggccgccacggacucccccauccuguacuugugucguuuuccaauuuucucuugauguuaucgcuggacucugagagcuucacagauauguauuuagaaauaaagcuguauagcugggucuccuaaccuuucaccuccuuaucacccagagggugggacuuccccagcauggcuggccucggacaccuggucaccgucuugcuguccuugcagguugaaggucgaggagcuggaaggcgagcggagucggcuggaggaggaaaagaggaugcuggaggcacagcuggagcggcgagcucugcaggugagggcggggcagccucugggugaggcacugccugggccucucauuucuuugggcgucgugaacgaccgugguuccugcugccacagaacacccguuuucuggcucgucugucugaacucuccucccucccaugugcacccccuugccuggcagggaggccaugccgcugacaggccugcacuggcugccucuggaguccucugcggcccgcaccacccacacgccuggugucgguggagugggcucugggcagauuugcacuaugcccacccgggaucugcuguggcgaggcuggacugcuguuuguguucuuuuaauuguacuuucucuuugguuuucauccuccugaguugcugcauggcaggaagcccucagguucgagguuaccggguuuuuggacaggccauugauuuuaucuuggcaccuguuagaggcagaucaaaucuauuuuuuaugaccaguuucugacgaugggaggagugacaucuguggugaugggcggcuccgagccgcgcuggccuguccucagccuaggaccugucaucuuguuuuaacugggccgugguguacagggagcggucacggggcugcugcccgcccaccagaggcucugcgucagagcugcugaacgucuuucuggguguugggcugagcagagccugaacccugcuccuuggugcccacguugcuugcugacugggggccaggcaucccugcaggcaccacuuacggcuucccugcuccagcuuccagcccuuuccccaagguguccucaguggccggcccuuggagcuuguugaggcuugaaugaggugaggggugugggugagugcggugccagcacuggugaacaccugauggggccuggccaccaucccuguucugcgcagacggcgugugcucgggagcucacuagcggagcacuccucugugggagaugccaagggcugucagguaccgugggguuggcaugaggaguggcuggcagugucaccugugacccucuccugagcucugccagggccuuggaggggugggggcucugccccuaggcauguccugaagcugcucagagcugaggcguggugcugcaguguggccaguguggccauuuggggagaggacagggcugggccuggugguccuggggaagcagauguuuaugccgugauauggugaccucgagccuagcccaggauucaggagcuguuccucccugggucagggcaacagggacaacugugcccggauggcgugggagaagcaagugcagagcagugaagcggggaggccacugggguucggccuguggaguguuggaaacuuccagacagcccuccagcugccaccacuucugacacccccugcgauuacacccuuaguggggggacguccaggguggcccuggggaaggugaggccucacaggcccugugguggcucaggcugccccuggcucuggaugcccagggcugugccauugaaggaaauacuguaaauagggguccauuuccaagauaaagugccuugaaccggcuuaggucaccaaacuacagaagaaacaggauauacuaggccccugcuuggaucaccaaugccugcuugucggccucccgcuccccccugccaccccacccccccacccaccuuacuugcccucauccaaaccaaagaaguuuagucuaagauggaaguuauacuacucugcaaaauaguucguuucaucuguucuuaucagccugcccagcuacuuaggucacaagucaaauaacugaagagccccugagcugacgaggauugcagugcauugugggcugcaacaaaaugcaacaggacaacccuaaaaacacaccuauagccccugcccaacaaccaguaggcaacauccaggaagacugugaccccagaguacucagccugugaggaaccgggggaggggccugcgcacuaggggauaaauggcuuguugucaccgugcugggugugccugcccaccagacaccuaaucuugcaagaccauugaaaaucucucuuuuggcugggcaugguggcucacgccuguaaucccaguacuuugggaggcugaggcggguggauugccugaggucaggagcucaaggccagccuggccaacauggugaaacccugccucuacuaaaaauacaaaaauucgcugggcaugguggugggcaccuguagucucagcuacucaggaggcugaggcaggagaaucgcuugaacccaggaggcagagauugcagugagccgagaucacgccacugcacuccagccugggugacagagcgaggccccaggagccggcugccgccccugcacccacuaugcgaugcccucuccucucccugcucccgcucccucuggagaagccuucaaguugggccgcuucaaggaagauugauuaaaaucagcugcagucugacuuaauugggaacauaugcuuggagaggggcuugacuaguuagaacuuuuuguaauuaguucacagcugguuggcgaggaaagagaauuucaguuaccccuuagagcugggcgcgagugccgcugcccucccgcggugcugaggccaggagaccaggccugggaggucuucgugcugccuuccugggagggccgucacugggcccugcuguggcacuggccuuucugggucucccuaagagcccagagcuguccacacacucauuagggccgacugggugcacccuugugucgcugaaggggcuggaagugggugggcggggcuccuggacugcaagcccucccaucccguggugggggugggagagcucggggcacccacggacgguggcuggccgggcuucuggcgcccccucucuagauggggaaagugaggcccacagggagccugcgugugaaggaggaaggagcucagacucuccauguuaggaggcagaaugagucuugaacguguugcaguguucugaagugaagacagaaaucgggcggaccccguggaacuccagaucuggcggcagagggacccccauggcuauuggugcagccgcaggagucaggucaggugggcggcacagucccugaccccaccugcagccacggccuccugccccaccccuguccccaccuccugagugugcccugugcucuuccccaggccuagaacugaggagcuggggccccagcgcuuuguucucuucuggcucccggcugcccucugaugcgccaccucauagcugggacacugggccuugucagcuuggaccccacagccuggggugggccacagcucugucucccacuggcugcagccuggccuuagugugcucccaaggauguggagggcacgggccuuucccgcaggcugucuuuggagaucuccggugauggcuccuggggggcccugcacauaccuggugaaccaggccugcaugguggccauuccuguugucugucauaauaccgucguccuuaccuccaagacacuuggacguuuuccacgucugugguucugaugggccacaugcggggauggagggcaccgagcuggggcaggacccacagugaggcuggucggggcucacaggcuacggggcaggacacacagugaggcuagucggggcucacaggccgcccuggguagagaggggcacguccaguggaggccgcacugggcaggacacugaccuucuggcugggcgggcgcauccccaccugacagucccacccaggagccuccagcuugugugugugaagugugcagccugggccggcaccugugccccguggggcccccgugucacccagcagugaugggagcagcauucagacucaacccuguuggguuuuuucagcauuugaugaugaacauuuaaagauacguugugaaguugagggaaguuugcagcgagcgccuggucacccgccaccaaggcuccaccacggauguuccgccgcggggcuuccugacaucucuuuaucccucgcccagccgccgcgccacuuuauucuucugacgcgcuuuaaguaaauugcagacaucugcacgcuuccucuaaaugccucagugugcguguaauuaaguagaauucaucuuuggguucugaagcccgugcuccagccguuccucgauguggccucaucauggugcuuguuugggcagguugguggucagggcugguggagccccccagugcggcucccuccccgccccaccugccugcuccucccuggcgggggccugggugggguuuguggccggggccaaccucaaugucccaagugcuguucaggaaagagaccagacaagagcccugugacguuuaaauaagugcaucuguuuugggaaggaguggguagaagauugccggguucccugugagcagaagcuggaagcacacggagaccguucugcucccgucugcaccagcaggcagguggugcgguaccucacaucccugguccgugucccugggaccaggguggggcgggcccgucaccucuccucagaccuccucacccccucccugagaugccaucccuguggcccccagaucccuggaauucugaagccaccaacgcugcagcugcccugggagagggccgcguucccuccuggagccacagcugcccccuuugugcuggcguccaugcccagguguggugggcuggggucgugucccuguaccggggccucccggcgggugcucugagccaaccuccucaggucuggccucucccgcucgcuggacucuuaguaacgcauguggcucaucagugggaccuucauucuguguucggcucuuucuccugaaccuucuaccauguuggacagaguguggccucuggaccgggacgaugggccugguguuaccugguggccucgggaagugcuccucucugugcccugagggccuccuuugugaggcaaggggguuggacuuuuccugggaggcaggaucacgggagggcagcucugcagggcccaugggacuccaugcucaccagcccagcccuccccucccaugcgugagccaccuucacgcaccucugugccaggcgcugcucuaagccagggcacagcgggggccaaggagccacagcccggauguucugggccccuguucugugggagucauacagcgagcugaugguucagacggaugaggugcuucccguccgugaaaggaagcaggucauuggcacggggccccagggacccacguuagguccuggcgggaccaagggcuccugguuuccucccguggcucguggaaggacaggagaagcgcccacuccggaccgggccgccggggaggcugagucggccgcaguccucggagcagcaucguguuuucuaugauggugcucguuuucuuuccaugagaucucacugcuccacagauucccggcagccgaugcugugugugggaaaccaggaauguucugcccacaagggcugaaggugcuggugaaguugggcgucuguuuuaaucggagcuuccuggcagccuagggagaaaggaaagugugaucacuuagguaauuccugccaugggaguuugcagacuaagccugagauucuagaagaaaugucaccgaugggggcuuggccauggugcugccacugauggaagaguggcuuuguuucaccacacugaccagcaaguccaccgcugcguacaugcccagaagaaccaaaagcagggacucauggauacgggcacccacguucacagcagccucgcucacgguagcccagaggugagcgcaccccagcgucuguggacagaugcauggauggacacagugugguccuuccauacgguggagcaugauagauacagccucaaggaggaggcgcgucccgacaccugccgcagcauggauggaccugaggacgcugagcugggugaaaccggccagucccagaaggacacaggcuaugugauuccaccuacacgaggccccuagagucaucagauccauagacaggagguggagaggccggugccaggggcuggggcuggggcaggggaauggagagugaguguugauggaugugggcuuuagccuggagagaugaggaagcucugggaaugggcuguggugguggccgcacagcacugagagugugcugaaugccagggagcugugcacuuagaaugguuauggcggucagcuuccugucacgugcguuucaccacagugagacccagcaggcagcuuguuaggagugagccacaccccggacgggaggggcagggcgcuugaggugacuacuccaacccugcccucacacggccucuguccuucggucacuccugccuuccucaggcccuucauccaccagcugguccugcaccugcugccugagccccugaggccuccugccagcucuggcugagccucaggcaggaugguuuaggcgcuggcuguuguuugugcccuguaguggggagacugggauagcagaggcuguccagggcuccugcucauccgccagucuggcagggacccaguucacuuccucggcaggccaggggagcagccucccgggugaagcccacgugucugggaaggaggaggaggaccugugguugcagcgggaccaggacagugcuggucccccgccuccuccucccaggaagcaugggcuucgugcccaggguggguggccagugggugcccugugcacugaccacacugccguggugggagcucagguagaugccucgucugcagauggggcaggcgaugugcugugagcugaacgaggagcacggguggcagagccaggacccaccgcggugcucacugggcucugcccgcucaucccccacuugcccacgugugcugcuccccccaugcugagcuuugccaacggccccacuagagcacccucccccugugggccugcagcugcucacagaggcagcagaggguggcgaagggccugggugcaggggaggaggugagagcugcagcugggggcagacauugaggggcucccguguggggucgacuggcgcucagagccaggccucagcccaagucacuguuguccaacccuucugacgauugggguuuuuaucuucucccuccaaauuguuuacaagucgcccuccgcagauuaccuucugaaggacucggguggaagucagcgggugauuaccagcaccggguaauuggcugugcugagaguccuucaucugcugaugaggccugaggucaggggagcuuucaugagggcuugcgggccucgagguggcgcgggacgugcaggagggcggcagagccacuggacggacggacagacggauggugugagugugcccgaguucucacuucccuaucacauggugaccauucucgccgcugggugacaugagacugaggucagggugcuggggacuggcccagagucacacaguuguggcugguggaacugggacccagcucgggcucugccagaccccugcgucugcugccugggcaggcaugggcaugcacgccuggcccacgagcccuuguccuuugucuagagaucgucuaguagucucugcuguccccucaaguagagaugugcccagggacccacugcugagcaccucgaucucccccagccugucccugcugcugccacuuggacugaagccaugucuugcacuugggguagaaaaccaaacucaaaggcgggaccugggggguccgggcuccucaaagcugauaucccugagcaugucugcagccucuuggaggcccggggccuccucugggaagcaagggccguggcccugucugcaagugccccgcacggggugccaguccccgcggcucuuggacauggcacgauggaggucuccccaagcagccgcugcugcaggcacugcguccaagggaccgauguccuuugguuccugggcguaucugcagagaaacggaugagagcagcuuuuuagaggagaagggaagcacagggcccugccggugccugugggguuucaggggagguggaaaguggcugcggcucuccugggggccaggaagaggccccuccccgccgccuccacuuggcaggacucuggggaaggggaagcacuuugcuucucucaugaggaacuggguuuggaccuggagccugcccauggccugguuugccagaugccccucgguucucaaggacgucuugaguccucagacagggauggaguucaagagggacucagagccgggcgcauguggcagagggaggagauccacgucuuugguuucacugcgcggguccccccgggcgaugcuugcgugcccggcagagcuccuuagagccugagaccaugugcacguccguuaacccgcccgaccuuuccauggacuugguaggucaccauagccaccacucuacagacagcagaucgaggcucagagagcaagcuagugcgugugcacacacucuggaccgcagagugucagcucuaggggccgugccccgggccccuccuaggagagccacccuggagccucaaggagcagggcccgggcagcguugccccagcugggcuuuuccuuugcugacagguccagggaagccccacauggcguccuggggcagcagcuguguguccuuccuccuggauccugugugugugucgggcccagccccuccuguguuguacgagugucuggccugggucucccuccagagcuaugcaucucgucucuguucagggacugcuccaggcagguggggcagaugucagccuugcugggugccaucaggaccaucuccuccucaccacaggcacagccccuggagcccaggaguucagcccagggugaucuggucucagccuuggccagauuaggaaggggaugcuguccccgccccgcugaccaguggagacucucacaugccgucuucccuggccacggcaggccgcccgcccuuucucugcuauggaaccacagaggcuguuaucaggggugucaugggaggagccccugacccuugcuggaaccaggacaggcaugaccccucccagcucccuccuccccuggccuuucacguggagcugcccagcagggucucaggccgggaaggccagcuccggagcugugcgguggccucagcgccgucuccugggugccagugucccggcuccacugguuuggcagacgugcuggcucacagggcguguccugcuggggaaagcugcggccccucccucaggcccuggugaacccucgcuuagccucugggcagggcccugagcggaggcuauacagcacacggucacugggggguggaggggguucauggggggcguuugcuggggcccauggcgcaggugggugggcucacucgcaggcuggcuuugccguggacgccuuggcuguggggaguuuccacuucuggugaagccuggccauggugcgugugcuggaggggccuccaggggcuccgcccugugaccccgggccacucccucgcccccugcaggugccccagaugaggcccgggacacucacuccccaugguggagcacucagcucugcagaaagggagcucucgggguucuguccuacccccauccaguucucauccucccaccgcucccgggcacuggucacggacagcagcauggccucugucccuccuugggccucaguuucucugucugcuucaggcugcccucucccauccaugugccucuaccugcuugggagcugcuuuccuggaauaggugggacacggccccgcaggccccucggcgacagguguguauaggugcauccagcccuucagcccuccugcuggcccugaguaaguugcccaaggucaggccgcugcugagggcagggcugggaggugugacccucgccugggcuuguuacagaggcagguuccacaacccagccgugugcggcaggcaaggccacgggcaggagaugggaaggccaagcgggcaaggccacgggcaggagaugggaaggccaagcgggcaaggccacgggcaggagaugggaaggccaagcaggcaaggccacgggcaggagaugggaaggccgggccucugccugugccucuuggugggccugguucugcaaugcccuggcccaacaggcacagcccgagcugccucgcucuccuccgugagccauuuccuucagccaggagagguauugauugaauuuugacgccggacgaucuauaaauaugcauaaggacuggugguuauuuaacuguguuuuccauuccccucuugucgcugcuuccuuccagcgcuuucucugcucucggcaugcgcgucaggcacacggggacaggcgccucccuccccaaguauugccugggccuugcuggaggcagccuccuccccagcagggaccuugaggauagggccccucagaagccauuuccuuugcccggggcagccaagggcccauggcacccagcuccugcacgcaccagggcgugggcucagggcuuuccuguccucugcuccgggucuuaugagcauuuuggccggaagggagguccuuaaggugaaacucaccacacucacccucacagaugggaagccgaggcccagagaggacggagaccuaccagcgaguuaggggcggaacucacagugggaacagagauggagccaacgccagcccccacccagccuccuccuccaggacuugggcuguagacaguccccugaacacagagagaaacgggccgucgaggccgaggccuccuggaggcacaggugugggcuuacaaggcagcccgggagcacccgcacccucucugggccuugucucucccugugcagaccccuccaagaccgcuuugucugaagguggggcccugucaucuccagaacccuaggcccagccuggaggggagcuuggacagacaguaggccugcaaguggccggggaccugcccugcccgucccagcauucucccgcugcacccgccagccggcucuuccgcuuaaccgcgcuggguagcagcaccagagcgccugcucgcucugcaagugaaagauuucuguugagucaaugauugcaccaucgcaucaaaggaaggcuccaaacuuuuccuuuugagauucucgucagcgucucaacaguuuucucagcugugaaucaaacaaggcaacaaauuuuagcagaagauuauagccauuuuccccuuucuuccuggaagcugucagcuaacagccgauuccagcaagguugcuccaucucccaucugcuugaguugaguggugccagcccccaacggugcuccugcuugcuggcacacacagugcucagcgcccuagguggguggggugcacggggccggggcagcacuggaggggcuucuccccacgccuggagccucacacugacccccugggccugcagcuagagguggguucugugagcaggaggcguccugccagaaugcacagagggcagggguggcccugagcggaugggcagauggggccugggaggaagugaucuugccuccugggcugcagagcccaccccacauccgcugccuccuggccccaguguacaacccgcuggcccuuccucugggcuggggcuugguguguccauugccuccuggccccagugcagaacccacuggcccuuccucugggcuggaggcuugguauguccauggugggaagugcuugggucuuugcguaggaggaucuugaggcugcacuggccugugccucaucugggaugccccuggaccaccuccugcccugguggucccucccccacugccuccagacuucucaggccacccucugagucccuuggggcccccagccacagccacgccaugcagagcccuaaccccggucugcggcccagcgccgccaccuuacccgcaccucugaggggucgcgugagugcugcaugaccguucuccuccagaaagcagcagaauacaugaaagagggcucacagagcacuggccgggcccggcaccccauggcgucugcagauggccgcugcccucacccuccuucccuucaucuccagggugggcccagcagcagcagcaccucucccacacccucugcuucuccuggguugcggcugugacccaggaagugagagugggacucuccacgacuuggagaaggguuccaagcccuuucgugggaccuacuugcucuuacuuccugcguuacucuaaccacucuagccaccugguuuaagccccaggagcacauccgaguguaguaaguguucaucaucaucaugcauucauucagcaaacacaucuuccacauggagccugugccgggauaguccucggugcuggggcuguggugguggacaggagucccugucaccgcggagcuggacuucuggcguggaggacgccuacugagaugaguguuuaggcugaucggggugucccgcuggcaacagcagucacccuuggcagccggccucugcugggccccugcugagcgggcgccgaggcaccgugcugcuucccugcucugcagagagagacggaggccuggcccuucgcagcccccaucuagcgggagggucucgguguccacugucucucccaguggccgacggcccaggugaggggcugcccguacccgucucccucugcuuccggcucccuugguggccacugcacugugcacuugcaggggcugccaagccacagaagccaggccagccgguccccugccugucagcugcugacucacaggggucuuuguccccaucagcugcagagguggccugcaggcuccaagaagccaccaaggcagggcccugugggcacacccugacgucaccugguccugcagacuguggucacugcacuuggugucugggcccagcuggcaggagugggagagggccgacgggguggggggugauggucaggccacugugcccuagaggcucuuccggcuguggaggaggagggucuugggggcagggauccccuucagccucacauuucccagcccaagcaggauacaaguaaggacauuuccuuacggagccccagaguuucuccuucacccuggagcucccuccaggcagccccucucagcccuuguccuccccguggagagcugcucuugaaguugaaaucgugguacaugcaaaggaagaggcugguuucagccccgcaggcucuggcagcugcauccacgcuuccugcuguuucucacuccccacccggcccgccauuucuaacagcucuauugaaaugcgacgcacauuccacguaccucgucccuuugaagggggcaguucagcgacuuuuauguccacggcuagugcaaccaccgucacccuucgcagaacguuuugauccccucucaaggaagcccgaacccucuaguuauccaucacccugcugucucccgugcccucaaacccucagccaccagucggcuacugcgugccucugugggucugucuguugugagcauuuccuggaaagggagucccguggccuguucugagcauuuccugggagggagucccguggcccauuaccagcauuuccugggaagggaguccuguggccuuugugauuggcuuuucucacuucccuuguucaagguucacccauguggucauaggugucggugguguauuccuucuuguggcugaaacaccccacugugcacggccgcaucuuauauauccagucaucaacugguggaccuuguguuccuucuuguggcugaaacaccccacugucugcacggccacaucuuacauauccagucaucgccugauggacaucuggaugguuuccgcuuuggggcuguuaugaacacagcugcccugaacauucacggacgagucuguguagaugugugugcaguucucucgggggucugccugggacugggccugcuggaucacaugguaaccguuucaccauuggaggaacugccagacuguucuccagggcugccgcacaccaggguuccaguuuauccccauccucaccaacguguuguugcgugacuucccagccguccugggggcgcaaagugauaccuggcugugauuucacuuucugucucuggaugccggaugaugccgagcagcuuuucaugugucuauugaacucauagaagucugucuucagaugccuugcccauugugacacuggguccucauaggagucugucugcagacgccuugccuauugugacacugggucguuugcugacagugcuucauguguugagguguaaguucuucggguauagauuugcagacauuuucucccauucuguggcuuguuuuugccugucacuggcguccuuugaagcacaagaguucuuaguuuggaugaagucugauuaccuguuauuuucuuuuguucuuugugcuuugggcuaagaauucuuuguuaaauccaagguuaggaggguuuccuccucuguuuucuuccacagguuuuacgguugggcuuugcgugggucuuggauccauuguuacuuaguuuuuguuuauggugggagguggggcccagcuucauucuuuggcaugcgccagcccauugucccagcagcauuuguugaaaagacuauuuuucccuaucgaaaggucuuaacaccuuucucagaaucacuuaacaugaacgugugguugguuccuggacucuccacuguguuguuggucuguacgucgguccucaugcccacaccacaccauccugauugcaguggcuuuguaguaaguuuugaaaucaggagacugagucuuccucccguguucccccuuugcaagccugugguggcucuucugagccccugcaguuccgugugaguuucagaaucagcuuaucaguucuucagggaggccggcugaguccugggauuguacagaaugugcagaucagcccugggagucucuggucccgacagcgccgggucuucugauccgagacaugggauguuuccuaaucaccuagaucccgccuaguuuccucccaugcuguuuugcugccuguguguuugaaauggcuccucuugguggggugggugcaggaguggugcuguuuguauaggacauagggccguccucccaucccgacacucggcugcccuggagacgggccucagcacagggcucccauuaccccugcacuuccagcaccugcugaaauguguggcgcgcgggcuccgaggcauggaauggugugccugacucugcgcugcccaggcuguggucacagcagcaggcuggaaguuuggcugucgcccccagccaccuuggggcacgguccugucucaccuggagcagagguccugggcccccaggggcucaggcguggccuccuucuggaggggccgggaauguccccuccacuugcugaguguuggcccaggaggcuccucugugggaugccagcugcucccaccaugaguggcagcuccaccccuguauucacagcugugcugagggcauccagggccuggaaaucaugucagauggacagacaggugugcggguggauggacuaagggaagaaaggaaggauggcaggaacgaacgcguggaggucaagagccuggcccagaaucacgguggggacgugagcggguggguggugcccagucugccccucccgugcugccucuaggggcucugccuucuccaggcguuaggcagggaaaguccccugaacuuacagaaagacgacuaggugccuggaauguugccaucugcacagagcccuagcgccuguccucccacuucccucgcccuccugggagguggguucuccacgccaccaguuauggagcccaggcuuguucucagcccuggucagcggugccaucgcaggucgcuccagccccagccgcaggugcccagugaaugcucuccgugacccagggccuccugcugcagguggaagccgggccacgggaaccugcgccgaccuuggccucacacuguggcuccgggagagcaggaccugguggugcaugcguagcggcugaggaggacaagccugggggcuggucccagcccggacacgguggcuuugcacacaccaagccuucgcccccagcggggccagcagugcagggcgcugcacuguugggggccagagggugacaggauugguguuuaagaagaacuucucaguuuuaucuuuucucuguuuugauuugguuuccuucaucucuacuggcuugggcuuuugguccuuaaauccucuaauauacagaauuguuuccuggaccucaagccccccaucaggggggaaaccucaucccaggaugaugggccggucguggggcacccuggcugggggcugggggcuggggcugugcucuggcucucguuccugcccguggaacguugaacguugccaggacauccaccccggggaacuugacguccucaggcacugcuggguccaacgccagcgcugggcgcaccaccgcugacccccgaccccuccugcaagucccccuaucugcuaaguaggaggaugcuggggccaggcgaggccuugcugggcagccucuaggauggucacuaccuccucccaccuggaggucccuucaggagguccgcgguguugaagccuggggaggaagaggaggcugaggccugggagaggaagaggagggugaggccugcggggggaggaagaggagggugaggccugggggaggagggucucacugcucugggucagaggagggcugaguacacgcugugcggccugguucuugccaggggucagcugacuacagccccgccuucugugcagccccucaacuaagaaccguuguacauuuuugaaggguugaagaaaaucaaaagaagaauauuuugggacacacgcggguuaucugaaauucagauucguguuuccgugcccgcagcuccgucagcggggcccaugcuggccuugugugcccugcggcuuucugggugcaguugcagcgcuacgugguuaggacgggggcagggugacugcacagccccgugacuggcugcucuccgcaggaggcggccccacccucugcccacauccucccuggcuccucgaggcuccguaggauggugaagagguugagaugcuguccagcccacagaggccccggaaagccagugccgcccgucagaggggucuccugagugcguguggguggcuggauucugcauacuggguuaucuuaaccccggcugugaaaacuggaugaaguagcaauccuuucaaccccaagagucugugauucagccagaguuacaagaugucucuucauccucugagguuuacaagguucucagaaaaccugugaagagcugcgcggauccucuccugccccggcccagcggcagggcugccgccucccucuccccugggccugaguggguggauuuccccuccccuccuccuucccaggagaagcacagagggagcggccaagcgagccgugucugcaaaccccgcuucccucugcggcggccucugccaucgugccauggggccggaggucccugguccaggucagcauguccaucuccacuggccucuuccaugagggggguggcagggccagcaguuagcuugugugacgugacgucagggggaugucuuagaguccgggguggcaccaggaggggugaggucucuucccuucuuccccauccucuccucucucccuguuggaggcacauucugggcucugggaccacgauugcccauggcugaugagcuccagcccaagugagguccccaggguacagcccaagccaggccucgccguccuucggggacuuggagagcaguggcccacagcagccugagcucuugggaggcuggaggcuuacugcgcccggucucuucaccccgugggguguguccacaccggccucuccugagagcguggggugaucugaacacaggauguguuucccuguuccccucugggagauaggagagugcgugggcagaagccccaaggguggcaggaacucauugccaaaggggaggaggccauugcuaugcguggugcuggccuggcuugcugggucaugucugugccugacaugacccaugucaugaccauggucaugucugugccugacaugacccaugucaugaccauggucaugucugugccugagggaccgggugcccauccagucucacugccccacagcucacagccacaagcugcagaaucucagcacuuggcgggagcccuggcccgugugugugcgugugugugcgccgcuggcuccagcccuggccuguguguguguguauguguguguguaugugugugcgugcaccgcuggccccggcccuggcccaugugugcgcgcgccucuggucccggcccuggcccgugugugugugccucuggcccuggcccgugugugugugugugugugugagcgccucugguccuggcccuggcccguaugugugugugcgccucuggucccggcccuggcccgugugugugugcgcgccucuggcccuggcccgugugugugugcgcgccucuggucccggcucuggcccgugugugugugugugugccucuggccccagcccuggcccaugugugugugugugugugugugugcgugugugugcgccucuggucccggcccuggcccgugugugugcgccucuggucccgguccuggccuguaugugugugugugugugugugugugugcgcgccucuggccccggcccuggacuguguccgugugugugugugugugugugugugugugugccucuggccccggcccuggcccgugugugugugugcgccucuggucccaguccuggucucugugugcgugcgugugugugugugugugugugugcgugcgcgccucuggccccagcccuggcccaugugugugcaccuuuucauauguuuaucagcuuuuugggugucuuuuugggaagugucugcucacauguuuugcagauuuuuagaguggguugucugacaugcccuugguuauuucugacaugcccuugguuauuucugacaugcccuugguuauuucugacuucuucguauguucuggaucugaacccuuucucagaaaugugauuuucaaacagcaccuccugcucugugggugccuuuccacuguuucaguggaugaaguucuuaauuucuauaaggucaguuguacucuuuuuuuuuucuuuuacggccagcacuuccugaacccuguuugaguaaccugugucuacucccaggagacagaaugugguggaauugauguuugugugugaugugaggucggggucucaggugugcagugacccugcaccucccugccgugggcggcuguuguuuguguguggcgugaggucggggucucgggugcgcaguaacccugcagcucccugccgugggcggcugauguuuguguguggcgugaggucggggucucgggugcgcagugacccugcaccucccugccgugggcggcugauguuuguguguggcgugaggucggggucucgggugcgcagugacccugcaccucccugccgugggcggcugauguuuguguguggcgugaggucggggucucgggugcgcagugacccugcaccucccugcugugggcggcugauguuuguguguggcgugaggucggggucucgggugcgcagugacccugcaccucccugcugugggcggcugauguuuguguguggcgugaggucggggucucgggugcgcagugacccugcaccucccugcugugggcggcugauguuuguguguggcgugaggucggggucucgggugcgcagugacccugcaccucccugcugugggcggcugauguuuguguguggcgugaggucggggucucgggugcgcagugacccugcaccucccugcugugggcggcugauguuuguguguggcgugaggucggggucucgggugcgcagugacccugcaccucccugcugggggcggcuguccccugcugugggcggcuguucccugcugugggcggcuguccccugcuguggggggcugucccugcugcagggcugcauggugcuuguugcugggggucggucacccaccacaggucagcaggcugggccuccaggcgcacuccucccucaaggaugccacacacaucccggcccuggguuucgugggaacaucagguugcgaggcgcauuccugagccacccacgcugaugccaggcucccuugccuuccaucucugugugguugaccuuguuucucuuguggcacggggcaccuuccaggcugguagggaagagaugggaacauggccacacgggcucccagucucaucccagccaggaaccucagaggagaggaagccucccucccgggcacugaguguggaauucugggaagcaccgcacuuggcugagcaaaggccgcauguccccucucacccuguuccugugguuaggcagaagggacccagcagguggccaggccuuguuccugcaccuguccacagggcacagggaaggagccacuccuuccaggagagauggcugccaggcaggcucaagaagacaaaagaacugagcacugugcugugugugacccgugcugugugucuuccugggccauggugacccaugcugugugugacccgugcugcgugugugccugggccauggugaccugugcuguguguguuccugcagggugacuaugaccagagcaggaccaaagugcugcacaugagccugaaccccaccaguguggccaggcagcgccugcgcgaggaccacagccagcugcaggcggagugcgagcgacugcgcgggcuccugcgcgccauggagagaggaggcaccgucccagccgaccuugaggcugccgccgcgagucugccaucguccaaggagguggcagguaggcaccccccacccccggucccugccauccucgaccuuccguggguagguccauccgugcgccuuuggggcagccucaggcgccccugccugucauccccagaggguuuguccuccccugugggcagccgggucuggugguugcuggggcagagcacccuggccccguguccccauggccccgugggguugugcaaacagguggagccauccgagucugcaggcagcuguggagaagcaaggggcugaaauuucaggcccuuaaacuaauucguaucauuugucaguuuauauguaccccauuaaucacaaguaaauccaguccuccacgaaaacaaguccaucucucaccagcuuaagugugcuucauggcguccagagagcccuuugaggccaaggccuguggcgucccagggaagaaugaggccuccaugagggccagcagggccugcccacacccuccaggucuacaugaggcccacggccuuuggaacgccagccuauccccugauguggggagguggugcuggggucugcccacgccaagccucggagggugcugccggggcugugucgacucugcagggugccccugaaggagcagggcugggaguccagagucacugugcagucugcacccccagcgaggcuguggggcucaggagaccccugcccccuguguugcucucugcuguuggagggagcugggcacugccccacgcuccugguucuggggggaccugggggaggguucccuguccagcccuuagcagcagccuggagcguggcccggcguccccuugcuccuguguuagagccacccggcugccagcccccucccuugggggugucugcaggcucaucugugguggggccuggaggcugcugcuuucuggccuuuggcaucucgaggugauuucagacucagcuuucauccgaugauaccuucuucuguuucuucccaccuacuugccaucgcgcccuguacugugggagagcauucccugugagcaugcaggugcagagguuguguggcggugacuuguccgcuucccacagcccagcacccaggcugauguaucaggagugauuguccucugccccgcuccuuuguggggagggucuuagguggggucuucccucccucuugugccccacccccauaagccaagacugcccugagucugggcgcacccugccggcagguaggggcuuaguggcuggcuagcggguggugugcccuccuggaguaguauggugggguuggaggacaaaagccagaagggggggccuguguugccagauugaggggcgagcugauggcagucgggggcuccuuuccagcuccccaccugcacaagggcugcucccggucuccacuguggcugugagggccugagcccccauguccccagcccccuuucugguccagccguggcucccucuccgcccugcauucugcagguguuauuggcaaguuucggagcugaggaugcagacuuggagccauauuuuuagguggcucugcacccugggagaggauuugggaaggggccuuccauccccugcugucacgggccugugccuuggcugugcacccauucgcuugucuguuuguuccccuguugucugggucucugcccgucucggguuugcccgucuguucguucccuuguugucugggucucugcccgucucggguuugcccaucuguucguucccuuguugucugggucucugcccgucucggguucacccgucuguuugucccccuguugucugggucucugcccgucucggguucgcccgucuguucguucaccuguugucugggucucugccugucucggguuugcccaucuguuuguuccccuguugucugggugucugccugucucggguucgcucguguguucguucaccuguugucugggucucugcgcaucucggguucgcccgucuguuccuucccuuuuugucugggucucugccugucucggguucgcccaucuguucguuccccuguugucugggugucugccugucucggguucgcccgucuguucguuccccuguugucugggucucugccugucucggguucgcucguguguuuguuccccuguugucugggucucugcgcaucucggguucaccugucuguuccuuuccuuguugucugggucucugccugucuaggguucgcucguguguuuguucaccuguuaucugggucucugcgcaucuuggguucucccgucuguuccuucccuuguugucugggucucugccugucucggguucgcccgucuguucguuaaccucuugucugggucucugcgcgucucaggcacgcggguggucggcaucuggcugugacaggugcccgggccauggcugauugggaguggggggugcgaagaggcgugucugagcugaccauggagaagucagggccagcguggucuggaagcaggaaggggaggaugagcagaggccugggauagugggggccgcgccacauggcgccaccaggaggugagggugggucgggcguccaggccccaguggcugaugcagcgcgugucugugcccccaaaaaucacaguguugguggccucuguuuuauguaaggccuaaccccacagagggagaggauacagaggcagacuuuuggagucuggaauuggcgggugagcagugaaaggacugaguagacuugggaaaccggaaucuaagccggcggcggguggagcugagaacccgccugaguuacaccucaaaacuccaacgcagcccaggaacuggcugcaaguggcguuaggggagggaugccacugacugaagcacaguggaucuggaggcuugauugcugaauuaagagauggguccccggaaccaucuguccaucugugugcccugggcaguugccgcuccccgggaaagaugaagacuccaaaacaagccagcaguuuauucuuggagcagugauacuuaaagugcaguacccaggucggccgcugccucccugggagccucuuagaaauguggauucucaggucucaucucagacuugcucagccagaggccugggggcggccggcagucugugcuaggcagcccuacagaccacgcggaugcucagcgcguuuguggaccgcugcucuggagagggcuggcaaggucccuggacagacccaagucaggacaacaggcuugaacugagcccggauugauagaugcaggugugggccuggaucgcacacccccgccacgugcccugcagaacacgggcagcaggugugacccuguaggcuaugguggaaagaccucccuguguauccgagcagcccagaaggaccuggcguuggcaguuccccagcucgacagcucccauggaucgcucccuggggaaaaccguggcagacggcuccaugcuccuacccggaguaucccugggccccuagugcccuccccuagugaggagcugauacccagggauugucagacagcccaagggaaaggacaggaaacgagcagggaaaacagagcacagcgaaacgcagagaaacacagcgucagcggggagggaacccacugucccagcaaagaaaaucuccaaaaacugucuccuggaucuccucagagagaagacggggcuucagcaaccaaacaacagggcagcuuaacacacaccaagagaaagcagugagcagggggaaggcaaaaguagggaacagugaauggaaaucuaagaagauuuguaaaguaacguugagaaagucugaaaguaaagacaacgagauggaaaacaggagaagagaaguaagaacauuagagguacagcccacugucugaacaacaggaacauggaaggagggaacagggaaaaagcagaugauaacagaagugccucaaggacgucucccugaaggaaggacgcagcucccugccucccgggagaggcucagacugggcugucugugguuggggauagacccgcacagugugcggcagcaugaagauucaggacacaggacgaaaggaagacccugagaacuucagagaagaaacacagaggucacuugucaaaggauccgggaucagucaucuagcguuuccuagcagcagcaccuccgaguuucuagcagagugaccugcaucucgggaucucauagccccccagccccacaucaggucugaaggaagaaguacgggcaucugcaggguucaaggccuuaaaaacuugacggccccgcaccgucucucaggaagcuggcagaggaugcacucccaaaggaugagggaguaaaccaggaaagaguguggcuguggcacgcagagcagaccacaggggcuucugccgcggaagcagagaaggaggccucaggccuggggagcagccggcaggggccagaacaggccagagguucugggauauagagcagagaaggaagccuuaggccuggggagcagcuggcaggggccagaacgggccagaguuucugggauauagagcagagaaggaagcccccagccugggcagccuccagcgggggcuggaacccaccagagauucuaggacagaaccuggugcguugggugucaugaugcggaccggagcuuuccacacgugugugccaggcgugggcugccauggacguugguccccaggucccugggucacucuuuggcagccuccuccuucccugcgugccacacacauuucucagguuuuagguuugcugccccgcacaaaaagacugggaagcaccuguguagacagcuggcaaagagggauggcugccaagagccaugagcaccuagaaggcugagugcgugggaagcaggacgaccauuggcucuggggacagcagaguugcaugagaagcagcagaagcagcaguguccugcauucugagcuggcccugagcagccucacacagucguaagggagcugaggccugaucugaacacagcccugagccucauauuaagaaaggggaccaggaggagggagacgcguguugcagggugggagggagggagagcugaagccucgcugucucucgggaagucagcaggacguccgagcgcucaaguccagaaggagccacagaauguguauuccagagaaaugcaguuaauaccgacaugaucggcugagaggugaacaugguggacucuggagagaaaggaaggaaaugagaaguguggagaccgcuguucccugacacaccccacagaauuccugggcucuuaacucaugugcauguaaaucuaaaguuaaaaagagaaaaguccaggucacgccgcuugcugccagagagggcuguccccuccccauucuccagaugaggagcaagggugugcccgcagugucagcagacccuugacguggaccccacgacgcgcccucgcuccugugaccgugcguggggugaggaguuggggguguucccguggugucagcagacccuugacguggaccccacgacgcgcccucgcuccugugaccgugcguggggugaggaguuggggguguucccacagcaucagcagacccuugacauggaccccaugaugcgcccucgcuccugugaccguggguggggugaggaguuggggguguucccguggugucagcagacccuugacguggaccccacgacgcgcccucgcuccugugaccguggguaggcugccugcacagucccugcaaagggugagauggcaggugugagccugagacagagacggaugcuccuccccggccuggcuggcccugagcauggguuaggggugggucuccugggucacgagagagaccaggguaaguugugagggcuucaggccagcaggucugcagauggcaggccugucacuggcuuaagggggagccgcguggccugagacagcgcccagugucccaccaggaagcaagucccaggggaguccccucacacccugaucacccagcaucucgggggucagcagaugucucuuccugcucuggggaaucagggcccccaaggaacaaggugaaggggaugugacggugggacgaagcaaggggacacguggcaguggggugggcgaggggacgcagcggugagguggggugagcggacacgguggugggauggggugaggggacguggcaguggggacggggcgaggggacguggcagugggggauggggcgaggggacguggcagugggggauggggcgaggggacguggcaguggggacggggcgaggggacguggcaguggggacggggcgaggggacguggcacugggggauggggcgaggggacguggcacugggggauggggcgaggggaccuggcacuggggacggggcgaggggacauggcauugggggauggggcgaggugacguggcaucggggacugugcgaggggacguggcaguggggacggggcgaggggacguggcaguggggacggggcgaggggacguggcaguguggacgugguggugggauguggcaguaggggacgggaugagggguuguggcaguggggacgggaugaggggacguggcagugggggcagggcgaggggacguggcaguggggacggggcgaggggacguggcaguguggacgugguggugggauguggcaguaggggacgggaugagggguuguggcaguggggacgggaugaggggacguggcaguggggacggggcgaggggacguggcagugggggacggggcgaggggacguggcaguguggacgugguggugggauguggcaguaggggacgggaugagggguuguggcaguggggacgggaugaggggacguggcaguggggacggggcaggggacguggcaguggggacggggcgaggggacguggcaguggggacggggcgaggggacguggcaguggggacggggcgaggggacguggcagugggggaugggcgaggggacguggcagcggggcugcagagucaagagcucccuuucguguuugccacggcuuccccaagggcugucucuggugugggccccagaccuccggucagagaagacacagaaacacauaaagaggccccugcucucggggaucugagucccugcucggaaguucaggcaggaacacccuugugauuuuccuggugucuuugacaaggcagucacuaaacaacccuugccaucggcacgggcccuuggcggauaggagccccaaagcccggccucccgugcuggcucugacuccucacucagccccccugccacguccaggcugggccagggagauuguuaauugcagcuuaauuagggaaugcauuaauauuaaaauaaucuuagcagcacauugaaggugaucaaauuugucacugccugugugggcacagcugauccuagaggugucuuuggggaggagggaggcagggggaggauggaggagcgaggaagagggagaagagauaccagggaggagaagggaggagguggaagaaaagaggggaggcccgggaggggaggagggaggggaagaugguuggccacagaguugcucugccuggaauccaccugcucggccucagggaggagggugcccucgaggggaggccugguuuggugucccugccugggcugaggacgggagcagugacugccuuucuguugcguccugugcacugcuucugucuguaucggcgcguguccucugcagucucaggacucacacuuuuccugcuuggcuggcgcuggccccacagguggccucagugaggugcccuaauggcugcuccguggaccaccaggacaagcacuguggagagcuacccauuggccuggcagugccaagccagcugugcccucccacggccagaaaucagugcccagcucucacguggcacaggccuguguuuacgucaugcccccaccccgugccaccugggcagggccgccaccugcccacgccucuguuugcucaguacaaacaccgugcaaugccgacagcugagcgguucaaaugggaugggggugcaggggcuccagcccuguucggcaguuagugggaguuggagaagaagggcuggcgucugaagugcaggaccaugccuguuuggcccaguccugugccaagcugagaucgucugccuggguccugccaucuagggaccugcaggucauggggaacagucucagguguggcaggaguuccgucgugggcuccucuagggaccggugggucguggggagcagugucaaguguggcaauucugucgugggcuccucuagggacuggugggugguggggagcagugucuggcguggcaggaguuccgucgugggcuccucuagggaccggcgggucgucgggagcagugucagguguggcaguucugucgugggcuccucuagggacuggcgggugguggggagcagugucuggcguggcaggaguuccgucgugggcuccuuuagggaccggcgggugguggggaacagucucaggcguggcgggaguuccgucaugggcuccucuagggaccggcgggucguggggagcagcagcagguguggcagguguuccgucgugggcuccgacuguagugcuggagacagaagugaugugacgucagccaaggccucgggcacgagcugguggcucuccacugucuggagaaguagcugccccccacgugcugcuuggugcugccuauuuuuuaauugaauuguuaguauugaguuuggggugaauccaaguugaguauauagcugauaaauaucuucucccagcccgugacgagccucuucauuuucugacccuguguuccucggagcaaaugcuuuucaucugggugcaugcugaugaucagguuuucuuuuauaggggucagauccagaaacucucugcauaacuccaggccaaacauauuuuuucuuguuuucuacuaaaagguuuuaaguucacauuuaaaucugugacccauuuugaguuaguuuuugcccauggugugagcuugaguucaagcuacuuuucuuuuuuguuuuuauauggauguccaauugugccauuauuauugaacugacuguccugccaccauugaauuauguuugcaccuuuguccaaaaccaguuggccaugcguuaugggggucucuuucuacaccuucucuucuguucccuugaucuaagcgucuguuccuuugcuguuaauaacaccccacgguauugauuacuguagcuucguaguaagucucgaaaucagcagcacaaucccccacuuuauggacaagauuuacauucagcuugucuuuaccugcaaaacgccugcucagauuuuuagaggaauuacugcaucugucagucagucuggggagcaucuacaucuugguugcagugagucuuccgauacaugaacacaauguagcucuccauuuauuuacguucuucuuauuuucuuucauccacauuuugugguuuucaccguacccacccaccccuuuuuuguuagaaauacacaugguuuuguugguuuuauuguuaguguuggagcuauguaauuauuuguaggcuuguuuuuaugggucccagguguucagugcguguguguagauguaugacggauguuuaugcuggcuuuguaacccaugaccuugcugaacucacuucuuacaucuggguuaguugcuguuuugauuuuguuuucuaauccuuugcagucauagcaccugugaauagggacaguuuugcuuauuuuguuaagauccauaugucuucuauuuuguuuucuugcuguguugcccugucuaggaccuuaguauggugcugaguaggagauggggcaacagagauccuggccuuucuccucaccuugcagggagagcaguccauccuccuccaugaggcgugcugcuagcugcaguuuauuugugguuuuuccuuaucaagcugaaaacgcucuuuccauucuuaguuugcugagaguguuuaucauguaggauguuggcgucugucagaugcuuuuccugcaucaauugaugggaucguauguuuuuuuucccuuacaccguuagugugauugacagugugucauugugauuuuuuugggaaguuuccaacguugagccaacucugcauuccuggaauaaaccccccccuugguuauggcauaguauuuuuacauguugcugaguucaucuugcugacaucgucaguaaucuucacgucuguguucauauuggucuguagcuuucuuguacugcccuugucugguuguaguauacacguaaugaaugaagugaauuggaaguauucccccuuuuauguccuagaggagauuauauagaauugguguuacuucuuuaaauguuuuguagaauuugcuggugaaaccaucugggccuagggauugugguuguggcagguucuaaucauuacaggaauagugaguucuuucaucucagcugaauguugguagaauguagguuuugggguuuuuuuuauugugaggaacugguucauuauaucugugaucaaauguaugagcagugaauugucugugcucuugccucgcugauuuuaucgugccugcuggguucguagcgguacuccuuccuuccugauacuggucguuuaugucuuuuuuuuucuuuuuucuuuuuuugucuguuagccuuucuggagauguauaaauuucacugaucuccuuagagaccuaguuuuugguuucauugauauuuugcuguuguaguuuuguguuuccuuccuucugccugcuuuaguuuuaguuugcucuccuuuuuuucuggccucuucagguggaagauuagauugcauauuugagaucuuuucugcuuuccaacguaagcguuccguguuagaaauuugcaucugagugcugcauuagcagcauuucacacauuuugauaauguuguauuuuuauguguguucaguucaaaacauuuucaaauuuccauuaagauguaccauaguuugaacguggccuccaaaguccacguguuggaaacuucaucccagagugaugguguugggagguggggccuccugggaggcguugaggucacgugggcuccaccuuggugaguggauucgugcuguuguaaaaggggcuucuguuaguuggcucucuguaucugcccuccugccguccaccaugugauggcgccucaggaaagcccuugccagaagcuggugccuugaucucggacuugccagccuccagaacugugagccuauaaacuucgggucguuauaaauuaaucucagguauucugugauagcgccgccaauagacuaggaugccugcugugauccauacagauuuagaaggaugcuuuuuaauuucaaagugucucucccugauuuucuggguaauuucuguucaauuucauuauguugagggaacgcacuuucuacgauucacuuucuuugcaauuuaaaguuuauuugguagcugauaauuugauaaccucaaaaugucccaugugcaccugauagguauguguguucugccgauuaauagauguguuuuggccauuuauaguuaauguaauuuuuuaugcauuuggauuuagguacauuuuaugauuaguuuucuguuuguccuccauuuuuuauucccguuuucucuuuccuaccuauuucagguuauuuggccuuuuuuauacuccauuuugauguaucuaugucuuuauuauaucuauuuguauacuuuuaaagugauuuuucugugguuuacaaugugcaagcuuaacauuucacggugcacuuauaauucauauuuuaucauuucagguggaaacgucaggauuucaccacgacguaggcuucucccugccucccuuuauguuguaguaguccuauguacuuacucucuauauguggaaaaccccaccaagaaauauuacaauucuugcucuuaacugucaugccuauuuuauaaaacauaagaggcaaaaaguaguuugugguuuugccucuuccuucuuuccuggcguuccuggguuccccugggaucauuucugguuuggcaggacuuccuucggggcuucuuuagaguagguucucucagcguuugcuugcccagcaguguccucaccccaccucguuacugaaggauaccauugcuggaugugggguucugggagagugguucuugucuccuagcacuuuaaaaaucgacacuguuuccccaucuucuggcuucugugguuucugaugagcaaccugcagucacucaaagaaaucuccccuuuccccuccgugcagaugagagaggcuuucagacacuccaaguguggugguguuuuaaguuaaaggacgggaaggaauucaugugcccacauugucugcuggguuccagcguguguggguguaaugccugccacccugccgcgagaaggacuccuguggugaugugcuuucuacaccaagcuuaguggcacggcaucaucucuaagauacugugaaaaguuaagucuguguuuuccaaucacuugcuucuuggagcgucuuuaaaaucucacucgauaauuccagcaucuccgucaucuuggcgccuguuggucguguuuucccuggcagguuucuguuuucccgguucuuuucaugcugcuuaauuuuagauugcauucuggauguuuugaauaucccgagauucuaggucuuucuuaaguucucuggagaauguaaauuucuguugguuucagcauuuccugauggcacuuccauuucaggcucuuugccgaguuucccaggccauugaaccuuguguccuccacaguccuggcuggguccugguguggucuagcucagaguccaacucucacaccuguggggugcugauuagggucagagccccaugcccagcuuagagggcaccuuccagagccacucugagcacccagcacuucccaggugacccaggguucccuucacugccuucuggccacagagccaggcaaggcuugcccacugugcugugcagucagucccacggccacagccgccuucacggccaacgccagccacagcguuggaacagggcaggacaugccccacgcacccugucuggagggaggggcccacucuugggcucuaggcgucuguccagcuguggcuguaccuccgcaggauugcccgggugccggggcggaagagcgcgggguugcccggcugccggggcggaagagcgcgggggugccagggugccggggcggaagagcgcaggauugccugggugucaggguagaagaggauggagacagacagaauuucccacacugccucucaggcuucucuugacaagcugugugcgucuugugcucacucccagguuuuagggguccccaaguccagacuggguagcaccagggcaaacacccaaccagugacagaaacuccagcaagcuucaaccacagacugcagaacucacccaguaugaaauagaucgucucauuaauccuagaaccauuaaauaacugaauccacaaucaaaaagcuuccaaaaaaggauaucuccaggcccagaugguuuucuggugaauucuaccaaacacuuaaagaaaacuuagcaccaauuugccaaaacucuccaagaaaacagaagagggagcacuucccaacucacucugugaagcaagcauuuaccccaacuucaaaaccaguggcaaaacugaagaacacugcggggcuauuuucuguuuucugagagugcaaggcuggguuggugucgagcgucagcugguacaauccaucgcgucagcucgccaaaaggaaaaauuacauggccaaaccaacggaugcacaaaugcagucagcgaggcccaacacacguucauggggaaacucggcaaaccaggagaagccgagaacccccaaguuugccaaagagcaucugcagaaaccgugcagcucaccgcagaccuggcuggugagggacugggaaacgccgacucaggcagaggccuucccucucaccgccuugguccaugucccagagccccagaugggcagcagggugaggaggucgaaggcacacggacuggaaaggcaggaccgacccuuuuccucuucacagguggcgugauuaugucgaaaaucacaagauaaaaacgagucgagcgaguucacccgggauuucuguguguggcucuuguauccugcaaccuugcugagcucacuuuaugagaaauauguccgugugucuguguaguucuguaaauauuacacaauagcagugcacauguggaaaccgaaauuaaaaacaugccguuucuguucacucuucugaagaugaaaucugcaggcaucacuaacaccacagcacgccgacaacggcaagcugcugaggcgaggcgugggaggucugugugaauggagacucugccuucguggcucguggggugcagcgcaguaaagacgcggcgcggccagguccagcugcaugucucucgcagcuggaagcagggcgcucgccgcugggcuggugaugcuagugguucuggguuccgaccucagcccgccugcagccuguggcucuccaggucuguagucggcugcuggcugcacucccuccaucgucagagcugccucagggagagacagggcugauugguuucuucaucuuucccagaaccugaaccccucgucuucagguucucucuuaucuguuaauuccguugcuuuuaagcuuaguaaguacuuuagugauuugauaaauaauucuauuuucuucugggcucuuugagcuuauuuuuauauuuaaagauuuaaucuacuugaaacuuauuuugguguaugguaugaggucgagaucuaaauugauuuuuuuuccagaucacuaaacaauugcccuagggccauuuaucucagaauccuuccuuccccguagauuuauaccuucaucuuuauuaaaacuuaggcaaaaucgggucuguauucagaucuuuuguuuuuuuuaauuucauuuauccuuuuuuuugacuuaaagguuuucuuaccuguuuauuauucuaaguuaauuuuagaauuacuuugucacggccaggcgcgguggcucaugccuguaaucccagcacugaggcugaggcggguggaucaccugaggucgggaguucaagaccagccuggccaacaaggugaaacccugucucuacuaaaaacacaaaacgccaggcguggcgggagggugucuguagucccagcuacagguacuauagaugcugaggugggagaaucgccugaaccugggggauggagguugcaguaagccaaaaucacaccauugcacuccagccugggcaacagagauagacccugucuccaaaaagaaaaaaaaaaaaagaauuagucaaauucaaaaaaaagguaucaagguuuuauuuuuuacugaaauuacacugaaguuauagguuaaucuaguggaagaaucuuuggcuuuccagcgucugugucugagcagggaagggcgccucagggccgccucccucaccgauaccacgucucagacccgcagcgugccgggguucccuuugcaggcuccgguccaggcaggagugugucaucugggcugccaucugcugggcagggguccugaguccccacugcuggcuccaggccgccucuccgcccucuucccaccuccccacccucucuuuggguugccugucucgucgucuccagggcucagagccgagcuuugcaggaggagcagggaacaugaaucugcacccuuuucugucuggaccggaugucccgugaaucuuuuuuauucagucaaugaagauuaggguuuuuugcugucgguuuuuaaauggauacacaguguucgugcaucguuaugggguguaggugauguugucuugcaugcccagaaugggcaguggccacacagggguauuugggguauccgucaccucauggacuggucauuucuaaguguugggaagaccuccuguccucucuucucacuguuuuaaaguagacagcacauguggcugacuguaguccgcccccacucggcuguggaacgugaggucuuacuccuuccaucuggcugugcgucuguacccacugaccagccuccguucauccccgcccaccccacaccugcacccuccuucucccccaacuccaugcgauggguuccccccgcucccgugggugagagcgugcagcgggucuuccuguuuuaaccacuucccuuggugccucugaggaaucgcuggguccacaacacagugugaggcugccacggcagccgagucuccccgacuuucucugccccugcuccucccacacacugucgcugcuccaucugcagacaacacagccccgggcgagcuuacugggcaggguucugccgaaacacagaacucguagaauguguguacacacgcacaugcacacgcacgcacgcacgcacacggagaugcuuguuacagggaguuggcucacgcaaugacaggcaagucccgagagcugcaggguugggggcaagccggggacccaggagcacucauguacuggggaaggacagggaugcugggcccacacagccccggcuucugacucuggggguugcugucuccuaacgcugcugcagcccugcugugcgcccuccuggggaccuccgugucacuggggaccuccgugucacuggagcuguuggcacuggcccucuauaagcguuggguggacuggaggagggguguggguaaggcugacuccgcccugccaccccugggcacuuugcaacuucagcucccuccccagagucaucugcaguuucuuuuuguugaucaaaguuaaauuucaguuccaaagcaaaguugcuccugagcugauggaggagggguugccacacacugucagcuguuuuggacuugggccauggucccagcucugcaccagcagccaugugaccuuggguucagcucucucagcucugacauguggcucacuccaaucacggucauuguggaggguguguuuauagcagaggcaccgcuggcccaugaugugugcucagcaugauggugauggcgacgauggcggcuguggccugagcccauuggccucugggcccgugcaggagcccauuugguagaagcugagccaggcugguggguagagaaacaaaaguggcucccaaugagcccauuccccagugcgguccucccuuugugugguagguccccagcgaggacggcaggcuuggcuuuacaguucugccuucagugccagccaccuggaccuccugcaccaggucagggagagaaggcagaggagaccuugcaggcugcaggugucccuggcuccaacacaccguguguccaucugaggccggggcagccguguuggacggccugggagccugaggucagaaggcuuggauggagguccugcuccacgucguaacaguugggggucuggguggacccuuuucucucugcaucucagcuuccccauuugagaaacgggaccaccggcccagguccuggggcaguugugagcgucuguccccgcaccaagggugagcgugacaggcggacgaucucugcagacuccugggacugaacgauaggaggaggucccuguccuugcuggggaggggccggaucacggcggcaugggccggagggaacugcccugcuggcaagagccgccagagccuggggugacccagagacaggacggguguuggaaggaucagugccccugcccugccacgugcucucacccugugcacucauugaggcgcccuguagagaggggaggggaggggaggggggcuggggccaggaguagccacagcaccagucgcccuggggccgggagcuguggucuccucaggugggcccaagugcaguccagguggggcaguggccucagagcacaguggcuuugcugaaggcuggcuggcacuccaguuaaacacccuaggcccuucucuccaugcuguucuuugguguugguguuggguaauaaaggccagcaccauuaauuagguguguaauuagaguuguaaaggaaucaugggauuuaaucacaggguuugcaggugagcgggguagaggaaggguaccacccucugugcugggcacacccgccuggcugccugcaaacagauccucccuggacugggcgccccccaugccguggacccggccugggccucggagcuccugggcagugcggagggcugaagcaccguccccaguggcgugacugcgguuguguguugggaacaugcucgggggccccaagacggagccgagggaggauccagacagacgcucccagaaccagguucugcagcaccagugagaagucagcagagguguggggaggggacugcgcuggggcugaggucccagggcugggacacaggugggccucacugcagcagggccagagaccaggcuggggcgguccccacugggccaucguggggcuucugggcuccauccugagggucacacagagccucggaggcauucugucaauuuggaagguggccuggcugcagaguggagcacgguccggggcaggcugagccgggcgcuggccguggacugggcagaggugcuggucugcgagguggggugugauaugugggcccacgauucagguuguagggauacagcgcugccugggccccuccccagccccacaucuagucugcugggcucugggcugaaccacaggguggggccugaugcaacacagucagggccgcccuccguccccgcuagcccuucucuuugcugcucugggggcuuugucuuccuggggaaccagagauagguaagaauguuccuggcacagccagguggccccacccuuccugcugugucuggcagaagugcccaggaugacuucucuguccuggcugugcacggccacacgcccgggcagcgugugccagccacagggacugcugaggagcccucuugcucuugcuacgguccccagccguggcaagcagcuccgucgccgcgacacccuucuucucuccucuuucuuucuggcacgucuguaaacuuugcuuguaacucaagccaaguacccaauuagggauuucuucacaguugcauuuaaaccugauugaagugggagcucuucagugccugacacauccaacaggcgcuuccccugagccccggccaggcggugcugagggcggagaggggcggcgcugcugggagcucuggcugucuggaggggaggugcgcccuucacccggggugggcacccagcccugucucggcccccauguccuuaucucuggucagggguguggccccucaugccccaggcugucaugaggcuccugugagcacagcgcacgugugcagggcuggguggucugcaugcuaggugggcagccgagcgggaggcccaugugcuggcagugcagggcggguggcuccaugccgcggcucccucgcuggaccccagcgccaagcccacacuguucuguccguguguguucugagcaucgccuggacgcucggcccuggggcacauggauggagggaacugggugccugguccagggaggguaaccaaccucgagcugugggcauccuuguccuggaaaagcaggaggaaaacugcaguggggaguggaggacauuccugucacaagaugcugugaugacuggaggacacuggagaagccguguccucugccagccccagccucgguucucguuggcaugggagaugugccagggucgugccucguaggugaaugggggugcccuggucucgcuucucgcuggcucgggagaugcgccagggucgugccugguaggcaaaugggggugcccgggcuguucaugcaguggaguuccugggagcccagccuggcccccaccgugggaucgggacuacugucauuucuacucaugagggaggggagcugcagggaggcaacaagacacccgcagcacagggcauggacacgaauucaucuccccgccagugaucaucccccaggccuggccugggcagcugcugacucccuugcagggccuggaggguaugcguaguccgaggggcuaagucgagucccuuccuugagggcucacugucugcugggcguguguccccgccucccccgccaugccucaugcucuggcgugugacuugcuccucucucuauaccgcccagcgugcuguccccgccucgugccaugacguguguuuugcuccucuuucuguacugcccagcgugcugccuagcacagacggaccacaauucacucauccaguccucagcugagggacgucugggugguuccacuuuuuggcugucaugagucaugcuguggacguuguggacguuuggguacaagucuuuguguggauacaguuuucguuccuccagacgggaggggaauuuccacauucuagggaggagaggagcugccuuacgguuuccgaggcggcuucacccguuugcaugucccacgugaggcuccaggggccccacacccucccgguguugguggcaucucucuuucugaccacagccccacuggugggugcggaguguguggggaugccugcacuuccucacaggugaggaugaugggcaccgacguggcuuguuagccucuccuaggucaucuucugcaaaauaccuacuuaaaucccugccauuuucgacuggauuguguucucaucauuuucucaaugcuuucuuuugauaagcaguuuuaaaucucgaugaaguauaacgaaucacuuuuuccugugguagugauggugguagugcuuugucccaagaauucccugcugaccccaguguugaaucgaccuuagacuaagccccuuaucccgcugguucuguucguggcgugaggggagguccacaucucacugucuccguguggacauugggucguuuuggccccgcuggcggaaaagacuuuucuuuccccguggaguugcuuucacuugcuuuuugaaaagcacucaacgcugaacauuucguccuggcugucuucugugccggcgacacauuugcuuguacccgcagcagucccacgcagccgaccaucgguccuuccuugacugugagacuuggaggcaggcagcgugcguccuccagcccgccguggaacaccgcuccacguacgucccgcgucggccuccuguggcguuccucgcugccccugaccguccucagcaccucugccugcgccguccccuggcccugcagcuuucugucccgggaagcgcguggcuuuuccccuaagucugccccaggucuccuucccagccaggugcugccaggacgccuuuucggaccgcagcccucccccucccaucuccccgucccucccggcugcgguucucuguagcacuuccgcuccaaggugcuacuguugcacuucguuuauuuuuuaucuguuucccuaguugaaaagcaacauccauuagggcaggggguucaucucuccauacacacuguguccucagggccugggguguuaccaggcgcccagcaccucuccacacauaccugcugggugaaugaauagcugagcagcgcuucugaggacccuggcaccaggguugcucccagugagaccccaguuccugcugcucuguggcccagcagggagggcucggcucuggaaaaccagaggcccacacuauccuuagaugccaccgcaugaggcuccuguugcugccaugacaaaccagcacugacugaguuacucaacacagcagggccggcgcggcacucaugccugucaucccaacgcuuugggaggcccagguacaggggauugccagaggcucgguuggagaccagccugggcagcauagcaagacccuauuuauaaaaauaauaauaauaauuagccgggugugguagcaccugccuguaaucccagcuacucuggaggcugaggcaggacaauggcuugggccugggaggucaaggccacagugagcugugaucgcaccccuguucgcuacccugggcaacauagugagaccucgucucaaaaaaacaaaccaaaaacucaacacgaugugaucucggguucuggaagucacacguuucccugggcuaaaggccaggggucaucagggccgguucguuucagaggcucuggggagaauccacauccggccuuuucuggcucccagaagcacccacgugccuuggcacacggccuuuccuccacccucagagccggagcgcacaucuucggaucucuagccgacuuuccugccucccuuucugacgugugaagacccgcgugauuguagcgggccaccaggauaaugcaggaacgcccguggucucaccaucccugccccggacacaucugcagagucccuucccacgugcgguccugggcccaggcauagccaccgcuugcugaugccugucuggucuccugccacccaucacagcgccaucuccuccuuccgacucccagguccugaggccuccaggccagcacuggccaggggagggggcugggaagagccagugagggcguguggcagaguggagaguaugucccccauuguggggucgggccugggaccuggacgcggugccugggcuugcaggagaggagagguggacaggcgugcuggggggggagaccugcccacgcugcccugggagcuugucuacccucuccccccccagcauggcguccagcaggacauggggcguucccuccagcguggccacccaggacuccaagcagggcccaggaggaacugugagggggcaugacugagucuguggcguuuccugcaggauucuucccauaggggugaagucuguauggcggaggcagccagggagccuccccuccacuccccacggaauccggacggccugcauugcagccccaguggcucugcuguguccccgaccagcugcuucccucucagccucagcuuuguccugggggagaggccacugggggcugcucucccuccccccauagcagcuguaaaucaugaaauccucauggugucagccgagggcucccccuccccgccacuucuagagccagagccccugcgaggucccagguugcugaccccacgccaacccccaggacgccagggccaucuccaggaccugggggagcaaggggccuggcugccgcuacagcucccagaagguaaagccuuuggccucagagagccucccccgacgguucccuucuccaggccgggcgugcacgcgcggauuccuccucaugcagagcccgucugcccugauggaucccccaccccacgccaccccaggccgcuuccuccggguggagugcuccucagcacucagggguccucccugcacccaccccgcccagaacccugcuccuugccccucuccuuccagagcccugugucuggcugcuccaauuacuggagcaguuccguguccucuucccgagucuccugcuaucugaagaguucauuacauaggaauccgaggccucgcugccuacauuagcagguuuucauagacugccacaucuccaaaaggggaaaagagacaggagauuuaaaacucucgucuugccgaaagcagacagauugacucgaaaaugacccagucaauaaaagaugagcucuggaaaggcuucccucuucucagagggggcucgccugccggggagcugagguucugcaagccucggugggaaauuaaucaugaacgcggcaugcaaagcggccggagcccacacagccccgcccccacgucucccaggaccucgccgccgccaccccaggccucucuccacggaccagcugcugggcauguuccuggagggaagcuuccggaaacagaugagguggccguguucuguggucacgucuugacucggcugugauaucgcuguggggcacugcucccucuggaguguuucuggcucugggaggugcgugcgcggugggcucccugccugcacaggggcccuggcugugggccugugaggcugggucugccuggagcuggugggaugagaggggagugcucugaggaccguucccccacuggugcagggauggggagcacagggucccgguggcucugaugcaucggcggcagggaccgcagcccugccugugccaggaggagccgugagaggaugggcaccccuugcccucugugggcuggcaucuccgugcagggccugcagucucugcaguggccacccauucuuaucucuccuggugcccacaccugccgccugccucaccucacccaaacaggaggagucaccucugaccccaacugcuuccuuuuaccagaguuucucagcucauguuccccaaaaggauagguuaaguuuuccuuuugagccacacaugcccccauuugcugucugucucucagauggccauccuucauccagucgacagggcuggccuugcgguuuccacugcugacacacacggagcuggcugguucuggggucuguacccgcacgcagggccccugccgccaucuggaccccugccaccccaguuucccccacuucaggauuuugggucagaaggaaacuaucccgacagcuauguguacuccugcagacuucuggguuuggccaugguucccgucagcccccagacccccgacaagugucugaggggauguggaacccagcccacucccaccacuucugcccugcagcugcauggagggcggguuggacaggugaggcccagccccugccuucaggcagcucacacagugagggaagcagcccugcaaagguggccgcagcuggaaaggcgugugugugccgcagagguucagacccaguccaggggagagggauaggaugcccaagaggggcuucaucuggaggugacgccggacuggagaggguugggaugcccaagaggggccucaucuggaggugacgccagacuggagacgguugggaugcccaagaggggccuguucuggaggugacgccggacuggagaggguugggaugcccaagaggggccucaucuggaggugacgccggagucuggccuugcagaaguucgcuggugaacaucguccccuggcagaaggcaaaugugcccgccacauuguggcagcagaaaugagcaccaugcguucugagugugccuggggugucugggaggacuguggacuuguagcggcagaggacagaacaccugggcugcacacgagugacugugcugggcaauggcgcuucccuuccgaagcugggcucugacucugcaagugacugcgccgggggcagugcuccccuuccgaagcugggcucugcgucaaaagaaagaccccuggggccugaggaggagggagaggagggugacaggaaguagaauuuggacucuaguaaagaaagaccccgagcagagguggugccagggaggguuggugaggacagagcguugaaaccugguguccagcggguguugagugcugaauccaggaaggccgaaggcaacucaaguugucuggcucaaggggugcgggggauggagggagaggcggccgcccaggagcgggaacugugggaguagcacuuagacaugaggcacgccugcaguuaugaauccucacggcuaaucagggcugugggcacaggcagcugaggccacuugaaaggacugaugcgcccagaccaggccccgccagggccuccggucacgggaugggugcaggguugggggucaggagagagacacuguggccccacaucgccaugcuggagcccaugucccgccugacuggcgucacagggagcccucucccugcuuucucaucgucgguuuccccauccagaagguggggacaaacguagccaugcuccccagggcggggcccggcugggaugggugcagcgaggcugcguguuccugccccggacaggcaccuacucaaagcccgagcaggcucucaccugacgaacguguuccagguggaagagaggccaggacacgggcaaacacgcgaucucagaugcucgugagcucuagggagaaagcaaauguggggugcccagaagaccacugguggggguggcccagggaggcuuuucugaacugaagccugaaugaccaauggagacagcugcucagcccccagggcagugcccagcgugggcuccagcuuuggcuccgcggcggguguucaagggguccccucaacagugcuggcaucgcagagguggcccugugcugacgcgucggacggcugcugcgaccagcccucccuguaguccuguugcuggccagagaccguggagcuggauucuggccuccugcaggcaucuuucuguccauucagcaggugccacguccccccacauaugcaggguguccggaggaucacugacacgggggccaaugucccuccuuccgccaagguuccgcugggccucugcugccgaaggaccccaugggggcuguggagccuggugccgggggagggggcugucccuugggguucagcugcuguguucucggugcugggggaggauucuucuccaaauaugauauccgcgcccgccugucaccccaggacucucccaccccguaaucugguggcuguaauugcuggugucuuuucauaucaguuuugugcaaggugacaagcugcuugcuggaguaagucguuaaucacacaagaggugcccuguuugaaagcugcacagagcucacccagccagcgccugccagguggugggccagggagcggcuccuccguguguaauuccagggcgagugucuucucacuggagcagagugugcaguuucugcccagcaggggaacucauggcucaucauggaggccgugucucaagggccgucugguaccagcagaguugaagcgaccaucuucuuggggcagcagcaggcccuggcuggcaggugguggcgucccauccuccuguugccaaagccaguuccuggggaccaugaugccugccagccccucgggcuggucuccgggaauuuggauuuggggccggcagccccugggaugagccagguggggcgcuguggggcaugcugggguacgguucucacgggugacaucccggggggucccggccagccuacaggugcguccccaccuccuacagucucuugcagagccagccaggacccggauacaaaucgcacagccauaaccacugcaaugccccaugcccauggcugcuaauaaaauugcaucaauauuugaugccuaauuauuaaauauuuaaaaauguaaaacugaaauaguuuagaagcuugcaaaacaugaauaauucagucccgggaagccuggcucggcauugggccugggcaggaccggggcugccagugccugccagggcccagaguacucucugcagggacacucgggcggcucccccagcccugggccuccacuggcuuccuguguccgcagcgugcaggggauccuuggucgucucucgucgaggucagaccucggccugauguggaggccucugcgucaccuacuaguacaccacgccggugucgggcuccuucagaggcuggucccgcugcuccgagucugggcacguucccuccugcccuguguucccacuggcacugagcaucugagagucaucucugacccaucagacccauccuagagggaagaucuggagaugccaaugcuggcagccucccagaaacaguccagcaggacccccuggggccgcugcucaugccaggcgcccagccgccgccagggagacaucuaacgagaggugggaaauagacacuugggggagccaggccguguggugggggucaugagagaaaugcaugcugggggaguuucauaauguugagaacagagacacggcucugcuacuuccggggagugagaaccagucacuuguagaagaccagaagucagaacggauucaggcuucuccacagcagugcugagcacuugagaccugagggcgaugccuucagcacugaaagagaggccgggugcggggcucacacccgucaucccaacacugugggaggcacacaugaggcccgcaggucaacaacagccugggcaacauagaaagacccuaaaaauauauauauuagcccagugugguggugugcucccuguggucccagcuacuugggaagcugaggugggaggauugcuugagccccggaguucgaggcuacagugagccacgaucgcgccacugcacuccagccugggugacagagugagacccugucucaaaaaacaaaacaaacacaacugaaggaggaguguauacagccuggaauucugcaucuggccaaauuacccaucagcucugauggugagguagagaugucuucagccaugcaggguuccagacauuguucccugucucacgucaucagggaccugcugaaggguaugaucgcgagaguugcggggcagcugcagcccugagccaggugguccccaguuccagcugcagcagccuggacagacuugcugggccugucaugcuggaaucccaaccuuugagcugggaaaggugcugugcccaggcugugcuacaucguugggaccgugugugggcaaacguacugucuggucacccaugucugcuaagagccuucaucucacccuugcaggguggcccuggccggacuccugagcucuggggucacgggccgcugucuccugagggggccgcacacugcaggggccagggcggucacccugucucuccggaccaugcucaggugaucuuuuggguguccuugcggcccagaccgcacugcccccucacuccacaccuggacucaggcccgccacucagaucccgcgccgagcacccgugauguccguagacagccaagugguuguugacgacacagggauguguuuuauuaagaggaacacguuauugccgagaggguuuucgccuccacugucucacugacccgggggcaggugauguuucccccacuccugccacacccagggaggaaagggggcuuagagagaugaggugacuuguccgugaacgcacaggcaguguauggagccuggaaucacucccuuccuccuggccccguggcggcgucaucaguggggccgggccuacgccgaguaggauuguccuccuggcuuggccugggccucaggggcugccuuguuuaauggugaaauauuagucccuuuuuguggguuuuuuaaagccugaaaaucccaacauugguuaacuguauuugauucauuguuuagaaagaaaaauggcugugccgugagucccugaaggaaaaguuccgaagcugccuccagucccuaaaucgagaguugcugcagagucuggggcuugggguccucgguggcagcugugcagggcccagacccaggccagcuccucacuggggcaccgguccaggucgggcaggagcugggggaccgugggacaggggcaaggcgguggcaguggggagauaguggggaugggggcguggcaagggcugagcagcugggagcugcucugaggccaugggugcccucaccgccccucgcaggcugaagccccuggaggccccuggcucucacagugacccuguuagccacagcagggaugggguugggggcuugggggcggggcaguggcauggccucucuucggccugccuugauuuuaagggcuuuucaucugaggccaugggaaggcuguauguucagggaugaacacggguguucagggacagacgcacacguguucggggauaaacggacguucagcaguaggcgugugugucccguccgcugugugugugcuugcuugugguuaagcugacuguguagcuugcgcaggggcaggagcucaggucuguaggggaugguggcuucgcucaccugcguguucaacacgcacccgucgcgcacuuccauguuccggguucucaggugcagggcaggugugacagugcgcacaggccuggcccagcccaccugagcucagggugcgccgcagggaaacagcaugaggcccaguugcacugcagggaaagagcgugaggcccaggcaucucaaacagcucuguggacgccacaaucugugcccugcaggaaaagagcaugcggagaacaggagccagagacuggagcgauggagaagcagggugcaggagaggcagcuggaaagggaggguggcucagggcccuggggcggggcugggaccaggucaggcuagggccagaugcagcugcaguggcagccaggccggggcacccagcagggcaugaauaucccaggagagagcccugccucagcucaagucuugcugugggagcauggagaucugucugcauggccgggguuauccuggacgggguagcaggagcgguguuggcauacacaaccgaggccagccugggaagaggcugcuugggguucggggacccuacagaagcaccagggcuggcgucucuuccuccuguggggucuucccacgugggccagcugccucagcugugcaggggcuggucuccucagggcagugcugccuggugccugcgggugcuugguaaacagcuaggccccggcucuuuuuuuuuuuuuuuuuuuuuuugagauggagucuuacugugucacccagcguggagugcaguggcgcaaucucggcucacugcagccucugcuuacugggcucaagcaauucuccugccucagccucccgaguagcugggauuacagaugugcgccaccacguccggcuaauuuuuguauuuuugguagagacaggguuucaccauguuggccaggauggucuugaacuccugaccucagauaaucugccugcuuuggccucccagagugcugggauuacaggugugagccacugugcccagccccagguuccucuuaaaaucaucccaggacacagaugggggucaggccggccucacucacgggagaggucccagagggaggucacagagcccaggcccacagagcuauuccaagcaccuggaacagugcuucaccaaucaugaauuccacaagagcaucuuccauaggcuacugcguccucgcugccuggaacagugcuucaucaaucaugaguuccacaagagcgucuuccauaggccacuguguccucgcugccuggaacagugcuucaucaaucaugaguuccgcaagagcgucuuccauaggccacugcgugcuugcugccuggaacagugcuucaucaaucaugaguuccacaagagcgucuuccguaggccacugcauccucgcugccuggaacagugcuuuaucaaucaugaguuccacaagaacgucuuccauaggccacugcauccuugcugccuggaacagugcuuuaucaaucaugaguuccgcaagagcgucuuccguaggccacugcguccucgcugccuggaacagugcuucaucaaucaugaauuccgcaagagcgucuuccguaggccacugcguccucacugccuggaacagugcuucaucaaucaugaauuccgcgagagcgucuuccguaggccacugcguccucgcugccuggaacagugcuucaucaaucaugaguuccacaagaacgucuuccauaggccacugcauccuugcugccuggaacagugcuuuaucaaucaugaguuccucaagagcgucuuccguaggccacuguguccuugcugccuggaauagugcuucaucaaucaugaguuccacaagaacgucuuccauaggcgacugcauccuugcugccuggaacagugcuucaucaaucaugaguucugcaagagcgucuuccauaggccacugcguccucgcuugccuggaacagugcuugaucaaucaugaguuccgcaggagcgucuucaauaggccacugcgugcuugcugccuggaacagugauugaucaaucaugaguuccgcaagagcgucuuccauaggccacugcguccucgcugccuggaacagugcuucauuaaucaugaauuccgcaagagcgucuuccauaggccacugcauccucgcugccuggaacaaugcuucauuaaucaugaauucugcaagagcgucuuccguaggccacugcguccucgcugccuggaacagugcuugaucaaucaugaguuccgcaagagcaucuuccauaggccacugcguccucgcugccuggaacagugcuugaucaauuaugaguuccgcaagagcaucuuucauaggccacuguguccucacugccuggaacagugcuucaucaaucaugaauucugcaagagcgucuuccauaggccacugcauccuugcugccuggagcagugcuucaucaaucaugaguuccgcaagagcgucuuccauaggccacugcguccucacugccuggaacagugcuucaucaaucaugaguuccgcaagagcuucuucaauaggccacugcgugcucgcugccuggaacagugcuucauuaaucaugaauucugcaagagcgucuuccauaggccacugcguccucgcugccuggaacagugcuugaucaaucuugaguuccgcaagagcgucuucaguaggccacugcauccucgcugccuggaacagugcuucaucaaucaugaguuccacaagaacgucuuccauaggccacugcguccucgcugccuggaacagugcuucaucaaucaugaguuccgcaagagugucuuccguaggccacugcguccucgcugccuggaacagugcuugaucaaucaugaguuccgcaagagcaucuuccauaggccacugcguccucgcugccuggaacagugcuugaucaauuaugaguucugcaagagcaucuuucauaggccacuguguccucacugccuggaacagugcuucaucaaucaugaauucugcaagagcgucuuccauaggccacugcauccuugcugccuggagcagugcuucaucaaucaugaguuccgcaagagcgucuuccauaggccacugcguccucacugccuggaacagugcuucaucaaucaugaguucugcaagagcuucuucaauaggccacugcgugcucgcugccuggaacagugcuucaucaaucaugaauucugcaagagcgucuuccauaggccacugcguccucgcugccuggaacagugcuugaucaaucuugaguuccgcaagagcgucuucaguagcccacugcauccucgcugccuggaacagugcuucaucaaucaugaguuccgcaagaacgucuuccauaggccacuguguccucgcugccuggaacagugcuucaucaaucaugaguuccgcaagagugucuuccguaggccacugcguccucgcugccuggaacagugcuucaucaaucaugaauuccgcaagagugucuuccguaggccacugcguccucacugccuggaacagugcuucaucaaucaugaguuccgcaggagcgucuucaauaggccaccgugugcuugcugccuggaacagugcuggaucaaucaugaguuccgcaagagcgucuuccauaggccacugcguccucgcugccuggaacagugcuucauuaaucaugaauuccacaagagugucuuccauaggccacugcauucucgcugccuggaacagugcuucaucaaucaugaguuccgcaagagcgucuucuguaggccacuggguccucgcuugccuggaacagugcuucaucaaucaugaguuccacaagaacgucuuccauaggccacugcauccucgcugccuggaacagugcuucaucaaucaugaguuccgcaagagcgucuuccauaggccacugcauccuugcugccuggaacagugcuucaucaaucaugaguuccgcaagaucgucuuccguaggccacugcguccuugcuuucuggaacggugccugcugcuggguccuccuucccacugcaggacguacagcgaggcuggagccugagacgguucccugcacccugaggcucacguagcccggccgaccugguucugcguggguauagcucaggccccggggaagggcggaaguggacaggcagugcccuggggcugcacuccuaagauccgucgguaccuuuaaaagguucucugcuugcucucaucugcgugugccccguaacacucgaaggaguaaagaggauguagagaaaaguaccgcguuuuccuuuucccuccuucugaaaggccugggccccggcaucucugucccuauccccgugggucacagcugugugcuggcucucccugcccugccaagguagaagcauuuucugcguuucaggcugugaacugggccucuugagauaagugcuguaaaugcuccuuuauccugacaucccggcccucaguacuguaaagccucucuuuccugcuagcuagccuuuaccuaauggagcacaauuuauuuuuauucuguccucuucacagcugccuccugugauuccaggaggaggcagguguggggcuaagguggugaggggguggcuguucaggcaccagugucguggaugccuucagcccccugguacaccccacugggccgggcccugggcagccgccgcugcauccucucugacucccacuugaacaccugcuguucuuccuccucucuugccccucaccgaggccuugagagcccaucaguaccaggccugugucccugcaucccugcaaggugguagcagguaccucuaagagggccgguucugcccaaagcaggggucccagggguguggaggaggggcccgaggagggccgguaucuaggcagaggggaguugcugcuuccuaggcaggugcuccuggucaguguggccagaguucaacauccccgggcagggaaggcaggagccagggcugugggugggcugggcucaaggccucccuacgguuuggcucuaagccugggguagcccuggaggucagcggagagggccuaaaagccuuggugaggccaccccagagagcagggcugcagagcugggcucccucccugagcaccccuggcccagcaggccuugagcacacagcgagccgggcugggcaggggaugggagcgcugaaggcugcaccacugucucgccucagcccaugcacugcuguugcaggucgggccugagaacagccugggcagugccuauguggucccagggcuggggucgggcacagggcugucgccucucacccugggggucucugccacuggcuucuggggucucugagaggagccugcccaggauccaggcccauagaacccaguccagaggaaccccgggcucuuggcucacuugggaggagaccacgugagagcaaccgacaagaaagcaaugacauuuccaaggcggaaaacccaucuuuuauuuauuuaauccaaaccaucgugugaauuauucauucacguugauguaagccacugaacuacagggauaaaggggggucagaacgcuggcuugaucugccccaaacugaaccgacuccgucgaggcagccuugucuggaggauggacccuucccuacguggacaggagaccaggaucagggcccccucaccuccgagggucuguguggcauggaggauggacccuuccccuccagggcccuggguuugucugucagagggugagagaguggccccaggagugagugcggcggcccaugcugcucccagccgcaugggugguggucucgccucugagagggggccccacacacugccuuccucgcccugggaccucauaccaaccugcuaugggugggcaaacacagccuggagccccggaacuuccagaggucugugagcggcacaggcagcuuugaagucuaucggaaaacagggcuguuuccuucuccaaggucaggcuugcauuuauuaccaaaaucuaauucuuccccuuuggacgccugagaucuaucaaaggcagcacgggccauguuagggugaaauauggccucugaaauguggucucugcguucuuccuugugcacguggcaauuccugcuaccgauagccccaucuucgggaggaucagccgagggacgcagggaagagucuuggggucagagcugccaauuagccuucagauuucacagccugauugcucgauucaucaagggccccagccucguccugcuggaggggcugggccguggaauaacagugucccccagggccgucuuugccagcaacggagggaggaggccagguuggggcgagggcugaaucagugccaaugcugccaucccacagguggaugggcgccagggccccucugcugacaggccugcgguuguacaggccccauauccucccagccccugacaucuggaugcugcuaacguggucccugcaccgcugcuccuuccagaacccauggcaggcagcgcccuugcuuuugcagcuaagcagcgagucucugugagccugggugucauuguguguggauuggggaucggaucguguucauagcugucauagccaggcagugagugagcuugcacucggaacgggcugcucgacugagcucacgccaucgggggugcccagcggcccugcgcucucggcgguggccuccggcacgugaucuggccuaacaccucugaaggcagcugccugccuguguccguguugcaggcagaaguccugggagauggggugaagggguagguucagagucacaggucagggaggcagagccgagcugaaaccgcggccccucccgcguccuccaucuuccucugcagacuugagggcuucugguuugcaccuggcuccccugucccugcucaccuccaggaagcaaccuggacugcaucguccaccuuaaacuggcccaucagagccucuucgggccgcugugcacaaacuccccggcagccccucucucacucacugugaccuggccagcaggcacucacacugcaccuuuccucacacuccccuagaguggacugugggggaccccacacccuuucuggggccuucagacucaucucuaacucaggaccagccuccccccgggcgcugccuggaguuggaacccuuguucucuccaaccauauggccaugguugacuuuaacauccucuuucucagccuagccagggagcugaccaucccgugccugguugugggcgccuacagcaguccugugauucagucccucgucauaguggagggaggcuagcagcuggcccagcucccguggccugcaggauaggguccagcaggcucccguccccgccuggagcagucccaggccccuggagggcuccccauugccagcuccagacagcacugcugggaagcacccggccuaggggacggcucugugugcgucuaaguggagccaguccugauaauuaacgcggggauaaaucgagguuuaacuacuuggaaggccucucgggugagaaauucaugauaaucgcuguuauccuccugauggcucugcagagcaguuccuccccaagcagccguaaacucugacgggcaggguguggggcuguacccugaauagucacuuagagccaugucaggggcagugggccugggggugccggcugucgucucacgauggccugaccucagagguggcuggcagguaaagccccggggcaguaggauccggaacgucccgguggccuccugccugccucccuguuugucggugcuggcuccugugggguaggcguccagccucagaaaggacccaggcggcaaccugggaauggauggucaggaucacuggguggcguggcagcccaggccuucgcuuugggacccacauccucagcaccggcuccucacgcgguucucgccuaaauccccggaguguuggggcaagcgaaccccgagucacgccugacccuguggcuuccugacccuguggcuuccuggcagugacugugcuggcuccagggguugucauucugcaggccgagggcugaucccuguggaggggcccuggcugcuuguagucuggcucucagaguuaccguucuuaaugcaguaacuuuauuauugccaccaccagagggucagccguuaucagcucaccccucacucccguucccucaugcaugccgauggaggcuggcuggugugacacgggggcuugcugugucccugggcagccgccacucccaccuguacucggcuuccucccugcccuggccgcucccggguccccaccccuccggccuggugccgcacucacugucuccuuccgucccucccgcagagcugaagaagcagguggagagugccgagcugaagaaccagcggcucaaggagguuuuccagaccaagauccaggaguuccgcaaggccugcuacacgcucaccggcuaccagaucgacaucaccacggagaaccaguaccggcugaccucgcuguacgccgagcacccaggcgacugccucaucuucaagguggguccugcgugugacggcucuccggcugucucgcucucugucuccuccuguggggagauccgaccguagcccucagcaaaggagcagccucgcguccaaaggggaugguguggagggcugggcgggaaggaggugcacuggcccguccucgucacccccugaggcuucucagccuugggccaacccuauguggcuuugcagcccuggaccuccugggugcagaagacccuaggcugucccccugacuuucucagccucugucugucgcaacuugggcuucguuccaugagggcugcggccguaggcgugugugucaguguguccagaggcaguggugccuggggaggacugaaguccguguggggccggggcaggggacgccuuccaagaugccaggcugcgcagugggacagcgcagucccagaagccagcacagggcaagguagacagacuagaagaggaaaggagagccagccgcaucucuacacucgcguccugcgagccagcaggcgcucuucugguuugcuggugaagccagacuggguccaccguuguggacaugaagaguccucgggcgagcgggguccaacagcagaaauugggguguuauguguugacccucaggguggagguggccccacuuggaccuccagcagcuggagacccagggcaacaggggcuuguucaucacugccccggugagcuaaccuccgguuugugaggauggugccgucggccugguguggcauuguggccccggcaugaccucguggccccgucuuggcauguggcugcuucaggaaggguggagggggcgguggcugugggagaugaggacaggcagagacgggccccaccugggacugcuguggucuggaacgggcgucuaaacugccugcagucugcagccucugcgugucuuuauggaaccgagaaccaacuuugauuuguauaaaagcuguacccagugcggccuacgcauguccgucagcgucucacagcggugagccgcugccugucugauucagccuuagcccggcucuuccuccuccuucugcacaacccgcccgucuucacagccugcgcugcacgggggcaccgugccgggcuugcucugcguuccuuguggauuuccugcuucucagaucacagucauccauuucuacacucuugaaacucucaaaccuuugaauaauaaaaacacaccaagucuuuaagcuaucagaaauguacuucuucgcuuuuguauaauucuguauacuuugaauaauucacagagguguuuaaugcauuauacgaauuccauagguuucuaaaaugauuagguauuaauaaagguguaccaugaacaguuaucacuuaacauaucacucguuacaucaacauuuacaaauuaagaggcagcguuuuccccggaucccugcgugugcuguaguugaagcgaaucuuaggaagacuaacugcagcggaaccuuggggcacccuccacaguguuuucuguugagagugucgaaaauccaaaagagggaagcaagccacucgucaucuucccgcgaaagguggccgcuguccugcuucgccguguuuccuuucgguguuucauacguaggcacaugccuaggcauguucauuuacaccugggaacucgggauccugggguuccauugugugugcuccugugucacuuuuuaaaaacaccgucagcaaguagcaucuugaccacuguaagcccugcaugggcuucugaagcgcagcccugcccaauguccucagguuugcuggacaccagguccauccccgucauacccucgagcaugggcccugccgcucuuccugcucgagccagcaucucagcucccccggcccucauccgcccgcccaggaucccagccauggcaggauguugagaccagaaggcuugggcuggccucagcuugccaguggccggacuuucagcccccauggccugggcaggaaccccugcccuccuuuccgccuuggagcccucucagcccccaggcuccugaggucagggagaggcaggaagggggccccaggaggaggaggcaggcggacagagagcccaggagcuggccagcuccccagcccugcucgccccaggccuaaaggacacacagcguacgggaggccgggcucgcccugaggagccgugguuccugcaggggucuggccugggccccgcagcucuugccaggcauccugcccgccuuccuagacucuugugaucuggagccuuggcgccuccccaggccgcccccucacugcccauccuccagcccuugcugucccuucuuuccaguggcaggccuggccugaccugaccuucuggaccacggccuguccuggcccaaggcccgugugaaugugacuuugcagguccugagggcuggaugugcugggucagaagccauggagcugaggcagccgccuccggaaggacagacgguccacuggcccagugcuccaccagcaaggccuggugcccgcagaggccccgcuccccacccuuccggccacccaccaugccugcucugggccguguuccgggggcuggcucagguggacagugucagggaacgagguugcuuuuagcuuacccacuuuccccaugugugacaugcacuguguuuucaugcuugaagcucacaggaucagggagauuaaguaaaguauggaagggcuuuacaaguugauguuugcaggcggggcugagagcugcggggugggccuggcauggggagcucugggcaacccaggcagggggcugacucuaggugagcuugugggcuggugcccaagugcagcuguugccaggggggugcuggcugggccucugccucaucuguaaagcagguacaguuacgucugacccacaggaguaaguggggccauguuccuggcacauccaucaugguugccaagaccccaccuugguccaucgguuucauuucugagcagugaaguccccgcaggaagaagcugccaacuugugucugcgguuuucccuggaaccccagcaucaaggcccaccugcuccauccucuucaccugggcccagcucgcuuguagacaccuucuccaggaagcccuccuggguuccccagaugugggacccuucuuccgcuggcuucccuccuaggacacgugccaccuuguguuuuuccugacaggcgagucugccggagguuuuauccuguuggguucguugucccuugaggguccccagggggccuaagugugccccuccuguguuucucccccacugcugggugccugguucuuaaagaugcuucuugcuccauuucucccuaggcuucuuuucacagccucuuucccccagccucacccaacccccacccucuacuccugcucuuccuccucccucucccacuccuccuccagacucuguccugcccagcugaugugcccugcuagcagcugugccuagcaccccgcucgcccccuccccucuuuggagggcuggggccucccagaccuuccugcgccccaucugguugauguggagggaucgccugcuggauaugggccuuuagagcauguucaugagggcugacacugggcaugcagccucaccuccccaaguuucagucuccucaccuguggaguagaaguaacuguggcucacuucggaggcugcaagaggcaagucucauaagugccaccuguggagcuggggaggggucauguugcaccgggaucccuguuggcugguucagcuccagcccacggugcacccgugcuucucccagagcugugacuagcucugccggcccuguguguccuggucccugcagaccuucuggagggccugcaacauuuagggagcuuucaaaggcucccuguaagccgacucuucccaaguccuccuccgagcugcccuucacugggugaggccguuggccuccugagaaauccucccccuuggguuccaagaagacagcgcuagagcugccaagucuucuggcaggagcucugaccaggagaucagcaucaguccugccccauccaccugucauuccugccuccuuuguauccaggacaccaagcuuggugacaggagaggcacuuguacuguucgcagcagcuccacgcccccagcucagggccuggcuuauggagagggcagucuagggcucugccagacagacagaaaaacagguuucaguggagcaaaagggaagagacaaacagugaacagacaacagccaaccuguagggccagggcucauguuggcaccucugccugcagauggucacugacuccuuggggccaugcagcgguggcccuggucuccacuguccagaggagagauaagagacacuguggagucaccuugucccgggcagcuccugacccuggugugcagccuuggccaggccacugcacuccugugagacucaguuuccccaucugucaugaggaauguggucugggugcucccugggggcccugacccuggccuccuggcuucagaaaggcauccucagggggcugagcaucacuaggugugcccaggagggucuucccugagcuacccuccugagauagggccacggagggcagaggccagugugggagggcagggagagcagggagacaggcccccugccccacccacuccaccugggggcuggcauacguggcucccgugcuccugaaagaucucgccaaaccccagccuccuggccaugucauuuauuuuaucagauuuucccccaaaugauucuucaggcagaaagggggcugcagacagaguuagaaauagccgaagccguuuccagucaagcggguuccacagaugugugcugggauaauugaggguuugccgcacagucccccgccacucugcuucccaucccagccaggacuucccaucccagccaggacuucccaucccagccgggaccaaaccucuuguugccgcguggguggagggagcuggcugccugggcugccguuugggggaaaggcaggcaaaucucagcuccagcucuucccagcgggaaccugcugccucugcuccucucccuccugagaggggauagagauuccagagucccuagagcuuccugggaaggccauacucugccugggccuggagcggggaggcucagcuccuggucucuccaucccggcugcacuccucccagugguucucacggaauuuuccccaccucccuuuuccccucuucucaaaacccagggaaggaagccuucuguuacgagagggagaaaaucagugguaagaagaaguggagugaccaggccggggacacagagcaaaugcaguuuggggcaaaaccgugagcuucugggaucugggagacacacugguuccagcaggcuccucauuccuugcuguccagggccuuccccggcucagaggccugcagggugggcgucagggccagaggcguggacggcacagauuccggaacugcacaaacauguggcgaugucgaccuaccggguuugucauauggaugagggggaaagguauacagguccagccuccccgauucgaaaaccugaagucgggaauguuccaaaauccacagcuuuuuuuauugugggucugucacucaaaggaaaugcuuaauggagcguuuccgauaccagauuuucagauuagggaugaauauuugcaugagaugcuuacucaaccaguaagcacguaauacagauauucugacaaccugaaaaucuggaaaucccagacacuuggucccaagcguuuccaauaagggauacucagcacucaccuguguguauauguguaagucuaguacggucucgcuuugccagaugacagggaugcaugcugaggaacgugcuggugggcaguguugucuuugcgggaacuuccuagaaugacuuguacgagccugggccgugcagccucccgcacccuugggccgcaugguuuagccggcugcugccaagcugcaaaagugugcagugcgugacugugcugaaugcaguagaccaccguggcgcagugcuaagcaucugcgugucuguacguguuuaaauauggaaaaggugccauaaacaugauguaugaaggguggaagacggugcaccugcguagggugcucaccgugaacggagcucgcagggcuggcgggugcucugggcgagcuggugaaugagggugagugagugugaaggccuaggacaugagugugcacaacuggagacuauaaaugccguaccacuuaggcuacacucaacuauuaaaaauacuguucuuuucuucaauaauaaaugaauggcugggcacaguggccugugccuauaauccuaacauuuggggaggcugaaguggggggaucgcuugagcccaggaguucaaaaccagccuuggcaacauagcaagacccugugucuacaaaauauuuaaaacuuagccaggcgugguggcgccugcuuaucgucccagcuacuccagaggcugaggcgggagaauuacuugagccccaggaguuagaggcugcggugaaaacuaugaucgcgccaccgcacucuagccugggugacagagugagaucccaucucuaauaauaauaagaauaaaguuuguuguaacuuuuugaguuuauaaacuuuuuaauuuuauuuauuuauuugagacagagucuuguucugucaccaggcuggagugcaguggcgcgauuucggcucacugcaaccucugccucccugguucaagcgauucuccucccucagccuccugaguaccuggcauuacaggggugcgccaccacacccagcuaauuuuuuuguacuuuuaguagagacgggguuucaccauguuggccaggauggucucaaucuccugaccuggugauccucccuccucggccuccuaaagugcugggauuacaggcgugagccaccgcacccagccuauuaaaauuuguuuuguauaacacuuagcuuaaagcacaagcacauccuacagcuauagaaaaauguuuuuguauagcagccuuccugggaagaagaaauagccccgcaccccucguccuugugcuggcccggggugucgcuucugugcacccuuuuuuccccucugcccauccuugcugccccugccggaccucagcaggggaaggggagguggcgcagagcccgcuuucuggcgucugucugaucccgccgaggucccgcacagagcccgcugcuggcgucugucugaucuugcuggggucccgcauucucacuguugcauggacuguggaaaucccagacaggaaggcugugcaccuccccaggaaaaaugagaacaugggcgucagacaggguccagacuccucuaccacagcagguuggcccugggaaaugacuucuggccucagcuccccaaggacaaaguggggcccgugagcaccccuucucaggugcugagcgauggagagcugauaaaacagcacagguggccuugguuucggggcucccuccuccucuccccgacauaccuguaguggccggcacagccugggccuccguggaaacuggcaggaugggcuugccuggugucuuugccuguuauguugcuauaaaggaauaucugagacugggugguuucuagagaaaaaggaguguauuuggcucacaauucugguggcugcuaaguucaaaagugggcacgugugcaccuggugagggucucaggcugcguccacucauggcgggagaugaagaggaaccgcccacuugggcagagaucacauggcaggaggccaaagggguggggugccaggcuccuucuaacaaccagcucucauggaaacagagagagaccucacuaauucccucaaaggcaguaccaggcugugggugaggccugugaccccaugacgcagacaccuccuccccauaggccacacuuccaacauuggggaucccauuucaauaugagacuugucagggacguaccaacaguacccacaccagaacacgugguccuggggugagacccucccggggauccgagcccaccauacccacaccagacagagcgugugguccaggagugagacccucccacggauacaugccccucccaggagaugauuccccauucuugccauagagaggggccaggaaggcccagguccugugugucuugagaguggaggcagcuccaccucccagcugccuucacagcccugugggugggcagccuucagggcaccaccagccuggggcccagagcccagcuguugcuguggccccugacgagcuguggcagcaggccccccagcucugagcuuuggagucucauggguggcugggccucugccuggguggggugaggggaaggaauuagcugggucuggagccaccaugcuugcuuagaaggugaggaagggccaagccacaaacauggcaggcucagcugacagcagcauccggccugcagaggggacguggcccagguccugcaugagucagcccaggggaaagaagcguguaacuccaagagccuggcugggugagccuacggaggccgcauggcugagccuguugccuccgugaagcaucucucugcguugcagggaacauaggagauggugcaggggcagcuccacuuggggagagcauuuucagaaccaccggugcaggccuggccccgacaagccucaggaugugcagcugggcugcuguggagccccugggcugggccuggccuaggguccagagcugcugggguccuccugagggacccuagcaguacagaggccagggaaauggcaagagugcccgugaggaugccaccuuuucugggcacaccagccacgccaucccccagccuccucagcaucugaggccuugcccgaguguuugcugaauggagguggucuuuggcggugucacugcuagucagcccccgucggguggugggagggacuggacccgggccagaacugccuugguguggaugucgcuugccucugccagccccgggaccuggacacauggcuucaccuccucaagccuugucuuccuuuaugugggccaggaucaucgcaucugcccaagggucguggugacagugaccuuggccaguauguaugcaagugccaggcacguuggggaccccguaugccugccacauugcgcugaguggaucccugccacugucugccgacaucaggccacgaggaucugcaggucagugagugcaucauggaagcuuucauggcucaucagugagaacugcagggugauugcgggaggagcaggucgaccucucguguccuaggcccugcccucgcacuggcaucaugcacgcucccacugacacauggacacaaauacaugcccacgcaugcacagccacccacaugcaugcaugcugacacacacaugaaaccacacacacacaugcaugcucacacaugcccacccaugcacagccacccacaugcacgggcagccacacacgacacacacgcauggacacaugcacagacagccacauacacacaugcgcgcacacacaggcauccacaugcacgcaugcaugcucacacaugcauaggcagccacaugcacgcaugcaugcucacauguacagccacaugcaugcaugcucacacacacgcacaggcaaccacacacgcaugcacacacacgaacaggcagccacauacaugcaugcacacaugaacaggcagccacauacaugcgugcacacacauguacaggcagccacaugcaugcucacaugcacaggcagccacacgcaugcacacacacgcauaggcagccacauacacgcaugcaugcacacacaugcacaggcagccgcacgcaugcacacacacacauaggcagucacauagacgcaugcaugcacacacaugcacaggcagcugcacccaugcauacagaugcauaggcagccacauacaugcaugcaugcacacacaugcacaggcagccacauacaugcaugcacacacgcacaggcagcugcacacaugcacacacaugcacaggcagccacaugcacacaaugcucacacacaggcacaggcagccccaugaacaugcaugcucaugcaugcacagccacccacacggaugaaggcucacacacacaugcucagucucacgcaugcacacacacguacaggcagccauauacacacaugcaugcacacacacaugcauaggcagccacauacacaugugcauacacacacgugcacaggcagccgcagccaugcaugcacacacaugcacaggcagccacacacacgcaugcuugcacacacacgugcacacacacacgcacaggacgccacauacaugcacacaugcacacacacacaggcagccacauacaugcacacaugcacacacacaggcagccacaugcacacauggacacaugcacaggaagccacauacaugcauguaugcacacacaugccuaugcaugcacagccacccacaugcauucaugcucacacacacaugcacaggcacccacaugcaugcaugcacacacaugcccaugcacaggcagccacauacacgcaugcauggucacacacacaggcagccacauacacgcaugcuugcacacaugcacaggcagccacaugcagacacacacgcacaggcagccacauacaugcacacaugcacccacacgggcagccacaugcaugcacaugugcacgcacacacagaggcagccacaugcacgcaugcacacacacacaugcacaggcagccacauacaugcauguacacgcaugcacagccacccacacacaugcaugcucacacguacacaggcagccacgcaugcgcaugcaugcacacacaugcccacacacaggcagccacauacacacaugcaugcacacaugcccacacaugcacagccacccccacauacacaugcucacacacacaugcucacaguuggccucugucucucccaggcgucccauguggcaccugcuucugugaucuggauccagaggaggcagggaaagcaagucaggcagcaugggcccagccggagccccccuagccugagugaguguuucaagggcugugaaggcccaugguaugcaaagcgccauguuagaaaaagagauguggagucuucuuccuguucucccugccgcugccaugcggucacugacagcccugaagccuucucaccaggaaccugcggggcaggacugugugagagaagcagcuugcggcaccaccuucuggaguccggcugcacaccccaacuguccccagggagcugcuggccugggccaggaagggugcagggcuagggccacagaccugugcucacuccucaccugcugccccagcccugcagcaggucucugccugucugcacacagugccaugugccuggccacagcuggcaccagcagagcagggccugcccagggucacccagaucacaggcccaggcucaggccuuccuuccugccaggcuggcccaggguccugcugaccccugcuguccuggaaguguugagagcagagaaccugcacacgcccacacgccuguuugcagacacaguguggugugcgagccccaggugggcccucucccgcccgugccaccgugcucucccacucagccgcccauucuugucaccgagcccaugcagaggugucgacucaugaaucgaggaccugcugucuagcuggggcguguugacacaggcugagauuugcacaggauuuaucacucucagaugaagcauccgcuuugcugccaacggguguagacaugaccuugguagcugcccuguucuuuccuucugaagcaggcuugugaauaagugggcauaucugccagcccaccaucucccgugcacugaucuugcacagaucaggacucaggacuccaggcucuuggagggguacuuacccccagaggacaagccccuuagacagugacuagcccugugccauuccaggcccagagcuugccgccaggugcccagaagugaaccuggcccucacagugcugcugggcugacgagaagguaaacaugcccacgggucucugcagguugcugggaugaggcugcccugauacgcggacgagggcuggugagggcccagguggggcggucgugggguggaggcaguaggaccugguggaggagaggaggcagagcugcugcugggggcauagaaugggaagccaggcguguggcccccagggcuggggccagagaugccgggcaggggucccugcuggggugucugccugcccugcuccauuuuccucauuccuuuccugaggagugggcccacccggccuaggggccaggcuggagggagagagacaggacuggaagggccgagacagggagaggcucugggcgccgggcugccgagcccucggggaucugccucugcuccacggggcagcagucagagccacggggccaggugagugggcaccuugggguugucauggcaacagcucuuagccagagguggacggaacugggggguugaaggccggacauuugggagcccguacccugcagggccacucaggaagcaggagcuacagcggcccaccgugggacagcuccacgugucacacauucgccugaaaucugcccuuccgaccgcaccccuguggcccacacacacccgcagcccagcccccuggacuucucuccugucugagugcacuggccucugccuggugcucacugcugugaguuugagcuucaaagcccucguuaagcccucuccaucuuucucuaggcagagcugggacacaggguuuuuggggauagaccgagaacaaaggacccgcgagagggacgcuguggugugggcagagggcaugugagaggcagcccuucguggagcucugggcagggagugguuccugagaccaguuccuugaaaguagugucugugugugggggcguccaugcaggagcccggagccaucucugaggcuggagcagcgagguccuuucucuuccccuguccugcuaugacucuaccacagggccucugcuccuggguccccgccuuggguccaguggugaugacuaaguacuuagguuguuggagaagugugcucaccauucacauguauggguuuugaccaacacggguaacuucaugcacagugauccccgauucuaaagcugagaugaacuuugccuauucccggagggcgacgugaggggugcgcaccaccacacuguguccccagagcagcugccccaagcugcagaaugcccucugcccccuugccccacggccugccccgccugcgucugagggcgcuguggccucccugcuguggcucaggcugcccccagggcucugaccugugggacagcagacaggaggccugggcugggggccucagggcgcaggcgugguccgcuccacacagucuucccaugugggaccagggguucuccuccgcccacucagacaacuccccugcugcccagccccucucgggcugucucaccaggccacucucggucgucucuuagaccuggugacauuuuggaacagaaauaaaguucggcagugauugggcugagaggcaggaagaugcaaugggaguuugggcugagggaaggucagcaggacggccucagggccuccaugugguggggaaucccggcuaggccccugacccaacguugcuccucaagagcauugaggccuggaacucagccagaggcgcugaggcugcaggaguccagggcucaccucaggcuucccaagccagaggcaggggagcugguggcugcccggacaugugggucgguggcuaggggugcacugguggauggccagagauccauggguggguggccaggggcaugcucuugggcgcccaggugugaggguggguggccacgucucuucagccagggcagcugcgagcagggcugugccaccaaacaccgugcaugccucggcugcgucccuccuggccacuggcccugccccaaguggagacuggcccagccgccaacucuggcuugcggucccagugcugccuccuguuggccacaugcucucucgaaugagcugcucgcucuggcgugguugugaggauggagcggucagaugcuggggaguccccagcuggcucugcacugugcagcgcggggccugcgguuccuccuccaggcuuccuucagcugcacgcgauuccccuggcccggguauccaggaggcucccuggccugaccgugugucagggucugcaggucagagucagcuucgcucgaggcuccugcuccggucgaguccuggaacucggagcugggaguuggcaucugguuugaagcugucuggguaauagagacacauggugccuuccuuuuaauacggccuggggcacacagacugcccucugagccuggaccugcacccucugccucggccuccgugaaaucaggcuuuggaccccgcgaccccagccacgguacccucuuugccgcccuggacagggcagaaguguuuuguguggauugugccugaggagguuggagacaugagaggucagggaguuguccguccccuggugcugaagcugaagucagcgagggucuccgggacacuggagcuuggccuucaggcagcagccaguggggagcugggcugauucccauggaaaugggcauccugcgggcaugggcagcccuccccaugacucauggccccaggcauucagaagagacugcugccucuggaaagggagcucauccccggggccguuugugagucacaguuugguguuaaggagcuccuacauaccaggggucauuugugaauuaggauucggguguuaaggagcucauggugggggaagggguggacauuugugauucacaguuugguaguuuggguuccuggggccguuuguggcacaagguuuguuguuaaggaacugguuccuggagucguuugugacacgagguuuggugauaaggagcugguuccuggaauuguuugugacaccagguuugcuguuaaagagcugguuccuggggccauuuguggcacgagguuugguaauaaggagcugguuccuggagucguuugugacaccagguuugguguuaaagagcugguuccuggggccguuuguggcacgagguuuggugauaaggagcugguuccuggagucguuugugacaccagguuugguguuaaagagcugguuccuggggccguuuguggugcaggguuugguguuucucaagacuucaguucucuacauuucuaaaggagcaaaacugccagugccuucucaccucagcaccgacccaggaucagagucacggccgcccuggugauggagggcaggccuggguguggaccccagcggugggaaggggggcgaggggccaugcagcgggccuguggcagggcaguggcuggagcccaugucaugcccacccagcagccuucuugcucccugugcagguguguggcauccucagaggugcucacgcuccaggccuggcugaggaaaggaggugagcaggacccuguggccacggguguugcugauaggaaguaguuaacugacaaggccaccccagcagucccugggagacuccagccagagcaacgucaaacacggcccgcgcgccccucaccccuucccucccucccugacaggcaggcaaggccauucacagucucuucugaagccuucccaucucccgcuggagcaaugaggucuacacagacagcuuaauuugaauuugccucucuggguccccugaauugagaguggaguugcuuucaacgcaugcugacuucacgucccaucuuguugcuucagcugugguucaggauguccaagcacuauguucgcgugugcuaacaucucccaggugcccucugcccggcacacucgccucccgaggcaccccggggugugggcauccagcccagggugggguacuugcaguaaggugagcuuugcccucccaaggcugccccuccucaucucgugcccuggccccagccacagaccuuccugguggaugugcauggugaacggugucugcccaccgccagguucaagcaggcggaggcucagagugauucucggucccuuagagagggugugggggaggucgccagcuguggggcccaaggacacgggcaagccuguggcucagaucacccuucuaccguggcaccagccacacaggacugcugaccaaaaucacagcguuccucauauccgcauagagaauuccucauggcuuaaugaaguauguaggagaagaugccaguggcucaucacccgucaccuggagugagggggcaccaugggccucgggucgugucugcugccuucccaccaccucugccuccccacaucuucaugucuguuuccuggugaagucgggucugugacagaucguuuuguuuccugcucugucccuucgacacuauaucgugagcauuuuacgcucaauuaaauauuuccucgaugaugguguuuaaugguugcauaaugugcuauuucgcaguugugccauaauuuacuuaaaauauuuccuuguuguaggacauuuagccagcuccucuuuuuauuuacucaccuguugauuuaucuuucgcuguguaacaaagcaucucagcaaucaucuguccacacagaucuuucucuggcuacuucuuuagauuaggguccucguagauugauuauuaguuuggauaaaauuaauuaauuggauaaauuauuaacccauuuaugcuggagguugcaaauuuuuuugugaaaaaucagaccuuggcgaugaccuugaacaccaggauauaaauaacucccacaagcuuaguguuccaauaauggaacacuaggcauaaauggguuaauucaaaugcgugaccauuuaaacccauauuugaguuguuuugcaucuauuucagccauguaagacuuccgggaaugagacuuggcucaucucguguaauucugagacugcagagcugggaggacuuugucauggcucauaaucuuaaugaaaccccagguauguaauggagcaguuccugucuccaucuuaugaagaucagcacaccggggcccugguucaccuaagguucugcagauggacagggucugagcaaagaaccaggcauccugccuagagagcccucugucagcucagcucugcagcccagacuuccccuccaggcuccaggcuccacuccuaagcugaaccauggggcugcaguggccugggcagggagcagcggggaagauggggcuguucccagcucaccgucucucaguuccaucucuuuucuggaucccaggcuccccaucagcagugagaucccugccuccacaggguccugugagugacugggacgcccuacagcuugccugcccucaggggccgggugcuuucugcugaccacaccguacuuccucuugcuuuggaaauggcagugaagauuguaugugagcauccuucugggguuugguguggggccccugagaugggacgcacgcagguucaagaacuacacuguuugccaaauugagggcccacugugacugcaggaagucaguuuguagugagcggggaaaggccaggaggcucaaggaggggaggacuuuggggcagccuggccauggcccuuugucaucacugugucgaguggccucccuuccuucugaggcuccagcuuuccucaaguuugggcucugcagggagguccuagcagcuccccagcuccucuaaccaggacagccucaguuucugggggcccugcagagacaucaugaccuggugcagggcuucccaaagcugucuguggccccaucugcccagccugggucaccacagguaggauccaggaacccggguguuggcaggcucccaggaaacauggaugucaucagcccagguuugaggggugcugauuaggaacacugugaggauacggaagguguguccgguucucaccugucacuccuguaggaguuguggcgaguccuaguuggccuauuccagcaacucuuguuuaaaggaauauccuuuccugauugaauuaccuugguacuuuuguugaaaaucaguuugccggccaggcgaaguggcucacaccuguaaucccagcacuuugggaggucgaggugggcggaucaccaggucaggagauugagaccauccuggcuaacagagugaaaucccgucucugcuaaaaauacgaaaaauuagccaggugugguggcaggugccuguagucccagcuacuggggagucugaggcaggagaauggcgugaacccgggaggaggagcuugcagugagccgagaucgcgccacugcacuccagcuugggcgacagagugagacuccgucucaaaagaaaaucaguuugccauaugugugguucuguuucugaacucuguguuccauucaggugaccuugugcugcuauccugaauacugcagcuuuauaguaagucucaaagucaaguaacauaaguccuccaauuuuguucuuuuucaaaauuauagcuauucuagauccacauaaauuuuggaauccgccugucaauuucuagaaaaaagccugcugggacuuugauuuggauuacauucaaucuguagaucaauuugggaagaacugacauucuuuuuuuuuuuuuuuuuggagaugaagucucacucuugucacucaggcuggagugccauggagugaucucggcucacugcaaccucugccugccagguucaagcgauucuccugccucagccuccugaguagcuaggauuacaggcgccugccaccacacccggcuaaguuuuuauuuuuaguagagaugggguuuuaccauguugaccaggcuggucucgaacuccugacuucaggcaauccaccugccuguaauacaggcaugagccacugcacccggccgggaagaacugacauucuaacaauauuguguuccaauccaugaaaaugguauauuucuguauuuauauaggucuuuaccuucucccagcaauguuuuuuauuuuccaacaugcagguuauguguauuuuuaaaauacuuagcuuuaacuaguucauguuuucaugcuuuuguaaaugugcuuuaaaauuuuuauuuuccaauguuucauuccuaauauauagaaauaauugacuuuuauauauuggucucguauucuguaaccuugcugaauuuacuuauuaguucuagaaaguuuuuguaguuucuucaggauuuucaacauagacaauuguaucgugugcauaaaguuagaguuuuaugucuuccuuuucaacuuuuaugccuuauauuuccuuaucuugcccuucaguacuggcuaggaauuucaguacagugcugaauaagaauggggggggggggacauuuuuaccuuguuucugaugcuagcgagaaagcauccaguauuuugacauuaguaugcuguuaaauaugaguuuuucauagauaccauuuaucaggcugagaaaguucccuucuguucuacuugcuaagagucgaauuuugucaguuuuuuuuuuuacaucuauugagauguucauaugaacuuaauuauucuguugauauuguaaguaauacugguugauuuuuuuuaauguuaaaccuaacuugcauuccuaggauaaaccgcacugggucccuuuuuauacaauugauagauucaauuuccuaauuuuuagugagaauuuuugcaucuaugaucuugugcaauauucaucugugguuuaguuuuucuuguaauguguuuguuugccuugguaucaggaugaugcuagccucaaaaaugaauugggaaggguucccuccuccucuuuuuucuggaagaauuugugugagauauuucuucccuaaauaucugauagaauucacuagugaggucaucugggcuuggcauuuucucugugggaagcuuuuuaaauuaugcauuuaauuuaauagauauagaacuacucagauguuuuuugagucaguuuuggucauuuguaucuucuugaguuuuugcuuauuuuguguauacugucaaauuuauuggcauaaaaucauucauaauaauucauuauuauccuuguauuacccauagcaucuguagugccaucccuucuuccauuucugauuuuggcaauacauaucaucucuuuuuucgucaucacucuaaguuuuaucgauuuuuuuaucucucuccuuucagaucugucagguuuugcuuccuauauuuuuaaucccuauuuugggguacauacgcaguuaagauuguuauaucuucuugaucacuugcaauuguaauuauaauuaugcaaugucugucuucaucucuuaaauauucuuguucugaagucugacuugaguaauauuaauauagccacuccugcuuucuuacaauuuuaauauuuauauauaccuaucuauauuucuaaucuuuuaaucuaccugugucuguauauuuuuaauggauuuuuugaagauaacaucuaauugaaucuugcuuuuuuuauucagacugauaaucuaugccauuuauauuuaauauaauuuuuaugacauugaguuuaaaucugccaucuugucauuuguuuucuuuuugucucguauauucuuuuuuucauuuuucuugccucuuuugggcuguuuuuugguauuccauguuuucuccaacauuggcuuauuaauuauaccucuuugguuuucuucuguuuugguuuaguuauugcucuagggcaagggucaguaaaccuuuccuguaaagaaacagguaucaaauauuuuaggcuuugggagccauacugucugugucacaccucugcuguuguagcacagaaggaacuguuacauaaugagcucaaaugugugccaguaaaacuuuauuacaaaagcgggcggugggccagaauuggcccauggguuggaguuugaugaccccagcucuaugucagucuguuuucaaauaaucuuacuaguuaacauagagcauuuuaaaaguauuuuuccauuuuuucuuuuuauguaauuuuuacacaaaauuuuuuugugaaauuauuuuuucacuuuagagaguacauuaucuucuaaauuaaaaugauucaaaaaugcuuguugaaguguauucaccuauuuaaauacgugaacuguauucacauauuuacugcuucuggcaguagugggaggaggaccagggcggggggccuggagauggaaccgcaccuucccaugcugccucgcuaauucuacaaauacuguugacauccugugcguguggccuugagcagagggguaaagaccgggcagcccuggcaggggcucuggggccaaggacaucaccuucuggggguaggagcaagauguccuuccagagccuagguuuugagaggagguuacccuggccugguuaggaugaguugucaucuuuuagcuuuugguuugguuucuguuuguguuuauuuucacuuuuugccauggaaaguuuuaagcauauauauaaaaauauggaaaacagcaucgagaagucccugugagcccaucccacccucuucccccuuccuggauuauucugaagcaaauccaagguaucguaauuaauuuagcugcaaucauucaaguauuguagcaugugucucugaagggcuggugacuccauaaagcccuaaccagaguccuuuuauugugguaggaccuggucucggugggugaggacgguggggaaaggggcagcguccggcagggugaccaccugugcgaaggagaagagagacaaagcaccugguguuggaccagacggggggcucgggaccuugggcugcaguugaccacgugaggcccuuagccuccagagaaggagcugguuuaacaugaccaaugguuguggagaccuugcuuccuagguggggcugccaugccgcuaccauccucccgcauaaguacguuacagagaucuauggagccaaggggcuaguucaccaaaauaagaccuggccguguccaccacucugcuggucuggcugggguugccgucacagagccccacggcggggggcugagaccgcaaacgugugucucacacaauucuggaggcugaaaucugagaucaaagggcaccggaguuggccccuggggaggacucuccucccggcuuguggacggccgccccuuguauuccugugugaccuuuccacugugcacuuggagagcucuggugccccugcuggaucaggacccacccuuaugaccuucaucagacuuaacuucccuccuuaaagguccuauuuccaaauacagucacauggggauuagguuaguaucuaaauuugggggacacaguucagccuguaacaguugcucugcacagccccgcucgguuacaucauagauguucgcacacgucugugcacgugaacuaccuguuaucuguugcacaugcagcguuacuaaacaggguucccuuauaccucccgggguuccuggaguggcgucuucucuuuugcugggaaccuugccgccuuuccucucccugccccucccagcccgugugggccaccugcuguguuccacgccuuccuuucuccucugcuugugcagcggaagguucugccagcaggggaguuagugagcagccaguggagggugugcccagccuuccugcugcagacccgcccccaagucaacacggacuucccucccugcgugccagaacuucgcguuguucuuaguggcaucuggggucgaggagggcgacugucagccaguugggggauguuuucuucuuggucucucggcuucugcuucccugugagcugggcagccucagcccagguccuauccgguacucagcuggccucggugugcacagcgcaggcuugagugcagccgugggggcgggcagggcagcagcagggccccugggaacagcugagucugaagggucagaagccauggccccuguggggggcucuggggcagccaggggagcugcucguuagucgucucuggggcagaaggaagggaccuucaccuggauugggacugggccuggguccccagucucacagggagcuuguccugauuguaccugcccagccugcccugcagaggggaaggaggcccuuggcucggaguaugccugcccuggagcucccaggcccagccggggcccggggugggggccacucacugggcacaggugcagggugccuauggccaggccugggguguggccggucuccaugcugcagagccggaggccucuguguucucucccugccuuccccuccucccuauaccugccccuccucucuaccauccuacccaaccucucucuccuggagcccuccagccccaccccuccccguguacacuaagugcccaggcgggagggccuguggguccugcugagccacacaaggccccaaucgagcagguagcagguggugugcugcgagcugcuuuucccuccugggucaauuccuaagcccaccaggcgaucgaugaagagccaccugccucuggguaaugcugauaggugagagccacucaacagcgcuuuuauuuuuuuuuuuaaggaagccgcacucagccacaagcugugcggaaagcuauaggauuaucaagaucaaaaggucagcccuccgccuccucuccuccaccagagccucacccuggccacggcgggugcuacccucgaugucacggccuggccaccgucuuacccccgucccggugcugcugcaacgucuccuccugagacgcuucccugaccaucccaagccacggucacccccucuguccucugcacuguggcccagccuggccgugcgaugacacgguugucugccagugugugucaccuccccaaagcugaugcgcuggugggagaccccgggucuuaccagccgugcaccgagacggccucgcugcacugaccucuggcgccagccacugucugcugggcagccugaccuucguuuuccauccccacuccggugcagauggagagccuggaacaccgucccgggauccccgguggccaggcagaagcaccgacccuagcauggggugcucagagaggcccgccuguccucagccugggccuguguguguuccacgccuccccaccggaacugacccuggcguggggugcuccaagaggcccucuggccucagccugggccugugugcuccacgcuuccucccuggugccgacuugaugggcucagcauccauucucguucagccacggggagcaguuucagggccaggagucccucagcaucuggaggcaggauaagcccugccugcuccccaaacacacgucuccccacugggcuucagggccagcuugggcuucgguggggguguccaucaggggugagcugcggcccuugucagggcacauccugcacccggggugcccacucccccaugguggucggggguuacagugagggaggcagcagugggcagcugguguguccccugccaggaucucccacuaccccuccauccaccgcagagcccccugcccagccccagaagagccccuuggcccccauccguagagagcccaggugcuuugcccguaccccucagcacuguccagccccggccgugccgugcuccuacuagcucuccaccagggcuccccaccugccccuccccaccgccccucgcauccuccaggacucagcccaaaugccaccuuccuugaggccuccccaaccuccucccagagcccugccccugcucccacccucuugcuguaauuacaaccccauuuagggcuggcgcucucuagcccauugaggccccaggacaggacccggacucgcgccccagcccgugagguccagaggggacuccccagccggggauggggccugugagccaggcucccugcacacauuuacggugggggucaaggccccccuuaugaaaagggacacugaggcaggagaggcugcaccagaauuggaaccgggcccaccagccccacggggggcuccuccccgcuccuccacggcucggcaugcagcccuucccugugugacucguugcgucauugcugggcugggcccuuucuucucuccguuucucaccuggggauaaaguccccaaagugggauuucuggauuaaagaucacggccaucucucucuccgugacaguuuccggcuuucucuccuucugacgcgccccccacccuggguguuugaauugacuggaagcguugacguuuuauugacguccaucgcgguguccucuccaaacagaacgauccucacuguggaguucgaucucagcacacagaaggcucggagcuggcuuuucauuccuguguuuauucguucagcaagcguuucuccauaucacccgugucuggcccugugcugggggcagaugagagaggcacgguccagugcccaggaguccgcagccaggaggacagcccuggagaccugcccgugugagugugagccggcgggagcagagagcggccucugcccugggcugcguccuggaggugauuuucagccuggauccuguucuggaaagaaaggccucucguucagcugagcccaguucggugucgcaggcgacuguuggaugccagacaugggcuagacaugaacaggaggagcugccugcccugaggcucagggccugggagcagagacagacggggaagccgcagcgcagagggugagggcucacccaggagcaggugcuguggggaggccuggugcaccuggaccaggggccucacuuccuggggcucagggccaucggccaggccgcugggcaugaccugucaucugggaaacggugcggcagccccaguguggccccgauccucucuauagaguguuugagucccaggccugcagcaccccguggggcucacagugugcaugucugacccugcaggcagcccugcgggguaggugucagccucucugucgcgggacaggggacagagggagcgcagauggccugcaggguguggaggaggcuccccaaggccuggggccuggacugggcuguuugggccuguaucugucagcaggagcugccgccugggagucaugcuggaacacagcagagccuggagaugagaggucuucauccugucucucccucccucugcuuucucuguccugugggcucugagccaccguaguucugcccccucucuucucaucuccuccacccccaaguguggggacccuagacccuguccccuccauguccccuccacaucuccucuggggcuccgagcugcuggcccuccggggaagccugcaccgccaucacaggugcaggaguucagaguggcaggcguauguuggguucagcguggcaggcguauguuggguucagcguggcagguguauguuggcuucagcguggcagguguuauguuggguucagcguggcaggcguauguuggguucagcauggcaggcguauguuggguucaguguggcaggcguaugguggguucggcguggcagguguuacgguggguucggcguggcaggcguauguuggguucagcguggcaggcauauguuggguucggcguggcagguguuauggucaguucagcguggcaggcguagguuggguucagcguggcaggcauauguuggguucagcguggcagguguuacgguggguucagcuuggcaggcguauguuggguucagcguggcagguguuacgguggguucagcguggcaggcauauguuggguucagcguggcagguguuacgguggguucagcguggcaggcguauguuggguucaguguggcagguguuacaauggguucagcguggcaggcuuauguuggguucagcguggcaggcguauguuggguucagcguggcagguguuacgguggguucagcauggcaggcguauguuggguucagcgcggcagguguuauggucgguucagcguggcaggcguauguuggguucaguguggcagguguuacgguggguucagcguggcagguguauguuggguucagcauggcagguguuacgguagguucaacguggcaggcguauguuagguucagcguggcagguguuacgguugguucggcauggcaggcguauguuggguucagcguggcagguguuacgguggguucagcauggcaggcguauguuggguucagcguggcagguguuacgguagguucaucguggcaggcguauguuagguucagcguggcagguguuauggucgguucagcguggcagguguuauggucgguucagcguggcaggcauauguuggguucagcguggcagguguuauggucgguucagcguggcaggcauauguuggguucagcguggcagguguuacgguggguucaguguggcagguguauguuggguucaguguggcagguguuacgguggguucagcguggcaggcauauguuggguucagcguggcaggcauauguuggguucagcguggcagguguuacgguggguucagcguggcaggcguauguuggguucagcguggcagguguuauggucgguucagcguggcaggcuuauguuggguucaguguggcagguguauguuggguucagcguggcaggcauauguuggguucagcguggcagguguuacgguggguucagcguggcaggaguauguuggguucagcguggcagguguuaugguggguucagcauggcaagcguauguuggguucagcauggcagguguuacgguagguucaccguggcaggcguauguuagguucagcguggcagguguuacggucgguucagcguggcaggcauauguuggguucagcguggcagguguuauggucgguucagcguggcaggcauauguuggguucagcauggcaggcauauguugggcaccaacuaggccggaugugacacaucgugagcugccaccugcacagccuuccugccgacaguucugggcagcggcucgcaucuggggucagucacucucccugucucgguucaaggucaggcuuguucugccgugucugggccucccacaccucaccuaccaauguggacuccggguuggcacggcaggggcaggggaggcacgggcgaggcaccccuuggcuuaugaagugcuccagccagccgccuguuggaccccguugcuuccugggcucacagccugccuugugggacgagccuggguccuccgucagcagcuggaccugaaccugccugccccauggaggcacuugcgggagcccagucuaggugugguguggcaucaccuccugcagggacagucgugauguguuccauggagcccacgcacgugaucuccaugaggcugugguccucggcccccucaacccgugcuagugugacagugcugauugacaaucguagcucauuaccgacgcaggcuaauuaaauuacccuucggcagcuggagauggauggcacagccaggcuggaacaugguuauguuccguuuugucacguuuuucaguguuuuuucccgggucccugugauacugagguuggagagaaggggaggcagcaaaggcgcugggaagagggcccuggggaggucaccugcucccagcugcacgugggcugagcucuugcaggccaucgcugugcccaacccugggcuggggauuuaaggaaaccuggggaguuuaggaaccuggacuugguucuugcccuugagagccuauaagguggaguucagggagagcuaagagccugcgccgagguagaugcugggaacucagagaggccucugggagaggcugugggagggggucccaggcaaggggugcucuccacgugggcugacugcuccuucccuggcguucccccgggccucuguggcccccacagcagcgugugugccuucuccuugagacccaaccccgccccaugccggcagccaugggggcgggcgauggugccugggcauggaucguugcucggauguucccgucccgggccucaccguccacguguggccuggaccaguugcgucggugccauucgggccccaccccagccugccgagccagagccugccuuucacagagccuugggggaguccuacacacgcgaggguuugggcugugccgggcuagcuuucugccuggcgcggugaggcggcgcuuccgugcucagcuucguccguguggggaagaggccagguucuccaugcagaggguuggugugccagggcuugcaccgcugggccccuguguggggaggucacaccuucagcuccuuagcugacaugcuggucuucugggcguuccccugguggucgucacugcguccuguuggccccuuggugcugagccgcauccccaacugugagaacucucgccucugguuaaggcugugaacacgcagugcgugucacuccuacccggcaugggcugugcugacuuccaggcaggccgcaaggguaucgcaugacgcgcuggagaaauccaagccuaaucccaggaccccaggaugaugcuccaucccuggagggaccuccaggagcucccuuccccacccccugcugagccuguacuuucuuuguguaaauuauccgugggguggggugggugggaggccucgcuggggaggacagacauggagggccccacuccagcagcacgcagcccgggaggcgcggccugcgugggagcagcccgggaagcguggugugugcugggcggcagcagccauggaaguccacgcugccuccacaguacccaggagcuggggaggcagugacuugaaaucucagagccaauuccuuaaaaauccagaaaguucuaacugauuucgguuaucagcagguggggcuuggcucccuguucugccucaagguuaucuuggccaaauuguccaccccaggggccacuguggggucaggagugcuggugucuggggggccacagugcaccucgcugggcugaauggcagggugcaggagggcccacucugagcgggcacggcagggacagugcuuacagaggucaguaggggaauuacugcuggcgucugcucagcgccauguggggcagggcagggcacuggccacacagaggacagauguggagggccccucagagacgguugucgccccguauuagggaagacgggagaagcgagcacagacacugcucuaauuauguggcucucaucugggcagggacugccuccgaugcaucgccauuuauuuuuaauaagucguuggaacaacuucagcuccaauuauugucccagagcugauggcaggggccagugcucagcccguccagucccuccaaugagggacugugucaccucccugugccaccccucccauccccuacagccacccugcaggagcucugccccggaggccaggaagcguggcccuucucccugccugcaggaggccucaggcgcagguuccuggaauggaaauugggcccgagccaccgguagaaucuggcagagugcugcugagaugugcagaagccuccgcgccccauggcccaccucgcuccuacucacugcacaccugcagugggaugcauggcccgcuuugcacucugcagaagauugggcgagcagaagggccagaucugucccaauuccugcggcccccagaggaagcugcugccaccgccucauccagaccuggagcucaggcugcagugccgccuuccaugcuggacccgcuucucuccucuacaucuuccggggggguccugcggaggcagccagcaccucuuccuugucccacacuuccuugucccggcauuccccuccuccauuagccccgaaggccucuggagcuugggcugggcaugagcuucaugugugucccuggcauguggucagugaugccaggggaggccuacggugcccaugucuguggcacugaccgugccauccaucucaccagcuucugccugccucugucucccacuucgccccagcuuggcccuagaucuccaaguacugcagccgaccucagccccucacccacugggccagcaggugcugcuguggugacccacucugcggucaggagcccagcgggcccuguagugagugcugcccacuaccuccccuaccuccgagcugcaccuccccaucccuacugcaggaggaccgcugugggcauggagagcaggccagcacagugagacgccugcaggagccuggcccagccagcgcuggcagcugagcugcccaucucuccuccuuggcccucaccgggcccuaugucgcugccuccugcugcuuccccagucaugguacacccucacugaaggcccucagggcucccgucagcccguggaacagaucuaguugguuuucacgauguucccugcccuucaccccugccugcccccaacgcucccgccaagcaggacugcucuggggcuggccggcaagaggugccauggccucugcguugccugccuguccgcagccucccguggcgucucacaccagcagcuucucuguagcgcucccugagccuccucuuccccacuuaagaccucuccucagcacagugcacccucgugucucugccccagagacuggaaccgucuggaggguggagcucgcucucaucucuugcuucagcccuuuguuccugggagcauguuacggccucagccugcagugggggcacagggagcuuuacagaaccaguuaggguuccaggagcaggcucugcaaggcuccacccuugucuuggagggcagaggcugucgggacccacagcgcaagggccuaggcgucuaucuccucccaccugggcaccuggcucccagagcgcacccgggcucugcaccaccaaccugggcaccuggcuuccagcauguacugaggcccuauacucccaacccaggcaccuggcucccagugugcacccgggcguucuggccccccucccaccaaccagcccugcugagcaucugugcucccacccacggucugucagggggcacucguggucucugacauggacaucccuggcuaucccaagaguuuugcuucaaaaccagcaugguucuccagacccaggaccaccccacccuccccuggggcgcaucacggcugucugccuggcccauugcgggccgauggugccugucacgcuggcaggcuuguccagggcuuccccgagggcccaguggcucacuagaggcugucaucuggcucguggagccccgaagcccccaggcggugcacagggccugcaagcaggaggggcugccauucgagagagagagcagucgcuguagaucccguagcagccgcucucugggucugugccuuugcgucuccaaggcagccaguccugauuaacugugcaaacuuaauuaguucacaucaaaguuuguggaaggcauuccucaagggaucuugugugaacagccucugguuaccaagaggccucaauuccacacugaggugaugguauuaauauugaguaucccuucucaggucuccaguccucccugcaucguaaaaagacucaucuucccaucuggcugcuccgucgcccugcgcuuguaaauaauauuaaagcaauuucuucugaggagacugaagggaagcuugcagggcaggguguccugagaccucugaaagcucugcugugggcacucagggcuacagccgggcagcagcagggcugggaugccccggggcuggcaccaggccugggggccccaucugugcccggcaaggucagcuuugacucaagggacaggcagacaggccuugcagacccccaagagcuucucucuggcccuucuuuccccaaggaggagccacuguggagagcuggggucuuggugggaagccuugggccccugacucugugggccagaucccauagggugggugcuugugcacgccucacgcaugugcccccuuccgggagucccagacaggaugggccuggucaccugcucuggacagggcagacuggggacagggaugcucccggaagggugucacuagacaagugagagcguggucagugggcgugagguggggacuugagcugcgggcgugguaggugucucagugcuucaguguggcuauacuagagcuccugagacugcgugguuuaugaggaggcuuauucgacacaggauucugcuggcugcagaguucaaaauuggacauuugcaucuggcaagguccucaggccgcauccacuccuggcagaagucgaggggagcuguugugugcagagaguacgcagcgagaaaggggcggagugggggcggggggcaccaggcucucccaacagugggaacccccucaccccagggagggggccagucuguucacgagggcccacccucacggccaaacaccuccgguuaggccccacuccaguaucgaggaucagggguccacgugaggucgggagacagacguccaggccacagccccgcaugggggaagggcaccgcugcagcaguucugggcaucagcucguguggaugucuaaggaauauuuccucguccugacaaauugcccagcaacugugucauggggacuuugcaaauccacccuuuaaagacucccggcagggggguguucagaagccagaagcaauuuggauaaugacccauccagcccugagccccagucaaaaggaagggcuggaccuuugaucugcagguucccuggagcucuggccaaaggcaaguucccccgagucccguccaggaaaggggccccgggucugcccugcagggagccagugcugagcugagacaggccaugagcccugcagccgccuccccuccuccuucagguguucaggugucucugcuagcaacacaaguggccaggaaagcggcuccccaacugucugacccuccuggagacccuggcccggggucuuuguuccucugcaagucccaccgggcugcgggaauuccuccgcagggccgccccguccccauccuggccaguuucucccucggcuuuccucggggcccaggcuggagugcaguggcgcgaucucggcucacugcaaccucugcuccuccagaguaguuuuaagcaguucucugccucagccuccagaguagcugggauuacaggugcgugccaccaugccuggcuaauuuuuuguauuuuuaguagagacgggguuucaccaucuuggccaggcuggucuugaacuccugaccuugugauccaccuggcucggccugccagagugcugggauuacaggcaggagccaccgcgccuggccuuccucggggcuuucuauccuugggcccccgggugccugacggggcugcaggagcacgggagcccacgguguuccgggacugcaggccggccacccuccacccaggagcuccagggagcggaggggcaagauggggcagggcagggcagcugagaacacaggcugagcccagcgcguggggugugggcaggugacggucucugcaagcccaagucuccuccugggucugggggugagauguggcugaagugcugcucaggggucagccucaguacuggcucccgggccuucagccaggccgugcugugcgggggcuuguuccagacccuccccaggacugaagugcugucucaucuuucuccucacagaggcccucaguggaccgcgaggucuccccgcccaggccuugugacggccgugccgcuggccccgggccugccgguagcugccuuucugcagccagacuguuaacaggcucucugcggacccucaccagugccuaacuagauccuggccccaggccuuccucccugcccucucgggccugaugagccgcacccggcauucaccccgcccugggcuccgcuaaccccgucuucggaggccgaaggagugaggucuucagcccgugcugaggcggccuccucgugcgcucagaucuggacgccaccuggcuugcggggcuuggggcucccuccucugguugggggguuggauggagggugcggagugcagcguccccucccagccuccaggccugugcaagacggccccacaaucagcaaccaggcagugaggaggaggcucugggucuccccaacacaugugggacuugucugauccccugaagacacggacucagucuagugcccaugggacccugacaucugacccugcgggccccuuucuacggccggcaaguagcugugggcccagagcccaccucagaccaguagaugaggguuucggugaauuguuuugucucuuuugaguuuguuuucaucgucacucuauuuauagcaagcacuguuuuuuuucauuuuacagcagugauguaaagcuuccuuuuucacugggccuauugaagcuaauaaggaaaguuggguuaaagaaaauacuaaguaaauaacaggccuguaggcagaccguuaccuagauggcagccacuugcuggaccggccagggccgaugcccucagccuccagcaaugcccccugaguggaucugaugaacuuuauuguacagaggauucugacacugugaaagguugagagacucacacagcuugggaggggcaaggcagggagggagggauccaggucggcccugcugcagucucgggacucuccggcacaaauccucaagccccugccucugggguccccaccagacuucaugcacaggacagggacaugaggagggaaggccucuguggagcuuugccgucuucuagggcacaguucaaacuguggcugcuucugccucccaggggacccguggcaacaucuggagauauuucaguccucacagcuggggccaggcuguuggccucuggugggcagaggcccggggugcugcucggugugcugaggagaccaacccggaguaaccuggcucccgaaguccagagcaccgaggcugcggggugccgcucuuggggacgccccagacaccccugagcagcuccccgaguuucucuguggaggaaauggguggggguguccagccauggcugaugccagaggcucugcaggucuaggaggccuucaagagacucacuucucuagucacucugcauccccugcauggcgguggggcucugaggcugagggcacaccccagcccucuacguucccagcagcuccugggcuggggggccaggagucccuccaaccagggggcaggcggagcagugucccuccaaccagggggcaggcggagcagugucccuccaaccagggggcaggcggagcagugucccuccaaccagggggcaggcggagcagugucccuccaaccagggggcaggcggagcagugucccuccaaccagggggcaggcggagcagugucccuccaaccagggggcaggcggagcagugucccuccaaccagggggcaggcggagcagugucccuccaaccagggggcaggcggagcagugucccuccaaccagggggcaggcggagcagugucccuccaaccagggggcaggcggagcagugucccuccaaccagggggcaggcggagcagugucccuccaaccagggggcaggcggagcagugucccuccaaccagggggcaggcggagcagugucccuccaaccagggggcaggcggagcagugucccuccaaccagggggcaggcggagcagugucccuccaaccagggggcaggcggagcagugacgcuucuguuuagaggcguguccuggcccuuguggccuuuaguccccaccucagccccguugucacugggaaaggauagcuucagccagguggagccaugugcccagggcccuugccuagagggggaccagcccggucucagcccagcccccaccggacccagcaccugcccugcuccccagagccuagccguggccgagccccagccucagccccggggggucaccagccuccugcccgucuuuggugguugugguuugaauauggaggcaguuguccagucaggggcagggugagcggccgccucugggcuugcgugcugggacuugugcgguacagacugggugucccagugacggcuuccgaggggaggggcgggccaggacagagguggacuccaucggggcagcugcugguacaaccaccuauagacuagccccuccaggcaagacccagaacugggugggagauuugacggccggccugucugccaugagcuggagcugccggagagcccagaaggcacaggggugacccagggcagccuugagcuguccucagugcagugcccuugugcucgggaugcucacggcaucccuuccugaggccgagagagagcacuucagagaauccugagaugugagcggaggucaggccccggggugaugcccaggaugaugcccaggggauccuuauucccugaggccggcagccaugugggugcagucgccaguagccccugcccucgguuaggcacccaagggagcccccaggcagagcugggcagcuucguuuuccagaccuucacuggggaagaacaaagcguuuugugagggacgagggacaggaaacagaggccacccugcagguugucacauuuagggaaacagaggcugcccugcaggaugucaccccuagggagacagaggcugcccugcaggaugucaccucuagggagacaggggccaccacaggaugucaggucuagggagacagaggccgccccgcaggaugucaagucuagggacacagaggccgccccgcaggaugucacaucuagggagacagaggccgccccgccagaugucaggucuagggacacagaggccgccccgcaggaugucaggucuagggaacagaggccgccccgcaggaugucaugucuagggacacagaggccgccccaccagaugucaggucuagggacacagaggccgccccgcaggaugucacaucuagggagacagaggccgccccgccagaugucaggucuagggacacagaggccgccccgcaggaugucaggucuagggacacagaggccgccccgccagaugucaggucuagggacacagaggcugccccgcaggaugucaggucuagggaacagaggccgccccacaggaugucacgucuagggagacagaggcagccccacaggaugucacgucuagggagacagaggccgccccgcaggaugucacaucuagggagacagaggcagccccgccggaugucacaucuagggagacagaggccgccccgccggguaucaugucuaagggagacagaggccaccccgcuggaugucacgucuagggagacagaggccgcccugcaggaugucaggucuagggaacagaggccgcccugcaggaugucacgucuagggaacagagggagcccugcagggugucaggucuacggagagcaccagcugaggggcuggggcugugccuggggccugucuccucccuccucugcagggcugccacuggcauccacuccuugcuggcaagguccccaucaugggugccauaagguccccagagaaaaacauaaaguccuggcaccuggggccacucagaucccacuuguggggcuuccaggugggaugcgcuccgccucgcagccaccugccccaccugugggcagcacugacuuuucaaagcccuuugcacgguagccgaaacacauaucccuguggcucugcccugauccuucccugugcagaaugaguuggaaucaacggggagaugcaagcuggaagggccgauauggagacgccuggugaaccugcagccccaggaggcugucguugccacuguggccuggucaggguucugaucaucacagcugcugcgcacccagcugucugccugagcguucugggaaguggcucuuccuucacaccagggggaggcaggcuggggaagcccggcgccaucucccacugccucucucaggcaucuggcccuccugcgugugggguuguguguggaggucugcuccgucucugcaggccucucucaggugccuggcccuccugcguaugggguuugguguggaggucugcuccaucccuccaccucucccaugcaggccgagucgggggacgccccccagaucugagcugugucuggguggccuuucagagccucaguggaaaggcguggugguccagguggguugcaagucaugaccugggcccccugcccugaccugggaucucccagagguggucaggcccugucccugaagccaggaggggcagaggcucugacugcccgugcucgugaagcauuccugcugggccuacuuuccagcugggggccccuugcccugggaccccaugguggccuagucuguggccucuguggcuuuccugugggccucgugucuguguagcccaugcguccucgccaccaugugcccugcgcauguucucacuaucccagucugcccugcacuguggcgugggucugacccuagcagccccgccagguaggaggaggcaccgcgggcguccuggugccgggacagggucagcaagaccugaaugaguuucagggcugaccccaggacgccugucccucaggugugcagaggugggggcaccacaugggagccggagacgccguggacgccacccucucacacgcagagccccuggguggaagggaggccucagaaaccaaggauuucagagaucuccaagccagguggaggcugagccaaggcaaaaacaaaagccauucauccccugucaugcccagagugggccaggaacggaguugggguccggccuuggggugcaacuggccagcccauguccccacucagaucccagcaccgcuaucuccugguuguggcgagcaggggacucugccugugcuccaagacucccaacacugccaccgacgggcgcgccagugaugaguucccugcucucagccugagcccgugcugaggaaaagcaagccuaagaaauuaaagcagcuuuuaaauguuagaccuaccaauuaaaaaaaagcagucacauggaaacgugcauuuuccagaacucuguuguuuacuccgucauaauuaauacaggcagggaggaaaguucgggcucuguggacagcgguugccagcgugggccacagccaagggacucggcccuggggacgggaggaagggcugccucugcagguucugcagggccgggguggacaagagccucccugggcccccagccuggagguccccaggcaccaccugccuuccuggacugaguggaugagaaagacaaggacuggcugggacaucagagccucagagggggcgucgugcuggccuagccgggcaggccucagauguagcaggaccaggacgucccccggccccuggugagcccuggccuugcccacacuccuguguccucuuuuuugcuccaaggccccucuuccuccuguccagcuggcccagcccuuccuuguccuuucccaggcagcccugguccaggggcucauccucgggcccagcccccucaccugagccccguucaucccagccgcagcagggcagaaacucaaaagauggcagcgaggggaccguccuguuccucugucugaaaacucagcugcacacgcggggugggggacugugaggagugccuaugugacagcagaggccugacugugggucauggggccagcaagggaccaggcuguggcuggcugccucccggggcaugaccaggacaccggcaggcagcccuaccuugugccgccccccgagcacagcaaaggcggguuucaggggcccugagcacugagucagaggcuguggaaagucaucgcacccacccucgcccgagacgugggacagccgugccuccugguggggcugcugaugaaauccucgggaaggugccaguacgguccgcgcucgcggcucuugccuaagaaaccguggcucuggcugcuguuggugaggaguccuggagguucccagagccucgggcaccgagggggagacccugacacuguccugccugccccaccagucugcuccccgcagcuccucguccucacccgagugcugcuggaggguuggcaggaggcgugaccagcaggguccagcacagucaggguuuccugggggguccaggaaacaggaugagcugcuguguggcagcucauggucagcucggucugaaggccucccuggggacacacaggcagcgagguccaggcucccucucccucccccagggugacagagccugggagaggcccgcaggagucccuccagccguuguggcccgagaccacguuccaggguuggguuacguguggaacguggaggcacgcggggugcgcgugggcccugccgcuggcaggaagcagggacuggucuggagcgcggcggggcuaugccaucuucggggcugugccaucuucccuucuggguuuguggaggagccgcgagcagcuccuccugaacuuuucuuuauuaaugaaucuuaucucugcucacacagcacgcagcggauacaggccgcgggugauaagcagagagcgagcaggccccaaugagaaauuaccugcucguagccagcagauuagccgacagcuggccagcgggggcugugggggugggcggugcuccgcgcgcugguucccccuucccaucccccaaccccggcaggggccgcuggaggcagggggcccccacagaggcuggccuguggggacuggcggguucuuccccgagcaccugggacaggcugagcccagagcguggccccacgucuucagccagaaccgaagcgagauguuccuucccuucauuucucccugcgcccaacccgaccugcuggccccacaggcacaccccuccccgguccagccaugucccuauucagaggcacguguggagaggcgucagaagcaggagggcgcggggccuugccacaggcugaaggucugugucccucuaaaauccauacguugaaauucuaacgcccaagaugagggauuaggaagugcagcccuuggacugggauuagcacuuuaugaagaagccgagagcucccucaccgcaccccacgugagcgcaccgcgaggaagugccuccccucagcagacaccacgucugccggcgccuugaguucccacuuccacuccagaaccugagcagccaaugucugcugcucauaagccacccugucugugggguuccagcagcuggacgcaaagagacagagcauugguaccaagaguggggugcagcuguaacagaccccgaaagccucucuggagcuggggagugggagaggcuggaaggguugggguggagccugugaaaagcagauguugccgagaacaggccaugaaaggugaugcuggugagggcucaggaggaagggaggagcacuguggagggagcccccaucuuccugcacaaggaaugcucccagaaucuuaggagggggcacggacaaggccgcucugaggaggccgugggugugugugguggugaggggagacccgccucggguggagcugggcugggcugggcugggcccgggccguguuuucuggaaagugagugugugagggaugagacuggagauuuggccacagcucuuuccaggccaggcguugaggugcagccuuuccucccgcuguuauagucagaugcgggcacagaggggcggccuaggauggcaucaagcagaaggaagcggaacuuaagcaccuggggaaugcucagcuugucgcugucaucgcugcuggagaaaacgagagcaacccuagggagagaacccuaggguguggcccgcaaccguuugauagggaggcucgugugggugugaccucaggccccgucugccacugcggcagagacaccgccagcuggaaccaaagaggagggagacgggaaggaugagggaggcugucgacuuggacuugacaugacaggaccacagagcugucggccggcaaacacgcgcggcucuucaccgcagaggaagggugacccugaaggugguucggaaaacucccagccgccgaugccuucuucagaggggaccgcagcccacgugccucccacaggccaggagcucugccagcggugggcgcggggccuccccaguggacgagagguggagcauggagccacagcggcagcucucaggccucugggccucacgggacuugccccucgggguuuggccugccuggggccuggcacccucccucuugccuuucccccuuuugaaaugggagcguccguccccuccuguccugccuuugucucccccguaugugacgccagugagguugagaggagacuuuggaguugaugguuggugagacuguuggggcugcugggguggagaaggauguggguucuguggggacaggggcaggaugcuggggaccgagguuugugucccgcaguucccacguggaaaccgaauccccacugugaggggcaugaggaggcggggucuucgggaggugcugaggugguaggguggggcccucgugaaugggauuaacauccuuauagaggggaccccagaguccccccgccccuucccccgugugacagacagugagaaagcuccaucaccaaacaccaagucugccugugccuuacccugcccuuguggccuccaggccugugagaagugaacucuguuuacgagccaccuagucugcagcggccgaguggaccaauacaggcuuccacaggguagguucccccacagcggggguuggggacgagcugccggggcccaggacguccgcucgcugcuggggcuggggcagucucagccacucccagccccagcgggcucaguacccaacaccgaggcaccggggccauggugggugcggccuguccugggugcucaguguuggggcucagagaauguaaagagccuggggcggggguggaggugccccaggggcagaggcugggcagccccgugagugauguggccuccgccacgccuggaugggguggauaaauguacccgacgcccgugaucgagcugguaauuacccuucacaaugagugauauuaaucgugaagcucccagugcacggcaugagaauggcgccgggagcuggcggcagcaggagaagccauuuauuagccugauaaaugaccaaaagauggccuuucuggcuggcuccugacaggacuuucugauaacagggccgagaguccaccugucagacggccagguggggccugcccgguccuccccugcucggccacccaggcugcucggagugaaaucguagguugggagggggugcagaggcagggccccuugcaggcgagucccagcugccuccugucauugggcggggauggaagggugggacaggaaggaggcaguguccuucugagcucagccugggagaggcagggggcccccgugcagagggaggcgugugggugugcagggcggcggggacaguguuucugagcuggugaucagucugcuguggucaggcaggcagggugggggcuggagcggggucaggcauggcaguggcaaggaagcauggcauaagguccucugugcccaggaggacacuggugcuaagcgucugcugucaccugcuucugucugucacugccgucugaugccugaccgggcugagcguguguuuguugaaugaaggcagggcugccgugugcguccucccugccaggccccuccaccuccgcucuuuccagagggaccgggcuaccugcuguugcugugccacccacaggggaggcaggugucagcuccacacgcguggggccuucucgccaggccugucccgacacagagggcagucccgugagguggcaaguucccacagucagcagugccgcugcuguuagaagguggugguggacugagaugacauccgcagucccuuccgcaucagggcccccaccuccuguacauccuuggggucucagcccagaugcacuuccucggggcucucccuggcucucccgggcuccagucuccuggugcaugucguuaucagcucccacuccacacugggacaggacccugagccuugaguccugcgggugccucggccgcccugcgcugugagcuggcaugugcucagugcuuggugcgugcuagaggagcacgugaaggcccggauaaaugaugcagacaugggcuccagggacagcggcccguccucggaggcgccccuuccaggcucagcacgugcggcucucagagucucauuuguuggcucuccuggccuuagagggcagcccgagggucccagcagggcgucuuggcugggugggcucaggaggcaggggaacagcaaguccggagucauuacaaggccugugccgacaccgggugauuuagcgguaugauuacuuccuaaugcaguaucucgcaaagcuuuuuauuagauuucuccccuuuuccuuccaaagucucuuuggaaauaaacaccuggggcuguuauacuucauaccacucaguuuaauuaacuuuuaaaucacauaacgucacccggaccucucagauggcggcggucgggccaggguggaagccuggcugccccagccucuccgcccagggagcggggcauugccccaucucagccucagggauccugagccuggacuccccccagugcaagguccauugagggggacccuuggaggggcagugguagcuccuggggcucugagucuaaggguggcagagacaccagccccaagccagguccucccaguccgggaaacccagugagcuccacagccuagugcuacgcugcaggugugggggccugaacccagcugccgucaucccugagaaacugcccaaacggugccucucgccaggucagcaggauccucgcccagugcugggucacguccaucccaaccuguguccccacaggaagcacuuucuucccuggggcuucuccccgacccgcucugccccaagucuggguccugcccugggucucgggccucaggagggccccuccccaggccaacagauuccagaacaaucuugugacaucugcccccaacgugggcaccagugaagguucccagccccucucguugccgcugacacuguccgcccacccgugccgggcccugccuccccgagcucuucccaccauuggucccacccauuguuucugccacuccagcucccgggcagcagccaggcgaaccagcuguuggcaggcaggcgacucuagcucccugggcagcaccuaggaggccuggccuuuggcaggcaggcgucacagaucaguuaggcccuucugcgccugccugggaugcugaacagguuucgcgacacuguaagugccuguuccugagaaagcagaggucgccggcacugaaggcuguguccccagcaccuuccccuguguggaccuccugccgucuuccucgccacgccuucacuaacuguuccauucuaguuuucuucuucuugggaccguuuugguuggugauuggugacuuuccaggaaucgugcauuccucgaguuuucagacuagccgugcugucccggggccccgagcagauuccucuggcccuggucacuggggugacgcacaguucaucaggggcuuccugggcacugcuggggacgccucucauccacgaggauggcacguucgaggucugagcugucccagcacggccucccugucgggguuucccgugaccucgagucccaucuccaggacgaacgugcagacacccucccccaccuucuccaugggcucagccaucagcccccaacccugugccggccgaggccaagcucuugcugccggcucuggucugggcgugggucacccccaccuuccacccugugccggccgaggccgggcuccugccgcccgcucuggucugggcaugggucaccccacaggguugccgccaucagucagcaguugggcugggagggccacaugagugccuauagauucuggcacagacgcuuguggccugugggcuuacuuccugcccucccugccaccuuguuggcuccagccgggcugccacgguggacgcagggucacagaagcuuagggcaacacauuugugguccucgacccacggacgcgacgccaggcccuucucgugucucuuccugcucucugaugcccggaagcugcuuccuaugggggucccacacggggucaggcagguuucggugugcccuccccacuccccaucccaggaggggaggagcuccuaguucugaggcugcucugugcacggucuggccugcagugaacauguguuugcuguugucgcaaucacugcugucaccaguggcugggcagggccaguaugcagggguggauagugcggugccugaucacagggcuagcccugugcccuggggugccuguuccccucugcgaacuugggcaaccauggcuuuggggguccccggaccuggguccagccccgugccuucuccggcccaggccggcucugccgagucaccugugcagcuccccggagucaagcacaggcucggggcagugagaucaucugcccaggcccugacccaccgucuggagcccugcaggaacuugggguacccccaccuggacccacuagaggaagccugggccccacagccaguguaaagcagcagcuucuguucaugguaccagggggcugagcugggcccaggcagcuggguggcuccagagguggcagggggugaguuccuaggaggcagggugggcgccucguaagauagaacucuugugggaaaggaugucuagcgaugggagcugccuggaggcguggguccagaggggcccucgggaccugacugggcgccugucgguuccguccuguugccccagaaggggaggccugcccagggguucaggaccgaacaccagguccaggggaagccgcugccccggccgccgcucacccacaaccacucagauuaaggcgaacgagaguggugagaacaaacgccucacagagcuguuccggaaauuagauuuuuccccuuaaggucacucacuccacuggaaaauuaaccaauauuuuccuaaucaaagcggggcuguuucuuccuuggaggaagguggccgcccuuccagcgcuugucauucaucuuggaggcaacugcugccgcgugggcucuuguuuuauuaaauaaacuccgguuuuuauggccgccucucagugccgcccgccccccguccagggagaguggccucaggugucgggcaccgcgccguccugcuuccgcugccgcugccacugcggggucaccuucccuccacagccccucagggcccucccagagccggcgucugcugauccagccuccccuguaccccagggggcucuuuacaccugggguuccaccuuuagcccaggugggagcagggagccgucuugaagucucaccuaggacgccaggacgcugccgcuucccguucuugggccacgccgagcacgacuucuuggggccuguccagcagugcaggcugaggagggcguggacccagucggccaccucagugagguccuggcugcccccugcagacagcccugagcacccccgccugccugccacugucucgacggggagggccgaccaucagggguccaggcagcacuucauaaagcaaagcuucacccggcuaagacgugugggcugcuugggggcucugugucugcaaaacaguaccugugaaaauaaggaaccguaggagacgugggcuggaaggacggcugguaaacauggccccuccucacuuggagauuugugcugccaauaacgaggacauggaugaggggccucccacagagcagcgcuucccaagugccgcugagugaagaagcccucgacagccucgcacagcaucagcucccugaccccgcaugugcguacgugugugugugugcauguguguacgugugugugcaugucugugugugcacguguaugugugugugcauguguccgugcaugugcauuuguguguguguguguguguguguguguacauguacacccgugcucacaaacaggcuggagaacuacaugccgucgccucugugcccccgcuggugugauucugagugacugggugaugggugaugaguguuauuuuuauauuucaaaauagugugagaaggaggcuguccuauugaggcacagaccagugggcaaggaccuuggugguggggggcacacaauccucugggggaccugggcugccccuguggggauguggcaucccuugggaugcugugggcagcacagucaccuccagggccccuggcuuauccucagcaacucagaauuaagugacaucuucguccuucucuggaccaguuguuuuccagagcaggucagacagagcucagcuuccccaucugccaggauucagcgcugggcucucggaaccaggagcgcaaaucgcuggugcucgggguccauggugccccuugagggcucacacagccuucccaugacccuugucuucuacuccugguagggucuugaaucccaggagaucuugcucucccauaagaaaagcagcugugaaagcacagccgggcccggugacuggcccaagccuccgaggaggcggcaagcuuggauggaguguccuauucagcaugagggcccggcauuuccaccaguauucaaauggagccggaaacuuccuguuuccauuggccugagaccccgggcuguccgucugcccuggcaugcacacagcccacccacacuucugucuacccgaguggccgauggucagccgcacacaccaggaagccuuugcuggggccggugguggugaugcuuccagcacgggcugcuugcuuguuggcaucugugaguccugacccuuccuggggcugcagcaggcgugaguguuguugagggagggagaguggccugcggacccagcccugagagcgacacuaggucugugugcccccaggagcuccuccaucaucgucucugcacaccccagccccgucccaccacaucccacgcugggacucccagccgcuucucugucaugagaguccacaguucauuugaaaaccaguguggucaggggcugagacuggcuugcaucuggguggccuguuagcccuggagaaaccggcuguguaggugagcagcugcgugggugagagugggagcauugcaggucacagggacccucuguccccucagcacgugggagccucacuugacacagcaaguggaggccuggagccggccaaggggugcuaggcaggccgauucguucauucuuguacacagcacgcagcaaguguguuccgugucccgggcccagggacgccgaagcgaugggaacccaggccugcccagagcugaggucuccccaguguaugcguccaggcuuugggagaugggccgagggcagcugcuggagggggcgaggccugcccagggcugagaucuccaugcugugugcaucccgguuucagaacaugggccgaaggcagcugcuggacagugccaggacuggucuggucucucccauggaaccuuccagcugagcuuccccugcaguggccgcccagugggggcuggguugugugggacagaggacagcuaaaggguagaggucuccacugucuccugguagauacaucgggccccccacaucuucccaagucacguaacgcugcacacccugguccgccccgugguaccuccgcgagcaccgccugccaugccugguuugcugcucuguaauccagcggcuccugcaguccuggcacguucgguugugucccgaaagaaaaccagugcuuccuaaacagaaaaggacaagcgucaguuggaaaagauguguggccuucaaacaaacacccuggaccagggaggaacuccuuguucccaggacagacgggaaagucagaggccuuuaaaacaucauuuccaaaaugaaaucacagaaagauaccugauggaugugagcagauuaucuguauuccauucuuggggccaaggagcaaaucagcugcagaacauguuuugaaaugucucuuuguaaugaauguggucaaugaaaacgcggagccaucagcaggaggcgaccgucccaccgcaagaugaagaaccucccgugauaccauucaagccccacgagcuggcagagagcaaacagcagcuucauacaggcugcgggugcugaugaaauggaaaaggcacuucacacaucuugcacacgcaaauugcaucaggcggaguauucuuugcaaagaaugaagcacuuccuccuccuuggcuccuaugagggggagcggugggggggcgucuggagcagggacgggccggccucaggcuucucauccccucgcucugggaacaacagaaaugcaaacacagcaugucuuccugagccacgggcacggggccgggcacucggucacccuuuccuuccgcccauuccuugugggggcagcuccuggucccagugaccucccagggccgggcaguaaccuucguggcuggacacacuuggcccaagcauccccugguaucuguagucuccgguuccggagggcaccucgggcacgagugacccuuggcaucucacggggucucuuggaugcuggcuccugugguggcuguggugucauccauccugcugguguuuauaaaccuccugaacccucuauggaaacacuguccgugagggcugacccccuuuaugucccguguccuggcuggaaccucaagugucuuugcagagcuggaggaaagggcaguguuccaggcccaggagcugucagccauggacguccaggacugcagcgccgggggcggccugugcugcugaccagccccuggcccugcgggaagggcagcagggggagacuggcccuggaagguuccccacuguggucuggggccggauggggcuggucccuucuucaguucuggacgcuggugcuuuagggaaaugccugggguuucagcuacagccugagacugccuguguggcugucccuuccccagugacgcugaacgcaugugcacaucucccuggucacgggcaccauccuggcaccaacugagucucuuggucuguuucugagcaccuccccucccuuggggagcguggagagaagagccugacacagcuuuguccccgaggcagcaggaggccuuuccuggggcuuggagggaucucugccuccccagaaacagcuccuggcucugaaugcccaagagccugagggcagagaggacgccagaggugguguggagcguguccaucuccuaaacagcgcgcuccuccccgugagccggaacccgacgcgugucugcguggagcguguccaucuccuaaacagcgcucuuccccgugaaccagagcgggacgcgugucugcguggagcacguccgucuccuaaacagcgcucuuccccgugaaccagagccggacgcaugucugcguggagcacguccgucuccuaaacagcgcucuuccccgugaaccagagccggacgcgugucugcguggagcacguccaucuccuaaacagagcucuuccccaugaaucagagcccgacgcgucucugcguggagcacguccaucuccuaaacagcgcucuuccccgugaaccagaguccgacgcgugucugcuuguuuccgagcugcuguuugugguuugaguccccaugcagggcagcggagggagguggcaagggcuguaacacaccaaggucagagccgccggccucucccacauugacauucugugcacugccugugugugaucaagucucccuccggagcgcugggcccugcgucagccucaggaaagcuacagacaagauaggaaucaugcgucuccccacccugagcccagcaggcugugccaggugucaaguagcuggucagcguaucagccacacagcauugcuaggagggaagaggagaccccuucgcucugcucuccccgcugcagucagggccugccucccgcgcccgccagguggggccuuggcugcacagacccugugcccacugugaguccaggagccucgggcucaggccccuccuccccgcaccccuguccuccuucugauggcgggacagugacccuggcugugcccacucacugaccagcagcauacugucuccguccuggcagcagcugugcgaggcaggcuuuccugucccacucgcagaggaggacacgcucaggugcuggaguggcuugcacgguacggccacagcccugcugacuguacccacgcgccccuccaccccugcaggagcaucgaaggaucggaugcaaccagacggguccccucugucagugcccggccugugccaagccacagcaggauguccugggggaagccuggagaaaggagugcugggcccuggacuccccccagcuuuggggggauggucaccaaggggaggugcugggcacguggcagccucggggagcaccuuccugggccagcuguaggcccgucccaagcugcguccccugccugcgccucucccugggccgccucugcccccugcagggcuccgugucaagcuccuucagcggggugggaccucgaaugccguccaugucccacaccucgcgugucagggucugcaguggagcacccaaccggcgucucuccccaggucuccccccagccuggagguggccccuugugccccugggccccuaccuguccagcagcagcagcuggggcucccuguccacugggagugcuuccucaagcaugagguuuuggcaggggggccugugggaccaccacacuucuccccaagggcacaccggggauggcagagggucgugggaaaguguugacccucgucagguccccggggagccccuggcaggccguucuguggcuggaugugaguuaagcgguucagccgugugugaggcuccgugacaccagccaggacacaccuggaguuguggggauuuuuaguugccuucuggugguagugaaaccgugcagccuugcacaaguguuccugcauaggcuccacuugcugcccuucccggccccacucacauccugagugugugcucaggccccucagaagaaaccaaacuucugaguguccccuccccgccccuagccauggaguggccguggcugaaguggaagagauucagaggcugacagccgaggggagguuugaaccucacuaaaaucauucggagcucacgcucguuucagcauugcccacgcugucuggguaggaggugaauucgccuccacguggccugccguggggcuucuucuugcagcgggcucuccugggugcuccaggaagacggagcugggacaaagugugcccacuccagaagugagucuucagcucaggucuccucccggccuugguuucugacuccuucguguuaggaaggaggcccccaggaggaagcacgcacuuuggcaaugagacguuuuaauugcaucuuaaaauagcauugcaguaaagaacacuaaaccgugacuaaccaauugcacuucaggaggcccucagcacagucagacacggggaagcgcggaaaagcugcccacuuguggacgcccaucaagcccccucaggaggggcuggaugacagaggaggucuacaccgcaccugggccccuuccccagguucagccuucauugcggccucccuggccgugagggacgucugcgcaggagcuccccggggccagcuuugccugaauguggaagauggagggaagaguguuaccguuuaguugauuuacugccgaagaaccuguaaggcccaggaagacagagaaagacgccagaaagagcaucauucugcaggguucaaggugaaccuggcucgcuuucagaggaguagggcaacgagggcacccagacccuaauuacacaggaucccggcacugugccaucggggccucauguguggucuugguggagaaugaccagggcugcucucuagcccccguccuccagaugguccccagagggacugacacacucaaggaaugugcuacugggaagccaggaugccauuucaguaccagcagccccacugugggccucacuugaaggcugugcuggagcccggccucggacucaccccagccagccccugagcuccaggcaguguacccuccccauccgggaaccagccgcaaggcagcccgugugcugagccacagggagggccagcugggcgaggggcugacaugugggacgcagcugugcagcacucagaggcccugcccacccuccccuccaggacacagccugaccgugcccugggccucggcugccuugcaggggcccaggugaggagugggagguggaggccucugcagcugcaggcaguagcuacucaguaaaugaugggcccagcgauggacgaaggacgaaggccucccucggggaccugaagaagcauagcugucugucccucgccggggcucagguggcugcaguuacucagcucgccugggacaggccuggggggccagugagcacgcggcauuguggcagcucaggcaggcaugcgccggaagggauucuggcggccuguggacugggagaaccuuuccagcugccaagaguugcccuuuggauccuaagugcagggccaagcccggcugugacggcugaggccgggcuccuggaggcaaggccaccucaggccuccagggccggagccgcagggagcugcuggguuuccacagggccacgggggcugcggccacacggagcgggagcacaggugggaagggugucugugaaaagugaaaucugucgccgcuuccucuggcuuaauuaccggcaugguaguugcagaguugaaaugcagcuuuaaaagccuuugugaguaguuagugucaaacacacaagaucuacaaagccauaaacucacagcuuggugauauuaccaaguacuaauuaagaaaaaaaaagaaaauucccuuucaugaucaaauuuucagcccugccaaagacgaaaaacaaggcaauuugcagcggauggugacgccggaggguaaguggcguccacaggaagauggcggccgagcgcggcgagcaggcagggucuggcugagggcugggguggugacggcgugauugugccuggcuaccggguucucagccagggagcaccucauucccagcagagauggaaucccagcucaggaaggggagacucaugcgagggcagaagcgaggcacccgcccagaaggauugggggucuccccauuucacagguggggacacugaggcugagcucacagccaggacggggacagcagagugacggccgagaccaucugccccgcgagggaagcagcgcccaccuuccuuggugguccgggaaggccggacuggccccuuggguccccaccggccucagccacugugggcucguccagcuucaggcaggcgcccggccacucaccugggaggcucugagaacgacagcuucugucucgugagugacguggugcccgcuuucauccuggggcccacagcugccaggagaggccaggccgaggucaggaggcucagcagccgguuccgugacuuccucuuugcugaggaggucaggacagaagcuucuagaugacaggccgcucaacuugguauaaaacagcaaauuucugugccugugcugucgggcugugaaugacuucucgucuguuucaugagaugcagcuucagcccagggaggcaucagaugcagccgggcgagacgcggagccaagagcuguccucgccccccaugugagugacuggagagacgaaauucucaaagucuugucacuuacggggauauuuuuaacccaggaccagggaagcacagcucucauugguggccgugugcucuggcgcuugggcagugggcagcagccagguuaucgggacgugcucaggcccaacaggacccccagagccgcaccugccccccacagaguagagccggcccgggagcggccuuggucacaucuaaucccaccagccgccggcaguggagagcugugccuggcccagagauuugggcaucacauccaggcugcaaacgcacggggaccaccuggccccgccaggguuugcucuauccuggcuuggccugcguggccucucgccgucugcacgguccacucacccgagucagggcuggggcaugcagggagugugcagugacauugggcagagggaggcugcucagguccaaguaggcagagaaaccgcaugcccaggccgcuaaaaccuugaacugcaggagcccugaacugcuguugcuguuuuauuguuuuguuuuguugucagauggagucucauucuguugcccaggcuggagugcaguggcgcgaucuuggcucacugcaaccucugccucccgggcucaagcgauucuccugccucagccucccgaguagcugggauuacaggcgcccgccaccaugccuggcuuuuuuuguauuuuuaguagagacgggguuuugccauguuggccaggcuggucuggaacuccugagcucaggugauccaucugccuuggccucccaaagugcugggauuacaggugugagccaccacgccuggcuuguuuuacuguuuaugacgcggcucugcugcugcuaggacagauacuuguacagcccgauucaaagacugugcagaggcgucucccagauaccccggggcgcacugcagucaaggaaggcugccuggaggagguggccuggagcuggggcucacgggugaauuagaguuugucuggcuggguuggggagauguuucuggccucaggaucucacuugcucacgcucaccggcuccagggcauccagcgugcagggagagcagagggguaggccucgggcuccaggccaaaguuggggaaagagagugucagaccugggcuugggggaugacucugaugucguccucaugggggaugguugaggaaagggugggguguggcucacucgucuggcccucgcccauguggaaugcccgccgugcugggccccgcugcaggugcuggaugcgcagcaguaaugcggggguccugcuccgccugggcacgucuuccagcagggauuggggggccgauggccaggcagggucugugcuccaugccuaggugguuauggggggaggcggggagccugggcccuggccguggguggaccuguggcuugcugaccuggugcccagcugccccaccucccaagcugugagaagccaggaccagccccauccuccauccagauggucucugacauugcccugggagccggggggaggcgggggggauguucuaacugaagggccugggcagccuagagcccuucuguaucuucuggccaaugguuuuaucugguccacugccucccaagccugcacaucccaucucgcgcguuuaaacuguuagaaaguuacuccuuugacuaagccggaaaugcucucuauggcccuguggaucugcguccaguucuccacgacauucuguuuuuggagccuuugugaagaggcuggggguuugucagccccacucggaagcgaacaggcugguuccccgccccaggcccagcuuguccugcgggcagcuggccugagagccaagcacuccccaggccauggcaccgggugggcaggaugcuuuccugccaggcagggggcaggacgcuuuccugccaggcagggggcaggacgcuuuccugccaggcaggaggcagagcccucccugggaccccgagugucuguccuggguggggacuagacggugaccaccaccucgaccccgggcaagcccaccuagccccgcccucccaccaagcccugcuccaccuacacgaagcugcggccagccccuuuugcccccaaccuaaaugacugaggagucuguuagggagggccucccuguugcucuaaagagcaggaacaggacaucccugccccagggcacggaggcagcuggccaucugcgagugggacccgccgcgguuggccaagcucaggccauaugagcugggacuggcaggcaguuccuggcugccucaaaucugggguccagacucucugcugaccucccagagcccggcgugucuuugcacacucuguccuuguccccagccuccuccccgccccagggugugccuggaaccuuagguagucuuaccugucagucauaccuucuucucggccagggacuguggauggcaggacguucaccccguggucaguggcugggccuuucucaugaagcagcuugauugagaugucaucuacagagcgugcagccaucaucacagucuaucuuggaaugaaugccuuuaucacccuggaaggaaacgugccccauagccauccucucccagucccagccgucggcagccgcugucuguguugucucuagacuccgcuaccugcaguguugcagggagaugggcucagcggcgaguggucucuggcaucuggcaucuuucgcugagcguaagguuuucacgguucgcucacauuggaccacgugcugacgcuccauuuguuacugaugaaucauacggucuaguguguggauagaccaugguuguuuauccguucauccguugauagaacauuugaauugcuuccguuuggggcuauuacacacagugcugcugugaacauucguguacaagcuuguguguggaaaugcauuuuuguuucucuuggguguacacccauaagcggaagugccagggucacaugguaauuuaacuuugagcuuuguaaggagcugccuguucucccagcuucuccccguccuccccagcacgcgccacugucugcuuuuaugaugcuuuuccaucccaggggcugcgggugccgcuggguuagaggguccgugaaccuccugagauucaaaugcaaaaugugaaguggguguuggcguggguuucggguagagggacugcagccccugcacgggguuaggaauauguuucccaguccaggcagagcuacgcgggaaucaccucuagacacccaagagggagcaguuuugucuggagaagcagcacgcugccguguuucaccaggcuggccugugacagcuggaccugcccccgaugccaccaccuccuccugccagggcuucccuguuugcugagucugcguuauugaugagcuaccaucuguauacacgcacccgugaggccaucaaggcaagacccuucgcccccagaucccaggcccugugcagccugccuugccccucccacugcaacccgaccccaggcagccacugauccuucuguguuuccugucaccacggguucauccacguuuuccagaguuucuguaaguggcaucacgcaguaucuagccuuucucaucuggcugcuucuacuaagcguaguuaguuugagauuuauccguguugcuaugguaucaacaguuuaucccuuuacagucauacggauagaccacaaugucuucauccauccagauguugacgggcauuccgguggcuuccagcuuggggcuguugcaaauaaaguguacagugaacauucacaugcaagcuuugcacggacauuuauuucuuuucucuuggcuaaaucggaacugcuugauuguguggucaguguacgccuaacuuuacaagaaguugccaagcuguuuuccaaagugccugcaccauuuuccauuccuaucagcaguauaggagacuuguaguuucugcacacggucaccaguacuugacaugaucagucuuuuuaauuucaguccuucuaagaggugacugacggcgucucauugcgguuuuaauuugcauuuuccucaugacgaaugacacugagcaucugucccugugccaucuugcuggucuucgcugaagugccuguucacaucuucugcuaauuauuuaugggguucuauguuuccuuaaugaguuuugagaguucuuuguauacuccagaugcaaauccuucaucaaauauguacauugcugguguucucuccuuauauaugacaugucuuuucauucucuuaacaaugucuuuugaagagcagacauuucuaauuuugauuaagucuaacuuacccgucuuuuauuuuauggagugugcuuuugcugucguaucuaagaaaucuuuaccuaacccaaggucacaaagacugccuccauuuuuuuuucuucuagaaguuuuauaguucuaaauuuuacauuuguguucaugauccauuuugaguuuuuuuuuauauggugcaaggucuggauugacucuuuuucauuuuuuauugcauaugaacguccaguuacuccagcaucaagaucauucuuuuuuacugaauagccuuuugcaucuuugucagccugcuaggauuuuaauuggaauuacgcugacucuauagaucauuuuggggauaauugacaucuuaacaauauggaaacuucuaaucuaugaacaguuucucucagcaauguguucucauuuucagugugcggguaucagaggcauuugaaccagagugacuccauuuugaauaaggacugggugaaauaagacugagaccuacagggcugcuuucccagaagguuaggcguucguagucacaagaugagagauaggagguccgcacaagaugcaagucacaaagacuuggcugauaaaacagguugcaguaaagaagcugaccccaaacccaccaaaaccaagacagccaugaaaaugaccucuggucagccaggcacgguggcucaugccuguaaucccagcacuuugggaggcugaggcaggcagaucaugagaucaggaguucaagaacagccugaccaacaugguaaaaccccaucucuacuaaaaauacaaaaauuagccgggcacgguggugcaugccuguaaucccagcuacucaggaggcugaggcaggagaauugcuugaacccaggaggcggagguuguggugagcugagauugcgccacugcacuccagccugggcggcagagugagacuccgucuuaaaaaaagaaaaaagaaagugaccucuggucauccucacugcucauuauacuguaauuauaaugcauuagcauaugacacgacacucccaccagugccaugacagcuuacaaaugccauggcaaugucaggaauuuccccuauauggucuaaaagggggaagaacccucaguucugggaauugccuaccccuuucccggaaaacucaugaauaauccaccccuucauuagcauauaaucaagaaauacaguauaaguguuagucgagcagcccacgucacugcucugccuauggaguagccauucuucuguuucuuuacuuuccuaauaaacuugcuuucacuucacuguauggacucaccucaaauucuuucuugugugagauccaagaacccucuuuuggggucuagauugagaccccuuccugauaacauagguauuucacaucuuuuucagauuuaucccaaguauuuuagauuuugauauuauuauaaaagaguuuuguuuuuacauuuaauuucuguugcuacuauauaaaaacaauucauuuguauauugaucuuuuuauuuugcaacuucgcuaaacucauguguuaguuccaguagcuucuuaguauaucugaugggauuuucuccuuagacaaugauauuaucuguaaguacacuugcacuuccacuugcccacacuggaugcuugugaaguuccuuguucuuguguuauuucacuagcuggaaccuucaggaugaugcugaauacaagcagugagagugaacauccuuguccuguuucagaucugagggagaagcauccaaucuucagccauuaagugugguauucucuguacgucauucauagauacccuuucucaggcugaggaaguucucuucuaauccuaguuugcugagauuuuuuuuuuuuuuuugaggaaugccuguuggguuugaucagaugcuuuuucugcauuuauugaguugaucauaugguuuuccuuuuguacuuuguuaauauguggaauuacuuugauuuucuaggguuaaaccaaccuuguauucuuaggauaaaccccacuuagucauacuacauuaucuuuuuuuauauguuauuggaugugaauugcuaaccguuuuguuuugaauuuuugcauaaauauuccuuaggguuguuccauaguuuugggggggugcggcuuguaaugucuucugauuuguauaucauaguaauguuggucucacagagugaguuggaaagcauuccuccucuucaguuuucuuaaagaguucauguagaauucuugauuaaaacaaacuggaagaaaagaguuaauguagaauugauauuauuucuuuuuuaaauaguugauccaauucaucgguaaacccauugaaccuugaaguuuucuuccugagguuuuaacuacacaucggugucuugauagacauagaguuauucacauugucuuuuucuuuuguggugagcuuuaguaguuuguaucuucagaaguuuguccauuuuaucuguuuucaaagguauuggcauaaaguuguucauaauuucucuuacuauccuuuuaacaucuguaggaucuguagugcuaucaucccucuucuuccugauguuaauaauuugucucuucucuuuuauuccaggucagucuggcuagaaacagcuuuggguuuuauuauuucuacugcuuuuuuguuuucuuucaccauuguugcuuugaucuuuauuuucuuucuucugcuuacuuugucuaauuugcccuucuuuaguuccuuaaggucgaagcugaagucucugauuugagaccuucuuuuuuuuaauguggacauucagugcuauaaguuucccccuaguuucugcucuaguggcaucccacaaauucugauauuuuguuuuuaucuucauucaguucaaaugacuuaacuaaccucccuuuugauuucuucuuugacguauggguuauuuagaaguguguuaguuuccacauuuuuugaaaaucuccagaugccguucuguuacuaauuucucauuuaauuucauuauugucagagaacauucucggaacggucuaaauccuucuacuuuuuuuggagacggagucucauucugucacccaggcuggagugcauggcgcaaucucagcucacugcaaccucugccuuccagguucaagugauucuccugccuccuaccucagccucccgaguaacugggauuacaggcacgugccaccacgccuggcuaauuuuuguauuuuuaguagagaggggguuucaccauguuggccaggcuggucucgaacuccugaucucaggugauccaccugccucggccucccaaagugcugggauuacaggcgugagccacugcaucuggucacauuucuugaaauuuguuuuaagguccauccagaauguuacugccuugguaaauguuguguguguacuugaaaucuguguguauccuguauccugcuggaaugugcuauaucgaugucaaguagcugacauuuuuaauaauguuugcgaagcuuuuauauccuugccaauuuucugucuuccuguucuaucaguuauugauagaugaauauugacaucucugacuauuauuacagauuucucuauuccuucuugcauuccaguuuuuguuucauauauaaauggacgcuuuuaucauuaugaaaugaccuuuauugcuaguaauauucuuugcucugaaaucugcuuuguuugauacagaguugcacugucaguaagcaaccuuggguauaucacgcauuugguuccagaucacugugauuaaaccaauaucacaauaaagcaagugccaugcauuuuguuucccagugcauauaaaaguuauguuuauccuaugcuauagucugucaaguguacaauagcauuaugucuuuaaaaaacaauguacauguucugauuuuaaaaauacuuuauugcuuaaaaaugcuaaugaucacccgaaccuuuagccaguuguaaucucuuugcugguggagguucuugcuuugauggugauggcugcugacagaucaggguggugguugcugaagguugggguggcugugacaguuucuuaaaaacaccagugggcugggugcuguggcucaagccuguaaucccagcacuuugggaggcugaggcaaguggaucacuugaggccaguaguucgagaccagccuggccaacauggugaaacccugucucuacuacaaacacaaaaauuagccgggcaugguggcacguaccuguaaucccagcuacuugggaggcugaggcaugaaaaucgcuugaaccugggagguggagguugcagugagcugagaucacaucacugcacuccagccugggcaacagagcacgacuccauccccaccccccccccccccgccaaaaaaaaaaaaacacagcaaugaagcuggccacauugauugacucuuccuuucaugaaagauuucucuguagcaugcaaugcucucuaaaaccauuuuaccuacaguagaacuucuuucuaucuuggagccaagccucucaaccccucaaacugcuuuaucaacuaaguugauguacuuugcugucauuuuucaacaauguucacagcauuuucaccaggagcagauuccaucucaagaaaccacuuucuuuguucauucauaagcagcagcuccucauccauucaagcuugaucaugagauugcagcaguuuagucacaucuucaggcucugcuucuaauucuaauucucuugcuauuuucaccacaucuguccaucuuccuccacugaccucuucuugaaccaagucauccaugaggguuggaaccaacuucugcaaacuccuguuaauggugauacuuugaccuccucucauaaaucacugauguucuuaauggcaucuagaaugacagcuccuuuccagaagguuuucaguugacuuugcccagauucauuagaggaagcacucugugacaacuauagccuuagaaaauguauuucuuaaauaauaacacuugaaagucaauugucccuugaucuaggggccacaggauggaugcuguguuagcagucauagaaacaacguucaucuccaucagagcccaguaacuaguugcauugucagugagcaauaauauuuugaaaggaauuuuguuuucugagcaggaggucucaacagugggcuuaaaauauucagugcacugugcuacguuugaacagaugugcugucauccaggcuuuguuguuccacugauagagcacagacagagaagacuuagcaucauucuuaagggccccaagagcucauuuaccgucuccauauuagcaguaagccuguucugcuuucuuaucauucauguguucguuggaauagcccuugugauuuccuuuacgaacuucuccuuugcaggcuagcuguguggugcaagagaccuagcuuuuggccucaguuuucaacaugccuuccucacuaaaccuaauuaucucuagcuuuugauuuaaagugagagacaugugagucuucuuucacuugaacaccuagaagccauucuaggguuauuaaugggccugguuucaauauuguugugacggucgugucucaggaaauggggaggccuaaggagaaggagagagaugggggauggcuggucaguggagcagucagaacacacacauuuaucaguuaaguuugcucucuuaugggcacuguuuguggagcuccgaaaccauuacaauggugacaucaaagaucacagaugacagaguaccauaaaagauauacuaguaaugaaaaaguuggaaauauauacgacacagacaugaagugaauccacgcuuuuggaaaaauagugccaauagacuugccagacacagaccuuaaacuuguaaaaaaugcagugucugugaggcacagucaggccacggaugaagcgaggugugcucaugugaacacagggcgaauuggcuucugugagcacgcuguaucugcuucacguuacuuuuaaucuacugcgucuucauaguuaaaaugugcuucuuaaaagcaggauauagcugagucuuaaauaugcauagaaucugacauucucugccuuuucacugggccauuuacauuuaaauugauuacuacuuugauuagauaagucuaucaucuuguuauuuguuuucuguuuguccugucuguccuuuguucuuuuuucuucccucuuuuucugccuuucuuggauugaauuuuuuacaaguucaugugccuccuuuuuugauuuguuaacuguauuuuuuacagguuguguuaggauuuagggcacguagaucuuuaacagucauccucgaaugauacgacaccgccuuauguguagugugagaaccugacagucacauacuuccagucuucuccuuccugccuuagucaucugcuuauaauauauuuuauuuaugcacaugauaaaccccacaauacuuuguuuuuauuucuguuuagucagcuaucuuugaaagagauguaaauaauaauuguaaauguuguauaugucugcccaugcagcucccaccccucauucauggaaggaguagagcuguucuuccuucuucuuguguaggcccauguuuguuuuuauuuuuauuuauuuuuuuugagacagagucucacucugucgcccaggcuggagugcaguggcacgaucucggcucacugcaaccuccgccucccagguuaaagcgauucuccugccucagccucccgaguagcugggauuacagggaugugccacugcacguggccaauuuuuguauuuuuaguagaaacaggguuucaccauguuggccaggcuggucuugaacuccugaccucaggugauccucccaccucggccucccacagugcugggauuacaggcgugagccaccggccuggccuguuguguaagccccuguuugcauccucauuuuccuucugucugaagggcuuccuuuaauauucuugcagugugaaucagcugcuuuuugggauauuuuaagcucuugcacaccugaagaagucuuuauuuggggggagauauuuccacuggguggagaauucugggcuuugucuuucuguacuuuacagaggugaucucacugucuucuuaauuccaguauuuccucugagaagucugcugucauucucaucuuuguuccucugucggucaguugucauuucuuccucugacugcuuuuaagauuucaucuguacuacugguuuugagcaguuugauuaugauguacuuuguguacuuuaauguuguuuccucccccugccuuuuuuuuuuuuuuuggugguugggguucuuugaacuucucagaucucucaguuuacacuuuuccacacauuucagaaaauuggggccacuacuuuuucaagacucuuugcuguccccaccacuggcaaccaguccuugaauaacaucgcugcagaacucacuggcucguggcuucuggggucaggaauccaaguguggcugagcuggcucucugcucagagaccucaccagccacaguccucuuggcucugcuggggaaggucccacguccagguacacccauguggccgucggaaggauucugcuucuauccgugguugggcugccgcgcuugguccuauggcagcuccucgccgugugggccgcucacgcauggcagcuggcgggucagagcucugagaaccagggugggagccgcagaagucacggcugcugugacgugacugcagaggggaagccagcacuugcgccccacuuugcauccgcuguaagucacgcugaagggcuggcgcugaugcggguggugccuggagguggggaccaucaggagccauuucagaagugccaccagccugccuccaggacuccugcccuacgugucaggccaugugacgucgccccacagcccacgcccaaugugcugccuccuuuaugucugucuuuccguuuuuuccuuuuuguuuguaugcgcuuuucuuucuuuuucucaucuguuucaucucggacgguuuccgugguuguaucugcagcuucacugauccuguuuucgccaugucugaucuggcauggauccgucccccguacuuguugucuucauccuuagaaggucaauuuggcucuuuuuugucccuuuuaugucuauccucaauuuuuugggcauauggagcaaaguuacagugacuuaaugugaucugccgcuucugacgucaggucagcccuaggucuguuucacucagcugauuuucucuuuguugagugcugcgaggcugugugugcaugugugcgugugccugugcaugcacguguguguguguuccuauaaauauucgugagcucuguucggagacacaguucagguacuuggaaacagccugguucucugggucucgguuuaggaaaugugaggugggagcagggcagcgucugucuggggcucacaccgccccuugcugcgggguguccaucucagugcugugcccuggagccgccuaguucgcaggcuuucccgcgaggcugccggagacaggcacugguccagcccagugugagcuucgggugccauuuucuggguuuuucucucuaaugcuccagguuuucucagccucucacugagcacuccagcgaacucagcccuccucuguggcacucuuuucggcgcccuggcuccagcuccagcccugucccucaacucgggucccgcgaggcccugccugggcugugacugucuccccaggcucgccccgucucucagggcccgccacccuuccugacugaaaacuguuguuucacauuugaugccucauauucuggcuguuucagauggcaggugcaucuguccuuguggcucugucucggccggaagcugccggccgcccucugaggugggaaaauaggcauuuugucuccauuuuacauucaggaaacuucagcucagagagacaaacugaugggccccggggcccacagcacauaagaggggcagccucacaggagggcgggccugcaucuccggcccuccucaccccgcauccccagcaucacauugcccuaagcguggcgcuccacgaaacgucacugccagcagcaugggccucgccugggugggaggugagaaggcgcagaggccgcugacguccucuccuguucucauucggcuacaucuggaaaggguggugcugucuagcccgggcccaggaggggaggaccccacacccgggacgggcucaggaggggaggaccccacacccgggacgggcucaggaggggaggaccccacagccacgcagggcucaggaggggaggcccccacacccgggacgggcucaggaggggaggcccccacacccgggccgggcucaggaggggaggcccccacacccgggcggggcucaggaggggaggaccccacacccgggacgggcucaggaggggaggaugccacacccgggacgggcucaggaggggaggcccccacacccgggacgggcucaggaggggaggaccccacacccgggacgggcucaggaggggaggcccccacacccgcgacgggcucaggaggggaggaccccacacccgcgacgggcucaggaggggaggaccccacaccugggcggggcucagggagccacugggcgagggcugugcugcagcuccucccuccucacccgugugccugaucugagcaccuguccucccugcccgcugcguccccuuucuucccuuaaccuucauuguguucugugcuccugcugcccucggggccagucccugucuuuuaacccacacucagccccuucucccaccuucuccauccccgccaccuccucuaacucaucccuguggccuccaugcccuuccacggcccuuggagccgcccguggcggaugccacucacagcaggggcugcgcaggccgccccaccccgagccggcgcccccacucccucggcuccccuccggcugcggcugcaggagcagcugcguguggcuguaaagcagaacgcccgugugcgagggggagcuguauaaauagaauaauaauaauaauaauuguugguuugggauuuuucugcgacugcuggggugccuggccuugcccgccccgccagucacucuugaaggaaaggucacccucgccgggaagauaaaccccaauaacgcugguauaauuagcacaggcaguauuuagaugcuuuccucgguacaauuaggcaggaauaauuggcugagcuauuuuccccgugccggacacacuuuuugccagcuuccguucuuuggaacuucaugccgggacauuuguucucggcguucuguccaagcuguccugacccaguugccgccaggcccucagcgcggugcucacgcggcagcaucugcgaggccucuuuugggcccggcugugucgucucccccgagggacgccggagggacaguggggcagagaggggugggagcugagggucgugcacacagcaggguguccuggggucaaaccuggaccucuggaccaggagcuccgcggagcugagcugggcugggccuggagcuggagggcuugugcaggguggggcugggccggccaugggcauccaugagggagugaggccaugagcgggggagucaggcauaggcuguaacaaguccuguggccagccuggaggaggaggcccucggccgagguaauacaccagcagcgagaagcuugcucucucccuccucagagcgcggacgggccaggcagugacugucagggcucggugguggcugcugcuccuggaucaccuucgggccguggaugugcagcaggcaggcuggccccacagcaccugagacuccugugcagagcccagcugugaguugugaggcugccaggaguccucgguaucccggucuaacagguugcguagaccacgguagcaccagccauuuucacgcuguacccggcaggcucagcacggucuugacguuaucacgccugaacuuugggauacagaucacugcugccgaggucaugaagccaagcuggggccgcgccgaccuccaacccuggggcugggaccgugcuggccuccaaccccgccuggggcugggacugugccgaccgccaacccuggggcugggacugugcucaucccagggcugggacuaugcugaccuccaaccccggggcugggacugugcugaccucuaacccccagcagcaccugcugggaugagagcacacauuacccagguuuaucaccucuggacccugaugccaugguccaaggccuucagccccugagacguuuuagggaagggagggcagcccuggccguggaggcucgugcagagcugugugcauggugagacugcccagcacuguucacaggcgcucagacgggcaccgcaaagacccguggacagagcugugccccaccugggauuugcacaagcccaaccugggugcccuggccgcugggugccgaggggcuugggcccgugucucucacaccucagcagcagcccuaugacagguagccucagcggacucugcuguggccaccugaccagcgccacccaccccaaccagcuggcugggcucacgcugugacccacgccuggcgucuguggugccaccagccaagaugccagccaugacgccagccuggcaccccaggcccaggacaucuggggcaggugggugggcagcaccggccucagcagcccacagaggggccucccacagagugucuggagacacuccaggcagacgggcagaugagcaagacgcccgaggguugcaggccagguggauaaggauuggggcuugcauguguccgcaguggggaacccgugugcucagcggccugucuugaagcuguuccgcucuugcagauauaauuuagauauacauuuuuccuaauuacaaauaugcagcauauaaaaaaaucuggaaaaugcagagaaccaugagucacuuuccgucccagcacuccgaguuaaccgccauuaacauuuugauuuucuaagaguccuuuugcacucugugagugugggugugagagugugugucgugcugcagugugaacuugaaggguuuucucaccccugaaguucagggcugacucucggcggacgcugcugagucuucuccccggcucgccccaugugugcaugaaagugccugggacgcgucagauucucaacuugagacgcccggagagucuuuugaaguugaaaacacuuugauuuccugacagccucaagacaaaaaaaaaucuccccuucgcuggcuuugagagcagguguauucuacaagcgagguucacagggaccuauggcugccccggcagaugccauccaggcacgccccucuccucucccgcggguccuggugggggagccucugugggaagccugggggcuccggggccuggcagacaaccaguccugcugcagcgagguggggacaaggccgggagcagcucacuucccaguagaggccauccgauggcgccagggcacggggcagcugcuguccucauggcccgggguaacgugggcacaggguuuccucaucccacugugcucugugucuccccugagcccggugauuuuacgcaccugacuucguuagucuucucggcaaugcccagcgugcagaccaggcucaagagaggugugucggugugcccagggucacgcagcuuccugguggccaagccgagguuagaagcuaguucuggugggugcgaaagcccccgaugucggcagcucugccaccaggcccgcacaagcaggugguguaagaggggaggcguuggggccggcagugcucaagucaggauugagccgucuaucuggaaggucuguugagggugugugcugguggccgggaggugguggcaggcugacuaccugccauuuuccugcagugccuaggcccaggagagggagcagcccccggucaggacccagcugcaggacaccccauccucauggaccuugcuucccgcucuccguccccccacaaaugggcucccagcauaacuucccccgagggcuccuuuccucuccccacacagagcccugcuccggagcggcgcuugcagcacaccaaugacaggaggauugggcuucagggaagcaggcgccuggagcuguguccaguuaggugcguggcgcuugcagauccaagcaugaaauauucaugccucccccggcccagcagcugcggcuucucaucuggaacaagggggugcuucucccaggaaggccagugggagcaggggugugucugagaaugccugggcgcucugcccucacgauggccgcugaugccacaggcccggccucugugcccaggccacucuccagccuggugaggucuguucugggaaaagagagaagcaagacagaugugggccuugcccuguggggccagggcacaggcaggaaucccacuugggguuaagacgcugcagucaccccuccaggugccaggguccccuguggccguggcguucuaggagagaugggcagggagacgcuggcgcccugucguguagcuuauccuuguaucugcuucacaggcucuuccacugugcaauuuccuaaaauuuuggcgaggcccauuuauccauuuuaauuuuauucuguggauugugcuuugguguugagugucagagcucugccucauccagauccugaagauuucuuuuuuaacauaauucuguguuuuacauguaaguucgugauacaguuugaguuaaauuuuauuugagaugugagguuucggucaaaaaaauuuuuuuuuaacuaaguguguccagcuccuccggcuccagcuguagcaaagacaaggcugcccuuccuccacugaagcgccuuugugacuuuucugugacuuuuccguaucgauuaauagggucauauguuguuuauucuuuagccuguugauauagcagauuacauugauugauuuucaaauaccaagcuagccucguacaccuaaacgaagucccacuuggucacggcauaauauucucuguuagaaaguggccuggacgcgucugugggucucuuucgaguuccucuguucuguucugcuggucuccacaucuccccuccagcgcugccccagccaugucugucugacguaggagccguauaacgcugugcuguagcuguacgguucucaacaucaggaagggcaauuccucuacucuucuuuuuuggaauugcuuucuauauacauuuuagaauaaucuugugucucucuaccaaaaaaaaaaaaaaaaaaugcuggccgggcaugguggcucacgccuguaaucccaacacuuggggaagccaaggcaaaaggaucgcuugagcccaggaguugggagaccagccugggcaacacagggagaccccaucucuaugaaaaaaauacagccaugagugguggugcgcaccuguaguuacagcuacuuggcacguugaggcaggaagauugccugaggcugcagugagccaagaccacaccacugcacuccagccugggugacagaauaagacccucuuuccaaaaaaaaaaaaaaaauauauauauauaugcugagguuuggacagcaauuaccuuaaaaccaaagaucaauuuuggaaaaauugauuuacuauaagucuuccaguucauaaacauuguaucuauuuauacaaacauucuuuuuauuccuuucgauuccuuucaucaguauuuccuaacuuucugcaaacagacacuauacaaguuuuuguuagauguauacccgaguauuuaagauguucuguaaauuauauugccuuuuaauuuuguuuuucacuuguuugcaauugcuuuauagaaaugugguuaauuuuuguauguucaucuuauuuccugcaaccuucguggacucacuuaguguuccaggaguuuucugcagauugcucaggauuuuccacgugggccgucacgucauucuaggaguuuucugcagauugcuuaggguuuuccacgugugccgucaugugauuuccgaguagggacaguucuguucuuuuccaaucccuaugcugcugcuuuccuuuucuuaccugcaugcccuggcgugaggagcucccaugcuggguugaggaugaguggggaaagccagcucuccgcugaccgaaugagggaaggcggccagacucuuccgugaagcagcgugagcugaggguucuucguggugcuuuuuaccaagucggaggacuuucccuugauuccugcuuugcaagaguucuugucaggaauggagauuaaauuuuuucaaaugcuuugccugugccaauaggaucauaucauugucuuccuuuagccuguugauaggguggauaacauugauugauuuucaaauuugaacuagccgucguuguacaccuaaacugaaucccacuuggucagggugugauacucuuuuucguguguugcuggauuccauuuguuaguccuuguugaguauuuuugcagcuaagcucaugagagacugauacuuauuuuucuuugugugcgcaccauccuuguugguuucaguacaggguucauaguggaaagguguuucucugucuuuuguuaacugaaaaaggauuguguaaaauugguauuaauucauauuuaauguucgguaaaacuuucuagugaaaccaucugggacuggagauuuugaguagcauuuuaauuagaacaaacuugauuuauuuaaugguuauaggacuaccgaggcuauuuuaucuuggcacguuuugguaguaugugguuuucgaggaauccauccaguuuguuaugagcaucaaguuuuguuguaguauuuuuuauuguuauuuuaauagcuucuggaucuauuauaauauuuccauuucauuucugauauuggucauuucacucuccccccccccuuuuuuuuuuuuugagauggagucucgcuguguugcucaggcuggagugcaguggcacgaucucggcucacugcaagcuccgccuccuggguucaugccauucuccugccucagccucccaaggagcugggacuacaggcacccgccaccacacccggcuaauuuuuuguauuuuuaguagagaugggguuucacuguguuagccaggauggucuugaucuccugaccucgugauccgcccaccucggccucccaaagugcugggauuacaggcguucccccuuuuuaaucuuugucaguuuugccagggguuuaucaauuuaucguugcuggucuuucuaacaaauuuuugagacaggguuucacucuguugcccaggcuggagugcaguggugugaucauagcucacuacagccucaaacuccuaggcccacgugaucccacauaccuggggcuacagguguaugccaccacaccuggcugauugauuauagggauggggucucacuguguuguccaggcuggucucaaacuccagggcucaagugauccucucaccuuggccucccaaagugcaaagauuacaggugugagcccugcuccuggccggccuuauugcuauuuuuuaaagaagcaguuuuugguuuuaauaacuuuuguuuuccuguucauuccuacuuguauuauuuccuccuccugcuucgggcuuguuuuucccuucguuucuugaaguaggaauuuagagaagcgauuugagaucuuucuccuuuccugauacaggcauugagugcuguccguuucccucuaagcacugccuugggugcgucuggcaaauuucauuaugcuguauucuuguuuccauucuguucucuuuuuuauuuccuucgaggcaucccauuugacucguggauuacuuagaagugugcuguuuaauuuccaggcacuuacaguuuuccuguugucuuucucugacugguuucugguuuugauguccacugguguggccuccaccucuucacgccaccccacagaugaacagcauucacauaacuucccaguaucucgaaguagcaucguuuccauuuccugcgugucuucucauuuuacugcauuauuucagcuuuccuuguuugagccaggauucagggcuuccuucauuccaucucuagcuuccuccccucgaguuucccaguucauggaguuucucuuggacccucagcagcagggggucuuguucuugacaggaaucccucacacuucccccuuggccuccgagccccaccacauccugcgguuggugguguguggagaaagugguguguggagagaguugguggugugcgcugucucugcucuccaagcccuuugucagcccccaccccucccucacuccgugccucuuguccgugcccgcugggacaccauggggcucggcucaggggauggugggaccagcgcuuaguaagacuagucagcccuaggcaccgagugagcacugcucacguggcagagcuggaaugggggccgggcacacaaucccuggcccacguguuccacggacaugcugcagagguccccggcccuccagggcaggcccucucugcuuccagaggggcaggugagccccaggccaggccagcgagggucuggacuagagugcaguggccacaauggacgccgcgagugucuucauuaagagugagugucucagucucccccagggcgcccgccagccacagggccgcuaugugcgcagacuagacagguggcagcucgggccggccaggcagagggagaggaagccagagccugcgcgcaggcagccucagaaguauuuccagccacagccaacgugucuuacuggcaauuugcuuuuuaaaaaauugcaguuuaauuuuaagugagcagcccguaauuacagugauuuacgagguaccuggggacugugugauauuugaacauggcagagggcugagcagcgauggcagagauggaugggcccggcgccacucauucagcagguccugcuaaugccggagcguuagaccgagguggagccucccaauguggcuggguacgcugggggaaacggagucagaggugggcugcacagcaggucgacuuguucaccgggggcugguguuuugcaaacgcugggucugccuucgugugggguuugagcugggagaguagcacugguuacuccugccugucuccguccacccccacccccaccuggagggcagcgcgguauauuagggcaucauucuuccagagccgccugaggccggcagagaggaggugcuguaggagccgugaguggguugcccggccuaccauugggagcagcugucuugcugacgcuggcggggugcaccuguuucaaauaaagaaugaucagagcucacgccuguaauccucacgucgugggcagcugaggcaggaggaucacgucaggccaggaguuugagaccagccaggccaggaguuugagaccagccugggcaaaauagcuaaagucuaucuaucucucaaaaaaauuuaaaaauuagccaggugugcuggcacaugccugucauuccaacugcucaggaggcugagguggaucacuugaguccgggagcucgaggcugagugacccguuaucaugccacugcacuccagccugggugacagagugagacucgucucuaaaaaaaaauauuuuuagaaaugaacggccaggcucccaaagccugccagccucugagggccggggaaggcgggugccuggaaaacagcuauucucugguccagccuggccagagucugcaccacagugcgucaggcccagccagguugccagcccuggguugggaggagggcgaagggccggcugaggagacuucuucccacacugccuccccaccccugcccggcagcugcaggagaaucagccccucugacauuuagggggagaaauucagaaucaagagcagaaggcagaagugaaaggauuuucucagcgaaaggucagagugguuucucuuguuuuuguuuaaaaaugguuuguguugaacuaugacaaggccaaauguacuaaggcagcagaaacagggggagggcagggggagggcacggggacggcuccugagaaacaggaggugcaggaacaggucaggucgcagggccucuggggcagcacgugcuccaaagguggugaggggaggggcgacaccaucagggcggggcccagcccaggcaugcuccgguggacaggggagcugccaggaccaagcuggauggagccaggccgcccuguggcuccuggggaggguucccagagggcugccgggcggagggagcgcuuuccaaaacgguuuccugagcuccgaugcacacacaugcagcucacccucacgucuagcgcuccauuagucuaccguuccguuccucccggcacauucagugcgcagccgcgaccagucuaaccguggcacauuuccacuggcccugagcccugacgugccccuccaggacauccccugggcacggaguugugucgacaggucucugugacuggcugggcguguuuucgggguuugcccgcguggcagcguguaucagaguucggcuguacgaagcgguguugacggguaaacccgguuuugugucucccuccggcgguugagggcugguuccgcguuccaucuguuggugaugggaucguguugccguggacacccgugccgaggucugugcguggacugcgcucagacccccuggcugcgcgcccgggcgggugcugggcccauggacucugcguccagcucuuugaggagcugccggcuguuugcaguggccgcaccacacacgcucccgccagcgacgcggagggucugauuccccucgacccagcagcucauggugguugcucucaguggccgucggcgcgaggcggcuccgugucucgcucaguugcgguucacguuuccccggugcccagcguccuggcaugagcucauuggccguguguggcucuucucuggagaaauguucaagggccccuuguuuaauuggcucuuuccucuucaugguggaguugugggaguucugggcauauucuggguacaggacuuuucagggacgugguuucagagggagcuuuguggugggccggguuuguguccugccugaccuggggcugugugggugcugaccgggguggggcuggcucucgggggcagcucagaagggccucuguccacuccccacacagcccaggaccguggcacagcagcuugcucagaccugcugugugacuccugcccuguguccccuggggccugcagcgcugucuggaagcuccuccuugcccguucuccaguuacaggaggccgcccucugggcugcagaauccacagagccagacucccccugggcccccagcgccccccugcacaaguggggaaacuaggucauggggcccaggcaguguggaaggcguugcaggacuugcccagggcgugggguccuccagccucagugaagaguggcacuagggccuggcacaggugcuggagccccccagguggaggaaggagcaagguggcagccccuugggugggcacaccccacagugccugggacccccaacugccuggguagaugacaguguagacaacagagaccuugcccuggguuaauucagucccuuuaggugaccuggaauaaggccuggcaggguugaggacgcaucuaccccuguccagguccucagacugagggaagcccccauggcuggaggggcuguguagggagggaggggagagggagaggccugucgggcugaccgcugucuugucucuuucuugacugccccgcaggccaccagccccucggguuccaagaugcagcuacuggagacagaguucucacacaccgugggcgagcucaucgaggugcaccugcggcgccaggacagcaucccugccuuccucagcucgcucacccucgagcucuucagccgccagaccguggcguagccugcaggcucgggggcauagccggagccacucugcuuggccugaccugcagguccccugccccgccagccacaggcugggugcacguccugccucuccagccccacagggcagcagcaugacugacagacacgcugggaccuacgucgggcuuccugcuggggcggccagcacccucuccacgugcagaccccaugcgucccggagccuggugugugggcgucggccaccagccuggguuccucaccuugugaaauaaaaucuucuccccuagacac

SEQ ID NO: 191564 - RNA, 8924 nt, Homo sapiens
ggucagaggccacgcccccggaagcggcggugcagguacgaaaagcgcgcgcggggauuccaggagucguggugaccagggaggggagccgggccagcgggcggcaggagacuaggggagcugagccaugggcuugggggagagcggggccgggagcucgaaggagaccagaagagcagggucgggggcucgagggagacgaggagagcggggccggggguuugggagagagacaaggagagcggggcggaggcuugggggagaccaggaguaaaucacaaaaauuuacuuuggaaaccguggcuucuggcagaaacagaucagugucgggacaaaguacacgggccuggugugaaacuaagccacaaacccauuuacccugucugaccugccuccgccaccaggacccagucucagugaaaugggaaagguucccuuguccuccucgaagggcgugcgaugaggauguggcucacuucuucagugccccgcuucucaagccucuaggggaacauacagacaggcaggcugaggggcucccaccccacggcagugucuaggggugaauguuugcagcuccugaagccccagcaggcauguguuagagggugcucuuucaguuuagccuuguagguggcuuguguuagucagcuguuagacucccugccuuaucgcaaggacagagggcuuucuguaucccuagguuucuugccuugauguacuggagcaaucagaucacacggcggcuuggagagugagugcaagguuuuaugaguggaauuagcccucagcagaugggggagccagaaggcaguuggagugggaaggugauuuuccccuggagucgggcugcugagcagccugggcucuccucugaccgccccugccaaacucaugguuccaucaguugauggccugcuggugccuguuggugugcuuuccacguccucuugacguccagcggcuugugucucugcccacuauaaaaaaccacugggguuuuuuuauaggcacaggacggggacguggcgggcucgggaaaugcaacauuugggcaaaaaaacagaaaugccuguccucacccaggucccugggcacaggccuggguguggagcccuggccagagaccacgcccuccucuacccagcacuucccugcccccuuccuuaucaucuggucccuuuucucagacaccacaacuuccaagaaggaucacugguccugaacccugugucuuguccagguguggaccccagaaaaguugguccuggcugggcgcaguggcucacgccuguaaucucagcacuuugggaggcugagguggguggaucgcuugagcucaggaguucgugaccagccugggcaacgugacaaaaccccaucucuacuaaaaauacagaaauuagcuggguguggcggcucaugccuguggucccagcuaugugggaugcugaggcaggaggauggcuucagccagggaggcggagguuacagugaaccgcgaucacgccacucuccuccagccugggcaacagagcaggaucuugucucaaaauaaauaaaggaaaguugguccuggcccuccagcauuucuccaggguccuuuuuucagcagggaccuggcggaggcaucgcccucagaguccucuggaccuggaccugcacaccuaugggagcaggaaggacccuugugacuuccaguggccccccugggugccaggucccacaguagccacagcaggagcagagugggugggguauaaacuccuaucacaggagggaggacuagccgggccuggcuggguggaccugugucuacagccacacauuuccugggaaucuggaagccugcuacagagaggccaggucccacuagacugaaagaaguuccuguuaauccaaaggccugaccugaggaccacaggauaaacugcgugguuauuuuggugccaaucaggcacggggacuguuguuccucacugugugccuauaagcaggggguuccuggggguagacgcaggagcaagagcacgcucuggaaaggugauguuguccucugcaccugaguacugacuuguggagaaggaagguagcgccggccucugcucugcuugaucagcccugcugaccacuggguucuguuucuaccccagaaaaucacugguucaauggcaguuuuccaccugccacaagggaagccacacguggcagggcuggggaguuacagcauacccccccgccccccacugccucccagagcacguccccuuccuccuggccccuggcacgugcuuccuccacgcacgucauggcugacucugcccucucaccuuccuuucagaacccagggaccaugggcgccuccaggcucuauacccuggugcugguccugcagccucagcgaguucuccugggcaugaaaaagcgaggcuucggggccggccgguggaauggcuuugggggcaaagugcaagaaggagagaccaucgaggauggggcuaggagguaaggauggggcaggucuggccauagaaccggcuuucccagggcacagggauucgggcuguagggccacacccuugguuucaccacuaagagcuaagugaccuggagcaggggguuaagcgugagccucagugucuucaucucagaaugaagaacaguccgcagcccuucggacucuugugaagauaaaaugaggaaaugaacucgaaggacuuagaacggugcgcggugugcggugcgugcugagugcguguuagcuguuguggugcgguggugcugggggcugcagggcguaucuggaagccucugugcagcagcuugaauugaacccucccagcacccucacuguugccgaagggcucgucagucacuugguuccucugucuguucaguggagcugaugaucgcuuucaucucacacucgcugugcacaaagccucacugcauccucaacacagccagcuucaccuaggaaggaacugaagcccagagagguugagccguuuacccaagaucacacaguccuccagacgccccucaacccucacaggguaaaugagaucaucuguguaaacaucgcugcacagacguuagcccccguucguguuuuuguucugagaaagguaggccagcuugccuggagaggagaacuacagaguaaagaggguccuggcacggaggaaagccaggacgcugcagccuaguggcuuuccaauuuuuucaucacaaccugcaguaagaaauacguuuuguacucugauagaguguacacacucaggugugcagguacagcuaaaguaaguugcaguagccgcccuuauuacauaaaagggggcucuacuuuuccgauucauuucucuuuuuuucuccagaggugggaucucacccauggcacacucuuggcucacugcagccucaaacucuugggcucaaacgauccuccugccucagccucacgaacagcugggaccacaggcacaugccaccacgcucaguucguuuuuuaauucuuuguagagauggugucucauuaacucccaggcucaagcgauccucccucccgggccucccagagugcugagauugcaggugugggccacuggcuugacccuuuuuuuuuuuucaauugcaauccacuaagccgauuucccgggguacaugggucccaacccucaguuuggagagcccugugugugcuuccccuccaaggcuugggaccccagaccgcagccacacggacacguucgaucagucacuguggcaggugccagugcgacaggcucugugcugggggccgcagcuggggaggaggaccacugggugugagucgggcauacagcgugucccugccaggagugugugcagagcgaccacagcacaggaaacaggaaagguggccccggggguucucugcccagcccuuugucuuugaucugcuaagacugcccaucagcucauggauuucuguagcgcugcucuguguggggccuggggacaugaggaggaacaggucagucccugccucuguggagcucucgugucaucuggcugccggguucaggagaccugcagaaggaggucugguccauaccucguggccaggggccuccaggagaaaggaagggagaauaacugggcaccaggaaaaugcucugagggccugacguuggcugggagaguguggaaggagggaggaaggagacauuugcagaagcacagagggcuggaggagcgccagcugugcagagaaguggugggugugaguggagcaggcagcggugcugaggaggcuggauggaggaacuccagguggcuggauuuccgcuucucguccugcuggugacaagcaaagcacaggcccccucggcagcccugcuuuauuuucuucugaacuuugucacggucgaaggaacuuuccuccuacccucuguaaauauuacacaaacagagggaccaucacuccagacccucaaagcugaauacagugguggcuugcugucagaccaggguuugagggggggaacugaggcacagagccggaagccugugacuuccauccucggguguaaccuggagacggggguuucaccauguuggccaggcuggucuugaacaccugaccucacgggauccacccgccucggcuucccaaagugcugugauuacaggcgugagccaccgugcccagccgagacccugucuuaaagaaagaaagaaaaaaauccuucguuggggagcaucugcaagcaugaggaaugggggacacuggagccagacaggcuggugcuuaggggucccagggccccgggaacccagcagcaaacagccucgcccucaggggaugacguaccaucagccacaggccaccagcacggcccugggcuucaguaccugcgagucugaauggauuugcuccuggggcaaccccaggcccgugcugcucaggagcgggaggcagggaggagcgucggcagcccggucucuggggaggcugguuccugcuuuauccacgcaauacccaguccuauucuaucaggaggaccccaagaugggcccuaacucccaggccaagagccgguuuaggcacccuccccgcuugccugcagggggcaggccugagcgccuaaccccaguccagagggcuggacucagacccuccucuguggggcaggggacaggcacguagggaguacugaauugugggggugugcagauuugggcuucaggcgcacagugugagccgaccuuucuagacagcaucccugguccccaaagacuagcgaggccggggacacaggagcagcgaugggaagcaggcccgccggaaccuccgacucccaccuccccacgccacggacgcugcaccacccuguguuuuuguuucauguauuucucacccuguuccccguguuccgccuggggaaccgagugccauggacagagcagacacuugggcagaacugaacagcgucaucuucgccugccuggcgcucccugccugggaaauggagcuucagcucugucucccggcggauucuugaugcuuccuacgcugccaugugcuagggaagauuaacuaaaaucagucacaauaucccacugggaggugacgcuuuuuaagacgagcaacagccggccgccaagaggcgggugaggccccacugagcacuucuauugcaucuaacuggggagccauuuauacccaaguagaagcacacguucacuuuguagcucaagcccaacuuuaauuagccaucuguaugaauaaaugcugauuccagguccguuuccucuccagucccugcaguuuaagcugaggaggcaucgcuuaaaucagaccauuuagaccaggcaugguggcucacaccugaaaucccagcacuuugggaggccaaagcagaaggaucgcuugagcccaggaguucaggaccagccugggcaacauagcaagacccugucucuacagaaaaacacacacacagaaaaauuagccgggcaugguaagaggaggagacugaggugcccagcggcugcagcccgugcauccccagggucccagcacagaguggguguucagaagugucugcugagggacugagcaagaacccgacugagcacagcaagcaaacgcucagaacgggaggucagcagcaccgcugugcccaacacggguuuccaccauaacccgaaguuggaacguuuuauucuuccauaccaaacaggaguugagaaggcggcuggguuccuugagguguggaaugucaugcacuccuccuuucuugcguggaaagcccgagguauaaaguguguaugauguuugcuuuuuuuuuuuuuuuuuuuuuuaagacagggucuagcucgguugcccaggcuggagugcaguggaguaaucccagcucacugcagccuccaacuccugggcucaagcauuccucccaucucagucuccugaggagcugggacuacaggcgagugccaccaugcccagcuaauuucuguccuuuuuguagaaacaggguuuugccauauugcccaagcuggucucaaacuccggagcucaagcaaucaauccucccaccuuggccuccaaaaaugcugggauuacaggcaugagccacccugcacccaaccuguuugcauuuuuauuuuuuaacuuuaagcuauuaaggguuaauguuugcauuucuuaagggaaaaacagaggagaaagagccaaaggaaaaacacugaaaugguagcauuccugggugaugaguuuauggcguuuuguuuccugguugucuauaacaaauauguaauuuuuaaauuagcaacagcguuagacuacuucggggaaaccuggcucugugugccacgaagcagggaagggcuuguucccaggcgcagcagcacuugggcaucccguggugaagucagccccuuacaccuccuccaggcacagcuguggggagcaugucccgagaaggcgcaggaagaggcccaggccacgugucccguguggucagccuggggaccagaguuaaaaccagagcuccuccuucaggaaacagaucauagaagccugugguuucauccuguguucucagagaagaggcaccaggcuggaaagacauuucuuugggcagacaggcccagaguauagggcccagguucccagagcaagcgucccagggccccggcggucguaacuaccgcugcaugggcucugaugcucagccgcggaaaagcaaguaaccgggaaugaaggaaguggggucagucccaacccugccacgugcgggucucgagacgguggacaaguggcuggacuccacugggccugggcugucacugguacacagagggcacugggcuagaacugcguuccucccaccagaggcuccacaccaucuccgggccccuccccagagccucucaaccaaaaucagugucuucaaaguucaaguugauucugaagcucagccaggucgggaccagauaaugcauucuaggggacauccuccugggucucccauccacccugguggcucccugggcuguguguagaugcccagcuccuccucccugccaucgugugggcauggcaccaugcccugacggccucccuccccugcccaccucugcccgcagggagcugcaggaggagagcggucugacaguggacgcccugcacaaggugggccagaucguguuugaguucgugggcgagccugagcucauggacgugcaugucuucugcacagacagcauccaggggacccccguggagagcgacggugagucucacagggccugcucccccuccccacuaugcgggucccaucuccuggcugggagaaaggccauccgcccaaaccaucucugagugccagggaccgggcagccugcgucccccuccaccccacagugccagcguggggcccaugagccguggucucugcaccgaggcuccaguagcguaccugccccugcucugcgcccacccuaaaaugagaaacacgguaaugaggaugaaauauaaacgaucgucagguuccucacgaucacucagugaacuccucagagagucaguguacguuugggcuggccagacgcaguggcucaccccuguaaucccagcacuguggacugugggaggccgaggcaggaggaucguugagcccaggaguucaagaccagucugggcaacacagugagaccccaucucuacaaaaaaacaugguuuuguuguuguugcuguuguuguuuugagacgaagucucgcucugucgcccaggcuggagggcaauggcgcaaucucggcucacugcaagcuccaccucccagguucacaccauucuccugccucagccucccaaguagcugggacuacaggcgcccgccaccacgcccggcuaauuuuuuuguauuuuuaguagagacgggguuucaccguguuagccaggauggucucgaucuccugaccucgugauccucccgccucggccucccaaagugcugggauuacaggcgugagccaccgcgcccggccaaaaaaaacauguuuuuuaagcaugaaguuuggguugcaccucagugccuccucuucccccauugguacagaaaugcgcccaugcugguuccagcuggaucagauccccuucaaggacauguggcccgacgacagcuacugguuuccacuccugcuucagaagaagaaauuccacggguacuucaaguuccagggucaggacaccauccuggacuacacacuccgcgagguggacacggucuagcgggagcccagggcagccccugggcaggagacguggcugcugaacagccgcaaaccaucuucaccugggggcauugaguggcgcagagccggguuucaucuggaauuaacuggauggaagggaaaauaaagcuaucuagcggug

SEQ ID NO: 191565 - RNA, 8924 nt, Homo sapiens
caccgcuagauagcuuuauuuucccuuccauccaguuaauuccagaugaaacccggcucugcgccacucaaugcccccaggugaagaugguuugcggcuguucagcagccacgucuccugcccaggggcugcccugggcucccgcuagaccguguccaccucgcggaguguguaguccaggaugguguccugacccuggaacuugaaguacccguggaauuucuucuucugaagcaggaguggaaaccaguagcugucgucgggccacauguccuugaaggggaucugauccagcuggaaccagcaugggcgcauuucuguaccaaugggggaagaggaggcacugaggugcaacccaaacuucaugcuuaaaaaacauguuuuuuuuggccgggcgcgguggcucacgccuguaaucccagcacuuugggaggccgaggcgggaggaucacgaggucaggagaucgagaccauccuggcuaacacggugaaaccccgucucuacuaaaaauacaaaaaaauuagccgggcgugguggcgggcgccuguagucccagcuacuugggaggcugaggcaggagaauggugugaaccugggagguggagcuugcagugagccgagauugcgccauugcccuccagccugggcgacagagcgagacuucgucucaaaacaacaacagcaacaacaacaaaaccauguuuuuuuguagagauggggucucacuguguugcccagacuggucuugaacuccugggcucaacgauccuccugccucggccucccacaguccacagugcugggauuacaggggugagccacugcgucuggccagcccaaacguacacugacucucugaggaguucacugagugaucgugaggaaccugacgaucguuuauauuucauccucauuaccguguuucucauuuuagggugggcgcagagcaggggcagguacgcuacuggagccucggugcagagaccacggcucaugggccccacgcuggcacugugggguggagggggacgcaggcugcccggucccuggcacucagagaugguuugggcggauggccuuucucccagccaggagaugggacccgcauaguggggagggggagcaggcccugugagacucaccgucgcucuccacggggguccccuggaugcugucugugcagaagacaugcacguccaugagcucaggcucgcccacgaacucaaacacgaucuggcccaccuugugcagggcguccacugucagaccgcucuccuccugcagcucccugcgggcagaggugggcaggggagggaggccgucagggcauggugccaugcccacacgauggcagggaggaggagcugggcaucuacacacagcccagggagccaccaggguggaugggagacccaggaggauguccccuagaaugcauuaucuggucccgaccuggcugagcuucagaaucaacuugaacuuugaagacacugauuuugguugagaggcucuggggaggggcccggagaugguguggagccucuggugggaggaacgcaguucuagcccagugcccucuguguaccagugacagcccaggcccaguggaguccagccacuuguccaccgucucgagacccgcacguggcaggguugggacugaccccacuuccuucauucccgguuacuugcuuuuccgcggcugagcaucagagcccaugcagcgguaguuacgaccgccggggcccugggacgcuugcucugggaaccugggcccuauacucugggccugucugcccaaagaaaugucuuuccagccuggugccucuucucugagaacacaggaugaaaccacaggcuucuaugaucuguuuccugaaggaggagcucugguuuuaacucugguccccaggcugaccacacgggacacguggccugggccucuuccugcgccuucucgggacaugcuccccacagcugugccuggaggagguguaaggggcugacuucaccacgggaugcccaagugcugcugcgccugggaacaagcccuucccugcuucguggcacacagagccagguuuccccgaaguagucuaacgcuguugcuaauuuaaaaauuacauauuuguuauagacaaccaggaaacaaaacgccauaaacucaucacccaggaaugcuaccauuucaguguuuuuccuuuggcucuuucuccucuguuuuucccuuaagaaaugcaaacauuaacccuuaauagcuuaaaguuaaaaaauaaaaaugcaaacagguugggugcaggguggcucaugccuguaaucccagcauuuuuggaggccaaggugggaggauugauugcuugagcuccggaguuugagaccagcuugggcaauauggcaaaacccuguuucuacaaaaaggacagaaauuagcugggcaugguggcacucgccuguagucccagcuccucaggagacugagaugggaggaaugcuugagcccaggaguuggaggcugcagugagcugggauuacuccacugcacuccagccugggcaaccgagcuagacccugucuuaaaaaaaaaaaaaaaaaaaaaagcaaacaucauacacacuuuauaccucgggcuuuccacgcaagaaaggaggagugcaugacauuccacaccucaaggaacccagccgccuucucaacuccuguuugguauggaagaauaaaacguuccaacuucggguuaugguggaaacccguguugggcacagcggugcugcugaccucccguucugagcguuugcuugcugugcucagucggguucuugcucagucccucagcagacacuucugaacacccacucugugcugggacccuggggaugcacgggcugcagccgcugggcaccucagucuccuccucuuaccaugcccggcuaauuuuucuguguguguguuuuucuguagagacagggucuugcuauguugcccaggcugguccugaacuccugggcucaagcgauccuucugcuuuggccucccaaagugcugggauuucaggugugagccaccaugccuggucuaaauggucugauuuaagcgaugccuccucagcuuaaacugcagggacuggagaggaaacggaccuggaaucagcauuuauucauacagauggcuaauuaaaguugggcuugagcuacaaagugaacgugugcuucuacuuggguauaaauggcuccccaguuagaugcaauagaagugcucaguggggccucacccgccucuuggcggccggcuguugcucgucuuaaaaagcgucaccucccagugggauauugugacugauuuuaguuaaucuucccuagcacauggcagcguaggaagcaucaagaauccgccgggagacagagcugaagcuccauuucccaggcagggagcgccaggcaggcgaagaugacgcuguucaguucugcccaagugucugcucuguccauggcacucgguuccccaggcggaacacggggaacagggugagaaauacaugaaacaaaaacacaggguggugcagcguccguggcguggggaggugggagucggagguuccggcgggccugcuucccaucgcugcuccuguguccccggccucgcuagucuuuggggaccagggaugcugucuagaaaggucggcucacacugugcgccugaagcccaaaucugcacacccccacaauucaguacucccuacgugccuguccccugccccacagaggagggucugaguccagcccucuggacugggguuaggcgcucaggccugcccccugcaggcaagcggggagggugccuaaaccggcucuuggccugggaguuagggcccaucuugggguccuccugauagaauaggacuggguauugcguggauaaagcaggaaccagccuccccagagaccgggcugccgacgcuccucccugccucccgcuccugagcagcacgggccugggguugccccaggagcaaauccauucagacucgcagguacugaagcccagggccgugcugguggccuguggcugaugguacgucauccccugagggcgaggcuguuugcugcuggguucccggggcccugggaccccuaagcaccagccugucuggcuccagugucccccauuccucaugcuugcagaugcuccccaacgaaggauuuuuuucuuucuuucuuuaagacagggucucggcugggcacgguggcucacgccuguaaucacagcacuuugggaagccgaggcggguggaucccgugaggucagguguucaagaccagccuggccaacauggugaaacccccgucuccagguuacacccgaggauggaagucacaggcuuccggcucugugccucaguucccccccucaaacccuggucugacagcaagccaccacuguauucagcuuugagggucuggagugauggucccucuguuuguguaauauuuacagaggguaggaggaaaguuccuucgaccgugacaaaguucagaagaaaauaaagcagggcugccgagggggccugugcuuugcuugucaccagcaggacgagaagcggaaauccagccaccuggaguuccuccauccagccuccucagcaccgcugccugcuccacucacacccaccacuucucugcacagcuggcgcuccuccagcccucugugcuucugcaaaugucuccuuccucccuccuuccacacucucccagccaacgucaggcccucagagcauuuuccuggugcccaguuauucucccuuccuuucuccuggaggccccuggccacgagguauggaccagaccuccuucugcaggucuccugaacccggcagccagaugacacgagagcuccacagaggcagggacugaccuguuccuccucauguccccaggccccacacagagcagcgcuacagaaauccaugagcugaugggcagucuuagcagaucaaagacaaagggcugggcagagaacccccggggccaccuuuccuguuuccugugcuguggucgcucugcacacacuccuggcagggacacgcuguaugcccgacucacacccagugguccuccuccccagcugcggcccccagcacagagccugucgcacuggcaccugccacagugacugaucgaacguguccguguggcugcggucuggggucccaagccuuggaggggaagcacacacagggcucuccaaacugaggguugggacccauguaccccgggaaaucggcuuaguggauugcaauugaaaaaaaaaaaagggucaagccaguggcccacaccugcaaucucagcacucugggaggcccgggagggaggaucgcuugagccugggaguuaaugagacaccaucucuacaaagaauuaaaaaacgaacugagcgugguggcaugugccuguggucccagcuguucgugaggcugaggcaggaggaucguuugagcccaagaguuugaggcugcagugagccaagagugugccaugggugagaucccaccucuggagaaaaaaagagaaaugaaucggaaaaguagagcccccuuuuauguaauaagggcggcuacugcaacuuacuuuagcuguaccugcacaccugaguguguacacucuaucagaguacaaaacguauuucuuacugcagguugugaugaaaaaauuggaaagccacuaggcugcagcguccuggcuuuccuccgugccaggacccucuuuacucuguaguucuccucuccaggcaagcuggccuaccuuucucagaacaaaaacacgaacgggggcuaacgucugugcagcgauguuuacacagaugaucucauuuacccugugaggguugaggggcgucuggaggacugugugaucuuggguaaacggcucaaccucucugggcuucaguuccuuccuaggugaagcuggcuguguugaggaugcagugaggcuuugugcacagcgagugugagaugaaagcgaucaucagcuccacugaacagacagaggaaccaagugacugacgagcccuucggcaacagugagggugcugggaggguucaauucaagcugcugcacagaggcuuccagauacgcccugcagcccccagcaccaccgcaccacaacagcuaacacgcacucagcacgcaccgcacaccgcgcaccguucuaaguccuucgaguucauuuccucauuuuaucuucacaagaguccgaagggcugcggacuguucuucauucugagaugaagacacugaggcucacgcuuaacccccugcuccaggucacuuagcucuuaguggugaaaccaaggguguggcccuacagcccgaaucccugugcccugggaaagccgguucuauggccagaccugccccauccuuaccuccuagccccauccucgauggucucuccuucuugcacuuugcccccaaagccauuccaccggccggccccgaagccucgcuuuuucaugcccaggagaacucgcugaggcugcaggaccagcaccaggguauagagccuggaggcgcccauggucccuggguucugaaaggaaggugagagggcagagucagccaugacgugcguggaggaagcacgugccaggggccaggaggaaggggacgugcucugggaggcaguggggggcggggggguaugcuguaacuccccagcccugccacguguggcuucccuuguggcagguggaaaacugccauugaaccagugauuuucugggguagaaacagaacccaguggucagcagggcugaucaagcagagcagaggccggcgcuaccuuccuucuccacaagucaguacucaggugcagaggacaacaucaccuuuccagagcgugcucuugcuccugcgucuacccccaggaacccccugcuuauaggcacacagugaggaacaacaguccccgugccugauuggcaccaaaauaaccacgcaguuuauccugugguccucaggucaggccuuuggauuaacaggaacuucuuucagucuagugggaccuggccucucuguagcaggcuuccagauucccaggaaauguguggcuguagacacagguccacccagccaggcccggcuaguccucccuccugugauaggaguuuauaccccacccacucugcuccugcuguggcuacugugggaccuggcacccaggggggccacuggaagucacaaggguccuuccugcucccauaggugugcagguccagguccagaggacucugagggcgaugccuccgccaggucccugcugaaaaaaggacccuggagaaaugcuggagggccaggaccaacuuuccuuuauuuauuuugagacaagauccugcucuguugcccaggcuggaggagaguggcgugaucgcgguucacuguaaccuccgccucccuggcugaagccauccuccugccucagcaucccacauagcugggaccacaggcaugagccgccacacccagcuaauuucuguauuuuuaguagagaugggguuuugucacguugcccaggcuggucacgaacuccugagcucaagcgauccacccaccucagccucccaaagugcugagauuacaggcgugagccacugcgcccagccaggaccaacuuuucugggguccacaccuggacaagacacaggguucaggaccagugauccuucuuggaaguuguggugucugagaaaagggaccagaugauaaggaagggggcagggaagugcuggguagaggagggcguggucucuggccagggcuccacacccaggccugugcccagggaccugggugaggacaggcauuucuguuuuuuugcccaaauguugcauuucccgagcccgccacguccccguccugugccuauaaaaaaaccccagugguuuuuuauagugggcagagacacaagccgcuggacgucaagaggacguggaaagcacaccaacaggcaccagcaggccaucaacugauggaaccaugaguuuggcaggggcggucagaggagagcccaggcugcucagcagcccgacuccaggggaaaaucaccuucccacuccaacugccuucuggcucccccaucugcugagggcuaauuccacucauaaaaccuugcacucacucuccaagccgccgugugaucugauugcuccaguacaucaaggcaagaaaccuagggauacagaaagcccucuguccuugcgauaaggcagggagucuaacagcugacuaacacaagccaccuacaaggcuaaacugaaagagcacccucuaacacaugccugcuggggcuucaggagcugcaaacauucaccccuagacacugccguggggugggagccccucagccugccugucuguauguuccccuagaggcuugagaagcggggcacugaagaagugagccacauccucaucgcacgcccuucgaggaggacaagggaaccuuucccauuucacugagacuggguccugguggcggaggcaggucagacaggguaaauggguuuguggcuuaguuucacaccaggcccguguacuuugucccgacacugaucuguuucugccagaagccacgguuuccaaaguaaauuuuugugauuuacuccuggucucccccaagccuccgccccgcucuccuugucucucucccaaacccccggccccgcucuccucgucucccucgagcccccgacccugcucuucuggucuccuucgagcucccggccccgcucucccccaagcccauggcucagcuccccuagucuccugccgcccgcuggcccggcuccccucccuggucaccacgacuccuggaauccccgcgcgcgcuuuucguaccugcaccgccgcuuccgggggcguggccucugacc

SEQ ID NO: 191566 - RNA, 7908 nt, Homo sapiens
gcggcgcgcugcaggcgcggggaacaccaauggcggggugagcugggcgcugcugcugcgcgugcagacagcgggagugguuggggguccgcccggucgccuuccucgguccuggccucggggcugggugccgagcgcugggcaccguccccgcacucagcgagcgcgacaggggcgaggccaggauuccgggucgcaguuccccgggaggagggcgcccucaggucuccaggggcagggccggcggggccguggggaggccggggccggcggcggaguccagguggggggcgcagcgccggggcccagauccaaggcgccgggggcgagcccggggcgggauuucgcuucugggccggguagcuccauugcccgcgcuuccugggcugucgagugggcccuggcccccgggaccggcuugugccauuuucccgggagaccccuuaagcgaggggaagacagcgacucacggucagcagucagugccuccuggcuugucagcacgcuuugguguugcagaagcuagaagcuuuggccuuggagccaugagggugguaacuuuuauuuauuuauuuaaaucagaaagauggacauagagaccgggcuugguggcccacaccugucaucccagcacuuuggaagucugaggcaggaggaucguuugagccuaggaguucgagaccagccuaggcaauguagugagaugccaucucuaaaaaagguuuuuaagaauuaaaaaaaaaaaaaaaauuagcccaggcaugguggugcacaccuguagucccagcuacucaggaggcugaggugggagguucacuugagacccagagguuauggcagcaaucagcugugauugugccacugcaacuccagccuggaugauagcaaaacaaaaauggccgggugaggugguucacgccuguaaucccagcacuuugggaggccaaggugggcugaucgccagaggucaggaguucgagaccagcucggccaacauggugaaaucccaucucuacugaaaauagaaaaauuagccggaagugguggcacacaccuguagucucagcuacucaggaggcugaggugggagguucacuugagccccagaggcuguggcugcagucagcugugaucaugccacugcacuccagccuggguaauaguaaaacccugucucuaaaaaaacaaaaagaagaaagaaaugccugggugcaguggcuuacaccuguaaucccagcacuuugggaggccaaggcgggcagaucagcggaggucaggaguuugagaccagccuggccaacaugguggaacccaucuauacugaaaauacaaacauuagccggacaugguagcaggugugccuguaaucccagcuacuugggaggcuggggcaggagaauugcuugaacccgggagucggaggcugcagugagcugucacugcacuccagccugggcgccagagugagacuccgucuuaaaaaaagaaaaagaggacauagaacuuccuuggugagguuguugucagaguuaaacaaggggagguguguauagcuuccaccugcuuagcuauugugggcugugaauaaauuguuacauuuauuguaacaauugucuagagaaucuuggaaauuguccuucaacgauugacacagguuuaguucaauuuuauuuaagacauguaggugagaggauuguuugagcccaggaguucgaaucugcguugaaccgugaccucaccacugcacuccagccugggcuauagagcgagacccugucucgaaaaaaagaagaaaaaaagaaaugugacaggccagacccucuguacuagcugucaaagcccuggaacuaggucacuaaggcaaggaucuguccuuaugagguuuucuugcagccugucagagcccaaugaacauuuuugccagaugagaaaauaauauuacuuuaauuaauuaauugauguauuuaguuauuguuugagacagagucucgcucugucgcccaggcuggagugcaguggcgcaaucucggcucacugcaaccucugccuccuggguucaggcgauucuccugcuucagccucccgaguagcuggguuuauaggcaucugccaccacgccaggcuaauuuuugcauuuuaguagagacgggguuucaucauguuggccacgguuggccaggcuggucucgaaauccugaccucaggggauccaccugucuuggccuccaaaagugcuggaauuacaggugucuccgaauacccccauauucugagguaccaaggguuaggacaucaacacauuaauuuugcggggacacaguuuggccugugaugccugcuuuccaucuguguagccuuaucaguucaccuccccuccugggccuuggugccccaucucuagaaaugaaugaguugauccgagggcccucccagcucaugaccugccguucugugugaugccaaccugccugcuccucuucucucccaccagguacuugaagcugguguguguuuccuuucagcgucaaggguuccacacuguugggagucgcugcaagaaucggacaggcgcugagcaccuguggcugacccgacaucucagggacccauuugugaaggcugcgaagguggagaguuaccggugucgaagcgccuucaagcuccuggaggugaacgagaggcaccagauucugcggcccggccuucggguguuagacuguggggcagcuccuggggccuggagucagguggcggugcagaaggucaacgccgcaggcacaggugggccucugcacugcuguuggcaccuucuggcuccccugaggcugagugggcaugggcaagcugccuuugccaguggaugcgggaugguggagcccuuuuuugaaggcgugugcuuccgagugggugguuuagcaauggugaugauaaaaauaggaugcugccauuuucaaaaugaaagacaagguagaaaggugcagugaacauggaaaucaccucgcaugagaccgcccgcagguaccagcaccagcaugguggugugcauccuuccaggcuugugcaugcauagaucccucacauuuucaaaagcgauguugugccauacuuuucuugcuaauuugcagccuauuggagcuauuuuugcuuaaugauacauacauauauguauuauauauauauauauauauauauauauauauauauauauauauauauauauaauuauuauuguuauuauuuuuguucuuccccccccuccagauggagucucacucuugcccaggcugcagugcaauggugugaucucggcucacugcaaccucugccuaccugguucaagcgauucuccugccucagccucccaaguagcugggauuacaggcgcccgccaccgcacccagcuaauuuuuucuuuuuguuuuuuuaaguagagauaggguuucacuauguuggcuaggcugaucucgaacucuugaccucaggugaucugcccaccucggccucccaaagugcugggauuacagaugugagccauggugcccggcuacucuuaaugauguauugacaucuuuccccaacagcacagcuaaauuuccaagucgcauaagcccuggggcuuuccugguggccccacuggggcugcuccguccggaaccuagaagaggcuucauggccagggcuauggauucuuugcucuggaugaagcugagacacaguuuucaucuguuuuguaucuuaggguuuugaguaagauuuucuauauaaaaagguucuccugaauaaugagaucagccaaccgcccaugcaacugaagacacugucgucauugggaaaguuucauccuauuccauguagugcuugcaccguagguucuuuaaccagcucccucacuguggcaucaagguugcuuuuggcuuuuggcugggaugcgugugcuguggugaauauccuugccauuuauguuuccugcuguaaagccaggguagcugcaugcacuggcauuugaacagggugagacaguccacccagagcucucccaagucucucccaaauaccuuagaguagggacacugguccccauuuauuggugagaaaacaggcucaggguuucaugacuuguugaaagugcagaaauggaaugcuggcccccuggaucugcacaucugccucgcugcugguuugcgguagguuugccaugaacucuuggugucuaccugcauccccuuggguggccccugcccauacuuaggcggggauaugccucuucgggcuuuucaacagcauuuuuuuuuuuuuuuuuuuuuuuuguuuauagagccucacucuguugcccaggcuggagugcaauggcgccaucucggcucacuguaaucuuugccuccuguguuuaagugauuuccggcuaauuuuuguauguuuaguagagaugagguuuugccauguuggccaggcuggucucgaacuccaggccucaggugauccgcccgccucugccucccagcauccucgaggugcuuccuggugcuuccaucguggucagccugaaagccuuuuuauuguuuuucagcucaacauuuauugacuaaauaagugaauuuguguuggaaaugucaguuccuuuucucauugcugagcuuaucaccguggaguccuccuaguaacugauuucagugguuucuguuccccuaagugcucuugagaugaagcaggagaguggcccagcgugccuuguaggaggaagugacagaaggagagagcgugagcgugaucugccugggcuuguccucccggaagucacaagcaugcagccaaagcuguuugccuucgguggaaauuuccgaagguuguaacauacuggauauuauaggagugaaagcucaggagcauaaagugaggcgugaggccgggcgcaguggcucacaccuguaaucccaguacuuugggaggccaaggggaggaucaccugaggucaggaguucgagaccagccugggcaauauggugaaacccccgucucuacaaaaaauuagccaggugugguggcauguuccugugguccuagcuccuugggaagcugagguggcaggggucgcucgaaccuggggaagucaaggcugcagugagcugaggccgugcaacggagugaggccuugucucacacacacacacacaaagacacacaaagauaacuugcugauauuugaguaacaccaguuugcuaaaacuaaaaagaugccuuugugucaccuuacguaaaacaagacuuguugccuauaacugaucucagcaucugccucccccucuucucacucuguaccuacauucaaagcccccucuucacaagcccaacgcccccaucuccccaacaguccccuccacugaggagggccguaguucuguugagaaauugucagaguugauaagcuaaggguacagucacagauuuucuuguucagucugcuuaacagaaaggcuguuccaacgguagggggagagaaagggaccguguuucauuccuaguguaaacauuggaaguccagguauuuugaagauuaccucauuuuucaaaggcgaaaccccucagucuucaccccaggaaaaugggacgccucacgccucauuuuagcugggucuccugaguagcugagacuacagcuaauuuuuauauuuuuuuguagagacaggaucuugcuauguugcccaggcuggacuagaacuccugggcucaaguaauccucuugcuucagccucccaaagugcugggauuuuagguguaagccaccacaccuagccgauaucaguuuuuguacguuauuuuauaucuguucauuuuccucaucucuugacuuguuuccaguaguuucuacauugaaagcaauuggauuaagcuggagaauggauuucuugauuuaauccagaggcacuuuauguacuaguuuauuauuuucuuuuucuuuuucuuuuucuuuugagaucgagucucgcucugucgccaaggcuggagugcaguggugcgaucuuggcucacugcaaccuccgcuucccggguucaagcgauucuccuaucuuagccucccgaguagcugggauuacaggcacgugccaccacgccugccuaauuuuuguauuuuuaguagagaugggguuuccccauguuggccaggcuggucucgaaguccugaccucaggugauccacccgugucagccucccaaagugcugggauuauaggugugagccacugggacuggccuauuuucuauuuuaguuuaucaaaaagagcacucagagauaagaacccuuucacagagagugagccuuggguagugaaaugauaccagauuuggaaucagaaguccugaugccuggcacaggucugcccauggcugaggaugacucuaggacagucacuuccugucugggccucagcuucucagauguuaaggcccgccaucuccaccaugugucuuuauaggauguauagauagagaaggccuguguuuaccuauuugcacauuagcucuuugccuuggucuugacauuuuauuuuuauuucaucacuuuguugcauguacuguauuuuuguaaaaagauucaggguguaaauaaauaacacauucaccauuucuuccauagaucccagcucuccuguuggcuucgugcuugggguagaucuucuucacauauucccccuggaaggagcaacuuuucugugcccugcugacgugacugacccgagaaccucacagagaauccucgaggugcuuccuggcaggagagcagaugugauucugagcgacauggcgcccaaugccacaggguuccgggaccucgaucaugacaggcucaucagccugugccugacccuucucagcgugaccccagacauccugcaaccuggggggacauuccuuuguaaaaccugggcuggaagucaaagccgucgguuacagaggagacugacagaggaauuccagaauguaaggaucaucaaaccugaagccagcaggaaagagucaucagaaguguacuucuuggccacacaguaccacggaaggaagggcacugugaagcagugaggauuucuugugccauuuucauaauggucauuagcuccuuuuaagcuagaaacguagccugagcuccugaagaguuccugggagauuugagcugauuuuggagauggagcaggacaaguggggagucucucucucucuuucucucucucucuuuuuaaccaaaaagagaugacaaaacuaaguucaggggccauggaaaaugaaaaaguccgcuauauugugauuugggaagagaaaguuaucaagagaaagaggugaggauggaaggauggagaaaaacagacugugggaaggaucagaaggaauccgccgaggcagggaugggugugcccaugugugccuugacgggacuucaucuuauagacuguuaaacugucacacacaaacaggcuuuccaccccugcucugagagcaccacgcacagauuuccaguucuuaguguggcuguuuaaaguagaaaaucugggggcugggugaggccacucaugccuguaaacccagggcuuuagaaggcugaggcugggggauugcuugaagucaggaguucaagaccaaccugggcaacauagcaacaccccccaugucuacaaaaaugaaaaaccaaaaagcaaaccaaaagaaaaaucugaaauuuccaucuggggauuaacuucugucuuucuggugaacaauauagcaauucacgcauucuucaagcagcaaaaguucccggaacaauuagggaagacguauggucugaauuuauccaggcagugggucugcuuugguuuuugcuggaaauuuauaucagugucugggcucccaagaacauaaauguaauugccaaagcaa

SEQ ID NO: 191567 - RNA, 31022 nt, Homo sapiens
gcuccugcgccgggggcggggccggcgagggcugccucugggggguccgcuagucgcggggcggcggcggcggcugcgggcgcgaggugaggggcgcgaggugagggucgcgaggugaggggcgcggcgggcggcgggcucggggcgcggucucccucucucucggccagugcugggcucccagggcccgggcgggggucccgggccgcgcugaggggcgcgggucggcucuccuuaaccuggccuggcgggcgcggcuugggccuggguucgaguucccgcgccggcgcgcagugugaccuuggcccugcgcgcgcccucucugagccccgcucgucguccucggccagggggacccagcccuggggcccugaucagcgcguucugcggcuccucggggucuggacgagaaaucugugguucugauucagcgacagcagaggcugcagcggccccgccggcccccaggagucccccugcccggcaucagccucugccgcccggcagggguaggaccaauucccgggcuuggaguuccaggauccccagcucccgagggcccccgugugccugcugucaccugaacggggcuccccggccccgccgaccgcagcccuggagccugcagacgccagcagcaccggcaggucgcucaggguaucccuuaaaugaccucucacuccagaagccgcagcccugccccucugggagaggaaaccgugcauuuaguccgggaacagugggacuuagaccuccucugcgggcucccggccaccgagacaccgccggcaaagccuuggcucgggcagaggcuccgucuggcaggcagcacaacaagccauaguguuuccagcauuauuaaauuauuuaguucauaagcggggcuguggggacucggaagccccggggugaauaggaaugugaguugcaggcgcggugcuggacgcaguacaucuuccaggacaccaggcccuacggugcuguucccggcugugggugguuggggacagcucagcgggucccccacuuacccccacgcggggacccggguuagccccucaccgugagcaucugguguugggagucagggcuggugucugagugaggauggagagaaaacagggguaaugaggagauugcuacacgaaggugcaacgcuugagaucugaaagagcaccugccuggaauggcauagauguuugauuucccugcaaaggaguuuaugggacuuugggcugacgcuuuggggccagcaguaacugucugcugucacucagcugacuccagcuuuauuaucaaaccuccaaucgagugcaagaugcuaagcugggguagaugccgguaauagcgugggccuugcccugggagcucacggccagccuggcuacaacuguguggaguugagacuguggugcaggcguuaacagaauguggcgacauuuuccgacauuuuccacaguggagaggaccuaugaauuggggcguuuggaggcaaagggcaugcagagauguggaagugaaagugauguuugggggagauggugggucgccguguucuugaugaagugggguuugaggauuggguuggaagcuaagacuggaaggccgggcgagguggcucgugacuguaaucccagcacuuugggaggcagaggcgggcggaucaccugaggucaggaguccgagaccagccuggccaacauggugaaaccccaucucuacuaaaaauacaaaauuuagcugggcgugguggugcacaccugaagucccagcuacuuaggaggaugagucaagagaauagcuugaaccuggaggcggaaguugcagugagccgacacugggccucugcacuccagccugggcaacagaguaaaaaaaagacuggaaagauggguuucugauugugcaggggccugaaugcugugugagggaguuuaaacuuuuaucccuuugguggugguuugggugcgacgcgauuagauguguuucagaaaaguggucguggugagaauaugggagguggguuuugccucugggcaguggagcugaguugaguagccuuguggggcgugggucuggggcagugagagagugggggcgggcauggagcugaaagauguugccaaauccacugggcgguggcgcuuugugagauguggcgaccuguaacagcgagggcagccgggacuucucaccugcgaugaggagcgcugcggccaggugggagaggaagggccacacaaacacacguggguuuuagaccugcagaguuggcgguauugguggccauccuggaggagaugugaccugguggagaagagacagccuguacaaggagggaauccccaggaaccccagugggaagggauccagagcugaagagaggcccguugguuggcugaccuugggcgugcaguuccuugacuacgcacagucauugaggcuggcaggugauucucuucuagugugggucaggggcugaaggagccaucagugggaaaagacggguuauugaugauacugaaacacaugcggcuuguuugucauuuaaaaaaaccguacaucuugaguuucgauucuuaaguugucuuucuuuucggagaguagcuguuaguuucacacuugcuuagugggucuguggcugcaggcgggacugugguucuccagcccuggcccacagaugugccuggagauaauugacucuccaacuuauuacuuccugcuguuaagguggugguuucuguaacuguuuagaaacuuuaaagauauuucagagaagaaugggagacagguacaguugaguacggggugggggcacaguugaguauggggugggggcacaguugaguacggggugggggaacaguugaguauggggugggggcacaguugaguacggggugggggcacaguugaguacggggugggggcacaguugaguacggggugggggcgcgguugaguauggggugggggcgcagugcugaacagggcacaggaggaggaagcgaacagggacccuuuggcucccagaacaugaccagcuggggcuuuucccuguagacaggaggauggaugugucuuuggggaaucugaguagcccaagagaaaagaccuaaaauuaaugacaucaggagguccccagucagcagacccagcuggaucccuugcuaacgaagcccgucauuaauaacccccucccaguguucaaggcaucaagcuuuaaaaauccccaucccuuaaauaugagcagauaaccaagggcaucugaagaaaaccucugcuacaggagauugagaccagaauacacacugggaaaccagagagcgugcaggaaggagccuuagaaagcaggcugucauuaauguccacgcggaggugagcgaaaauaucgcgaacaugaggcaagaacaggaagcucuaaaaaaaagccaccaaaaggaguauucgaauauccaaaaagagaacucucggauguaaaaaaaaaaaauaaaagcagaaauaagaaaaucaguuagugggugaaagauaaaguugaggaacucccucagaaaguagaacagaaaagcaacgagguggcaaaugagagaaaaaagaaacggaaaggaucagaucaggaagucagcagcugaauaguaagagcuucaaagcugaggugagaggaucguuugaggccaggaguucaagaccagccugggcaacauagcaagacccccaucucuacaacaaaauuuaaaaauuagccaggugugguggugugcaccuguagucccagcuacuugggaggcugaggugggaggaucacuugagcccaggaguuugaggcugcagugagcugugaucaugccacugccauccagccugggugacagagcaagaccccaucucuaaaaaauaaaauaaaauacauuuuaaaaaguuuccagaagaaaaaaauagggaaaacaggaugaaauucacaaaauaauuuccuagaacccaaacuuucuggguuaaagaggcucacccaguggccaguaccacgggugaaaaugcagguauccuucacuuucauagccucuucacuucucagcuuggauauuaaaagcuugggaaggcugggugugguggcucaugccuguaaucccagcaauuuaggagguaggugaaucacugaggucaggaguucgagaccagccuggccaucaugaugaaaccccaucucuacuaaaaauacaaaaauuagccaagcaugguggugggugccuguaaucccauacucaggaggcugaggcaggagaauugcuugaacccaggaggcggggguugcugugagcccagaucgugccacugcacuccagccugggcaauagaaugagacuccgucucaaaaauaaaauuuaaaaaauuaaaagucugggcagcaaacuuggauagugagagaggcugaguuucagauaaagacuagugagagcuugggaggggaaggauuuauuugaaagcaugucugcagcuguugaccccagaauuuggauagugagaguucagaggccaggcgcuguggcucacgccuguaaucccagcacuuuggguggccgagguggacggaucacuugaggccaggaguuugagaccagccuggccaacauagugaaacccuggcuaauacaaaaauuagccagguaugguggcaggugccuguaaucccagcugcccaggaggcugagacaggagaauugcuugaaccugggaggcggagguaacgguaaguggagaucaugccauugcacuccagcccgggcaacaagggugagacuccgucucaaaaaaaaaaaaaaaaaaaaaaaaaaaagauccuugcguacccucuccaggacauacuguugugaaaucucagaacaagaggagaaaguaaaaacaaaucacaaauaggucaucacaggucaagaggcagaagguuagaacauguggaaaaaggcagaagaacuaacuacaauuaaaaugaaaagaagcagaagggcuugggcuuuuucaaagcagcacuggguggcaggagacgggagggccuugcuugagaaauucugaaggaugcauuugcagccuggaagucuacacucaggcaagggaggguaggguaaagacaacuucagacuugcucccagauuuguuccucaugcuuuaaggaggugauuggcagauguagucuccccagaugaggcaguaagucuagacugagagagacuggcuggugggaacaggauuucccccaggugagaggugagaagaaccugcugaagggaaaucccagccaggugcuggugugaagagcagacauguccugaccccagcuggucagaggcuccaagaggagauucuuugggagaagaugaaauuagcaggacaccugacaugcugcagcaucuggagaggaguugauacaguuggcagaguuggggcgggauuagugauaaguacuaaacaaagcaaaugaaaacacaaggcuguuauuaguuccagggaaaauaaaccaucgugcgggaaacgaaaaauaauuaugguguacuacaaggcgcagcuguggauagccucgccgcaaugauaguaauuuauguaaacacugacugcugcucuaauugaaauuaugaugcaccugggcagagaagguguggggaggagagcgcugcauuuucgccugucgccuugggaagucagucgcuaaugccccaagcugaacaaccaagguucacucugaaggcagacauuaaaagaauuagcuaaaaagaauuauggagcggguagggcguggugguucgcaccuguaaucccagcacuucaggaggccgaggcaggaggauugcuugaguccaggaguucaagaccagccugggcaacauggcgaaacccugucucuacugaaaauacaaaaauuagccagacaugguggccugugucugucucagcuccuugggaggcugaggugggaggaucacuucacuugagcccaggagguggagauuuuagugagcugagaucgagccaucacacuccacucuagccugggugacagagcaagauccugucucaaagaaaaaaaaaaaaaaagaaucauggagaagggcggaggugagaaagggaagcagggacagagacuguugaguuucuuaauaaacuucaccucacggaaugauuucacucuuucauggauauguauguguggcauugaauugacccaaaugggaacagucucagaugggcuuucugcucugauggaauggcggcccucgccugccucugugcacaggcccuguuaacagggaggguuuccuugcucugauuuccucuugguuauugucauuguucucuguaugcugucucgucguuguggucauuuaucagagauucugagcacuuuuuuuuuuuuuccuuucaggcagagucucacucugucacucaggcuggagugcagugauaugaucucauugcagccucuguuuccugaguucaagcaauuaugauuacaggccugagccgccacgcccggccgagcgcuuucuuucgucguuuuccaaggggguuuuaaaacauaccgaccaguagagagagcaguauuauacaucauccuucaccuguccccaaguuucagaaauuaggcaaucagaguuugucugguuuuuguuagaacaucaccucuuucuugagcaaguacugagugccagaugcuacuguaagccuugagaauacccgcugugaggcaggacgaggaccucccuuuuaagucagugcaggaagacagugaguggauuaacugguguauaugagcuauuugaggccaggcaugguggcucacgccuguaauccugacauuuugggaggcugaggcaggaggauggcuugagcccagcaguucagggauucugcgauugcaccacugcacuccagccugggugacacagugagacacuacucuaaaaauaauaaauaaaagauuugagguagggaugggauaaaugcugcuaugaagaaaaccaggguauggggagugcaggguagagacugggaucuacuuucucagggugguuagggaaggcuugcugaggaggugagcgucaagcagagaucugaaggaagcgugggacugcccugggauuccccagcugagggaugguggugcagaggcccagcagcaggagccugcugggugcgguggaugaacggcaaggagacuguugaggcuggagagggucgccgagggggacugugauagaagaggagaucaguggaguccuggucacgggccaucagaaggacucgagauaggaagccacugauccaacuuuuaauagaauaaccguggcuuugggguugaaaauggauugugugggccugagagcagaagcagggagacugguuuggagccuguugcaauaacgcaggugagagcugauggugauuggggcagggugggguguagguagggcagaggggacuugacaaguuagagccuggauaacuauuuacuuuuuuaaauuauuuauuuauuuauuuuuaaauuuugagaugagaucucacucugucauccaggcuggagggcuggaguacaguggugugaucauaguucacugcagccucagccuccugggcuuaagagauccucccaccucagccuccugaguagcugggacuacagguguauacuaccauaccuggcuaauuuuuaaauuuuuguacagauggcuucuugguauguugcgcaagcugaucuugaacuccuggucucaaaauauuauccugccuuggccaccuaaaguguugggauuacaggcaucagccacugcaccuggcugagccuggauauauuuugcauguaaagccccaagcagguucuuaaacugaucauagugagauuuauuaucauuuucuucugaaauaauuucuuugaguuaacuuaacucuuuuuuuuuuuuuuuuuugagacggagucucacuguuggccaggcuggagugcaguggggcaaucuugacucacugcaaccuccaccuccuggguucaagcaauugucucugccucagccucucaaguagcugggaugauaggugccagccaccacacccagcuacuuuuuguauuuaguagagacaggguuuugccauguuggccaggcuggucuccugaccucaggugauccacccagcuuggcuucccaaagugcugggauuacaggcgugagccacugugcccagccacgaauugauuuaacucuuaagucaguugagucaagugaguuaucguuuggauucuagagucaaauaccuaugcaacaaauauuugagccuuaugaggaauacagaagguacaugagauaugaucccugucuucuaagaacuugaaacccaguuugggaauauuggacugguauacgugcguggauuuccugucuaccugggaagggccaacagagggcuuagagacgggaaggaagagaacagggugagcugauagccucugugcucuaggaccggcucugcagggaaguuacuuuacuucaaaggcuaaguuugggcucaguuuucauucaggucuccugggauauaaaucaacauuccauucucaucaaugugaccguuaauuacauauuuuuauuuggauauacugucagauauaguuaacugaacacaaaugaaguaauuguauaagcaaauaaaccauaguccuggagguaccgcgugaaaaugugucucacgauggagguuuuaauguaguaccacuguguguaaguuccaggcagcccaggacaugcagagagcaaauauugacaccaggaacagaaacuuuccacauuuuuguugacuacagcgaugggaacugcagugaauuauuugccuuauauagugucuguaaagcuggaaaagaaguagguaguuucuggucuuugugucaguagcauaaauaaauaaacuugaaacauucuugcgcuucuuauugaaggucaugucacuugauuuagugcucaagagcuugguuauuuggacacgaagaagcuacuucccucagcaguaaaggaaauagaaauuugacugucuagugaaaccuaccaauucugccuaaacauauacuguagaggccagcagagcagaguggcaaggaaggggggcucuccaacaacagccugaguucugaggccagcucuaaacacugcuagcuauguagacuugugcaagucuguagcuacuuuucccaguuucaucccaguucaugugaggauuaaacaaaguaauaugugcaaagcccuuagaacaucacuuuuaacaacauguuagcuauugguauuguuauuuuaaaaucaauuugcaaauagacaguuuuuuuuuuuuugacuugauaacuggcucuugguagaaagcaugaguaauaauaaaaauaacacauauuuguguaacaaauauuugagccugaugaagacagagagauaaguaaggccggggcagauucuaaagaaagugcuuuacuauuuuaucaaccacuuagcuguguuuucucauuuuugugcucucgguagcucugguuagcagaaaggccuaguuuguucuucuuuuguagauggacugaaagucagacauaaaaugacuuggcccaggccacucagcagaggccggacuuggucucaguaucccuucccucuuccucccagucccuccgugucugugcggaacucugcacugguguuuucuucuguacuguggaaauuggugagagcugggccauugcauucauauuagagagagaaguguuagccucuggagaucagcuucauaaaaccacaaacauuuucuuuuuaacuuuaaaucaaauguauugaguaugauuuacaugcaauaaaacguacccauuuuaaguaugcaguuugaggaacguggccaaacauauucaccuuguaccugccucugcaaucaaacaguagagcauuuccaucgccccgaguuucugcgugcuccucugcagucuaugauuuucaucacgauuuuggccucuuuuaaaugucauauaaauggaaccacagaacaugcagucuuuuacgucuggcuccuuuuucagugugcgaccuguggcguucacccaugaaucagcacuucacccuuuuuacacucacuugcugauguacauugggguuguuuucagguuuuagcuuuuuuuuuuuuuuuuuuuuuuugagacagagucucccucugucgcccaggcuggagugcaguggcgugaucuuggcucacugcaaccucugccuccuggguucaagugauucuccugccucagccucccgaguagcugggaucacaggcacccaccaccacacccagcuaauuuuuguauuuuuaguagagaugggguuucaccauguuggccaggcuggucuugaacuucugaccucaggugauccacccaccucggccucccaaagugcugggauuacgggcaugagccaccacgcccggccaguuaucucauuuuaauuugcauuucuuugaugacuaaugaugaugagcacuuuccuaugugcuuucugacuauuuguaucucuucuuuugugaaacgucuguucaaauuuuuugcuuauuuuuuaauuggguuuauuuuccguuguaagagcucuuuauauauucuggauauaggcacuuuguuagauauacauauugagaauauuuucucccggccuauggccugucuuuuacuuucuuuuuuuauuuuucuuuuucuuuuuuuuucucugagacagaguuuuggucuugucacccaggcuggagcgcaauggugugaucuuggcucacugcaaccuccaccucuuggguucaagcgauucucuugccucagccuccugaguagcuggaauuacaggcacuugcccccaugcccggcuaauuuuuuguaauuuuaguggagaugggguuucgccauguuggacaggcuggucuugaacuccuuaccucaggugauccacccuucucggccucccaaagugcugggauuacaggugugagccaccgugcccagccuuuacuuucuuuaaugguaaaauuugagaauccuaaguuuuaaauuuugauaaaguccaauuuaccacauuuuucucucauauuugugcuuuugguaucccaacaaaucuuugccuucucccaagucauggagauuuuuuccuguuuuccucugaauauuuuaguuuuaguguuuauguguaaggccaugauccauugugaguuaauuucugugugaggcguaggguugagguucauucuuuuucaugcagauauccaguuguuucagcaccauuuguugaaaagauuguuauuccuuauugaauuacuuugccaccuuuugaaaacagccacauacauguggaucucuuuugggacuuugugcugucucauuuaucucuacaggcauacuucagagauguugcagguucaguucuggaccaccacaaucaagugaauaucgcaauaaagagagucaacaaaguuuuugcguuucccagugcauauaaaaguuauauuuggccaggugugguggcucacgccucagucccugcacuuugggaggccaaggcggguggaucaccugaggucaggaguucaagaccagccuggccaacaugaugaaaccccaucucuacuaaaaauacaaaaaauuagccagaugugguggugggcgccuguaauccuggcuacucaggaggcuaaggcaggaggaucaccugaaccccagaguagagguugcagugagccgagauugugccacugcacuccagccuggaugacaacagcgaaacucugccucaaaaaaaaaaaaaaguuuuauguuuacacuauacuguagucuauuaagugugcaauagcauuaugucuaagaaacaauguacauacguuaauuuaaaaauauugcuaaaaaaugcuaacaauuaucugagccuucagcgaguggcaaucuuuuugcugguggagggucuugucuugauguugauagcugcugauugaucagggcggugguugcugaaggcuggaguggcuauggcaauuucuuuucuuuuuucuuuuuuuuuuuuuugaggcagagucgcucugucgcccaggcuggagugcaguggcacgaucuuggcucacugcaagcuccgccucccggguucacgccauucuccugccucagccuccugaguagcugggacuacaggcgcccgccaccacgccuggcuaauuuuuuuuguauuuuuaguagagacgggguuuuaccguguuagccaggauggucucgaucuccugaccuugugauccgcgcaccucagccucccaaagugcugggauuacaagcgugagccaccgcgccuggcuggcaauuucuuaagacaacaaugaagugugcugcauuuauugacucuuacuuuuacaaaagguuuuccuguagcacgugaugcuguuugauaacauuuuacuuauaguagaacaucuuuuaaaauuguagucaaucuucucaaaccuugccacugcauuaucauguaagucuauggaauauucuaaaucuuuucuggucaucucagcagcguucauagcaucuuuacccagaguagauuccuccucaagaaacugcucuuucguuccuucguaagaagcaacucuucaucuguucagcuuugaacaugagauugcaauuauuuggccacaucuucaggcuccacuucugauucuacuucucuugcuguuuccaccacaucugcuguuacuuccugcaccggagucuugaacuccucagagucauccaugaggacuggaaccaaccucuucaaacuucuauuaauguugcuauuuugaucucuuccugugaaucccgaauguucuuaaaggcauuagaauggugaauccuuuccagguuuucaguuuacuuugcccagauccuacagaggaaucacuauggcagcuuuagccuuacaaaauguauuccuuuaauaauaagaccuaaaagucaaaauuacugcuugauccaugggcugcagaauggauguuguguuagcaggcauggaaacagaaacagaucucagucgauuuagagguguauuuugccaagguuaagaaagaaacacaagucauuguaggaucuguggccugugugcuuuuucuaaagaggguuuuggaaacuucaguauuuaaagaggaaaaaguaggcaggaggggaagaggggaagaaaaggagguggaguaggcaaugaggccaguggucacauuuuugugaggcuuuuaguaccauucagugaaucuacauuuuacaugugaaaagaagggaguggggcagagucacauacgccuucuccgcacaguaaaucugcauuuuaccugcgauaaauaagcacguaaauuacuuuaucugggaaagaaaagaaggcagcuuuucuuuugcguaacuugguuguuaagcuuaacuuucccuuuagcuuggugaauucgggguccugagauuuuauuuuucuuuugcaauguguauacaaagagauugaugauaagaaauuggcucacacaauuacggaggcugagaaauucagacccuggagagccaaugguaugacuccagucugagacggaguccaaagacgaagaccaaugucccagcucaaagacaggcaggcagagagaguugauucucuuacucuaccuuuuuuuuuuuuuuuugaggcagagucuugcucuguuggccaggcuagagugcaguggcgugaucucagcucacugcaaccucugcuuccuggguucaagcaauucuccugccucagccuccugaguagcuggguuacaggugugcgccaccaugucugacuuuuuuuuuuuuuuuuuuuugugauggagucucacaguguugcccaggcuggaguacaguggugugaucuuagcucacugcaaccuccgccucccagguucaaacuauucuccugccucaaccucccauguagcuggaauuacaggcaugugccaccaggccugacuaauuuuuguauuuuuaguagagacaggguuuuaccauguuggccaggcuagucucgaacuccugaccucaacugauccgccugccuuggccucccaaagugcugugauuauaggcaugagccaccacaccuggccuuacuccacuuuucuguuguacuugggccuucaguggacuggcugaggcccucucauacugggagggcauccgauaucucaguucacccauuuggauguuacucuccuccagaaacaugcucacagacgcagucagaguaugcuuaaccaaauaucuggguaccccacggcccaguccaguugacacauaaaauuagccacguauuacgugaccuuuuugugugaucgaugucaguucugcuguaacaauguggaaaaugcgcuucuggggggcuuaauauagaucuggccauguggcagugucuuccagagcaggauggcuguggucacgucacggugacacacagcugaacacgagugagcuaaggccauagcugucugugcuagcugccuuuucuuucucuaguguuuugcccacagucagcaugaguauuuggaccaguggccuugcgugggcagccggcauggacuugcucccuggggcugcagagucugccccuggcuucaugcccugcauguugugugugagcaaagaaauauuuaacagccccacccggagcuaagacacaacucugucagccuaaccacaguguuugcguuuaaaccuaaccuaauaauuuucagugccauuuaugagggcaucugacacagccgccguggaaaagcaccuccaccgcuacaguuuccuggcggaugaugcuucuaggugaaacuuugcucuguggguucccuugcuggaggcagcagcccacgguuggugugccgcaggcggguuauacgucuguucaucugagaugccucugcgugcucugcuucaaaucacagggggcuuuuuguugaaacacugggagauuugcauuuggaaaucauguccuauuucuuuuuaaugaaaaauuacuuuauggcuucaguguugcccaugauguguuuuggaagcaggugggaucaugaccgcagugcucagcccagcgguucuaucggacccuucccugaaugcuucucuccugcccagaagguagcaaaagucacgugggcuucaggccggagcugugucagucacugggccagacauucuuguauguccaagcuguuguuucuguugcuguuguuguuguuuuguuuuuugggauguggucucacccugucacccaggcuggaguacaacggcacaaucauagcuuacugcagccuugaccuccuggguucaagccauuuucccacuucagccuccagaguaacugggaccacaggugugugccaucaugcccagcuaauuuuaaaaauuauuuguagacaugaggucucacuguguggaccaggcuggucuugaaccccuuggcucaagcaaucccccugccuuggcuucccaaauugcugggaucacaggcaugaaccaccaugucuggcuguccaaaccgccuuuuaaaauuaaaacuuggcugggcgugguggcucaugccuguauucccaucacuuugggaggccgaggcagguagaucacuugagcccaggaguucaagaccauccuggucaacauggugaaaccccaucucuacuaaaaauacaaaaauuagccaggcgugguggugcacaccuguaacccagcuacucaggaggcugaggugggaggaucacuugaguggggagguugcagugagccaagaucacgccacugcacucaagucugaaugauagaguggaacccugucuccaaaaaaaaaaaaaaaaaaaaaauggcugggcauaguggcuuacgccuguaaucccagcacuuugagaggccaaggcagguggauucccugaggucaggaguccgagaccagccuggccaacauggugaagccccgucucuacuaaaaauacaaaaauuagccaggcaugguggugggagccuguaaucccagcuacuuaggaggcugaggcaggagaaucgcuugaacccgggaagcagagguugcagugagcugagauugugcaacugcacucaagccuaggcaacaagagcaaaacuccgucucaaaaaaaaaaaaaaaaaauuaccauuguaaccauuuuuaagcaugcaguuuggugguguuaagcacguucacaucacucugcagcaaucaccacccuccagccccagaacuauguucaucuuguaaaacuaaagcucuguccccauugaacacaaacucccaucccccuccccugcccccacaaccaccauucuacuuucugucucuaggaauuuaacugcccugggaaccucauacaaguagaaucuugaaauauuugucuuuuuuuuuuuuuuuuuuuuuuugagauggagucucgcucuguugcccaggcuggagugcaguggcacgaucucaccucacuguaagcucugccucccggguucaugccauucuccugccucagccuccagaguagcugagacuacaggcgcccgucagcaugcccggcuaauuuuuuguauuuuuaguagagacgggguuucaccguguuagccaggauggucuugaucuccugaccucgugaucugcccgccucggcuucccaaagugcugggauuacaggugugagccgccacaccggccaaguauuuguccuuuuguuucuggcuuauuucacugagcauaaugucuucaggguucauccauguuguagcaugugucagaauuuccuuucuuuugaaggcugaguaauauucuacuacauggguugaccacaguuugcuugucuguucaucugucgcgaacacuuggguuccuuccaccuuuuggcuauugugaaugaugcugacaucaguguggacaugggugugcaagcaucucuucaagacccugcucuaaguugagugcaguggcucaugccugucaucccagcacuuuggggggccaagguggaaggaucacuugaggccaggaauucaagaccacccugacaacauagcaagaugccaucucuacaaaaaauuagcugggcaugguggcaaccaccuauagucucagcuacucaggaggcugcuugagcccaggaguucaaggcugcagugagguuugauggcaccacugcaccccagccuggacaacacagugagacccugucucaggaaaagaacaacaaccuugcuuucaguuauuuuggguguauacacagaaguggaauugcuguaucauauggcaauuuuauuuuauuauuauuuuuuaagacggagucucacugugucaccaagucuggaauacagugguacaaucucagcucacugcaaccucugccuccuggguucaagcaauucugccucagccuccuugaguagcugggauuacaggcgugagucacugcaccuggccccucauaugguaauuuuauaugauaauucuguguuaauuuuuuuuuuugagacagagucucacucuguuccccaggcuggagugcaguggugccaucacagcucacugcaaccuccaucuccugggcucaagcgauccucuugccucagccuccugaguagcugggacuguaagugcacaccaccauguccugcuaauucuuuuuuuuuuuuuuuuuuuuuuuacauuuuuuuuguagagaagggucuugguauguugcccaggcugggaugcaguggcaacaucauagcucacugcagccucaaacucuugggcucaagcaauccucucaccucagccuccuaaguagcugagacuacaggcacacacuaccaugccuggcuaguuuuuuaguuugguuuuuuuuuuuacuuuuuuuuuuuuuuuugagacggagucucgcucuguugcccaggcuagagugcggugacgcgaucuuggcucacugcaacuuccaccugccagguucaaaugguccuuccaucucagccucucaagaaacugggauuacaaguguacaccaccaugccaggcuaauuuuuuuauuuuuaguagagacaggguuuugccauguuggccaggcuguccucaaacuccugagcucaagugaucugcccaccucagccucccaaagugccaggauuacaggcaugagcuacugcgcccagccuuuuuaaacauuuuuuauagagauagggucuugcuauguugcccaggcuggucuuaaacuccugggcaguucucccgccucagccucccaaagugcugggauuacaggcaugagccaccauagcuggcccuaaaagauauuauuaauacuuaguuauaauccuaaaauauuuuccuuguaauuaaacugaaaucuuauuaaauuauccaugaaaagucauagguuuuauaaaaugauguagucacuggcauugguuguauauauguaaugcuucuuggcugaaaaauaagcagaagugcuuagguuggcucaguaacgcccuuaucuaguucuuagguacagaauucguggacggcggcagcaucccuggccucuggcgucugccuaugucggcgaugugacugacuccccugcagcuucacucuccucguuagucuucaucuuaauuggcaacuucccucucaaguuguuugucauguuaacuuuuccccuuugcuacuuucuuuuucuuucuuuuuuuuuuuugagagggaguuucccucuuguggcccaggcuggagugcaguggcgccaucucggcucacugcaaccuccgccucccagguucaagcgauucuccugccucagccucccgaguagcugggauuacaggcaugugccaccaugcccggcuuauuuuguauuuuuaguagagacaggguuucuccguuauuggucaggcuggucucgaacuccugaccucaggugauccacccgccucggccucccaagguucugggauuacaggcgugagccacugcgcccugccucuuuuuuuuuagauggagucuuguuccgucaccaggcuggagugcaguggugcgaucucagcucacugcaaacugcgacucccggguucaagcgauucuccugccucagccuccccaguagcugggacuacaggcacacaccaccacacccagcuaauuuuuguauuuuuaguagagacaggguuucaccguguuggccagacuggucucgaucucuugacuuugugauccaccugccucggcuucccaaagugcugggauuacaggagagagccacugcgugcagcccugcuuugcugcuuucuuagccuucagaaaaccuuuuuuuuuuuuuuuuuagugugguuucauucacugucaucugaagaaacuguugauuguuacacauccucgagaggggugguccugaaaacuugaacagcacagguacuuaggaucuaguuuuaaaaauaggcugcaguggcucacgccugucauuccagcacuuugggaggcugaggcacuuggaucacucgaggccaggaguuagagaccagccuggccaacauggagaaagccccucucuacuaaaaauccaaaaauuagccgggcauggugcgugccuguggucccagcuauuugggaggcugaggcaugagaaucccuugaaccugggagguggaggcuguggugagccaaggucacaccacuguagucccgccugggugacagaacaagacuccaucucaaaaaaaauaaaaaaaaguagaaaaauaggcuguaaaaucgugugguuauaaccguucagaggguauugaaagcugguacaggacugcauguucucgucccacucacacccugaacacacugggagggcaggugaggaaugcggugggggccauggagagacagcagcgggggccguggagagacagcagcaggcccucugaugcucacguuuucgugauuucuguaguggggucauugccuuucucugguuugagacacguauuagcugugcgugaugcuggugcacuacaggccacagggcgggaggagguuggaguccucugggugcugggcuucucugccuccaucaggcaugcugagcucuguggguccaggaagcacugagugaagguggcaguaggcagagggcauccuuuuuucugagaaucaucccagcuccuuucauguggaagcccaccacccucuguacacugagcuuuuuacugugauuuaccucauuacucuugccauugaaaaaaugaauuaagaggccaggcgugguggcucaugccagaagcagaggcggguaaaucauuugagcccaggaguucgagaccagccugggcaacauggcaagacccugucucuacccagaauacaaaaauuagcugggcaugguggcacacgccuauggucccagcuacuugggaaacugaggugccugggaggucgaggcugcagugagccgagauugcagcacuguucuccagccugggcaacagcgcaagacuguauuucaaaauuaauugauuaauuaaggcugggcacaauggcuuaugccuguaauccugacacuuuggaaggccauggugggaggaucaccugaucccaggaguucaagagcagccugggcaacauagggagauccugucucuacagaauaauuuuaaaaaugagccagguaugguggugugcacccauggccccagcuuuuugggacaacccaggaaguugaggcugcagugagccaugaucacaccacuuuacucuagucugggcaacagggugagacccugacucuaaagaauauaaagaaagaacaugaauuaagaauccacagaaguugcagagguggaugcagaguacagccacauuucagccucaugaacuuugagguucauuuaaugagaaucugugaagggucaggcaguggcuuuuagagucuaguccagugcgugagaggcagauagacuccgagaagcuuaugccggaagaaguccaggagggucucccagugcgagacucucccccggaagacucccgggcaauccgccuguuugugcuuggaugcccucgggaacagagaucuuacuacaguuuuuggccccuuaacucauuagcguaucuguucauucacugggcugacugugcuguccgaguguugucuucugaagcugcagaggucaagccugcucccccuccucugugacagcccuucaggaguuugaggcaccaacagaaauccuccucguccugaacagccccagcucccacagagcuccccuuccacaagaugcugugggaaaagagacacugagagccugcuagagccuguuguaaucagggugcccccguggaggagcaggaggaggaggcaagaccccgcuccaggccgggcgugguggcucacgccuguaaucccagcacuuugggaggccgaggugggcagaucacuugaggucaggaguucaagaccagccuggccaacagagugaaacuccaucucuacuaaaaauacaaaaauuagccaggugugguggcgggcgccuguagucccagcuacucgggaggcugaggcagaaaaucgcaugaacccgggaggcagagauugcagugagccgagauugcaccacugcacuccagccuggugacagagcaagacuccgucucaaaaaaaaaaaaaaaacaacaaacaaaaaaaaaacguaaaaaaacaaaccccggcccagugaggaccgcgcuuagucagcaugucggucaagacagguguggacacaaccacagugcagacaagggugagugccaggagagagggguccagacuguugggcucuuccagaaaccccagaccaggucauagccacugaaaauggauauauuucauauucaccuuuuacccuccacccccaaaagggccuaugagauggcccugcucaaacaucuagaaagaaagagauaggaucuggccucugacggagaugagugccucuggggauccaugcccuguggccaccauuguuucuggauguggcugaggucacaggacuguugugagcacagguggugagucaccuguaaggcccacacgcgggacaggugcagggggcccacaucugcagauguguguguguucaaaugcaaaauagcacugcauuugcuuuuuuuuuuuuuugucuuuugucaagcuugucccuuuuccucuuguauccaacuugcaggucuucucccaugcugucuauuugaucuuuauuuuuuuggguggagaacuuaccacuuaucccacuauacguuuccaucucuuauuuauuuucagcuuuacuucucgucuuuccagggugucaucuuucugaaugcagauucuggggagucugcacucuggugguggcagcacaggugccaggggucagggguuagacgcucugggggaagggccuggcagaaggcaguaagcuggagggagagacaggcuggggacgacggggcucgcuagaucagcaggggaccucuuugggggaccugcauaguccgggaugggaguagguagaugggcaucgugcgaagggacugccagugagaagagggcagcuggcuguggggacgaauauucagggggcugggacucauuucuguaaaggaaccaacguccuuagcaagaagccaaggcaggaagguggcccaggguugccccaggauaggaccuggcauggaaccucaggggcuuggucacaaggggcuucagagccaggcugaugugaugggggccucugagccugagauucacucgguauugacugcacccuaccaugugcaugcacguggugagcacaaccagacggagcccacccuccccagcuaugugagugagagcgggaguaauuaaacauacacaccccaaauaagcacacaguugcugaugggaccuauggagagugcauagucugggauuugacccaacugggaaagacuucgcugagcuggggaugaguaggugucuacugaugacggggcaggggcggguagacagauguccuugccuuguucaugaucuuggugguaagguacucacucuugcacccuuaauuaugagguuagcuguagguuuuuuuuuuuaaagcacucagauuguugcuaauauuaaaaaaauauaacauacaagagugacaggagagacauacaguccgggugugguggcuuaugccuguaaucccagcacuuuggaggccgaggaagguggaucacuugaggucaggaguucaagaccagccuggccaacaugguggagcuccaucccuacuaaaaauacaaaaauuagccgggugucagggugggcaccuguaauccuagcugccugggaggcugaggcaugagaaucacuugaaccugggaggcggagguugcagugagccaagaucaugccacugcacuccagccugggugacacagcgagacccugucucacaaaagaaaaagagagagagagagagacauauaaaugaaaaaguacucaguuuaagaaauuuguagcacuuugcaaggccgagguggccaggcugaggcaugagaaucacuugaacccgggaggcggagguugcagugagccaagaucaugccacugcacuccggccugggugacacagcgagacccugucucacaaaagaaaaaagagagagagagagacauacaaauguaaaaauacucaguuuaagaaauucauagcacuuugcgaggccgagguggccagcuugcuagagcccaggaguucaagaccagccggguuaacauggugagaccacaacucuauaaaaaauuuuuaaaaauuagcccggcccagugguguguaucugcagucccagcuacuuggaaggcugagacgggaggaucacuugagccuaggaggucaaggcugcagugagcugugauugugccacugcacuccagcuuaggugacagagcaaggcucugucuugaaaaaaaaaaaaaaaaguuuacacauuuguuugaagaugaaaaguucaacacaguuugggccuuccaucugccaccccccccuacagagaugauagaaaaaugguacagcuguaggguguuuguagaugcccuauaaguugaggauauccucuuugcuaaguuugcugagaguguuuauaaugaauggauauggguuuuguuguuccuuccuguaggaguugauuuuuuagcuuguuaauaugauagauuacaugguugauuuuugaacauugagccguucuugcauacccuacuuggucaugccgugacuccuuuuuguuuguuuguuuuuugagauggagucuugcucugucacccaggcuggagugcaguggugcgaucucggcucacugcaaccgccaccucccagauucaagcgauucuccugccucagccucccgaguagcugggacuacaggcacccgucaccauggccagcuaauuuuuuguauuuuuaguagagacgggguuucaccguguuuggaucuccugaccucgugauccacccaccucggccucccaaagugcugggguuacaggcgugagucacuaugcugugauucuuucuauacacugcuggauuugguuuauuaauauuuugagcauuuuugcauccaaguucauaagugauauuggccuguagcuuucucucucucuuuuuuuuuuuuuuugagacagagucuugcucuaucacccaggcuggagugcaguggcacaaucucggcucacugcaagcucugccucucggguucaagugauuuuccugccucagccuccugaguaucugggauuacaggcguccaccaccaugcccagcuaauuuuuuguauuuuuuaguagagacgguauugugggaucuggccagaagcccacaaugcaacggggcucuuuuauuuguucccaggcggaucagcaggucgagaaauaauagacacacacaagacagugaaagcuggguccggggggugaccgccuucugguccugcgaugccgccaaugcacuggauauaccagcauuuauuauuaaguuuagugagggcggggguagguuagugagggauuuagggucauuugauuaugaggugagauggucacauggggaugaaguaauucuuuaacauaacaucuguaugcagaaguacaguauacagagauaagaauuuacaauauagcaugugcaucaguaauuucuaacagccuuaaaacagaaacacaggcuuuccauaaccuaugauuagcaagauauuaaucagcaguaauaguugcagcaaaagcugguuacaaacaauccauagaaacaggacgugaagcuagacagccaguuagaccagaaauucucagaagggaguaugccuuaacccuaaagaggccuagaagagccguggcaagaugagggcguuuauagcacuaucuuauccauauggacaggcgccccccaugcguccguuuguaggcucuccacaagggucgcauuccauucccagagcuaugaacaucugcuuuucugggauaggaaucuuggugaugugaaagcucccugacugcauguccguucauaggcucucugcagggggaagcauaucacgugcuguuggcucauucugacaguccaaccuggcauugucuuuacacaauccugaaugcaacuuuguauuuacaguaaucaggagcauuucaucuuuuauuccauagcaauaguuucagggggucucccuacaagacaggguuucgccauguuggccaggcuggucuugaacuccuugaccucagguguuccuccugccucagccuaccaaagugcuaggauuacaagcgugagccacgacgcccggccucuuuuuuuuuguacuuauuuucacugguuuggguauuaggaugaugaguuggacauguccucucuucuccuuucuguaagagauuguauaaaauugauguuguuauucuuugaauguuugauagaauucuucagugaaaccaucugggcccagagauuucuuuuuaaggagcuuuuacguuacaaauuuaguuucuuuaauuaguauaggauuauucauuuugguaguuugugguugucaaggaauuggucuguuucaucuagguugcuaaauuugugggcguaaaauuguuuguaauaguuccuuauccuuucaauggcugcaggaucuauaauuucauuccuugucuuguuccugauaaagauaauuuguagguuuuuuucauuuguuugguugguuuuuuguuuuuguuuuucuuuugagacagggucuuggucuugcuaagaccaaggcuggagggcaguggcacgaucucggcuuacugcagccuugaccuccugggcucaagcgauccuccugccucagccuccagaguagcuaggacuacaggugcaugccaccaugcacggcagauuuuugcauuuuuuauagggaugggguuuugccauguugucuaggcuggucuuggacucuagggcucaagagacccucucgccucggcuucccaaagugcuaggauuauaggagagagccaccgugcccggccuuuucugcuuucuaaugcucuuggcaccacagugacuguaacauauguuguauuuucauucucauucuauucuguguacuuuaacuuuuuccuuugcuauuauuuagaaaugugucauuuauuuuccaggaauuuguguuuguggauuuuccuguugucuuuucuguuauugauuucuaguuuuauuccuuuauauaaaauauuucaauucuuuuauuuuuauuuauuuauucauuuuuauuuauuuuuuugagauggagucuugcucagucacccagguuggagugcaguggcacaaucuuggcuccuugcaaccucugccuccuggguucaagcgauucuccugccucagucuccugaguagcugggauuacaggcgccugccaccaugcccagcuaauuuuugcauuuuuuuaguagagacgggguuucaccauguuggccaggcgggucuugaacuccugaccucaggugauccaccugccuuggccucccaaagugcugggauuacaggcauaagccaccaugcccagccuaaauuuuguauuuucaguagagacaguuucaccauguuggccaggcgggucuccaacuccugaucucaagugauccaccugccucggccucccaaagugcugggauuacaggcaugagccaccacacccagccuaaauuuuguaauuucaguagagacaggguuucaccauguuggccaggcuggucuccaacuccugaucucaaaugauccacccgccuuggccaccugaagugaugggauuacagaugugagccaccgugcccugucaagauuucaauucuuuuaaauuagcugagguuuggucuaccauggugaauguuuuguggacacuuagaaaaaacuguguucucuuguuaggugaguguucugcauaugucgguuauguccuguugguugcugguguugaguucuucuguauccuugcugauuuucugccucauaguuuugucaguuaucaagagugaaguguugaagucuccagccauaauuguggauuugucuguuuauccuuuagcucuaucgauuuuugcuuuuuguauuuugaggcucuguuguuuggugcauacauguuuaggauuguuaugucuuccuggggauugaacuguuugucauuauguaauguccuuuugucucuaguaguuuccuuccuucugaaauuugcuucaucugauauuaagauagccacuccugcuuucuuuucauuaauauuugcaugauuaauguuuuccauucccgggagagaggaggugagaaaguagagggccaacuugccccaccucuaaccaccucacgccaugucaugggugccagauagggguggaguagaguuggaguucagcuccuacugggcccugaccuggcugggggagagggagucagaguguggacucuccugccucacaccaucuccuuccaccuuguggaugccagguggggucaaggcuuagcucccugcuggaccacacugacaguacccuggugggacagacagaggaagcaccucuacuuccaugggcagaggaagggguaucagcucccagcucagccccaccaacacccccuggugccuggcaggggaauagcaaugugccacuuacuuuugggaagccagggugguguggaaggucagcucucaggguggcccugaugaagcuguagggugcaguuuuuccauuggcauucgacuuaaguagaguggguguugccaaaacaauuuuccuguuguugggucacugugaaguuaaggaaugguucccaagaccccucuuacuuaugacaccaauagcaaaugcaggcgucccugagaccacugugggguuugaugauuugcuagaaagauuacagagcucacugaucacaguuauucuuguggcuaugguuuauuauaggaaaaggauauagauucgaagauuaaaaucagccuuggcaggagaauggcgugaaccugggaggugcagcuugcagugagccaagaucgggccacugcacuccagccugggcgacagagcgagacuccauaucaaaaaaaaaaaaaaaaaaaaaaaaaaaaaaaaaaaaucagccuugggaagaguugcagagggcagaguccaggagggcucacaccuggagcuggucuccacucccugggaggcguccucuucuugggaguugugggcaauauuacuuucccgccaguggcgagugucagcacauguggaguacugccagccagggaagcacgcgagccuuggcguccagggucauuacuggugcucgggcacauggauguguagacucccugcacugcugaccucagccuccagccccucuggagggcgagcugauaucacguggcccagcgcuccugcuccuccggaccccagucccccacugaucagaaggcaggagucagagccccagugcaccucagucauuaacuagugugucauugcaucugcagguucccagcaggaugccccggcucugcaggaagcugaagugagaggcccggagagggcccagcccgcccggggcaggaugaccaaggcccggcuguuccggcuguggcuggugcuggggucgguguucaugauccugcugaucaucguguacugggacagcgcaggcgccgcgcacuucuacuugcacacguccuucucuaggccgcacacggggccgccgcugcccacgcccgggccggacagggacagggagcucacggccgacuccgaugucgacgaguuucuggacaaguuucucagugcuggcgugaagcagagcgaccuucccagaaaggagacggagcagccgccugcgccggggagcauggaggagagcgugagaggcuacgacugguccccgcgcgacgcccggcgcagcccagaccagggccggcagcaggcggagcggaggagcgugcugcggggcuucugcgccaacuccagccuggccuuccccaccaaggagcgcgcauucgacgacauccccaacucggagcugagccaccugaucguggacgaccggcacggggccaucuacugcuacgugcccaagguggccugcaccaacuggaagcgcgugaugaucgugcugagcggaagccugcugcaccgcggugcgcccuaccgcgacccgcugcgcaucccgcgcgagcacgugcacaacgccagcgcgcaccugaccuucaacaaguucuggcgccgcuacgggaagcucucccgccaccucaugaaggucaagcucaagaaguacaccaaguuccucuucgugcgcgaccccuucgugcgccugaucuccgccuuccgcagcaaguucgagcuggagaacgaggaguucuaccgcaaguucgccgugcccaugcugcggcuguacgccaaccacaccagccugcccgccucggcgcgcgaggccuuccgcgcuggccucaagguguccuucgccaacuucauccaguaccugcuggacccgcacacggagaagcuggcgcccuucaacgagcacuggcggcagguguaccgccucugccacccgugccagaucgacuacgacuucguggggaagcuggagacucuggacgaggacgccgcgcagcugcugcagcuacuccagguggaccggcagcuccgcuuccccccgagcuaccggaacaggaccgccagcagcugggaggaggacugguucgccaagaucccccuggccuggaggcagcagcuguauaaacucuacgaggccgacuuuguucucuucggcuaccccaagcccgaaaaccuccuccgagacugaaagcuuucgcguugcuuuuucucgcgugccuggaaccugacgcacgcgcacuccaguuuuuuuaugaccuacgauuuugcaaucugggcuucuuguucacuccacugccucuauccauugaguacuguaucgauauuguuuuuuaagauuaauauauuucagguauuuaauacgaaauguggaagggaaugcuggaguaaaauauccccucuccccuccgcccgcccacccgcccgcccgcucgcccgcucgcccgcuccugugguuuuucugagcgugcgggcgccgggaggggaugcugaggcugauggagcugccuccagggcuagggccacucaccggaggagggcggggccugcacuugaagucaggccgcaccugucuguuuuuggaaggguagccgacaaauccuuccagagggaaaguucuuuguuuaaguguuguacuugaaaaggucaaucuucagggcuuccuguuugaagucaagucagagguaaaccggucaguuacagaagcaggauuucuaggauuucuaacuccagcuguucccauacugucuaguuuaaauuauggcuguuaaggccgggcgggugacucaggcagguaaucccagaacuuugggaggcccagacagaaggaucgcuugaggucaggaauuugagaccuggccaacauggugaaacccugucucuacuaa

SEQ ID NO: 191568 - RNA, 17949 nt, Homo sapiens
accggaugcucggcaugaaccacuaggcgccuggcgggggugaucugucggagcgaccggcuuggcgccugccuguccccagccccucucagcuugaacuccuuccuucaagucugggcccucgaggcuuccagagcggccuccaggggugcagucucaguuccccacgccagccgucuccguccuccgccuccuccgggccuggcagguggcacuguccggaggcggagccuugggcgaggggugguugcggcggaggacgcaaccgagcggugaggcgcgugggccuucgggggucgaggucgugguaguggggcgcggggaggccaagacccggccgaggggggcgggcgggccagggagcagcccagcccggggcgugcgcgaccugggcucgcuucccagcccgacuguggccgccugcucuggcgccccuucuggacucucgggccuggcgcucgcggccaaaacugacuucaaaguguggggaggguuccucuucccgggacgcagccuucccgggcauuggcagacggugccccgguuagacagagccgcugaccaccccgcccacccccgaggcuggacgcacggaugcacaccugguccugggagagacaggcgccccuuccuuuccgcaccccgccgccccccucucccccccgccggcuucagaugcagccaccacuaauccugggagggacagacacacggacaggugccccuuccccuccucacccuccuacuggcugcagaacagcaaaugcagccaccacugacccugagagggacagacacacggacaggcgccccuuccccuccgcaccccccugcuggcuucaggacgucaaaugcagccaccacuugacgcugggagggacagaaacuuuccagcccaggcuggcccuggggcauggguagacauccccuugcacacauggcugaccccggaacucaaagaugccccugacucuggcccaccugcagccugggccagcaccacgcuguugccccgacugcaccaaagaccaagggugacagacuuugaguuccggaggccuugugguuucagcuagacccucaucugccccuuucagccccgccaccagcgcucagggccccaccuagaccaaagcuuugcauccaucccugcaguacagaccucuggucuggggaucaugguucuccuggucugagaugaaaguucuggggccccuucccaggccugagcaggcauggugggcugcugugacuagagcgagcugggucuggagugggcauugagguuuggcucucacauugccuuugcagggccugcggccucaccauggacccagaaugcgcccagcugcucccggcucucugugcuguucugguagaucccaggcagccgguggcagaugacaccuguuuggagaagcuccuggacugguuuaaaacggucacugaaggagguaaggagguggugcugcuguuuacugccuauccagagaccagacgcagaggcugggacagggagcaggggccagauggggacuccccuguccuggaggaagggcagaaacugccaaucagaugucuuuccuucacuuccuaaggauuaucuguggcagacugagggcaaguuaagaugaagcccgagagaaugaucuggagaguuagagccugaaauucagccaguugagccacgaucagggcaccccaagguucaguucuacagaaggcgugaacaaacuuguuuuauuguuguucucguuguauuuaguguguuuaagacaucagauuuguuuucuuucugauuaugaaaguaggggccggaugcaguggcucauaccuguaaucccagcacuuugggaggcugaggcgagcggauugcuuaaguccaggaguucaagaccagccugguccaacauagcgagacgucaucucuaaaaaaaaaaaaaacaaaaauuagcugugccugguggcgcaccuguagucccagcuacucuggaggcugagaugggaggauccuuugaguccgggagguagagguugcagugagcuaugauugugccacugcacccugaccugggugauagagugagacccugucucaaaaaaaaaaaacaaaguaauacauguucuuuaaaacaugaacaaaagaguaaagaggaaaauuaaaccaucaacguuuuaauuuacucccagccuuuucauaacacauaaagcuguauuuuucuggggaaaaaaaaaugaggucauacuguaaacacaauuuuggugucuugcuuucucucuugcuaucauagugaguguuuucuccacauaauauguuaauguuauugacuacauguuauuugcuguaggaauagaccauaauuaauugaaucacuccacugucagauguuuauauuucucauuuuucaucauuuuaaguagugucauaggucaggcgcggugacucaugcuuguaaucccaucacuuugggaggccaaggcggguaggucacuugaagucaggaguucgaaaccagccuggccaacauggugagaccucgucucuacuaaaaauaaaaaaauuagccgggcaugguggcaugcgccguaaucccagcuacuugggagacugagggggaggaucgcuugaacccaggaagcggagguugcagugagcccagaucgugccacugcacuccagcgacagaauggacucugucucaaaaaaauagugucagucgagcgcgguggcucaagccuguaaucccagcacuuugggagaccgaggcaggcagaucacgaggucuggagaucaagacccuccuggcuaacauggugaaaccccgucucuacuaaaaauacaaaaaaaaaaaaaauagccagacgugguggugggcgccuguagucccaguuacuugggaggcugggcaggagaauggcgugaacacaggaggcagagcuugcagugagccgagaucacgccacugcacugcagccugggcgacagagcgagauuccgucucaaaaaaaaaaaaauagugucauaauggcuuuccuuuuacauaaauauucucgcauguaaauguuuauucucaugguugauaauugcauugggauagacugcauguuguuaauuucugcuauucuuuacuuccuuuuuuugguuuaccguguucuuuuauucuuuuuauuuuuaaauuauauuguauuuuuuuuuuuaaggauggggucucaccguauugcccaagcuguuuucgaucuccugggcucaggcagucaccugccucugcuucccaaagugccuuuuacccucuuugagcuaaauaucuaggucuuccuuguuuucuaauauauauauuuaaggccaggcacggugguucaugccuauaaucccagcacuuugggaggcugaggcaggcagaucacuugaggucaggaguuggagaccagccuggcuaacauggugaaaccccgucucuacuaaaaauacaagaauuagccugacauggugguccaugccuguaaucccagcuacucgggaggcugaagcaggagaaucacuugaaccugggaggcagagguugcagugagccgagauaacgccauugcacuccagccagggcaauggagugagacucuugucucaaaaaaaaaaaaaaaaaaaaaaaaaaaauauauauauauauauauauauauauuuaagacuaugcauuucucuaaaaguaugacuuuagcuacaucuuacacguuuuacauugcaguacuuugguuuuaauuuaguucugaguauuuuaugcuuuucauuauaauuuuuuuuucacccacaaguuacuuaaaagaguauccuuuaguuucaaaauauggauuuuuccagucuuuuuauuauugauuuuuaauuuacuuuguggagguuagaaaacauaacauauguuuugaaucuuuauagcuguugagacuuuuauugagacauaggacccaggcgaguuuucucaauguucuagagauuucacuauaugauuuugauguuuugguauuugaaggucuucaacuguggccuaguuuguaguagucaguuuuucuuuuucuuuuuuuuuuuuuuugagccaggguuuuugcgcgucacccaggauggagugcaauggcgugaacacggcucacugcagccuugaccuccugggcaguccgccugccucauucucuugaguuccugggaucaagguguguaccaggcccagcuauuuuuuuuuuucccauagagaugaggucucaccaucuuguccaggccagcuuggaacuccugggcucaagcagucuucccgccugggcuucccaaagugcugggauuacaggagcgagccaccaugccuggccuguauuuaaauuuuaagaaguauuuuucaguagcuuuauugagauauaauuugcauaccaugccauucucccauuuaagguguaccagauccuuuuacaguuuguaagcaugagauauauauauaucuauauauagauauauauauagauauagauuuuuuuuuuuuugagaccaagucuugcucuguugcccaggcuggggugcaauggcacaaucuuggcucacugcaaccuccgccuccuggguuucaaacgauucuccugccucagccuccugaguaccugcgauuaaaggugcaugccaccaugcccggccaauuuuuguauuuuuaguagaggugggauuucaucauguuggccaggcuggucucgaacuccugaccucaggugaucccuccaccuuggccucccaaagugcugggguuacaguggagagccacugcacccaaccuaagcaugauaauugaguguucaggcgcaugugugagauguggcaccauggaacccugguaugaugucgguacgugacccgucugacaugagaaauggacaaaauaaauaaauaaaugguaccaauucaacaguucuuaguaaauuuacagggcucugaaaucaucagcacaaucuaauuuuguucccccuaaagaaaccgagucuggguucacagugagucccuguuuccuccucccucccagccucugucauuucuccugcauuguacuugauggaaagaguguaguuuccacacucguucauuaguucagaccugcuauguucuugcuaauuuguuugcuuguuucugagagguguguaaaaagcuuacaccaagaucauggauucaugauuuuucuuugagaugcauccuuuuuuuuuuuuucgcuuuacauauuauuuuuuucuuuuucuuuucuuucuuuuuuuuuuuuuguuuuuuuuuuuuugagauggagucuugcucuauugcccaggcuggagugcaguggcaugaucucgguucacugcagccucgacuucuugggcucagaugauucucucaccucagccucccuaauagcugggaccacaggagcccgccaccacgcccggcuaaguuuuuguauuuuuuguagugacgggguuucacuauguagcccaggcuggucucaaacuccugggcucaagcagucugcccgccuuggccucucaaaucgcugcaauuacaggugugaggcacugugccuggcauuuuuuuuuucuuuuuuuuuuggagacagggucucacucugucacucaggcuagagugcaguggugugaucacggcucacuguagccucaacuuccugggcucaagugauccucccaccccagccuccuggauggcugggacuacagggacacaccaccacacccagcuaauuuuuuguauuuuuuugcggagacgggguuucaccacguugcccaggcugcuuuacacguuuugaagugagguuagguauacauagauguaggaauguugugucuuucuggaauuuaucuccgugaucaguuaacuuacuucugcaugaauacugcuuuuugcuuuacagcccauuuuguuugcuauuucuguugcuacaucagcuucuuuaaaguuagaauuugccuacugugucuuuucucuccugcucccagccuuuccugucguugcauuuuauugcuuuuagaaacaccacauugcuuguuuuuaguguuuaauuuaaucucagcaacucuuucuuuuaacagauaaguuugaucucuuuaauuuguugaggcgacuguuagauuugaauucuuuuguauuuuuuaauuuccugugccuuaccuuugugccuuuauccuccuuuucugcccuccaucagauugauaaagcuuuuuuuuuucuuuuaaaucuuuccucuucugguuuugaaguuauacauucuauuuauguucuucuuuuuagacaaguucuugugcuguuguccaggacagugguguaaucacggcucacugcagccuugaccuccugggcucaggugaucuucccaucucagcuuccaguguagcugggacuauagaugcgcgccaccaugcccagcgaauuuuuauagagaggggaucuuccuguguugcccaagcuggucuuaaaacuccugggcucaggcaaucugcccaccucggccucucaagaugcugggaccacaggcuuauuuguguucuucaguggcuacccuuauauuuuuaacaugagaaccggauuuuuuaaaaagucugaaguuaauuagacuuuccauucucuauccaggcaaccgaaggaccucagagcacuugaacuucaggccaucacaaccuucuauuauugucguuaguauuuuaauucuguuuuguuucaaaacccuucaacaaugauuuuuuagauuuugaacucaguggcauuguuuuuuguuuguuuguuuguuuguuuuugagacagagucuugcccugucaccaggcuggagugcaguggugcgaucucggcucaccgcaaccuccaccucccgaguucaagcaguucuccugccucagccucccaaauagcugggaccacaggcgcccgccaccaugccuggcuaauuuuuuauauuuuaguagagacaggguuucauucaccauguuugccaggauggucucaaucuccugaccucgugaucugccugccuuggccuucaaaagugcugggauuacaggcgugagccaccacgccccgccuuuuuuuuuuuuagagagacagggucucccucugucgcccaggcuggaguacaguggugcagugauagcuugcugcagccucgaacuccugggcucaagcaauccucccgucucagccuccugaguagcugggacugcagaugugugccaccaugccgggcuaauuuuuuuuuauuuuuuguagagacagggucuugcuauguuguucuccugccuuggccucccaaagugcugggacuacagguaugagcaccucacccagccugcagugcugauucagguggacauagugcuuuuuggguccuggccugguucuccuccucugcaugcuccucacucuccuuacugaaccacauucuuuccacaggggcuucucacugggaaacucucccaaccuuugccucaaaaugucuuuuucccccacuggugcuuuugagcgauagcauagcugguuauagaaauacaggaugccaguucuggagaggaauguuuguuccauuguaccugcuugcauggagcacugucuaaggaaaaguacccauuuggaaggugaaaaugcucuuccacuuuuuuuuuuuuuuuuuuuuggaauggagucucgcucugucgcccagggcuggagugugccgugugcaaugacguggucuuggcucacugcagccucugccucccagguucaagcgauucuccugccucagccuuccaauuagcugggacuacaggcaugagccaccacaccuggcuaauuuuuuguauuuuuaguagagaugggacuucgccauguuggccaggcuggucucgaacuccugagcucaagugaccacccgccuuggccuccuaacguguugggauuacaggcgugagccaccacgcccagccuggucuuucacuuuaauuugcauuucuuuuucacuaucagugagacagaacauuuuuucagcauuuuuggccauucaccuguugugaaaggugacaguguuccgccuuucaccuguuguuaagguguuggcuuucuagcccuuacugaauuaaaauuaugagucauuugccguauuuguugcagauauuuuuuucccaguuggaucccuaaaucuaacacccugcaagaaaagggucugggaauugcuaggagaagagcggucauccagggggacaccuggugccguaccccuggugaccccugggcugggccauccccacagaguccagugucgugcugcugcaggagcaccccugccugguggagcugcugucccaugugcugaaaguccaggaccugaguucugggguccucuccuucucacugcgccuggcaggaaccuucgcagcccaggaaaacugcuuccaguaucuucaggugagccuggggccucccaccugagugucccguggagaggugggcaggcuuuuccucccgcagccagguggggcauuuguagccaucaccaucccaagucccagcggccugccccgacccuguguccucacuagaacugcauguuuuuuacccccgacuguagcccccuuugaaaaauucgcccggagugaugcuggggcuaaggaguugagguuuuuuggaauaagaugacuggcacgggcucccagcucugaccagcugucugagcuugcccacggccgcaagccuccaucucuuccugggacggagacaggagucgcagcugcgccguggccuccgucucuuccugggacggagacaggagucguagcugccccguggcccccgucucuuccugggacggagacaggagucguagcugcgccgugggguugucgugaggaccaaaugagaccgcacauccugcaccuccagcgacccagccuacaaaugaaugaauaacuaaugagaaugugaaugacuaaugagaaugucuuuuuuuuaaaaaauuaauuuuauuuauuuuuauuuuauuuuauuauuauuuuucgagacagagucuugcucugucacccaggcuggagugcaaugguucgaacucagcuaacugcagucuccaccucccagguucaagcgauucuccugccucagccucccgaguaucugggacuacaggcaccugccaccacgcccagcuaauuuuuguaguuuuaguagagacaggauuucaccauuuuggccaggcugaucacgaacuccuugaccucaagugauccgucugccucggccucccaaaaugcuaggauuacaggcgugagccaccauacccggccuuuuuuuguuuuguuuuuuagagacagaguccugcucugucguccaggcuggagugcaguggcagcucacugcagccuugaccuccugggcucaagugacccuccccauucagcuucccgaguagcuggguccacaggugcaugaaccacaccuggcuaacuuuguuaucuuugguagagauggggucucacuauguugcccaggcuggucucaaacuccuggucucaagcgaucauccugccucggccucccaaaguguugggauacagucgugagccacugcucccagccaagaauuucuacauagcaaggcaugagagcucgagagccucccagagcugugucuuccagcuucaagugccucagacaggcaccgcugagucugucgggaugcguggugugagcuucagggcccuugcccgucuaccacgacggcuucucuuggugccucacaggcccucgccagguugugcgaaggcacauccaguaccguuagcuugccguucacgaugccccccaguuaagcagcugcaggcucccuagcagcccacccaggcaccaucuugcugcaggacagacuuuccaagguguccuagggugcugccguacagugaauccgggggcccuugucugucagcagcugguaugaaaguacccuccaggcugggcacgguggcucaugccuauaaucccagcacuuugggaggcugaggcaggcggaucaccugaggucaggaguucgagaccaggcuaaccaacaugguaaagcccugucucuacuaaaaaugaaaaaauuagcugggugugguggugggcaccuguaaugccagcuacucaggaggcugagacaggaaaauagcuugagcccaggaggcagagguugcagugagccgagaugugccacugcacuccagccuaggcaacagagugggacugucucaaaaaaaaaaaaaagaagaagaaaguguccuccagaaguaucuccaccagcccuggaaaacugaaaacccaucucugcuuugcuccacaucccuggaaaccuaccagguccccucaccucuuuuuuuuuuuuuuuuuuuuuuuuuuugagauggagucucgcugugucacccaggcuggugugcaguggugcgaucuuggcucacugcaaccuucgccucccggguucaagcaauucuccugccucagccuucuuaguagcugggauuacaggugcaugccaccacacccagcaaauuuuuguauuucuaguagagaugggguuucaccauguuggucaggcuggucucgaacuccugaccucgugaucugcccuccucggccucccaaagugcugggauuacaggcuucagccacugcgccuggccacccucacuucuuuuuuugcuucccagcagggggaguuacuaccagggcucuuuggggagccaggaccccucggccgagcaaccugggccguccccaccgugcgcagcggcuggauccagggccugcgcucccuggcacagcaccccagcgcccugcgcuuccuggccgaccauggugagugcgcccacaccccaccccauuccucauccugccugugugaucccagggaauucacugcaccuugcugaaucugagugucuggucugugcgaugucucaggguuguugcaaagacugcacugugacaguacggcuguccaguguucucugguuggcaggucaggcccuaggagccaggacggcuuucucagccacuuacagaucagccgugaggacucagucuuugaaacuauuugggagccaggcguggugaugcguggcuauagucccagcuacucgggaggcugaagcaagaggaucacuugagcccagggguucgaggcuacagugagcagugguugagccacugcacuccaacuuaggcaacagagcaagaccccgucucaaaaaaacaagaaacgaggcugggcacgguggcucacgccuguaaucucagcacuuugggaggccgaggcggguggaucaccugaggucaggaguucaagaccagccuggccaacauggugaaacccugucucuacgagaauacaaaaauuagccgggcaugauggcgggugccuguaaucccagcuacuugggaggcugagguggcagaauggcuugaaccugggagguggaaguugcagugaacugagaucgcaccauuguacuccacccugggcaacagaacaagacucugucucaaaaaaaaaaaaaaaaaaaacaacaagaaggaacgaauugggaagcaucacaagcuguguguguuuaacgcucggggggaggaggugcuugucuccagggagcuucaguuccuguucuuuuuugcuuuugaguggagaggcauuugggggcaucuuggggggcccucugcuauuuguaucuucccugaggcccucugccucccccagcucuauucuggcucacccccuuuucccucucuucccccauccccuacccaggugcggucgacaccaucuucucccugcagggagacuccagccuguuuguggccucggcggccagucagcuccuggugcacguccuggcuuuguccaugcgagguggagccgaggggcagcccugccugccggggggugacuggcccgcgugugcccagaagaucauggaucacguugaagaguccuugugcuccgcggccacccccaaggucacucaggcccugaacguccugaccacgaccuucgggcgcugccagagccccuggacggaagcccugugggugcggcugaguccccgcguggccugucugcuggagagagaccccauccccgccgcacacucguucguggaccugcuucucuguguggcucggucagggccccgggacgcagcuggggggccugggugggcaacuguuuuccucggauaacgcccagggaugucccacuggcagccggagacucucugaggacauggccugcagugaagcggcaccggggugacccuggaacccucauggggaaaggccugucuugggcugggcgccuccagugccggagccauggcagucucagccaggccucgaaugggguuuugagggugggggaguaauuuuucucucuggggucucccugcaguucucccguguucaguucuuccgacggcagccugugggagacaguggcgcgggcucugagcugccugggucccacccacaugggaccccuggcuuuggggauccugaagcucgagcacugguauggucuggggugcauuucauuccgaggcgggugcugggagcuggggcaggcagggagguugagagcgcagcccucauggcaggggaguuccggacaccagggacagucaggcggccgugcggggugugacuggguggugcguggguugcgcgcggcagcuucugaagguucuuuagcaacagaauaauuguuucagaccaaagcucugcgagauccccagaggugagaaggaugcgggagcugcucugcucagagcagggugguccugccgacgcccugcgcuccgcugcccucccaccugucccccaccgcagcuuugguuggggguuucggagcuccccagcacacacaccaugcggguggggggccugggggcggugcaacggcagagccuggggucaggacaggugggaaggccguggauggccugccaguguuccaggugggcucacaauagggguggaagugaccucaggaccugcugcccacagggcccagggguaccaugaggguccagcucugagcuccggggucuccgaauguuuaggagagaguagaccgggggaggauggaggaacaggcccggcccugcaggaaugcauuguggggacacugccuccaccuaggcccagacgugagggcaggucccucccacagaguggacgcuguacacaccugggggcaccccaucccugucccccugagcgggcacugccccucucucugggugcauggccaggcccuccuggaggccccucaguaucugcuccuaaggacaucaggagugucaggcccaucuccuuggucaggccuguccuccccgccacucugucccauggcauccccuggccaguggccugcagagaauguuucucggggggugucccaacccccuggcugauuugccccaggcuugcuggggacauuaggagcacagccaacuugucucgcagccagggucgcggcacucaccucgcguuugucuccaguccacaggcacugaggacccaggccuuccagguccuucuccagccccuggccuguguccugaaggccacgguucaggcccccggacccccaggugugcugcuuagaaagggcugggagggcagaaccugggucccugcggcugggggaagggagauggaugagaguagcuggcucgccacccccgccccacuuuaaucacacccaggccucccuccaagagcaaaggggaccggggacauggccaucuccccuggugagcugcugcucugcaccuagguccuggccugugcuguggguggugaccgugggguggcuggugaccguggggaggcugaagugcucucuaagggagcucuuccuggcuuggcccccaggcuugcuggacgggacggcagacgaugccacgacgguggacacacuccuggccuccaagucguccugcgccggccuccugugccgcacccuggcucaccuggaggagcugcagccgcugguaggugcggcccgguccucaugcagcccagcagcauccacgcuggcggugggaccgcaacguaggcugacgccccccaccccuugcugccccagcacccuugcauccacgccagcagugggaccacaaccuuggcugaugucccccgccccacaugccucgaagucccagcaccccugcauccacgccggcagugggaccgcaaccuuggcugacggcccucuuccucgcagccccagcgcccuucaccguggccccaggcgucucuacugggggcuacagugacuguccugcggcucugugacggcucggcugccccugccuccaguguggggggccaccucugugggacccuggcgggcugcguccggguccagcgagcagcccucgacuuccuggggacgcugucacaggggacaggugaguguguucuguacggcuuuggcguggggcuaucccugugcccccacucuccuuucugcucggaggcacccgggaacugcugucccucucuguuucuucucuggggugggggcugaggggugcaggggccgugcaggagguuucagcuggcggaugaggccuuguucugcuccuucccagaguugauggggaggguccuagggugggggugggggugguuuauccacucaccucugucucaggcccccaggagcuggugacgcaggcgcuugcuguccuccuggagugccucgagagccccggcuccagccccacgguacggugguggggauagagagcgaggagaggagggaggcagaggcagugggacccaccccugacuccaccccgucccgugcaggccucugcggauggggccuucacacagggccacagagcugcugcucagagagcuucacgaugcagguggcugcauggggcgggcccagggccucuuguuggugaagauacaucagcacgcagggguguguggggccguggggagcaggggcacuggucaggcggccugcggggaauucuggacaagggaaaugagguggcaccaagacggcccugggcgugggcuuuggguucuccuaagcgccauuugugaaugugccuacuccacagccccucacggagcugggcccuggcagguacagaccuugugccaccugccgcugagcagacagcagacaacuuuggaggaagggcccagggcuucuugggauccuaaggaaaaggugcccugcguaauuggucauguuuugauguagaaaucccguugccuggguugugggucuucuggugagggcugccaccaccuccuccugcucacagucugggaagccgguucugcagcauauucugcccuauuaaaaucagcccaggaggggcguggggcucacagcugugauuacugugcguuggggggccgagguggggggaucaauggagcccaggacuuuugaggccagccugggcaacauagcaagaucccaucucuacaaaaaaauagaaaaauuagccccaggaguauagcucagggguagagcauuugacugcaaaaauuagccaggcguggugaugugugccucuagccccagcuacucaugaggcugaggcaggaggacuguuugagccugggagguggaggcugcagugaacugugauugcaguccagccuggaugacacauugagacccugucucuaaaaaagaaggaagcccagcguucccuucucucuccacuuccuguccccauugcugucccuggaguacgggcagcacaggugaaggcgagggggacagacagacagccugccccuccgucucccguggcccugcagcccacccuaucugcuccagguucugaagaaggccuuccaggccacgcucagguggcuccugagcucacccaagacccccggcugcucugaucucggcccccucaucccgcaguuccucagagguaacgcagccccuugcaggggugaacggagcuggagucgcagggguggaggcagcaggggcuggguggaauggcucagcuggcucugagggcagggugagccuggccccaaggucacccugaccugucccuucccacccuagagcuguucccugugcugcagaaacgccugugccaccccugcugggaggugagggacuccgcccucgaguuccugacccagcugagcaggcacuggggaggugagugcuggcagguggaggggcugccuuccccgccuguggggggcucacugagccagggugcaccagcagccucuugcuggcucuagaaacuugggccaugucggcugcccacaaggggauggaggcagaggccgaggcgacaaggcucggcccucagucacagcugcauguggccguuucgacccccaggacaggcugacuucagaugcgcacucuuggcuucagaggugccucagcuggcccugcagcuccuccaggacccugagaguuauguccgagcgagugcagugaccgccauggggcagcuguccagccagggccugcacgcccccaccagcccugagcaugcagaggcccggcagguaggagguggcagguuccucagccagcaacucccgccuggccaucgugugugcucguuugcuugcggguggucgagcggccagcaugcagcgugggagcagcugcugcugugggcagcgccugcagcagugacugccgaggcccuggggcugugcugggugugggaccugugcgcuucgccuucugucuccccagcaccccuccacuuagacaugguuaccuccauuugacagauggguaaacugaggauuggagggccgugugcucacugcgcagcaugggaaggugucagagcgggcuguggcccuagacugcauguccggggccagcccccaucauguaccggaguccuguugcgggagccucgcuccugccaccccaccaaccauccgcacuugcucccugucccccagagccuguuccuggagcuccugcacauccucuccguagacucggagggcuucccacggcgggcggucaugcaagucuucacugaguggcugcgggacggccacgccgacgcggcccaggacacggagcaguucguggccacugugcugcaggcggcgagccgagaccuggacugggagguccgcgcccagggccuggagcuggcccucguguuccugggccagacuuuggggccgccgcguacccacugccccuaugccguggcccuacccgagguggccccagcccagccacucaccgaggcacugagggcucucugccacguggggcucuuugacuucgccuuuugugccuuguuugacugcgaccgcccuguggcgcagaagucuugugaccuccuucucuuccugagggacaagauugcuuccuacagcagccugcgggaggccaggggcagccccaacacugccuccgcagaggccacccugccgagguggcgggcgggugagcaggcccagcccccaggggaccaggagccugaggcugugcuggccaugcucaggucccuagaccuggagggccugcggagcacgcuggccgagagcagcgaccacguggaaaagaguccccagucccuccugcaggacaugcuggccacgggaggcuuccugcagggggacgaggccgacugcuacugagcagaaccagagucugccacuggggcucaggaccaagggaggcagcaccauguccuucugugggacacugccagccccagggcuccagcccagcccgguggauccucuggggaagccaggaccaggagagaagcaaggucaagaaaucccacaguuugauguauuaaagaaaugacuuauuucuacucaaaauaaauggcauugaagucuuucuuuaacccuuuuugaguuaauuuaauaauaaugaucugagacaagg

SEQ ID NO: 191569 - RNA, 35907 nt, Homo sapiens
gcugugaccugcggcagcacagccgccugcguugagcgcccacggugggcuggacuuugcacuaggugcugacaggaccggcagagguggccacugcccucguccccagccugcacuccugggcgaaggcugacgcugaacagguacuuguaagagucaccgaagugcgugccgggaggguucugggaagaggcagcuguggggccugaagccuaaauguggggugggaggcauccaggcugcugcuccaggcagagggcacagccugggcaaaggccaggagaccagggaagaaaggacagagucuggagcccgggagagguggcgaggggccauagcccugaaggagcuucauccuggggcuucauccgaguugaggaggcccagcugggggugaagggugccucguaggcagagggaccccggagguaggaacuagggaugugaggcuggggcagacagagcugagggacgcagcucacagcuggcgguagugagacguggucuuugaaaggcuuccuguuggggcaaguggcuuggcaggggguguguggaagcuggggagucuauagccggccuggguggggcgggcaguugagagagauuuuggagguugacuagaugcuccuuggugacaguggcacuugaagaaggagggcagggcugggaugaugugguuuccugggaugggaggcgcugagaaggucugggugcugguggcggucucaccagggggcugcuucuggagcccccauuaacaggcacucggcucucuggggaccugccugggucuccggccccacaggcuccccgagcccugccaggcugggcaggugugcagcccacccagcaggcacuggagaccccgggagaccccggauccugcagggcuucuccagguguuuccaggagcccagacaugcagccgcccugggccgcgaagccucaagagggagccgggcacguccuuggcaccccagcuuuccuugcuaccugagauccccucuguggcugggguugcuggagaugcccaaggaguaggggcuccguccucauuuucacccccgaccccagcuccgacuaugugggagguggaggugauggcucaggaaggucuuggcugcuucaggccagcucuggucucuuggacgaagccgcugggccguggguucagccuccucgugcuggccacagaguuggggccccucacgugccucacaggccugcccagcgcagcccaugcgcucacugggggcuccuucccagggcacgacccugauggaugcugggccucccugacgacccugcuggucaagcccggggccaggcgugucugaggacuccgaggagauuuccaugguccgugguguggcccuggguaggcgccuggccaagucaccagacaccaggccuucgggauccccgcauccaccaaugggguacugacccacaggcgccgggcagggcggccuccaggucagaaaccuuccaggacgcugagcaccgacuguuugcuucccugcccacggaugcccccucguggccaaucccauccaucuuagaacuacguuucagaguugaggaugcagggcuggagcggggccauggcugagcucggugccacucaggcccgaaagccccaagucagccuggcuagcgugcgccuggccaugggcaucaucaacacagcuuuuguuauucauuauuauuuuuugagacggggucucacucuugcccaggcuggagugcaguggugcaaucauggcucacugcagccuugaccuccccggccucuggugauccucccaccucagccuccuaggugcaugccaccacgcccucaggugauccucccaucucagccucccaggugcaugccaccacgcccggcuaauuuuuuuuuaauuuuuguagagaugggggugucuugcuauccugcccaggcugcucucaaacuccagggcucgagagauccauccgccuugcccucucaaagugcugggauuacaggcaugagccacggugcccagccaagccuuuguuauucuuguuguugggguccaacugugggggcuguggggaagucugcagacagcucagagucaagacagaccccgacagggacagguggugcagggagaugucauuggagauucguccccacgugccugguccgugugucuuuuccugcuggagaaacuacaugugggguuacuccuggggccccugacuacacacagcaugagaggguaggagacagggauggagggaggagggagauggugacagagagagagaccaagaaccccaagagacagagacagacagacagagauagaaacucagagagacagacagacagacagagagauggacaggcggccccucccucccagucccccagccuugcugagcccaugggagcccaaacagcggaggagggguccugggggagcgggcuaagggccccaguuuaugugcuggggcugucacuuugcacugagcgcgcccccagcuccagccgcucuggcugcucucuggagggaacaagggcuuucagagcuggggacccgacgugaauacuaauccagaagcucaaagggcggccucacaggcugggcacagggaggcugggccggggccagggccagcugagccugucugggagcucgcccugcuuggccuccccccgcucuucgugcuggggagcuccuguccuccccucaggccugagaggguccccagcuaccccaggacaggguggggggugggaacugcagcuccaggagucagggucucguguccagcaugagaugacaccgggugggcccccagcacacagucccuugaagaauggcugcccaggaggccucaggccgaugcgaggguccuuagcuuugcuuugcauuccuacagugcuccagcgacagcuccagggaggccuggggaaacggaggcacgggcacggagcccauggcagggaagagggcuugacuguacucugugcuaggacaccccaagucccgcaggcagugcuggggucaggccccgugcauccugccuggaccaggauucagaccccuuugccuccuuccuggacgucaccuacugcacccaggagaccucagugucgggccauggaaaccccugcuugggccauacacggcuccccugcuuguguuccgagccccuucaccccccagccccuggcccucagcaaccccccuccccagaugcggccucaucucuucuccagcuuuucugacccugccccacuuccugcacccaucuuugcccagaucccugcaggcauucuguacagggaggccugugcucgcacgguuccuuccaccuggcacacccccaucucugccguugacccgggcucaucuugcugugcggugaagccagccucagagccguccuccucuguccccacagcacugucugccugcacccucgccugcuggccuuggagcagggcugagcugcagagaggccaagccccuguucuguggcucgaguuugcugggugagcagcugcugcuucccaggacuccuugugccaaugccccgggagaguuuuccucuuccuuauaaaacccgugugaagcauuuuccuguuuuccaauguggaugaguuuccugcggcugccgugacaaaugaccacagcugugcggcuucaaacagcacacauucacugucaauucuggagggcaguggucugaagucaaggcuggggcagggccgaacuucugcagagggcuccaggggaagguccuuccugccucuuccugcuucugggggcuccagguguccuuggcuuguggcugcaccacucccaucuccgucuucuccucugugucucugugucuucaacuuucuguuuuuuuguuuguuuguuuguuuuuguuuuuguuuuuuuugagacagagucuggcucugucacccaggcuggagugcaguggcacgaucucggcucacugcaagcuccgccucccagguucacaccauucuccugccucagacucccgaguagcugggacuacaggugccugccaccacgccuggcuaauuuuuuuauauuuuuaauagagacgggguuucaccguguuagccaggauggucucgaucuccugaccucgugauccgccugccuuggccucccaaagugcugggauuagagacgcgagccaccgcgcccagcucugucuguuuuuuacaauauuuuguagagaugcugcccaggcuggucuccaacuccugggcucaagugauccucccaccucggcuucccaaaguguuggagauuacaggcgugagccaccucacccagccucuuucucucucuuuuuaaaaaauuguuggcuggguguaguggcucaugccuauaaucccagcacuuugggaggccgaggcggguggaucacuugaggucaggaguuuaagaccagccuggccaacacagugaaaccccaucucuacuaaaaauacaaaaauuagcugggcuugguggcacgcgccuauaaucccagcuacucaggaggcugaagcaggagaaucgcuugaaccugggaggcagagguugcagugagccaagaucacgccacugcacuccagcccgggugacagagcgagacuccaucucaaaaaaaaaaauugucauuauuuuuuacauugucuuguuccuccaaugaggaaccucuuucugucucuuacaaagucacuugcauuggauuuagggcccacccugacucugacccaggaugaccucaucuugagauccuuacuuuaaccauaucugcaacgacucgguuuccaaauaaggucccauucugauggugcaaguaggcacauuuuugggagccgcuauguaacccacccuggggaaacugaggcagggcaaggugaagcagcuuccccaggccacacaguucucuuuuaaccccaagucggccugggucagaggauggugauggggucaaaguugggggcggcccccuuuguucaucacugaaaggacagggguccccauaucacggccucuuucuagaauagacucugacgagguagcuucaaccagaaaggggugugcagucugccggugggagaccagcgugucccgggugcaguguggacagggcguuggcugagugaagccuuggcuggcaggggccaggucaucagcaggcugccucuguguuucggggguccuggcacugggcauggcgccacccaacuuggggcacccaggaggggcccuacucaucugggcuuccagucucccgggcugacccaacagacagaggaggaacugccacucugggcuugacacauaauugcuuuuuuuuuuuuuuuuuuugagacggagucucugucgcccaggcuggagugcaguggcgcgaucucagcucacugcaagcuccgccucccagguucacgccauucuccugccucagccuccugaguagcugggacuacaggcgcccgccaccacgcccggcuaauuuuuuguaucuuuaguaaagauggaguuucacuguguuagccaggauggucuugaucuucugaccucgugauccgcccgccucggccucccaaagugcugggauuacagguugagccgccgcgcccggccucgaugcauaauuuccuuuccgguggcuauucagggaggggcguggggguuggggggaggauauuccacaacuucuuuguaauaagcagcuuuaggacagaacauucaggccaggcucgguggcucacgccuguaaucccagcaauuugggaggccaaggcggguggaucacuugaagucaggaguucgagaccagccuggccaacagggugaagcccuguccuuccuaaaaauacaaaaauuagccgggcgaggugacgggcaccuguaaucgcagcuacuuggguggcugaggcaggagaaucgcuugaacccaggaaguggaguuugcagugagccgagaucgcgccacuuguacuccagcucugggcaacagagugagacuccgucucaaaaaaaaaaaaaggccgggugcgguggcucaugccuguaaucccagcacuuugggaggccguggcaggcggaucacgaggucaggagaucgagaccauccuggccaacauggugaaaccccaucucuacuaaaaacacaaaaauuagcuaggcaugauggcaggcgccuguagucccagcuacuuaggaggcugaggcaggagaauggugugaacccgggagguggagcuugcagugagccgagaucacgccacugcacuccagccugagugacagagcgagacuccgucucaagaaaaaaaaaaaaaaaaaaaaaagaacauucaucuuuucucagguucuggguucuccauccccaacagaaauaaccuggaaaaucccugcggcaacacgugugaagaagugcagcuuucugagucacaaucuauuuguaggaauuuaucccaaggugagggggaccagauaccuguacaaagaucuguggaaacaagaucgucuaucacagugauauaugcuagugagacaccaggagaaaccaaaauaucccaaagcaggugacagauccaugacacggaguccagcgcagaccaucaggguguggagacggacuuuuggcuauugaugagugugaagucacgggccgccugcagaacgcaguaugugacgugaaucccuuaaaauauguauuuaggcugggcacgguggcucauaccugugaucucaacauuuugggaggccgagcugggaggguuguuugagcccaggaguuugagaccagcuugagcaacauagcgagaucccaucucuacauaaaaguuucaaaauuagccaggugugauggcacguaccuguagucucagcuacucaggaggcugagggaggaggauugcuggagucuaggaggucgaggcuacagugacucgcguuuauaccagugcauucuagcuugggcaauagagcaagauccugucucaaaaaaaacuuuuuaaaaauacauuucaauguggaggagaaggcgaucagaaggaugucugacaagaaggugagagagguuaccucuacacaguuggcuuauggggucuucuuuuuguuuuuauuuuucauaauuuuccaaauuuugcacaccggacaccuaguguuguguuguuuuucucucucucucuuuuuuuuuugaaacaaagucuugcuuugucacccaggcuggagugcaguggcauaaucucggcucacugcaaccuccgccucccggguucaagugauucuccugcuucagccucccgaguagcugggacuauaggcaccagccaccacgcccagcuaauuuuuuuauuuuuaauagagacgggguuugaccauacuggccaggccggucuugaacuccugaccuugugaucugucugccucagccucccaaagugcugggauuacaggcaugagccaccacgcccagccguguuauuucuuaaggcuuaaaaaaauucuuugaggcugggugugguggcucacgccuguacucccagcacuuugagaggcugaggcggguguaucaugaggucaagaguuugauaccagccuggccaagaaggugaaaccccaucucuauuaaaaauacaaaaauuagcuggacacaaugauggguaccuauaauccccacuacucaggcggcugaggcagaagaaugacuugaaccccggagguggagguugcagugagcccagauugcaccauuacacuccagccugggcgacagagcgagacuccaucuaaaaaaaaaaaaaaauucuuugcacuggugugggacgauggugacgaaucccucagccaucuguggggcgcugcugagggcguggggggcauuucugcacggugaagcagagcuggugggaggcugcccgagggaagcuggugcugggaggguuugcagagaggaaaagggcaguuuauggaaaaggccucugggcucugucuggagccgucaugccggccuucacggcauccuuccgcacuuagaguccuuuccaucuccugguggcuggcacagggccagggcugcacucacagcuggccaggguagggcagggcgcccguccucagggccacugacuguagggcuaaccuaggggccugguucaccccucucaccuggggcuucgcugauaagccugguucaccuccucaccugguggccucguucacccccucaccuggcgccuugccugauagccugguucaccccucucaccuggggccucuccugguggccugguuccccuuccucaccucguggcgcugguucaccccucucaccuggggccuuaacugguggccugguucaccucuucaccuggcgccuugcagaguagccggguuuacuccucucaccuggggaggcacgaacuggcccgggcugacugaccucccucaccuguuuggcuuuaggcucuggggccccccugcccggguguuucugggaggcuggagggucccacgugagcuccaccgcgggcagcuggagggaguggggcaggacgcugagcgccgggagggguguggcccuccuguccugcccgcggccccacaccggccccagucccgcccgccucggucccugccccgcgcgccgacgucaccgggaccucccgauccucccggcccaggccgagcugcccacgcugcugcccggggcucggugcccggcgcggccucugccggcuccggcgggcgcgggacugcgagguaggggggcgcgcggggaagacucgggggcgcagggaccgagagggaccuccgugccggggcggguggguaggggcagcuccggguccagcccggcccgcgcaccaagucccgagggcgcccgggcggcggcggcuacgggcgcgcggggaccgcggagacgcgaagggcgcacuuggcgaggguuuggugcagcgccgcgccgggguccgcacagccccggcagguccugcagagggaaggccgggccagggaagggccacgcgcccccuccccgccauccucucccaggccagggcgaccugcgcgcuucccgaugggagcaaacuggggacgggucgggaauccagggccaagcgcccgaaagaaggcguuuccgggcuggggcgagccaggugggugcgggacguccccggggaaccuccagggcgccgagaaucucgucgugcccagggcuccccgcagccuguguaugagccggggagggagaaggcuuccucccccaggagacugagggagaaggcuguggauaugaucccugcagggauguaagacaggucucaaaaccagaaaagcaagggaggggugacagagaaauggcaaacuuuacaaaggacaggggagggcagggaccuggguccuuucugcccccaucacgggagggaaacacuuggcagaggaguuugggguucgcaggugaggagagagaacaggaagccaagagucuggcccggaggccacuaccccugcggucuaagcccccgguuuucccuccuagcgaauggaaacugagaggugagaaacccccaaaaccauccguccgucugguucugccugaaggucuccgcugucagcuaaugaauagcucgaugcagcugcugggagguuuugcaaagcgcauucagaauagcgagaaucagagcaugguuucuugcccaaaggccaggcaucugcguggucagaugggggagcaugagugcccggagcugugcgguuuagggcagccugaccuuggauaccugguuacugggccagucuggcggcccuuguugcuuagagcggcagaaccucccugggggggggaugcggacgugcucuuuuccagucuuuggacaaaaaaaggcaaggggaggaggaaggagaagcgucugaguuuacccaugguauuaauagcagcagggcuggaacucgggugcucugggagaggagacguccuacccccuguccccgucagaacaucccugcuccaggagcagcugggguuccagugugaagcguggcuuugaaaccaggccccgcuggcccccagcugugucgccagggccaagucacuuaacgucugagccucaguuuccccaccugaaacaccgcaguggcaccugcggcuccguguguggcuuggaggacgcaggcaugagaccuguuggcugcugucaugacugcaguuagcagaggagggggacacacugugacaggguccaaaggacagcgagaaaccuccaucugggggucuccuuuuuggagcauggauggguuggugagugccagagggugcugcgaagcugacccccacuaaggcggcucccuccccguggguacccccagggcucacaugcagcucuggcucuaugugaggaguggucuugugcagaaaugaccuggcaggauggaaggacucagcuggcagcugacaguggggaccgggguuuuccugaaugacccacgaagacgaauguggccacaaggcuucuugagaggaaauaguaugugggcagacgucaugcccuggaugcccgagagcuguacccguguuaagggauggagggagcuaagcguucucauuccuagcuuggagccugucacaccauucuccagucugcacuaggagguggcuguguuuuugugugugugugagagagagagagagacagacagacagacagacagggucuugcucugucuuccaggcuggaaugcagugaugcaaucauagcucaccacagccucgaccuccagggcgaaagcaauccucccaucucagccucccuaguagcugggaccacaggcaugcacaaccaugcccagcuaauuuuuaaaauguuuuguagagacgggguuuugccauauuuccccaggcuggucucaaacuccuggacucaagcgauugucccgggagguggcuauuuuuagagcuugccucucacauccuguugaucuuccagccgggcuagucuggagcuggcguggccacuccuucccgggcggcucagguuggcugaaggugguguugugucucuggcuggguuuccgauguagaugcucuugaguuacccacgugcccgccacugcuugcgggugugcaaacggccucuguggucguggcuccucugugcgugugcucugguccccugcaaaacuugucgcuguggcccuuccuguugcucccauucgguccucccugaauaacuuagaugggccugagguuggcaguuugggcccaagucacaccuggaaccaaugugguagggcuugugaacuuuugguaaaaagaaggcauuucucagccgggugugguggcucaccucugaaaucccagugcuuugggaggccgaggcaggcagaccacuugaggccaggaguucgauacuagccuggccaacauggugaaacccugucucuacuaaagauaacaaaauuagccuggcaugguggcaugcgucuguagucccagcuacuagggaggcugaggcaugagaaucgcuugaacccuggaggagaaggagguugcagugagcugagauugugccacugcacuccagccugggugacagaggcaaaaaaaaaaaaaaaaaaagcauuucucauuuccugaugcuuugccuggaguaggaggguuugcuggcagggaagccucugaccaggguuuucggguggucaggugggugugggugcuggcaggaaagcccccucaagaguaggggaagguccgugugugaggacuggagucaggggucucugugcugggagucaagauccaggugagcuguguaacccugggcaaguggcuuucccucucugagccucagucuccuggguuaugacaugggugaaucucaggauggcuuuggaggucggacaagguguugcaucagaaagugauuuugggccgggcgcgguggcucacacauauaaucccagcacuucgggaggccgaggcggguggaucacaaggucaggagucugagaacagcuuggccaauauggugaaaccucguuucuacuaaaaauacaaaaauaagcuggguguggucgugagcgccugcagucccagcuguucgggaggcucaggcagugaacccaggaggcggagguugcagugagccgagauugcgccacugcacucuaaccugggugacagagcaaggcuccgucucaaaaaaaaaaaaaaaaaauaagugauuuuggggcuuugcaggguggcaggcaccggaaggggaauguugaucagggcugguccagggugcccgcagguauugcuaucuguuuuaccaugucauucucuggaaagcugggacacagaccauccugggcaucuggaaggcccugggcugcuccagagaaauaauugauaggccccuguggacagaacaaauaauucugagcuggcugcggcgcuaggggaaugauuuggagguaacugggagguuauggugcuugccccuugugggcggcagugcuggugaguggaaggucugggagcgagaagccggugagcaggucaugucaccgguacccagaaacuacaaaaauaagcuggugagucuccuguggcgucgggugcuccgaggccggcuaagugccuccuccuccuacuugggccagccaggcuccuggaggaagacaggugggaccacacccaucucacagggaggacacagugggguugaaagaggaccgagcuuggccgggcgugguggcucacgccuguaaucccaacacucugggaggccgaggcgggcggaucaugaggucaggagaucgagaccauccuggcuaacacgugaaaccccaucucuacuaaaaauacaaaaaaaaauuagccgggugugguggcgggcgccuuuagucccagcuauucgggaggcugaggcaggagaaucgcuuuaacccgggaagcggagguugcagugagccgagauugugccacugcacuccagccugggugauagagugaggcuccaucucaaaaaauaaaaaauaaauaaagaggaccaagcucaugccagagcccucggaguuguugagggcauuccagcuucagggguuuccugggcgccucuuccguagcgagguccccaggaguccccgaggggacucugagagguugcagggggugcugccuccacacgcugacaccuggcauggcuagggcaggaguaccccaccccuuggccacaagcccagcagcgguuccccaccucacccagagcaaagguuaaagcucuuccaacagccucccggcuccugcgcgauguguccccaucuucccccaaucucguccccuguucuuucccccaauuuguuccagccacacuggccuccuccggcuguccccugagcccccagacguaucugcugcgggccuguguacacccaccucugucugggacggucugccccuccuccccgcugccuccuugcucagagaucccaccucaauggagcccacugugaucacccucucaggaaugggagugugggccuggcacgccugagcccugccccgcucuguagggggguguuuguuuguuuguuuguuuugagauggaguuuuugcuguuguugcccaggccggagugcaguggcgcgauuucggcucaccgcaaccuccgccucccgaguuuaagcaauucuucugaguagcugggauuacaggcaugcgccaccacgcccagcuaauauuguauuuuuaggagagaugggguuucuccauguuggucaggcuggucuugaacuccugaccucaggugauugcccgccucccaaggugcugggauuacaggugugagccaccgugccugguuggugggauuguuguuguuggacacagggucuugcugucauccaggcuggagugcaguggugcgaucacagcucacugcagccuuggacuccugggcuggagacuuccuccgaccucagccucucgaguaacuaggaccacagaugugugccaccacacccagcuaauuuuuguuuuguuuuguuuuguuuuuugacacggagucuugcucuguggcccagacuggagugcaguggcgcgaucuccgcucacugcaagcuccgccucccggguucacuccauucuccagccucagccuccagaguagcuaggacuauaggcgcccgccaccacgccuggcuaauuuuuuguauuuuuaguagagacaggguuucaccguguuagccaggauugucuugaucuccugaccuccugauccgcucgccucggccucccaaagugcugagaaugcaggcaugggccacugcagccagccagccuuuucuuuuuccaacaggaccugucaccuucuaaccuaccuucuaugcuauuuacuuagcacuuuugccaccugccuuccugcuggagcaccuaacuccauggggccagggaccucuguuuuguccacucauguuggaaaacccccagcacagggcccagcacccaggaagcccuuggcagcuaaugucacugucaugaguccgcugaacugggccacagggugccugaugcaacaccguuccugggcgugucugugagggugcucgagaugacauuaggauuaggacaguggguucaggaagguggacugcccuccccaaguggcugggcaccuuccaaucccuccagacccugaauagaacagacggcagagggaggaggaguucaccccucauuuccugccucgccgcuggagcugggacaugucauccucucuugccccgggacuggauguccaccaucggcugcccugguucucaggccuucggacaugagcugaguuugaaucacgccuugggcuucccugggucucuggcuuguaggcagcacacuguaggacuucucagcuucugaggccugugagccaauucucauaauaaauccuuauuuuauuuucauagaguagagaugaggucuauguugcccaggcuggccuuggccgccccugcucaagugauccuucugccucccgaaguacugggauuacaggugugagccaccguaccuggucauaauccuauaaauauacaugugagauuauauuacauuaauauauuaucguauauauuaaaaucucauauauauaauauauauuuuauuuauuuuuuuuuugagauggagucucgcucugucacucaggcuggagugcaguggcgcgaucucagcucacugcaaccucugucuccuggauucaagcgauucuccugccucagccucccgaguagcugggauuacaggcaugugccaccacgccuggcuaauuuuuguacuuuuaguagagacaggguuucaccauguuggccaggcuggucucgaacuccugaccucgagugauccgccugccucgaccucccaaggugcugggauuccaggcgugagccaucgcguccggccuauuauuuuauauauauuggauaaaugaaugaacccgugcguucaccugcccugggacccgccuggccucuuuuggaaccacugaucgugcaucucagcugcuucuggcugacuugggucuguccucacggcuccuccuugcucagccucuggccccgcugcaagacuugcccacuacggcccuuuccauggccacaggaucugguccuguccaucgucugugcaucugauguuucuuucuuccuuuaugguccagaggcgggaauuccacccuggugugaaccugccaggacugcccugugcacuccaggaguccaggagugagacccacgcuggagucugguggugggcaugcgggucugggcacaggcucggucugcauagaacccacguggucccagcaagguggggcccugcuucccauggugaugggaaccaugaugcuugaaaaucugcauguucaggcccaugugguggcucaggcuuauaaucucagcacuuugggaggcccauaagggaggauugcuugagccucggaguucaagaccagccugggcaacauagugagacucuucucuacaaaaaaaaaaauugacugggcguguugguacauguccguagucucagcuacucaggaggccaaggcaggaggacugcuugagcccaggaguuggaggcugcagugagcugagugcaccacagcacuccagccugggcaaaacagggagauccugucucauuuaaaaaagaaaaaaaggccgggcgcaguggcucaugccuauaaucccagcacuuugggaggccaaggcagguagaucacaugaggucaggaguucgagaccagccugacuaacauggugaaaccccgucucuacuaaaaauacaaaauuagccgggcgugguggcgggcaccuguagucccagcuacucgggaggcugaggcaggagaaucgcuugaacccggaggcggagguugcagugagcugagauagugccauuggacuccagccugggugacagagcgaaacugucuugggggggaaaaaaaaaaaaaaaaggaaauggacauaacuauuauuagaaaacaaaaucuguguguuccaaccccccucgccccgccccccacaaccucugauucuggguggcaugguguugcuuaaguuagauuuaacccuacuccaccucgguuuugaaaauggggacaaaaacugcacccacuuuucugaggguuaaagcaaugaagcccugccuggaacacagugcgguuuguggcucuugauagucauuuuuuuuuuuuuuuuugagauggagucucgcucugucacccaggcuggagugcaguggugcgaucuuggcucacugcaagcuccgccucccagguucacgccauucuccugccucagccucccaaguagcugggacuacaggcgcccgccaccacgccuggcuaauuuuuuuguauuuuuaguagagacgggguuucaccauguuagccaggauggucucgaucuccugaccucgugaucugcccgccugggccucccaaagugcugugauuacaggcgugagccaccgcaccuggccaauagucauuuuuaucugcugcugaugacuuagaacuuccagggcuggccgggcacgguggcucaugccuguaaucccagcacuuugggaggcugaggugggcagaucaccuugaggucaggaguucaagaccaaccuggccaacauggugaaacccugucuccacuaaaaauacaaaaauuagcugggcaugguggugggugccuguagucccaacuacuugggaggcuaaggcaggagaaucgcuugaacccagaaaguggagguugcagugagcaaagaucgugcuacugcacuccagccugggguagagggagacucugucucaaaaacaaaaaacaaaaacaaaaaaccuugagggcuggugggauuguaaacuggugugaucuuucugcaaagcaauuugcaauacaaaucacgauccuucaaacauccacauguggaauuuucccuucuaggaguccaucuugaggagauggaaacacagacuuauguacaaagauguucauuacggcguuuuugggcagugguugaaaguagcauuuuaauuuauuuuuuauuuuugagacagagccuugcugcaaugcccaagcuggagugcaauggcgcaaucucggcucacugcaaccucugccucccggguucaagugauucuucugccucuugaguagcugggauuacaggcacgugucaccacgcccggcuaauuuuuguauuuuuaguagagaugggguuucacuggguuagccaggauggucucgaacuccugaccucgggugauccagcagccucggccucccaaagugcugggauuacaggcgugagcugcugcgcccggcucuauuuuuuauuuuuuaaaauaaaauuuaaauuuguuguuuuuuugagacagggucucacucccuccuccaggcuggagugcaguggcacgaucauggcucacugcagccuugacuuucugggcucaggugauccuuccacgucagccuccugaguugcugggacuacaggugcgcgucaccaugcccggcuaauuuuuuguguuuuuaguagagaugagauuuugccauguugccugggcuggucuugaacuccugugcucaagugauccacccgccucagccuccugaagugcugggauuacaggugugagccaccacacucagccaaaaacagcauuuuuguagaauguuuaagaauuuggaaaaugcucaagauuuaugaagcaaaaagauacaggauuauauaugcaguuggaucuuaaauuuguaaaauauauuuggagaaagaaguuauagaaagcuccaggcuggcagugaucucaguggaaauucaguaccagccccuccccuacucuaagccaguacguuccucuggaaaaaaaauauauuuguguauauuugugugcacacauguauauacagcugugucacauuuuccccaaaagaaaauauauaaauuacauauaucaaauuuauuuauguauucacauauacauaggaauaugagcacauauacauguauuuuccagaugaaugugugacacuggaguuagugggccaggcgugguacguaugcccauguugccacuacucaggaggcuacugugagccaugauugugccacuauacucuagccugggcacagagcuagaaccauucuguuaaaaaaaacaaaacaaaaaacaagcaaaaaaaccaaacaggcgugguggcucaugccuguaaucccagcacuuugggaggcagaggcagucggaucacuugaggucaggaguuugagaccagccuggccaacauggugaaacccuguuucuacuaagaacacaaaaauuagccuagcauggucgggggcaccuguaaucccagccacuugggaggcuggggcagcagaauugcuugaacccgggagguggagguugcagugagcccagaucacgacacugcauucuagccugggcgacacagcaagacuccaucuaaaaaaacaaaaagaaguuggggcucggggggucugugugcaguggcugacgcacuuugggagguugaggagagaggauugcuugagcccaggaguuugagaccagccugggcaacauagugagacccccgucucuacaaaaaauacaaaaauuagcaggacauuguacacacuuuguauucccagcuacuugggaggcugaagcaggaggaucgcuugagcucaggaguuggaggcugcagugagcuaugauugcaccacugcacuccagccuggacgaaacagcgagacccuaucucuaaaaaagaaaucaggguuaguuagagaauagggcuguucauucucccugcaaaaacauagcuguuucugguuuuccggcuaggacuggcaggucuugcaacuugacggucgcagacaaguggguuuugcgugucuagcucagcuuucuacaggaagcuuguccgagggcugcugauucauaagggucuauucacacguccuuagcugcaccugccuugcuauauuauuugugcaucccccuucugugguuucugguucguuucuagccucuccccacaaccaccccuuugcuuuuaucuguucugcgaggcuuccccugcccagcccacucuccauccgcccuggcaggucucacagucucugaacagagacauaaauguagcccggaaccaagugugcggugacgacucucaggcguguuccuaagugugggguugccuagcugcugcugcuccggucagagcaucuguuuugcagggcggcuuugucacgguucugccagcuccacaccccccaccgucuccucccuaccugguccguccuggguguugaaauccgcuguugcuucuccacuucucccuguuucuagcuggugggguuuggcacaaacgccugcccugacugcuucaucuggaucucgggcccucacguguguccuggggacgucugcgugcuguuggggcugcguacccccgcccccccccaaacauaugcuugcugggcgcacagggaccugcuaggaaagcuuguaauugggaugaagagcugccgugaugggaguucuuggguguuggggggucccuaggugauaggggcucugggugaggaggaaucccagaugaugggggcucuggguaaggaggaaccccaggcgauggggggacccaggugaggaugcacacuuugugaucaugccguggagaggagcauuugguuuccaccuggaggggcccuucuagcucugcagggaggggaggaggucucucuucccuccaaggccucuagacagaguuggcugguaagagggaauggaagaauggccuugggggcccuugcccuucugugggggcccauggacacaugucccugccccugccgagugggagguacuuccccauacccaguucuggaugagggaagcuucuggaagagacugugaccguccccuggguggcccaugggacccaaccugcuagagaagaugaagugguugaauguguccuuccaaccucgcuggguggcagugcuguguccuggaggggccagggcucccucugacacccucguccucugcagagcuucuccccaggccugggcaggagcggcccaucccuugccugggacaucgggcccugugugcucggcagugaggggaccccuguucgugucauccacagggugcugugggcccagaagcgcccaugccugagagcguccaggaccaggcagagcugggccuuaagggcccuuggaccagugucugucugcagggagcccccgguagccacucggaucagcccgagggaagauucuggacgagaccguggccgucccccggguggcccauggacagcagcaggggcucccaggaguggccaggcccugcccgcccaccaugcugcaguguagacccgcacaggaguucagcuucgggccccgggccuugaaggacgcucuggucuccacugacgcagcccugcagcagcuguauguguccgccuucuccccugccgagcggcucuuccuggccgaggccuacaacccgcagaggacgcucuucugcacccugcucauccgcacgggcuucgacuggcuccugagccgacccgaggcucccgaggacuuccagaccuuccacgccucccugcagcaccggaagccccgccuggcucggaagcacaucuaccuacagccgauagguacgggacgccugcagccaucggcacgcuccugggggaccagcuuauauauagcacaagugggggaugucugugcauagcccccaggcaggacugaaaugagggaagaggguccuggguguaugggaugccaggguggaggcagggagguccuggcugggccaaggcuuccuuccucccaccccauccugacacgaugcucagacggcccaggcucugggacugguccacaugcagguguggccucauccagaugugcacgguccuggcuacgccuguugaaacuagagccaucccaggcacugugcugcgggcuguauaaagaucacgccgggugugguggugcacaccuguaaucccagcuauucaggaggcugaggcaggagaaucgcuugaaccugggagacagagguugcagugagcugagaucaugccacugcauuccagccugggugacggagugagacugucucaaaaaaaaaaagaccacuuucucuuuggggugcugaaaugaggaucagcccauuucgccggcaaggagauggaagcagggagaggucccuugaccugugugacuggcagagcuggucacugguagggacgggacuggaacgcaguucuauuugacccuggggcuggggugcucauccugaugcuauagugggaggggcugggcugagcagggugggggcuugagggcccagaguggucacuguccucagagcucugugucuggcagagucugggggacccagggugaauggggggccgagacaacaggcauccgugcucagaagggaacggcccaggcaggugcggggagcgcgaggggcagggccagcucugugccucucacaugccaagagcagccuggcagagacagcacacgggacgggggcccuugggcucggagaggaggaaagggcugguguccgcuucugaccagcgcaccacgccuuucggcaucucgacagcaagccagaacagggcugaccucgccuggccuugccccacgcaggcuugucaccagcccuggugguccacgcagccccuuuccugccccucaggacccaaauccugcggguguccguuggucucagcauccaccaccccacagcagccaauccaacagcuugggagcuacccgcuucccuccaccucccugcuaauggcucagagccuggugucccaagcucugacgcacugacacaugggcauguuguugaaacacaggggccgggucaggagguggggacugggccaggcucugcauuucccuccuuuccugggugaggcugaugcugcuggccuggaguccuggcagcugauuucucacuggucuccuggccucuacccuugguccuuguccaucuguccuccugaccugugaucuggugugugcaucccuucaggggcugcccugggagcucccugcugccucuccagccucgaccugcacccuugugugcuacucugccccagccaggcuggcauuuugcagccaugcagccuggcucuguguccugcugucugccccagccaggcuggcauuuugcagccaugcagccuggcucuguguccugcugucugccccagucaggcuggcauuuugcagcgagguggcucggcucugugugcugccugcucagcugcagugccuggcgcuaacccuagaagucccugucccuggugagucccugccugcucucucccugagcucauaugcgauugucacugcuguccuuucaucugugcaugaaucuuuccucugugucccucgguguuugcccuuuugaaaaagucaugcuuuccaucccuuuucuaagccugacgcucugcuugcugucaggguagguccacauuggccuuguucacccagcaggccggugucugcgagugauucccggggagagggucccaggcgggcaggggcgucgcagggcugacggugcugcucucccaccagaccugagcgaggagccggugggaagcucccugcugcaccagcugugcagcugcacagaggccuucuuccugggccugcgcgucaagugccugccgucgguggcagccgcguccauccgcugcuccucgcggcccagccgggacucugacaggcuccagcuccacacaggugagugaggacggcagccgccgcucaggccaaggcaggccccuucuggaaggaagaggugggaggaaggcgcccaggagaggaagggaaccuuuucuuccuuuuugcugggaaacauccauuucccagguguuugggaagcaggaccaagccggagagcuccuucuucccacccaggagugucuggggaccugaccauacagccagugcccacaggaaaacgccagagcaugcagagcaggagaagcgagcccuucuuuuuuuguuauuuuuuugagacggagucuugcucugucacccaggcuggagugccguggcgcgaucucggcucacugcaaccucccgguugaggcaagcgauucuccugccucagccuucugaguagcugggacuaaaagcgcccaccacacccggcuaauuuuuguauuuuuaguugagacagggucucacuguguuggccaggcuggucuugaacuccugaccucaagugaucugccugccucagccucccaaagugcugggaugacaggcgugagucaccgucacuggcuugaaaugagcccuucuaaggccacucagcauggcuccaaccuuccgucuuugcauaguacuuuacacgugccuagaucucaacccucaagcccuugccccuucccugagggucgcuggugacuggagagugugaggcaggguugagaggcagaggugaagugagggcucuguugguggauaggaaaccuagacucaaguuuagggagggccucaaaggggcuggaaugagcggauggacagcuuucaucaguucugggauacucucagccauugcugcuuuugucaguuaucaccucugccccauucucuucucuccuaugacuccaacugaauguauauuaauccaucuuacucucuucucuauaauaucuuuuaugaucauucaugcuuuagucugaauuuauucucauccuuuggcuaaggcuuacucucucuggagucacauccaagguacuuuuuuuuucugagacagaaucuugcucugucgcccaggcuggagugcaguggugcaaucucggcucauggcaagcucugccucccggguucacaccauucuccugccucagccucccgcguagcugggacuacaggcggcugccaccaugcccagcuaauuuuuuuguauuuuuaguagagacgggauuucaccguguuagccaggauggucuggaucuccugaccgcaugaucugccugcauuggccucccaaagugcugggauuauaggcgugagccacugugccuggccucaucuaagguacucuuaaacccauauauugaggcuggacaugguggcucacacauguaaucccaguacuuugagaggcugaggugggaggauagcuugacagcagguguucaagaccagccugggcaacuaggccagacccugucugugcaaaaaauauaaaaauagcuggcagugguggcacacaucuauagucucagcuacuugggaggcugagaguuugaaacugcagugagcugugaucgugcuacuguauuccccucuauccugggugacagaacaagacccgaucauuaaaaaaaaaucacaacccccauauauuguguuccuaauuucaguugucauguuugugaguucuacaguuuccaguggauucuuuuugaaauuagcagugucacgcuuuuuuuuuuuuuuuuuuuuuuuuuuaagacggagucuugcugugucacccaggcuggagugcaguggcaugaucuuggcucacugcaagcuccgccuccuggguucaugccauucuccugcgucagccucccgaguagcugggccuacaggcgcccaguacugugccuggcuauuuuuuugcauauuuaguagagacgggguuucaccguguuagccaggaugaucucgaucuccugaccuggugaucugccugccucggucucccaaagugcugggauuacaggugugagccacugcgcccggcccagugucacauuuuuauaggucucaguugccuaugacacuucuuuaaguucagcauugauguccaugaacauaguugcuugaccgucuguccgaugauuacacuaucuggagugcccaugugccuguauuuguuauuucugcuaauuuugucucaguuauccugcuucauugugccuuguuauuuuugauuguuaguuacgcaucuuauuggaaaaauuaguuuaacuuugagaauuuuuggccugggccgauguuuuucaccauagaggauuuucuuuuccuucugccaggcaccaaagggcugacugugggacaaagacaugaagcuuuucugggucauucugaugguccccagggcuccgcaucccucccagggcaggaagcaugucagggucauccugcccacucccccaccccagaaacaguccagcuucaucuguuugagcuccaguccuccccguuuuucucauuaggucucugccuugguuauugagguauaauuuagauaguaaaauucauccuuuuuaguguaagguucugagucuugacacacgcauacaucacguggccaucaccauaaucauauagagggcggcucucuaccccucuaccggccaccaaaccuuucuccuuaauccacuccuccccaucguggguguuggaagcagcuguucuuuaucauucacucugccugucuggccaucuuuuggcgggaggguugucuaaauucccuaggguacuguuacagggagcagccacuguugagauuuggggguugauagggguccccuggcugggguggggugccauccccuggguggcauguuucuuuguccuggccugcuuucuggguacagccuacacuccacaggcuuccccagccccugagguccuacaguggggucuggggacaauguggccugccuuggcccuggcccuaaaacacagccggggaccccgugccucucaggcuuggccucugcagccucagcucuccucaccucccccacgccguacacggugcgucucaccuguuauggccucugaccuguuggugccaggccuguggcagcucagagacagcaccaagucccacaagggucacuccagggcuuuccacccccucugcuuaguggacaaacugcuguuuuccccagccccacacuucagaaggugcacgggggagcccucgggaaaaggacaugcacucgggaagguucaaaagcagguggaacucagaggguaugccagguugcauuuguggggucagcucagccugguuuuuaauuuuuuuuuagagauggggucuugcuuugugacccaggcucaagcgcaguggugcgaucauagcucccugcagccuugaacuccugggcuccucugccucagccucccaaguagcugggaccgcagacacgugccaucacaccuggcuaauuauuuugauuguuguagagaugggguccugccaucuugcccagagaguagcaugcuuuggaucacuguacugguuuccugggacugccguaacaaaguaccacaaacugaguggcuuagggacauuucuugucucacaucgcuggagccugcaguucuuaaccaagguuuuggcagggccacguggucucagaaggcuccguggagggugcuuccuggcugccuccagcuucuggaaguugcuggcaaugcccagcccucuguggcuuccagaugcacaacuccaaccucagccuuugacuucccgugagcuuuacgccaugugccucugcgucucuucuaagacuccagucacugggucuccuucaugaccucaucuuaacuggauuacaucugcacagauccuguuuccaaacaauggcagguuccggggguuaggacuuccaccugucuuuuugggggacauagccugauccacaacaaucaucacugucaaucaucaucaccucauuagcaucauugucaaucaauuacccagcugcucaggaggccgaggcaggaagauugcuugagcccaggagguggagacugcagcgugagcugugauuguacuccagccugggugacagaaugggauguuaucucaaaaacaaacacagggccagcuguggugggucaugccuguaaucccagcacuuugggagaccgaggcagacggaucacgaggguaggaguuugagaccagcuugacuaacauggugaaaucuccuuucuacuaaaaauacaaaaauuagcugggugugauggcacgugccuguaaucccugcuacucaggaagcugaggcaggagaauggcuugaaccugggaggcggagguuacagugaacugagauagauagcgccacuacacugcagccugggcaacaaagcaacacuccaucucaaaaaaaaaaaacaaaaaaacacacacacacagaacaaccuccuugucaaucuguuccuuuuaaugguagaacuccuuggaaaacacuucuccggugugccucugugccgcaaccccucuucucuacacuaacucugagacccucuccggguuuccugggcccgugguggcugcucugcccccuucccucccugggcuucugguuucccggcuuugaugccaucgugcccagguucagccccugggccucuccuguaucuguccacacucaugcuccggggaaccaugcuaacaaguuacacaacuugcuagcuuggaugacccacugugaucucacagugcugugggucaggagcgcccccacugcccaggcuaaagucaaggguuggcuccaggaaacuccagggagaauccauuuccugcccuuuccagcuucuagaggcacccguauccuuggcuaaugguccuuccuccgagccagcccugcagugcccucaggccucacguucucacccagacccccugcugccucuaacgagggcuuuuuuuuuuuuuuuuuuuuuuugagauggagucuggcucuguugcccaggcuagagggcaguggcgugaugucagcucauugccaccucuaccuccuggguucaagcaauucucccgucucagacuccugaguaguugggauuacaggcacgcaccaccaggcccggcucauuuuguauuuuuaguagagaugggguuuugucauguuggccaggcuggucucgaacuccugaccucaggugaucugcccaucuuggccucccgaguugcuggcaucacaggugugagccacugugcccggccuuaccgaggguucuugugauggcaucaggcucagcuggcugcugcagaaaaacgccuccaucccaagaucuuuaaucaucugcagccccuuuggcuguggggacucacaggucccagggcugagacguggacucucuggggcugucgcucagcugcugagguggcuucuccuuccuggggcugcaagcgccagucuuguuggcccggcugccucuccagcguccccacugggcuguccauggccuuugacuuaccauguccugaucuccaaauggcccuggcugucacuccacaucaugcaguacugugugcccucaggucacaccaaacgcugguggcccacaccugacuugggaaggggcagggcccaggcagaggaagaggaugacggggugccagccugagccuggaagauggggguccccggcugccuccugaccccauccucuggcccucuccccgcagacggcauccuguccuucuugaagaacaacaagccaggggacgcgcugugugugcugggccucacacugucugaccuguacccccaugaggccuggagcuucaccuucagcaaguuccuuccagggcacggugagccggggccccagcagcugugcgugggggguagccuggcauggggcuguggccuccguggcugcagggcacccucuuugcuuuugcuucaagcacccuccugguggaagucaacaccugugcaugggaauagauggccccuuccagcuccuccugaggaauggcauaggggcuguuccucagcuguggcgucugccccagggcccaacuucaugugggcaggacagggccucccaggacugguaugucuuugggccauggccagcuugcaugagagcaugagguggguuugacggugggccccccagagccaaggcugaccccugagagugcccuucucuccaucucucuccagaagugggcgucugcagcuucgcccgguucucaggggaauucccgaagucggggcccagcgccccugaucuggcccugguagaggcagcagcagacggccccgaggccccccugcaggacaggggcugggcccugugcuucagugcccuggggaugguucagugcugcaaggugggugggggcucuggggcugguaagaggggacaggagggugcugucugagcccuuggugccucggucuguuacacugccccauccucacagugaaguggauggaccccuaacucuauggaaugaggaaagcaaggcuacacagcuaugaagcagcaggggagggauuagagccccaagccccuauccuguguggccucccacccugacucaccuuuccccuggggcccugaaaguggccugugccgccuggggcagggggagggcgccuggaccaccucccggccaucuggccucacccagguccucauuuugguccugcuggggcugccuggggaucugccggaugcaggggcaaggcagugaggcaaggugcuugguggccuuccccccaggucacgugccacgagcucugccaccuucugggccuggggaacugccgcuggcuccgcugccucaugcagggugcgcucagccuggacgaggcccugcggcggccccuggaccucugucccaucugccugaggaagcugcagcauguccuggguuucaggcucaucgagagguaccaggugaguggcugaguugcgcugcccggcugcugggaccugcgcuccggaggcccgcgagcgccgccuggaggcuacgcagggcauggggaccgcacacaggcuuugucaacugccggguuccaggcagugcagagcccugggaccugcgcugggguugagcuccauccggaucucacuggcaguagaucgaguccugccagggcccgcgugugguggcugugacugggagguugcagcggggucgaguggggacgagggcuuuucucccucugucaggaagagcuggcauuggagcccagccggcggguggcacggucuucccaggguaacuuucucuuugcuuucccgucacccacacuugggucacugcugcucagaggaggcacaggccccuugcgaggaggugggagcugacacaacaaggcuuguuggagguggccuccauuccuaacucccucugucgccugggugggguugccgagcaaagggcucguccguauucauggacauuuguuugcaagcucaaaagcuuuacucugaguucugagugcaaaggcagguggugguaauuuuucuucaaacccagcuuuggacuacaaccaguuauaaggugcucacugcguacaggcaccagagcagucaaugaaaccgcgcuggaaagccccugcauccuccucccgcccguugaggcaagugggggugugguucccggaccgagccugucagaauccccugcagggccuagcugggcccuccuuccuucugggguagagugaggagcuguaucuugcaggguccugggugacacugaacuagaggccguggcauuucuagcucacagugcuggaaucucucugcagggauccucucugaagacucuggcagucaagggaaggugaagggggcacagaggaaacagcuuuuccaaguguaaggagaagagccugugacuuggggggaacccaggcgcagccauggcugaggguaggagcaucucccgaggguacagguggcgugauggcuggucagcaccuggugaugccuuguaaagguugcugcugccagcugugccccgucaaggggcagcucuuaguaccuuccugaggcuguguaacaggcacaggggcagcuuggucugcagaaaggguugagagcucucauuugaugccuucaccuggggucuugugcaaccaucugacaugaacuuuuagaaaguguaugccccucccuacacgugcugaccuggcauagccuggauccaccuggaucugagcuggaggguguagcuccuccuccugcccagagcucucuccguuccgugagcaccaucuccugaggcuguggagggaagagggccagggcaaaggcacuccaggguggccuggcccuccuggcuguuguagggagggcagugguguggaugugaggucaccugcugucccagggcuuggggaggugcuggagagcugaccaagggccuggccagaaaaggucacugcuguccacugacagcaaucagugaaaugccucuugaagaaagccugacuuguuguggucucugccacuuccugugguguaaacagucucacgauggcugaugugagcucccaaugugaugucagugagugcugaguugggaacagaugugcagugggaccuuguuaaacuguguguccccuguacagaugcaggagaggagacuaaccuugagagcagaggugagagugaaauggagaaaacauuuaggaagugaguuucaaguacugccuuugcuuuacauuuuuuucccccugguggucucacuauguugcccaggcuggucuugaacuccugguuucaagugauccuccugccucugccucccugugcugggauuacaagcgugagccaccaugcccacaccuuugcuuuaaaauuuuaaauuuuauuuaauuauacgcuuucugggugggugccguggcucacaccuguaaucccagcacuuugggaggcggaggugggugggucaucugaggucaggaguuugagaccagccuggcuaacauggugaaaccccgucuccacuaaaaaauguaaaaauuagccaggcaugcuggcaggaaccuguaaaaucccugcuacucaggaggccaacgcaggagaauugcuugaaccugggagggggagguugcagugagcugagaucgcagcacugcacuccagccuggccaacagagugagccucugucuuaaaaaaaucgaaaaauguuaaguguucuaacuuuggaugacaaggagcuugcgaaguuccugaauggugagcucuuggggguggguaccucugacucuggcacagccuggacaugaguccucaaagggugcuggucacaagagcccucacaccaccagccugacucccgccccuggguaacugaggacggugggguccccuuagguaaggaggucuccuggcaguucccuggcuagacaagggcuggcacggagcaaacucagccuguguuucucccucuuagagacucuacaccuggacucaggcggugguggggacguggcccagccaggaggcgggggagccgucagugugggaggacaccccgccugccagcgccgacucgggcaugugcugugagagugacucggagcccggcaccagugugucggagccccucaccccugaugccgggagucacaccuucgccucggggccagaggaagggcugagcuaccuggcagccucagaggcuccgcugccaccugggggcccugcggaggccaucaaggagcaugaacgguggcuggccaugugcauccaggcccugcagcgggaaguggcagaggaggaccuggugcagguggacagagccguggacgcccucgaccgcugggagauguucacgggccagcucccggccaccaggcaggacccacccagcagcagggacagcguggggcugcgcaaggugcugggggacaaguucuccucccugaggaggaagcugagugcccgaaaacucgccagagcagagucggccccccgucccugggauggggaagagaguuaguacagcaggggcugcccuacgucuccuucccuaaggaugcuggccagcacuguccaguagcugaggccacuacugaccugccagggauaaagaggaagggucugccugggugguggcucaggccugucaucccaucacuuugagaggccaggaguuugagaccagacugggcaacauggugagacucugccucuacaaaagaaaaauuaaaaaauuagcuggaugaagugguucaugccuguguucccagcuauucaggaggcugaggugggaggauugcuugagccuaggaggucgaggcugcagugggaugugaucauaccacuguacugcagucugggccacacagaaagacugucuccagaaaaaaaaaaguucuuuggagaagccacagaccaccugucuucaggcgccuccuucaacuccugagucccagccagccgcucccaggggccugcacacauggagaggccucccugauccugggugcuucucguggaguacaagccggacugugcugagguugggacagagcccccuccccugcagaggcagaaggaagcagcgugcguccugucuccuuccaggcugugggccugcccuucaguuauuuauagcuggagcuggagaggcuggcucagaugaggagugaccccgggggcacacaggcuccacacugccacccagcuuccaaggcugagucuccucccuaacggggaagugacgggguuuugucucuaucaucucaggcgucaaccacaugcacacacacacugucacguucuguggcgcuaacagcauccugauccugacggacuucaccggggcucuccaggcaucucuucugacaaacacugcaggaggugagggugucugacgugcacugagggcagaggcccccuuauuccugaggcggcuacagcucaccguggggaagaucaacuguggugauguuuuugggacaguuucuuggcaaagguggccgcgcugucaguaccaaguagcuggagguggugaucagaugaucugucuuuccuuuuuuuuucggucuaguucugucaguugcugagagagggguauuauugccauggcugggcguuugaucugucucccuuuaguuuugccggauuuugcuuccugcacuuugaagcuccuuuacgucccugcacauuugauuguugugucuuccugaggaauugacccuuuuauugucacacguacccccucagccugugguggagggucucugggagagagacuuccgguucugacagcggaaucccuucggagugacgagggcggggucacagcucgcgcacccucaucuggagagaggcaagaacagggcagcuuggaccuuuuguggguggguggcucacacgguuauggagggcuucuaagaaaaacaaaauacaaaacuaaaacuagaagggcuaugcaggugaggugggcugaggcuuccuugugaaucugacauugguggaggccgacugaaggcucccgguccuggucccacuccguguugacuucagagaagcaaagaugcagcucagaaguagcauuaggaucuucgucccguucucuuuugcguagcuucaaaaaggcguaacagugaccugggaggggagaugaagagcuaggccuuucagaaagugaccaauggaaggugccggcagagcacccugcaguaacagaaggugaaagccggagccugguggcuguugcugcaaacaaccacccaaaacuuaguggcuuaaaaucaccacagucuagcucaugaaucuguaacuugggcagagcucgguggagacgguuugccccuguggcucgacuggaguguucguucacacggcugccaaguggaauuuggcugggaaucucaggccuugguuccugcccacgugagacucuccauggaggaggggcaucuucuuaggaaggcagcugccauaccgugaggaaacccgacaaacagggcagccagagccagacagcaggcuccuggucccagucccggaaaaugcaaagggacaaguauguguugauuucagagaagcucagauguagcauuaggaccuucauccauacccuucucuuuugcauggcuucuaaagggcaugacagugaccugggagguaacugugccagaauaaagaggggagacgaaaaaaagagggucacuuucagaaagggaccugggcuuccucacaauauggcgguugcccuccuaagguggacaucgggagggucagauggaagcucuguggccuuuccuaacucggccucacgucacagagcgucaccuuuccugcacuccacggcggcagugacaaggaccccaccccagguucacggggaggggacguggcagggaaugugagacaacacaauauugcuguggccauucaugaacagucagucagccccacucggcguucacuguggggauuuggcuggugcaccugcgagguggccugaccuguuuuccgauuuccuucaucuucugcaaaagguuaaccgcuggagugaugcgagauuaaacagaggugauaaaaau

SEQ ID NO: 191570 - RNA, 43652 nt, Homo sapiens
gugcgucgcgggggcggggccgcgcaggcguaccgggugccccggcucuggagcauaaacaagagcggggacgggaugaggcggcgguugaucccaggguggcgaguggcggcgaccgaggcggcgagcggggcccggcgccgacccugagugcagccugacccgcccucgcgcgcgcgcccuccccggccgggcccacucgccgcgcgcccagccaugaaccuggcgagccagagcggggaggccggcgccggccagcugcucuucgccaacuucaaccaggacaacacguaaggccggggucgggggucggagucggggugaggccagggucggacccgggcuagggggagggccucgcugccaagcucggcggcgucgcaggcucggccuccccgcgggccaaggcgcgcagaggcguccccaggggcgggcccggggcgugcagggaggggcgcccuccagggagacccucgggugcuggccuggagcugcggucccggagcgggagaggugguggagagggggcugcuuucacccucuugcggggaggcccccuggcuucagacuuaacuacuucucgcaaaguuggggccgaacuuuggggcuugacuugucuuggccgccuguggagcgcugggugugggucgcuuccucuccucucgucuccucuucccgcugcuugcucagcgucucccacucacucuccuuugaaucaggcccuucuccuugucuuuucaucgucuuaagacccuucucucucucuugauuuucuuuucuucguuucucacuguuuuuuuguuuguuuuuguuuuuugggguuuguuuuguuuugagacagagucuugcucuguugcccaggcuggagugcaguggugccaucucagcucacugcaaccuccgccuccuggguucaagcgauucuccugccucagccucccgaguagcugagacuacaggcacgcgccacugugcccagcuaacuuuuuuguauuuguaguagagacaggguuucaccauguuggucaggcuggucucaaauuccugaccucaagugauccgcccaccucagccucccaaagugcugggauuacaggugugagccaccgugcgcggcccucccuguucuuuuugggacaucaacuuugaugucuucuccagcaaguaacaaacuuagcaauaaccuuggcaucugaccuagcuagggagaaacugagccaagagaggcguuacggaccagugccccaggagucucagagcuccagcgggugggucauccucagggcaagagaaggccuuaaugccagcccgugcauucggaacgcuguuuguccccacugauacggguuggaugcugccugggaggaggacuuguggggaugguuaauagaugagcgagcuuucuggagagagaagggugaguuaugggguuggcagggaggagagccaucuuggaagugaguaagaggaagugaggaaagagaaggaguggggcauuuggcaucuuacuaagucauugguugaguuguuacuggcugaguggaauuaacauagcagaagguaagauucuuuaggaaauuaaaagugaauuguagaauggacaacacucagugggugguguacagcaggcacucaauagcaccuccccaaagcugugaagacagucgcacagugggacuguauugagagucggaaggggcaaaucaccucauccaacuacagaugaggaaauccuuccgaaaggcuccaagcuggucuggguuuuggaauugguuaauaguggagcgggggcaggaguggaaucucgccuccugagcucucuuccaauguucuuucugcucugccaugcuguuuuuuuuucuguuuacagaguagaauucugaagacagugaauuuagaaauaauagcauaacaacguguaaagaugaaaacucccaaguacuguagcguucugugugaccaaaagccagaacaacaaacaauucggacaaccuguugcaguucaaguggaauagacuauguuaauccagauagggaaaaggacacaucccaaaccaauucuaauuugguuuuuaagcccaaggccacaguauuuugagaccaguaagaaaugguaguaguaguagggugguuuaugccuuguauaaauuagagaguuuccaaaacauugucggccacucuuucaguuuuucacuaauuauuucuaucagaaugaaaucaaauagagaaaagcauucucuuuuacuguuacuucagcuggacugccauguucccugugucacagaagagugucacucuggccugaaauaggaccuuuucacacuuggacauuuucacacuuacccacuucuccaugcuccccgaaguuauuacaguucaagagauuucuguuacuuugagauuucauaacuuugacuugccagagagaccuugauguaguguaaaccuaaauuggaaugaauaguaagcuaggauuauacuagaaguugacugggcuaaaaugacgguaauuuguuuuaaaucuacacuugaaagaaauagagaaguucccggagagagcuuuuauggcuuauaccuuuuccucccuucuuaaucuccagaauuuauugaggagcacaauuuuuagcaagugaaagaaugaccgucuagaacucacauuuacuguaugcagugagaaaauuuggaagccaguucacuuacuagaauauauauguuauagggucauuucccuuuuuuuugucuuuuaaauucuuuuuguauuuguuacauaccaaacuauaacuguccugccuuucuuuacugguaauaugauuuccaaugucguacuuuuucaugauuccuauccuaaaagugugcauaaguuuuauuuguuuuuuaccauuuguuuuuuguuuuguuuuguuuuuuuaccuagagaagugaaaggggcaucaagagcagcuggucuuggccgucgcgcuguugucugguuaguuccaacccugguuucugaaaguaucaccuuggaaggcuuauguuagaggacuuuuuuggcuuuuugaaauugcagugaaccaguuaauaagugggagaggaucacuugaaucugaaauggaaauaucaaggacuacauuuuuccaguggauaccacagcuugugggaaguuagugauguagcaaugucuguuuuaaaugccaugucuaaaagggauggaaugaagaaagggacuugacuuuccaagucuuguguuuguagaauugauguuaugaaguguguggagacaacaggagaaaccuguuguuuucuuccaccaugucucuucuagguuaugcuuauugugcugggaagguacugcucuccucucuuuguucaucuguaaaucaaggguuuggguuuuuguuuuugagauggagucucacuguugcacaguuugaagugcaguggcauaguuauaaugaucauagcuuacugcaacuuugaguuccugggcucaagcgguccuccugccucagccucccgagaaaccgggacuacaggcguaggccccacaccuggcuaauuuuuuuuuuaguuuuuguaggcacagggucuugcuaugucgaccaggcugguguugaacuccuggccucaugcgaucuuccugccucagccuccagagcauugggauuacaggugugagccguugugcccggccugaagaugguuucuaagauccuucacccuuaaaguuuuaaguaauucugccugcuaugcaaaggauauguuugaggagggcagggggugacuuaggaggauaucauccaacagcagugaccagugggaaggagacugucucgccaucaggacuugugugacccacaggacgugcaucaugcagccaagggagaacuuaggugacgcccaguuucuggcuuggguucugggugaaugugauaacaucguggugaaaaagccgagaaggagagaacucugcuuggggauacugaugaguuggaaaggccacagggauauggagguggaggaugugagggggagcggggaugggggugggcuguccauagcccugaaagagagggcaccagggccucccaggucugggcuggcagccacaguugagguugcuuuugguuuacagugucgggcucuauccgccuaagcacgcaaucaaguauggcuucuccgcaaagaugaugaagaaggagagucuuuacggacugacgauuagggaagggggagaaaaggaaaauaagcaaaaaaucugacucacaucuucauuuuugaguggcagucacugucucuuugauguucaauguucaaguuuaaauucauugacggagacuuucaguuaaaaaugauggaucaaacauaagcauuuauuuugguuccauccccagacccuaauaaaauguuaaucaguaaaaugucaaaaauauacauuuucuaauuuuaaacauuucuuaauuuuuuauuuuuguagagaugggguuucacuuuguugccccaacuggucucaaacuccuggcuucaagugauccucccgccuggguagcucagauugcagacgcaagccaccacccuugaccucaaaaagauauuuuaaaaggcuuaaacucauacgauagaaagaaugagaaaggagauauuagccaguuuggaagcuagcgagugguaaaggaagugggaucucaaauugcuagugaagaaagcagagaaccaaccuaguuuaaacugcagaauccccuccaggcucaggaaugggcaggccagggcuccagaggcgggcuuguggggccgugaaaugaggaggauguguucaagugcguuuaaaaagcagugacucuguccuucccuagagaaggacaggccuacucucuggggaggguagagcagggucucuggguuugggcaccaggcacaguugaagguggggauacuggcaaaaugggggauugagccaauacauauuuuuuugguugugauuugcuaguuuuccccuuugucaaugaaagagcccacuaauggggacaggcacaguggcucacgccuguaauccuggcacuaugcaaggccaaggugggaggaucccuugaguucaggaguucaagaccagguugggcaacacagggagaccucgacucuacacaaaacaaaaauuagccgggugugguggcacgcgccugugguccccagcuacucgggaggcugagaugggaggaucccuugagcccaggagguuggggcugcaguaaggcgagaucgcaccacugugccccagccuggguggcagagugagacccugucucaaaaaaauaaauaaaaauaaauaaaucccacucuguugacuuaaaaauaaauaaauaaacauuuuuuggcaauaaagcuauguauuagggaaaaucuccuacuuaccuguugcucugccuuucccauuaguaugucugccauuuuauggucaggucaauuuugaaauuguuuaaagccaaaucuccaaagggguguugaacuugauuguugauguugagacgaaaauaucaaucauauuuauauuuaauaccauucuuuaaaaauacucaucuaggccaggcacgguggucacgccuguaaucccagcacuuugggaagccagggcagguggaucaccaggucaggaguucgagaccagccuggccaagauggugaaacuccaucucuacuaaaaauacaaaaauuagccgggugugaugguggucaccuguaauuccagcugcucgggacgcugaggcaggagaaucacuugaaccgggaggcugagguugcagugaguugagaucacaucacugcacucuagccugggcaacagagcaagacuccaucucaaaaaaaaaaacuuaucuuuugcugggcgugguggcuuacaccuguaaucccagcacuuugggaggcugaggcagguggaucaccugaggucaagaguucgagaccagacugaccaacauggugaaaccccaucucuacuaaauacaaaaaauuugcugggcacgguggugcaugccucuaaucccagcuaccuggaacuaccuggaaggcugaggcaggagaaucgcuugaacccaggagguggagguuccagugagccgagauugugccauugcacuccagccugggcgacagagcaaaacuccaucuaaaaaaaaagaaaaaccaacuuaucuuuacugauaaaguguacucauacuaugguauauauaucucaaaaaauauuuggaauauuuuuguuucccuuucuuaacggauuggaaugcacaguuuuguaaacugugggguuaaacuucuagcugagguauuuaauauccuaaaucagcuuccaaauaucugaacuugauuggcaaaguccaguuuuaacaaaugcuguguguagggagcacagcagagaacugggaugucuaacccaaggaucagggacuaaggcucguuaauuuugcccaugggagaagcccccucgaagcucauuuuauacauaaugcuaauaagcuuggugauuugguuuccaagucaccaagaaauuaggaaggacgggcuguuaaugacggcaggauggucacgaggaaaagugacaacugucggcaaaacaagagauggaaaaauauuuuuauaaacucagugcuacaggccgggcaugguggcucacaccuguaaucccagcacuuugggaggccgaggcaaguggaucaccuaaggucaggaguucaagaccagccuggccaacaugguaaaaccccaucucuacuagaaauacaaaaauuagccgggcgugguggcaggcaccuguaaucccagcuacuuaggaggcugaggcaggagaauugacugaacccaggaggcagagguuucagugagccaggaucgcgcugcugcacuccagccugcaugacagagcgggacuccgucucaaaaaacaaaaaaaaaaaaaaaaaaaaaaaaaaaaccauaaaauaaauaaacuuagcacuacagucuggcuguuugauaugggguacaccaaacccucaacucgaaagaacuugucaucccuuguuuuaaggacacaggaagguauacaauuuaagaacaauuuguuuuuuuaaucagaaaaugggagugggggaguccugcuuaaaauagcaacccuuaguuaucuggaaaauguuuuccugaacaucaguuucccgaaaguucuggguugcugagauuuuguuuuaguuuuagccuagggauauuacucuauucuucuugguucuuuuauuaauuuucaaaauaguuacagguaauaauaccuaauuauuucauugauacaacaauugauguaacuaauucaguauaguaaagaagcaaaaaauuuuugcaaagaaaaauuauaugagcugguagaguuuuguuucuguucuuuuuauccuucuaagauaaaucaaugugauuuuacagauuaauacugauuauagcaacucuucuuggaauacauuucuuccacauacgugugaaagaguaguuggaaaucucaaguuuuuaauaaaucacaugaucauuaaaauagcccugauccuaucuugggguacaaauacuuagugugaaaugugccccuucccuguuucagccuucuguuuuaccuccucauuuucauguucucccagauguuaaaagugauccugguaucugauuccucuguaccccggugcuuccugcuuguucgcucaucuuucuucugcugaaagcuggacuugcuucuuguuuugcuuucuuuggucaacuggguucuggagaggcacuuuucugaugaggaaaccccuucugugguguccccgaggccccugcugggaggggcugcugagcugugggcuccuugagccuccucgcagaagcgggugaugaguauggacucauaaacgcaaggccaugaaaccaauccucugcuuuuuccuuguaagccaacgacggggccuuugauuccagacucuaagguagcuuuggaguccguuucguuuccagcccacugcucagccauggcacagcacagggguggagccacggguaguaaaggccugcagaagcacagagagaugccugcgcccaccucgauuuuaaauaccuucguuuaaaauuuagaaaauucacuuacuuaacuuuuuuuuuuuuuugguuggagucucgcucuaucacccagucuggagugcaguggcgcaaucuccgcucacugcagccaccuccucccagguucaagcaauucugcugccucagccucccaaguagcugggauuacaggcgccuuccaccaugccugacugauuuuuguauuuuuaguagagacagguuuucgccauguuggccaggcaggucucaaauuccugaccucaaguaaucugcccgccucagccuuccaaagugcugggauuauaggcaugagccaccacaccuggccagcuuacuuaacucucauauucugacauauacuguguguacacaucagaccacuugagaaaccucaguuuguuuugaggaaaccaguaaggcugauuccuugugcuuauaucccaaacuuaaaguuuuauagaguuuguuuuuuaguauucuuauuuuaauuuucccuccacuuuauugugguguaauuaaaauuguaucuguugaagguauacagugugauguuuuauauacacacgucuuuugaagugaucaccaguccaguuaauuaacauaucuaucaccucaaauaguuaccuuuuugugacaagcacacuuaagaucugcugucucagcaaauuucaagcacacaauaccuuauuaucaacuacaguuacuauccuguauguuagaucuccagaaaaaguuuuuugguuucuuuucuugagacaguaucucgcuccgucucccaggcuggagugcaguagcaggaucaaucuuagcucacugcagccucaaccuccuguccugggcucaagcaauccucccaucucacccuccugaguagcucccugggacuacaagggcaccaccaugccuagcuaauuguuuuauuuuuaauguuauuuuuguagagauggagugucaguauuuugcccaggcuaaucuugaacuccugggcucaagcaguccuccugccuuggccucccaaaguguugggauuacaggcaugagccaccacauccagccucagaaaaguuuuauaggauuuaaguaauaauauugucuguauuuuauugaccuuguggcaucuuccugugccaagcacuugauacaaacagugugaaaugauuugcucugugcugauuuguggagggcacgcggggaacuugcugggaacucgcugggaacgugggagcugguuucuacauugucacugucugcacguaucagcucuuauuucugaauuuggcuuuuuugcaggucccuagcuguugguaguaaguccgguuauaaauuuuucucccuuucuucuguggauaagcuggaacagaucuaugaaugcaguaaguguuugcuuuauuuuuccccuucuuaaaaaaaaaaaaaaaaguuguacuugaauuggaaugcgaucuaaaauucagacgcugugguugaaguccagacacccucuuaccaguccucugcuuccaccuucaucuccccaagagguggcaacuggugacaccuguggccgucugcccugaucugugcauuugccuacauaggagggcagguaccgagggagcucuguucaugagggucuucaguacaugagcacauaccauguguacuggucuguaacuucucucccuuuuaaugccauuuaaaccgucuaaauuacugucauaaagggcuuccagaaaauugaaaauuuuacagccccuguaggaacaauuuauuuucccgcguuggcauuuuacagcauugaaguggcccgcgugucggagaggcgcauggaacagcgggaggucaugcgcuuuggccucuugcucagucauguuuugugugguucuagauggauuacuucaucucugggccucaguuucuuuuauuuuuugcaaaacagaaauaaugcaggucuguaagauuauugccaggauuagagauuauguauguguguacuuaacagugugcaaaaauaguauuugcugaguaaagccugugauggagacugugacuggaagcuuuggacccuuuccacgugcguaauuuuuaauuaagauaguuauggauucacauguaguugcaggaaauaauacaggucccuugcauccuuuacccuguucuucccaguguaacaucucgcaaagccccaguguaauaucauagcugggauauugacauccaccucuccugagcacacucuccaguccuccuugugcucguuugugugugcguagguucugugcagucuuuuuuguuuguuuuuuuuugagacggaguuuugcucuuacugcccaggcuggagugcaguggugccaucuuggcucaccgcacccuccgucucccccagguuccagcgauucugaacuuugugcuggugacuuuuaauuaugguguucuccuggcccgccagcaggugcggccuuucggacucgcuccugggcccuggccuccucucugcaggugagccugcaggugccccucaccuccaucggggaugugucugauucuucccagcagugucuuuccuguugcugcccccaagagcaaguacccaggcccuuugcagggagagaguggggcagcagaauuuccaugaucagcgucccugacucauggcuccugguggcuggcuuagguuuuacuccuuucuuuguccuuagacuugccugcugguacuuacuaaaucuuccaaaaaagccuuucuucugccacggaggcugggagaugugaucugggcgauaacauaggugugagccagggcuguuuaucccaggcgccgcccgccuuccugaaguccugucaccuggcugccuucacgugagccacacgggauugcuccccacagugguuucugcaguggagggcagccccgucuccaggcuuuuacgaaugacugaaacucaguccagauccagaugaagcgccugaauugugcuguuaaauuguugcuggagucacuguagucaucuguuuugaaaugcacagagguuuuucccuugcugggggccagugcuuauaaagaguggaagaaugccaaaaccuggucuuuccuuuuccucaaauugaaguuuaguuacuggcuucuagugccuuauuucccagagauuuuuaguggaacaaaaugggaugucuugauaguaucuuuuagaguggauauuggccgggcgcaguggcucacgccuguaaucccagcacuuuguaaggccaggacaggcagaucacaugaggccaggaguugaagacgagccuggccaacauggcaaaacccugucucuacuaaaaauacaaaaaaauuagccaggcaugguggcgcacaccuguaaucccagcuaauagggaggcugaggcacgagaaucacuugaacccaggaggcagagguugcagugagccaagauugugccauugcacuccagccucggugacagugagacucugucuuaauaaauaauaaaaaauaaagaguggauguuuccugaccaacaugguaaggugggugcaugaaugucuguguucuucuuagugaacuuuggcccuuaaaaauagaugaugaaauggacaaagaauguuuugaggguuaauacuuuaaacugaucuauuacauuguucuauuccaagaauauuaucugccuuuccucuuucacacuuuuuuuuuuuaguagauaagagaaugucucuagaaaacagguuagcuacuaagugaaaugucaagauuguuuucuagcauuuuucuauagguggacucagaggaaagaauguuucuucaugucucaguauuuaguucaggcucaguauugacgucuacccucaaaacuuuuaacaauccaucauaaaaucagaucuuugcugucacucacuguggcuguuacagaaagaaugggccagagcuggucuuagagaaaaacaagauggacagcuacuuguuguucuuuuguuuacuuagaaaagaaaauucacacacacacacaaaagcuuggucuagcaguacuggaagauagauuuucuaccaucaauguuguaauuucaaacuugaaaguugcaggaacugccagauaggcuuugcacauuguuuaugggcgccucauauauguauauauauggggacagagucucgcucugucacccaggcuggaguacaguggcauaaucauagcucacuguacccuugaccuccugggcucaagcgauccucccuccucagccuccugaguagcugggaccacaggcacaugccacuacaccuggcugauuuuuuuuuaauuuuuguagaaacggggucuuacuauguugcccaggcuggucuugaacuccuggccucaagcaguccucccaccucagccucccaaagugcugggauuauaggcgugagccacugcauccagccucucauaugaucagugcugggauuacaggcgugagccaccgcgcccggccucucauaugaucauuuucuuucuccaugugcauuuuuguugucgucauuuuuugaauauacauaaugcacaaaauguggucucuuuucccuaaaauauucuacaacaguauccuacacuguuaggcaaaauaaaugaaggguauggguuuauuauuuguaaaagaucacaaaaguuuagaaguuggcuuuuuucaaaagcugcacuguguguuuucuuugcauuugcuaaacuggauucugagcuaggaaaacaucucauaaacauuccguucugaaacccagcacaagcagacugcuccuuagcucagcaaaagugacuacagccugcguugauuauggaaguguagcuguugacauauaacaucuuuuaucaaccuuccugcuuggccaagaaacuaaucauuuacuuuacgggccaucaucugcaucuuaagguuugagaaaugguguuuucugacguuagucuuauuugacaggcagugcacugguuggaauauuaauuucagugagauuuauaguaauguauccuacagaggagaaaccacgagcgucccuuggccuaaaucuguggugcuggaaugcuggccucuuaccuugcauccuggcggagccgcagacacacacggaaguggauucaagcaguuauuucauggccucauucuucccuucccacuccagagcuucaucguugccaacuauaaaccacgccagcagaagcaaaaagcaacauucuuuuuuaaaucaaguaauuaauuucuuagauuuuagucaggcaaucucuaggagggaaguuuggcagaaaguguggcugaggccaccuagaaugagugcuaaaagcaaggccucauuccuccagugggauggaagucacuaaaguuuacguucagccuuuuuuuuuuuuuuuuuuuuuuuuugagacggagugucgcucuguagcccaggcuggaguguaguggcgcaaucuuggcucacugcaagcuccgccucccggauucgcgccauucuccugccucagccucccgaguagcgccaccaugcccggcugauuuuuuuuguguguguauuuuuaguagagacaggguuucaccguguuagccaggauggucucgaucuccugaccucaugauccacccgccucagccucccaaagugcugggauuauaggcgugagccaccacacccugccacguucagucuuucuuagugucagcgugagugccucuuggcacugguguccugggacgugccaucuugagucaauacaucugugcagucugguuucuuugcuuucuuuugauuauuauggcaucuuucaccuagcagccugauccauuguccaccauuauuucaugggagggcugagccagguuuguacuucaguuuacuggaaagugauuguucuggguaugcggguuccauguauauuuauauguuugaaaguucaucugggccgggcgcgguggcucacgccuguuaucccaacacuuugggaggccgaggcggguggaucaccugaggugaggaguuagagaccagccuggccaacauggugaaaccgcgccucuacuaaaaauauaaaaauuagccggacaugguggcgcgcuccuguaaucccagcuacucugcaggcugagguaggagaaucacuuggacccgggagucaaagguugcagugagucaagauugugccacugcgcuccagcuugggcugucucaaaaaaauuaaaaauaagaaaguucaucuguaugugaaguguaauagaaaaauauuagagcaucuugaaauaauacauuagaaaaauggcaacaaaccuaaacuacuagcaauauauaaaaguagguugcuuucugaaagguguauuccugaaaagaucuagucagauuugguccguagaacuuaaugucacugcgaagugcauccuuuuguguuauggcuguuaccacuacuacuacuacugcguuuuuuuuuuuaaaacacagggucucgcucugucacucaugcaguggugccagcacggcucacuguaaccucaaccucccgggcucaagugauccucccccuucuugcauagcugggacugacuacaggugcacaccaccaugcccagcuaauuuuuuuuuaagaguuggggucucacuguguugccaaggcuggucuugaacucgugggcucaggccaucuuccugccucagccuccuaaagugcugggccuacaggugugagccaacaugcccggccuauuagucuuuuuuuuuugagacggagucucgcuguaucauccaggcuggagugcaguggugagaucucggcucacugcagccuccgccuccuggguucaagcaauucuccugccucagccucccaaggagcugggauuagaggcaugcaccaccacgcccggcuacauuuuguauuuuuaguagagacgggguuucaccauguuggcuaggcuggucuggaacuccugaccucagguuauccauccgccucagcuucccaaagugcugggauuacaggcgcgagccacugcacccggcccuggccuauuagucuuaaguaaugacaaaaauauguucacuccagagugauuggucguucauuucugccuuuugcagagccaccucuccuacuuuugguuacugacucuuguaaaugugaugagaguuauagaucuaucucccccagaacacucaguguuuagcauaugguuucagcgacguuagagauucaggaagcccauccaguuauccacggacaccuggucuuugcaguuggccgucacacuuaguuucuguccugccucugcugcugcccauguccccacaggaggagguggcucacugugcaaccuccaccucccgaguucaagugauucuccugccuuagccuccuuaguagcugggacuacagguaugugucaccacgcucagcuaauuuuucuauuuuuuuuaguagagaugggguuucaccauauugggcaggcugguguugaacuccugaccucaagugauccaccugccucugccucccaaagugcugggauuauaggcaugaaccaucgugccuggccuuauuuacaauucuuacaucaacucaaacugaguucuuuuuuuuuuuucccccaugcagucaugugcugccacuguuuuuuuuuuuuuuaacuaccuguuucugccguuugccuguuuuucuguuggguuauuuaucuccuaaugacuuaaagcaaauuagccauuuguuagggguugcaaauauuuuuuuuuucuggacugucauuugccuuuugaccuuguuuaugauucuuuucaccauucugaagucuugaauuucuauguauucaaaugcauuggucuuuuuuucuaaggcuucuaaauacuagaaaggguuuuuccugcucccagcauguacauaaaacauuucccaaggugguccuguaauacucuggggucauguucuaccuucaauacuuggaguguauuggauguaaggaaucccucccuugcauuaaggggcugggaaggaugcuugccuguguccuuacuuauguagaggggcuuacucugaagcauuuagggugaaugucagaaggagcuucucuuccaaacuucaauaaagaaaaaaucauugaagcaaaaugguagaaaguuaauauuuguuggauuagguguugaguauauggagguucauuuuacuguucucuuuuaugaauauuugcaguuaaaaacgagcuuuucugccuucauccucccaucccuguuuaaagcauucugaaagcucugcuuuuucucauuaacauuuuagaaaaaccauuuccaagugaugguuggugguauuaccuucucagcaccugcacguaagcaacugaagacaucauuuuucuuucuaacauuuuauuaaaggaaauuuucaaacugaaaaguggaaaguauuuuacagcuaacaccuguguauccaccacuuagauucuucccuugacauuuuacuauacuuguccuaacacacacacacacacagacaccaucuaucuuuuuuauguuuauuucuuuuuuugagacagcaucuagcucugucacccaggcugccaggcuggagugcaguggugcaaucauagcuugcuacagcuuugaccucuggggcucaagcgauccuccugccucugccuccagaguugcugaggcuacaggagugcaccgccaugcucagcuaauuuuucgauuuuuuuguagggacacgaucuuguuauguuguccaggcuagucucaaacuccugggcucaagugauccacaucagccucccagagugcugagauuacagacaaaccaccacaccuggcuuuauuuugugugugugugugcauuuccagguagacggcaggcaucaguacauuucuccucaauacugaguagaguucaauguuuguuuuuuucuuguaagauaaaauuuacuuacaguggaaugcaucuaucuugagugaacacuaugugaguuuuaacaaaugccugcaucucugugaacugaaacccuaucaagguuuaccaucacuccagaaaguucucucauacuuccuuccagucucagcucccuucugcccacauuccccaagaggcaaccaguguucugguuuuuuucuacuguagauuaguuuugucuuuucuagaacuugauaugaauggagcaucuacucuuuugaugacguuucuuuugcucugcauuuuuuuuagauuuauccacaucuuaugucucauuugcccaguaugugaauauaugacaguuguugauguauucuuuucaugacaguuaucugggcucuuuguaguucagcuauuaugaacaaagcuaccaugaacauucucguacaagucuuuuaauggacagauauuuucacuuagauaaauauuguaguggaauuguuggcuagauauguguuuaguuuuguaagaaacccccauaaccuucuccuaagugacuauaccauuugugguucugucagugcuguaugagaguucugauugcucuauguccucacuaacuuuuuuuuuuuuuuuuuuuuugagagagucucugucgcccaggcuggagugcaguggcacaaucucggcucacugcaaccuccaccucugggguucaagcaguucuccucccucagccucccaaguagcugggauuacaggugugcaccaccacaccuggcuaauuuuuguauuuuugguagagacgggguuucaccauguuggccaggcuggccugagacuccugaccucaggcgauccggccaucucgaccucccaaagugcugggauuacaggcgugagccaccacacccagccuccucaccaacuuuugauauuacuaguuuuuuucuuuucagcccuucugauguguguauaaugauaacuucaugguuuuaauuugaauuucucagguaacuaaugauguugaacauuuucaugugcuuguuggccguuuauauaucuuccucugugacaugucuguuccagucuuuuguugcuuuuuagguuugguuguuuaucuuuuuauuauagaguuguuagagcucuuuagauauucuggauaccaguccuuugucagauauguuuugugacuauuucuccuagucuguggcuugccuguuuucuuucuuugagcaaaugguuuaaauuuugaugcagucauauuuauguuguuuuuuuuuuuccuuccauuuaugguuuuugcuuucuaggcccuguccaggaaacuuuugccuacccuguagucaggaagguguuuuccuauguguucugugaaagcuuuauauaguuaacacuauacauaaaagcuaaaguuuuuauauuuaagucaauaaucuaucucauuaauuuuuauguauguugugagguaugaaucaagguuguuuuuuuccuaauggauuccuauuccaucaucauuuguugagaagauuuuucuucccuccugggauugcuuuggugcuuuacaguccugugaccugugagucuguuucuggacucuuuagucucuucuaaugaucuauuugucagucuucaacuuuguucuuuuucaggauagcuuugcauuuucuaguuucuuuuccuuuccauauaaaauuuaaaauccacuuugucugcaaaagagccuguugggauuaugauuaggaugggauuggaccuagagaucaguuugaggguugauacguuaauaauauugaguacccagaauaugguauaucucuucauuuauuuagcucuuuuuaaauuuguuuugguaauauucugugauuuuuuuuuuuuuuuuuuuuugguauggaggucuuacaucuuuuguaaaauuuauuccuaauacuuuggauuuugacauuaucauaaaagaaaauuauuucacugaguuuuccaguuugcugcuggccuaaacauauaguuaauuuuuuauauuuuaaucuuguauccuaugacuuugcuaaauucauauauuaaauaguugcuccauagauuccuuaagauggcagugaaggcuguuugaugucuugcuuucuaauguuugugccuuuuauuucuuuuucuugccucacugcaacguguaagaccucgagcacaaaguaaggagaguggguauccuugccuuguuucuagucuuaacgggaagagaucaaauaucuucaccauuaaguacagugucagcuguagauuuucuuaacuguuucuuaaccuucaucagugaaagaagguucuuccuaauuccagguuucuuagguuucuaccaugaaugagcauugcauuuucucaugcuuuuucugcaucuguuggguuggcacagucuuucucugugcaguugaauuggaauuuaucaccaccucuaauggcgacuugcucuuugagaugaucgucucauacuguucucacuuugaaaucucccaccuccaucccaucacaguuaacaccugcugcugcuucaagagagguuggugcugucggucuggggcucccuucucuuuccuucuucaggugaccagcccccuaagugguuuguuccuccaggcaagcagucucaaccauaaauccaucucaguauaucuaguagcuccuguauuugaagacagaaacuucccuugcccaugcauaucccccagccccucccauauuucuacuucuccagaacauaacuucuuuuuuuguuuuguuuuuuugguuuuuuugguggagucucguugugcugcccaugcuggagucugguggugccaucucggcuggcugcaaccuccgucucucagguucaacugaugcuccugccucagccucccaaguagcugggauuacaggcgcccaccgcgaugcccggcucauuuuuuguauuuuuaguagagaugggguuucaucauguuggccaggcuggccucgaacgccugaccucaggugaucugccugccucagccucccaaagugaugggacuccaggcgugagccccugcgccuggccuguagcauaacuccuauagauaguugccuaaguuuuuuuccacuucucauucucuuucauguuucagccauucuuccuacacaucuccaucaaaauaugucaaggucgccauauaagcuccucguucccagacucaggggacgugucucauuuccucuucccuccucugcagugcugggcacaguuaccugcuugcuguucuucagaugcccucuucuguugacuuccaucucauacacggucuuggcuuuucucuuacucaaucuccuuugcugaccuuuggcaguuucggugccacacagggcccugggcccacaucucuuuggccuccucuccgugauggcaggcacugcccuguuuaccacuguauacuugggauggucucuacugguguaggaucugcuguuuguguugaaugggugaaguaaauaagucaaguuuuaccaagcaaagcaguaagaaccuauucuuugaaaaaaaauaaaaauacaguugauucuuguuguucacaguucuagucuguaagucucugggacgcuggauuagcgaaucaugaaguguugcucccaggggaaggauugguagguggccucuggucgcaacauuuucaucagcugaucaaaagacaaccucguuuugugugugcuucccugccucaagacaugcugacguaauggggauuguugguucacuaacauugaacucgcggcucgcauagaacucagcccacacaugugcuuucuccgcgggguacaucccaggcugcuugugcuuagggauacucgacgacacucagcacugugccagggccaacagugaaaucaacaacaagcacaaaagugcaaaaagcagacacucaguagcccuauguagaccaggaaaaggacaguuguuuucagaaucaacacgagaagauaggacguugcccugugugaccucagccaggaacaugugcaucaugugacucaaaucuuuucccgaggcugggagcgguggcucacgccuguaauccaagcacuuugggaggcugaggcgggugcaucaccugaggucaggaguucaagaccagccuggccaacauggugaaacccugucucuacuaaaaauacaaaaauuaggcaggcgugguggcaugcaacuguagucccagcuacucaggaggcugaggcaggagaauugcuugaacccggaaggcagagguugcagugagucgagaucacgccauugcacuccagccugggcaacaaaagcaaaacucugucucaaaaaaauaaaaucccacuucgcaugugucuacggacggcuguaaaacaccgugaguguuuaugcggggucacaaagaaaccuuaccuagcaggugaguucacagauacugagccugugcauguugaggagcagcccuauuuggaaguaaguucuuuucaccacugauuggauuuaggaggccaguggagaggccaguggauuuaaauaaaauuguacuuaauaaaaaaccaguuuuguguauaccagguuuuccuaugugucccaacccugaaguuaaugaagcugagaguccaacucuucuuucaccauucaggaaguagauaucaggccuuacagcuaauuagagcagagcugagacuggaaugugauuguuaaacucgccuuccugcagggucgccguggcacccaguacucaccaagguugcagugccgcacacacgcccaguacauguguuaggacgcgugccgcugagcuucaccaagagcacuucugccucuuggauguagcacugggguuaacagcauuucaccacccacugaaacugaauggcacagagauugaguuuuguuuuuuguugcuguuguuguuguuuugauguuuuuaaaacaacaccauuuggggaguuuggggaauauccaaaaucuggucauaagguccauuccauccguucagccaguguggaaggagcuccucgucuaugacaggcgacauuagaccuggggguggugcagccgugaaugggccaaacacggcaccuguccucagaccaucaguccagcagggaacucugucucucagccauugccuagauucucagugguaagcgcggugacuacuagaggcaacagguacaggaugcaaccgggccagugcgugcagccccuaauacuaccaaguacuaccugagaauggggugccuggagagugagaggcuagacaguggccggggaagggccuugugccccuggauuugcacaucuggcugccggauuugagaagugaggguggcagccucaggacaccagccaugaucaucauucaguccuacccuccuuuuuggggcaggacugguauuacagacagggucucgcucuuuugcccaggcuggcaugcaggaacgugaucaccgcucauugcagccucaaccuccugggaucaggcacucuuccuaccucagcuacacaggcaugcaccaccacgcccagcuaauuuuuguauuuuuuguagagauaggaccucacuauguugcccaggcuggucucgaauuccugcccucaagcaauccucccaccuuggccucccaaagugcggggauuacaggugcgaagcaccgcaucuggccccagcccucuuucucgcccaccgccuagcaagcagggcugccgugacuuaguauccaugucaaucuccugagggaaagaggggacuggucagagaaccagggucugaucuuuagagaaauuauuuuuacugcaaauaauugacauucuggguuaugcaccaucucuucugaguuggguuggccucgugucugaguggugcugcaugccaggugcuagagguguauccgcugacaaagauuccuguguccacgcacuggcaugaucccuccugaucgugccuuucguugacagauccuggaagacgguggccgcuagucugagaugcugcugagcagagaagcugcagacagagccuguccucccuggccccccgacccugccaccaucuccccauuuguggcagacgcuugcaucuguuccuuuugaaugaaggucgcuugcuguugucagaaagaagguuuaugacagcuuucugguaaaagcaacugaaaagacacugaauggaugcugugaagagcuuaggaugauguacuuguguuuauggcccguuccauuugaaguggugucgcacugcaggauggcgcguaggucagcgaggggccgcgggugcgagggugguccugugagaggagcaggccguguuuuugcugcagcuuucccauguuucauucacacacacaaguacuugucacugugcugcagcuggccacaguauccaguuagucacacgcagcgcaggucuguagccaggagccacaggccacagcauacagccuaggggcauaguaggccuaccaucuagauuuguguuugcacgacacaauugccuacggggcuuuucuuuguuuuguuguuguuguuguuguuguuguuguuguuguuuuugagauggagucucgcucuguggcccaggcuggagugcaguggcgcgauuuuggcucacuucaagcuccgucccccggguucacaccguucuccugccucaggcuccugaguagcugggacuacaggcgcccgccaccacgccuggcugauuuuuuguauuuuuaguagagaugggguuucaccauguuagccaggauggucuuaaucucccgaccuugugauccacccaccucggccucccaaagugcugggauuacaggcgugagccaccgcgcccggccccuucagggcauuucuuagaacguaugucagcguuuugugacaugaguguaauagcgacaucuuuuuaauaaauaugugucaugccacuuuggacaugugugauucuuuggccagccucaguaugcgagcacguaggcuagcgcucagcacaugagucuauggaacccaggggaagcaauugcaguuucguaguaguuugugucuuaauuaagggagccccuagaccuuacucuuucacuuuaccuaggaguuugguuccuaaacucaccauucaaauccagcaacagaacugacugaaaggaaccuuugucuuucgugugaaugcucgugaggggccauccuuagaguggaaaugcuccugaggcuccagcgaaucaagacccucagacccccgggcuguccccaccccaugaccacauguuccgcaggcacccucagcgcugugcccugcgugucgcccaggcagguguuuguuuuugagcgcagauucugccuguggccauagccauguggagauguucacgcauguacuucccuuugugauuucagccgauacggaagaugugugcauuguagagagauuguucuccagcagccuaguggccaucgucagccuuaaagcaccaaggaagcuaaagguuugccacuuuaagaagggaacugagaucugcaacuacagcuacuccaacacgauucuggcugugaagcucaacaggcaggugagcgcugccccagcugggugugggcuugucuguugcucccuccagcacucugggacaagcccaccccaccggcaugccccuccgucauucccuugcugccuggccccacguugccgggcacagauccuugccuacagagaccagcucuguuuccucacccaccagcuuugcucagcccauuccauucacgacaaaugcccgggccucugccacacugcucccauacaggcguccccggccccacccagaggguggauggcagucucuuucaccuauuaccugguuuugcuuuuauaaauguuacuuaaaaaaaauauauuuggccgagcacaguggcucacgccuguaauccccacacuuugggaggccgaggcgggcagauugccugaggucaggaauuugagaucagccuggccaacaugaugaaaccccgucucuacuaaaaauacaaaaauuagccgggcaugguggcaggcaccuguaaucccggcuacucgggaggcugaggcaggaaaaucgcuugaacccgggagucggaaguugcagugagccaaggucaugucauugcacuccagcuugggcaacaagagugagacuucgucucaaaaaaaaaacuuacagacuuuuuuuuccuuuuguaaauuguuaguuuaacuuugaauucaagaugaaggauuuauuacuuuaucucccccuaaacuaauaagacugucuggcacagaggaaggacgugguggguggcaugugugcguguuucacgcacgugugugugucucccagcuugugcucacgcccaggguaacagcaccacccgggagaccccuggcaaucugauucugcccgcacucccugcagggaaagcugauuaggcugcuggcuguagaguggacaugaugacagccaguagcugcacccugagauacagugacuaggugaagucacaguagagacguucuugccuuacgcaguugaaacuaggaaguggucuguuaacugacauaguugguuagaaugggaaauuauaagacaucauaucuugagcauuuaaaaauuguguucacguccaacuaauguagagcuggucaucuuucuugcauaaguugucucagcgaugcaucgucugcaugucuacauucauuuucuuccaaauggagcaggaacuugcaaaguaaucugagugcacaauaaaauguuagaccuuuuaaaacccccuuauuuucauuuuaccugugcugcacucagcaucaguuuuaaaaagcaaaucuuuccaaaucuauucacagcacacuugucuuagcuguagguuagcauuugccuaacacuaaacuaaauggccugguuagaauucccaguagagauggggugaguaugagggagaggugcauccggccuggcuccuucuugauuguugauggaaagcagcuguauccuuggcgcuucuaacauuggucugcaugguguucuagaaggaacuaagauugugaagccaacgcagggguggaucaccugaggucaggaguccaagaccagccuggccaacauggugaaaccccaucucuacuaaaaauacaaaaauuagccaggccugguggcagucaccuguaauuccagcuacuugggaggcugaggcaggaaaaucacuugaacccggaaggcagagguugcagugagccgagaucacaccacugcacuccagcccgggugacacagcgagacacugacuccaaaaaaauaaaauacaauaacaauagaaggaaugagagcgucauaguccaggagucagucaacuggagauuggggcagguauugcacuggccguugcuucacguuugguuucguuuugucucucgccuagaggcugauaguaugccuggaggagucccuguacauccacaacauucgggacaugaaggugcugcauacgaucagggagacgccuccaaacccugcaggugagcuaacuugugaggagagaaucccauuuuucugauuuugcccuugaaagauagcuauaggugagagagauuuuuucuuuuuauagguuccgcagaugagacagauuuuaaaaguauugaucccaaaccaagcugccuuccuacugaugcuggucaugugaccacauaagcucauugguuugaucaacuuucaaguuugagguuacugaucaguucaaaccaaaggccuuuaaucucuugacaauacugguaucaccuaagguggggauuugggguugcagaacuuuccuaacacagcaaacaagauuguauccaagcuauuauuuguuccuaaugcucuguuaaaugaaugcugaauuaugucugacauccaagaaggaacucucagguggaaguuugcaucucguccuccgugugucauuugcaggccugugugcgcugucaaucaacaacgacaacugcuacuuggcguacccagggagcgcgaccaucggagaggugcaggucuucgauaccauuaauuuggugagaugccuuuccugcucgaauagcucucuaaaguguggcuuuuuccugaagaggagcacuguggugucccuggcauccugacuuggcucagcaauacaaccgcugcacuuuuuuguuuguuuguuuguuuuugagacagggucuggcucugucgcccaugcuggagugcaguggugcaguccuagcucacugcagccucaaccuccugggcucaauugauccuccugccucagccucccgaggaguuacagucaugcaacaccacacccagcuaauuuuuuauuuuuguagagauggagucuugcuggguugcccaggcuggccucaaacuccuggccuuaagccauccucccgccucggcccccuaaagugcugggacuacaggcgggugccccgcgcccagccccacugcucucuucucaguagcagaguaggucuggcucauucugcuucuggaucugcugcggcguucagagcagugcugagcuccucgccacgggaauguuugaaggaacauagaaaaccuuagggauaaauugcuuugcuuuuucuaaaguuggagcagcauuuccuuggaugcccagccccaguaaaucaaguggguuuggcauuuguuuggaccguaaugguguuuuaggaacagcuaauuggcacuugcggaccaagugucagcccuggggcgugggcggucacugugcgguggccacucuuuauuggugucccuuuuucagagagcugcaaacaugauuccggcucacgacaguccuuuagcggcacuggccuuugacgcaaguggaacuaaacuugccacggcuucggagaaggugagucugcuuuuccccgggggagcacuggugccaaggcguccacagacuuuuucaguucuguucacacagccaccuuagaggcaagguccuauacuuaccagcuccgggagaagcaaagacagccacccacuugucaggccacaggcguguacugcccgagagugagcggagcuugcagugugccacugggacgggagagcugguccacauuuguaguagaaaauacagaaauguccagaggagacagaagugccguguguaaccacaccgcucacccaguguguuucuaaaugaugaaacuaccacauaacaguaaagaacccagacagugaugaaaugugaaaaagcaaagacagaauucuauccagccagucugaacacauuucaguguauuucauuuucucuuuagucaacaaaauugggauccuacuauggguauaauuuauccuuuuucacucugcaugacauuugucuaaguucaaaaacacuuguaauggccgcgcaguauuuaguugugauucaugucaacaucacccuuuugggacuuuguuucuaauauguugcugccguagguaguaguguauuuaagucauguaucaauguuuuauauguauuucuaacuaugaauucaagagauuccaguaagaagaaugucuggcuuuaaaggagauggccucuaaauguccccguguaccugugaccgcguggcgaggcucccuggcccccaggagacugaaggcuccuuguucucuuccucauuuggacugugccucucuuuucguuucaguuccucuuuucuugaaaguugcgucuuccauucuucugucuugaggucgcgucuguucucccgccuccguuuucuccgcucuucauuggccaccgaugaccuuuacuuugauuuggauaugauuuugcuucucauugaaauccuaaaauagccuccccuuucaagccaucucuccccucaaacuauugaccagagaagauacaauaaaacgucggcucacuuccuuagcuuuccugccugggccuuuguucuucagucucacacccgaguucuguaauaaugaugucaccgcuuaugggucacuucugggucgugaauuauccuggaucuuuuaucuucauuaccucauuuguuuccccucagcaagguaaacaguucucuguuucauagcaagggcucagaaagguuaagcggugugcccggggccgcccaacugggcagcaacagaggggucagacuccaagucugacuuugauucuaauuaugcuagacuaucccaauagcaccuuguccuuuucuuuucccuuugaaauggcccugaaauucuguuacccuuugacuaaucaaagucucacuguuaauguuucuuuaguagcucuuauaaaggcccaaaaguacuugauggaauuuuaaggcccauaaaaauagauuuuuuuuuuucuggacuauaaagaggaaccuugauugcuuguacauggaaugcucucaucuguggagugagagcagcaaggccuucccagccccgcucugucccaggugcugaggcccccugaggccugugacuuaauccugcuuucaagaaucuugcggucauguggcaacaaaacaacucuuaauuaauuaguauugcacgguagacgugcgccacaaaauuaugucucaucugaaaguuuaggcugcagaggacaaaaccuuugccgugguuauuuuuguauauggaugcagaaaauaguucauucucuaauucucaauguuacaagcucaguuugugucccuccauccagagagaaccaaguguucucaaguaccaguuuuuuuuuuuuuugagacagggucaugcuugcucugucacccaggcuggagugcaguggcacaaucucugcucuaugcaaccuccaucucccaggcuuaagugaucuuccuacuucagccucccaaguagcugggacuacaggcaccugccaccacgcccggcuaauuguuguacuuuuuguagagaugggguuucacccuguuggccaggcugguuucaaacuccugagcucaagcgaucuacaaaccucagccucccaaagugcuagaauuacaggagugagccacugugccuggccuauauucugauuucuaauagcuguauacuaucccauuguaugaguuuaccauaauuuauguaaacaguuccuugguguucuacacuuaggucaucugcugcuuuuugcuuuuuuuuuuuuuuugaaacggagucuuguucugucccccaggcuggagugcagugugguaugaucucagcucaccacaaccucugccucccagguucaagcaguucuccugccgcagccuccugaguagcugagauuacaagcgcgcgccaccacacccagcuaauuuuuguauuuugaguagaugggguuuaaccacguuggccaggcuggucgugaacuccugaccucgugauccacccgccuuggccucccaaagugcugggauuacaggagugagccaccacgcccagccacuuuuuacuauuuacaaacacagagauagugcaguggcaugaucauggcucacugcagcuuccacuccugggacaacaggaacgaaucaucaggcuuagcugauuuuuuuguuuuuuguagagguggggucuuguuauguugcccaggcuggucuugaacuccuggacucuaguguuucuccugucuuggccuccccaagugcugggauuacaggcaugaguuacugcauucagcuuagauagucuuuucuuucuuucuuucuuucuuuuuuuugagacagagucucucuguagcccaagcuggagugcaauggcgcgaucucagcucacugcagccuccaccucuggggcucaagcgauucucgugccucagccucccaacuagcugggacuacaggugcgugccaccacacccaccuaauuuuuuuuuuuuuuuuuuuuugagacggagucuugcugugucacccaggcucaagugcagugguaugaucucggcucacugcaaccuccgccuccuggguucaagcgauucuccugccucagccuccugaguagcugggauuacaggcaugcgccaccaugcccagcuaauuuuguauuuuuaguagagacgggguuucaccauguuggccaggcuggucuggaacuccucaccucaggugaccacucaccucgggcucccaaagcuugggauuacaggcgugagucaccgcaccuggcccacacccagcuaauucuuuuguauuuuaguagagauggggguuucaccauguugcccaggguggucucgaacuccucaccucaggagaucugcccaccuugaccuuccaucagccuagauauucuuaacaguuuuuauauuuaacaguuugaaccuccuaaaauuuguauaguaggagggugaauguugaauaauucuuccugcccugcaaauuuggaaugcuacccauuuuaaggccuuucuuuccaucagucuauuucuuuuugugcuaauuuaauaccguuauaucacuugauaguauucuuuuaauauuaaagcauucaaaguccugcucguuauuuucuuggcgcuucucuguuuauucccccagauguucaugucugucucaucauccacagaucugauauuaacuugggggaaguuggcaucuucaagacacuucccauuaaagcaggcacaugccgagcucccuuguauuccuaguucuuugucuuaguaagauuuucuucaugugcaucuuaccauuuggugaguugggauugacuccuuauaagguaguugagauuuccagcuaaucggcucucuggauccguaacugaauuuaaaguggcaggaaagaccuuggugggguccgaagccucgucagaccacaaggucuugcccguguaccacacacaaauccaggcuuuuauuuuuuuuuuuuuuccccccccgagauggagucuugcuccagagcuggagugcaguggugcagucucggcucacugcaaccuccaccuccuggguucaagcgauucuucugccucagccucccgaguaguugggauuacaggcaugcgccaccacacccagcuaauuuuguauuuuuaguagagacacaguuucuccauguuggucaggcuggucucaaacuccugaccucugaugaucugcccgccucggccucccaaaguucugggauuacaggcgugagccaccacgcccggcccaggcuuuuauuuuuaauaguuuaaacuucagaugacucagaacaauagaaugauaugccacuuuugcccugaagacuguuaguguugagaguaaguagucauuuaaaauagguuuaaagagaagauugaacauuaagucaacaauagaacaggggaguguuuuucuaugcucguggcaaaaaguguggagaugauguucaaggggggcccugggggaccccagacuccuugguggcccagggcagagcuguccuggagauagccguguggcgcauuugcagucugcugugaaagaugggaaauuccuguuuuaacucagcucaaauucuucuuuucucuuuuccuuccacaggggaccgugauuaggguauuuuccauuccagaaggacaaaaacucuuugaguuucggagaggaguaaagagguaaaguacgugaauguccagaauggauucuggagguuguauuuggauuucaguuuuauguuaucuaugaacaaacaaguagaacccccaggagaauuccacacgagcauuucuagcccggcugggucaccggguaagaucugggcgucggucuugucaugggaauugaagagcacuuucagaaaagcaaauuggguuuuuguuugcgaucccaccagcuagcgugagaguugugaagagcucacgcaaccaggugggcccuccagugcccggcagcucccagccugcuguaagggacggggcggcgacgucauggguagcacacccuccccuuuaaaggccacgcucugagaaccuguuccagcucuccagcuccgccuccacccucagcaaauggcauuggccccuucuuuuaacccagaagccgcagccuggaguucucuugucuuccucccuccaggcugcaaagcuucccucaucggugcuuacaugccuccuguggcgccugcuuuggaggcaggacugucccucccucgucggacaguagagcgggggaggccucgggcucuggagcccgugccucagauuggagcccuagggagcacuuucagucgcauggccguggucggcgggaccccaccucaggucuguggcuccacgucucggaucaguaccucccucccugaagguggcuguugaaagaggaggggcugucuuucggggacucucccgccaucugguccccuuuccucaugggauccccacaggugcagcaggugcaccucaguauccccaaacgucaccgcuccuccagcuccugccuccucgugucccuuggucuucuuccuuacaccacaucuuucuggaguuuuccuguguugcugcuucugcccaguuccccuccugugccuguuucugcccuggagccgcucuucacccaacccccuuccucacccccguggccugugugugugcugaucccggggcuggacguguagccuggcuuccuucuugaggugcccguauuccuccugccugcugggcacugggcaccucaagccaccaggccaguuugccccuggccccucgucccucacacuccccaucuugguaaauagcgccacuugccacccccgccagcacccuggcacccaagccagagggacucggcccugcauccuuccgccugaauggugccuccagggagcucccaccugugggcccgcccugugccucucccgccacgccaccugauccaggcuuugccugguuucugcuguugcccuggauuccugucaggccguucuucagacucucacccaggcuguuugaaaaauguaaauauaauccaaucacaccccaccugacaucucccaccacaccucuguccugcaggauuagccccaggccccugccuugguucagcaggccucccggcaccagcccuuccgcccagccugauucuguuucacugucccuguccuggcuccagcaguaccgcacuuucagauccucagaagagccgaucucuuuuauccaccagggucuugcgugagcuggcagaucugguggccuggccggcuucuguaacccugggaguccaagucgagugucgcccucgaggaggccuuuuuuugauccuuggguuaaaucccuuucuccaugcgucucuagugccuuccacguauuuuucucacauuccuuugccuguggcaaauggaauauuugggugaccgcccaagggguucaccuugcccgcugccuaggcagagccgauucaucaagaugggaauugcaguagagaaaguaauucaugcagagcuggccaugcgggaggcuggaguuuuacuacuacucaaaucagucugucugagcauucagggagcagaguuuuuaaggauaacuuggguggggagaagccagugagccaggagggcugacuggucagagaugaaauguuagggagucggagcugucuucuugcacucagugaguuccuggcugggggccacaagaucagaugagccaguucauugaucuguguggggccgccggauccaucaagugcagggucugcaaaauaccauaagcaaacuuucucccaaaguuaauucagccuaugcccggggaggaacaaggacggcuuggagaugacaagcaagauggagucagcaaagcuagaucucguucaccgucucagucauaauuuugcaaaggcgguuucguuugcaccucccugaccccacccccaucgcuggaugcugcauuaaggcgagaacauuccuaauucauacacauggucaacacugacuccaggaaaaccccuugcuauuacggacagggcuaaaaguaucuuguauuucuaggguuaugaagaaauucacaugaauuuaguggcuuugggaugccgauugauuuuuaagacacacuggagccacuuucccuguugaaaguuuugcucugucuuuuuuuuuuuuuaaauaauugagacagagucucacucugucgcccaggcuggagugcaguggugcgaucucagcucacugcaaccucugccucccagguucaagcaauucuccugccucagccucccgaguagcugggacuacaggcacccgccaccacgcccagcuaauuuuuguaauuuuaguagagacgggggguuucaccauguuggccaggauggucucgauaucuugaccucaugauccgcccaccuuggccucccaaagugcugggauuacaagcuugagccaccgugcccggcccuuugcucuguucuuaaacuuuacugagguugccgauuuacccucugguguggaaagaauggcuguaacuuaaauuacugaguuuucuuuuacucaccuuaggacuauaaauccauccuacuucagcuaaaagugguuuagugaaauccuacuccuuuugucauguggaagcuugcagcuguguuaacgaauuguucuuaguauuuccuuuugaacauuuuccucucucaaggaaaauguuugagaagguggcuagaggggaauaaaacuuaccagcaggcccaagugugcccgugacaggaacucuucuccgccacuugaguugaaccccuggggcagcugcuggcuccgguggcccgccccaaccugugcgucuccccaggugcgugagcaucugcucccuggccuucagcauggacggcauguuccucuccgccuccagcaacacugagaccgugcacaucuucaaacucgagacugugaaagaaaagugaguugcaaauauacguuucuuuaaaaaugaugcaaaacccuuuguccccacuugcugccgggaugagagguaagcacggacccgcccacccucugacaucguuagccagugaagaccccggagcuggccauggagcgagcaccuccgcauccaggcucggcagugaggaggaugggccccagcagaugagcuucucccacaggcagcacgcaggguagacagagcccucgcguagggcauggagggcccagguggacauccuuuugucagugaagauggccucuccucagguuccccucacgacaaaagcguuugugaucagacagcccacuagggugaauggcucgucucuuaccuucccacggguaagcagagacauggacggcuuccacaagaauuuauuaucgcaaugaauguguagcaugaggggggucuuaucuuuuaagaggggcuuacucuguugcccaggcugcagugcagugguacagucauuacuuauuguagccucuagcugcugggcucaagcgauccuccugccucagccuccugaguaccugggacuauaggcgugcaccaugccuggcuaauuuuuaaaauuuuguagagacagaauuucgcuguguugcccaggcuggucuggaauuccugggcucaagugaucugccggugagccaccgcgcccagccugucuuuaaaaauuuuaaaaagaacaucccacucagaccagcguuaacaauaacauacuuuagguggucaaaaauaauaaauuuuguuggguauauuucaucacaauuuuuaaaaagacaaauggagcaugccccgcccucccccccaaaaaagaugaauagcaacacaaacaggauacgggaaaauaacauuuuggggucuauacucaagguuuuuggagacuucuauuacagagaccuagcaggggucaucaguuaggcccuagacguccucacacccuugcaaaggggauguguggucagcugccacgucuuguccguggccaaaggcuguagcuccucccugaagccugagcaccccucccccgacaccucccagaggaagcuccgugaugccccuggggcccugagugucugcuuauaaccaacccuguuuaauuuuccugugaagaauggagacuuuugcugucggcuccagagcugugcgucugugugaguaggggguggccguccccccagggagggugcagcuucaugugucugguggccuuuccuuccagacccccagaggagcccaccaccuggaccggguacuucgggaaagugcucauggccuccaccagcuaccugccuucccaagugacagaaauguucaaccagggcagagccuucgccacgguccgccugccauucugcggccacaaaaacaucugcucgcuagccacgugaguagagccggcgccuccgucccccaccccgugugccucaggccgaggggcccaguccuggcggcuuguggccccuuccgugcuucugaacaggagcagcuucuuagagccgacacuccaucgagaguugucggggaugggagguccccuggcaggcacuaggcuugccgcucugugcggggguccauuuccagacgggcucccguucuguuuuuguggauagucugcgguauuaaugaaagacguuaagucaaaccucgugagugugccguaguuaacccuuuggggccacagaaaccgcacuugccgagucucaggcauccguccggcuccagggucuggccucagaacacacacagggccuguggagguucugugcugcgugcgggaaagauugucauuacacccagugauggcagggcuuugggcuuccgugcgucuuuaaacaucauuuuccaguuuuguuaucugacuagcauccuggaaaacuucucugacgaugacuaccuauaauaaucccagaagccacaaaacugguuucaucccgcucucgucucccgugggcuucagggcucagcacacgagugcagccuuggccgugugagccgaggucaguggggcgccagacaccugcagcugcccuugugcucaucuugcuggggucucuuuccucgccugccaaaagugaggccgccauguaguaagaccguuucugugacaguugucuagaauuuggcugcucuuuauucucccuagaauucagaagaucccgcgguuguuggugggugccgccgacggguaccuguacauguacaaccuggacccccaggagggcggcgagugugcccugaugaagcagcaccggugagucugcuccggccgcuucacggagcugcuccgugcuggcggggggcuuucggggcaccuggcgaacguuuguuuauuuccuugcaaaccagugacauagaggggcagauuccagcacagcggcccaugccgcgcaggucgggagcuucgcuuucccaggugaaaucaaugccgccgcaagacagggagccccgggcugcggcugguggcgucagggcucccucagggacugggcacagaggcgacgcagggguggcgggagccgcauuuguucuuaggugggggagaggugcugggaggccaggccuuccuccccaggguggaguuucgcauuuggaaaggaagggcgcagcgugguggccuccacaauucagugcacguggcugagagccucuugucucacugugagguacagguuuguucuuggaaaacagggaguuaacauuuguucauugggaaguaaugcauuuucauucugucuuacauguuuuuuaaugaucaaaaaguucuaacaacauauaauuuuuuauuuuagagauagggucucacccucgcccaggcuggagagcaguggugcagucacagcucacugcagccuugaccucccagguucaagggauccuuccaccucagccucccuaguagcugggacuacaggcacacagcacauccagcuaauuacuuucuugugcagggucuugcuagguuguccaggcuggucuggaacuccuaggcucaagugagccuccugccuuggccuccccaaguguugggguaacaggagugagccgcugcaccuagcuuuuugugugugugugugaaauggagucucacucugucacccaggcuggaguacaguggcgcgaucucggcucacugcaaucuccgccucccagguucaagcgauucuccugccucagccucccgaguagcugggaugacaggugcaugccaccaugcccugcuaauuuuuuguauuuuuaguagagacgggguuucacuguguuagccaggauggucuccgucuccugaccucgugauccgcccgccucagccucccaaagugcugggauuacaggcgugagccacugcacccgggcuagccugacuuuuuuuguaaauagugaauccucguuauuaguuaguucuuccauuguaaaagugaaauauugucuuguuagguauaacucccucuuuagacuuuccauguaaaacucuucauguaaaaacgugugcagauagacgagauuaaaguugccacggcgugaugaaugccuggcguccuguguggugaguggugugcuggcucuguugccgcagggcagccaguguguacugcccgcagggcugcccuguguggagacgcugagcugugucgcuuucuucccuccaggcuggacggcagucuggaaacgaccaaugagaucuuggacucugccucucacgacugccccuuagucacucagacauacggcgcagcugcaggaaaagguacuuacgugccuucauccccaacgagacuugguaaggggcgugacgcaaaccuggaagguaauuagccccacagccccgagugcuacugccuucugcuggcuccggagccaccccaccagcuccucacugggaaagauggggacugguucugagaacauaagcgagguugguaaauggguguucccaaggccucucucaaggcugaauucaguuucguuuccuuuuuuuuuuuuuuuuuuaaaggagagaugggguuucccuauguugcccaggguggucucaaacuccuccugggcucaagugauucucccgccucagccucccacagugcugggauuauaggcaugagccaccguaccaggcucauuuucuccguuuuuaaagaaaaugucauccuggcucaggugacucuggggucacgugacuugggcccagacuggccaccucucagccaagauaccacccugaaaaguacugccaaggguuuugccucagucuuuucccucccaccuuuuucguccuucagcaaaucugcaucgaguacugccuucaugcugggccugugaagugcagaagcuguaggggaaugaggccaaugggcuccccuccggcggcagcacuaagacccaugcaugagauccuccagccacagccuuggcuaugugagccaccuucuuaaaaaagccaacucgcacuccagugggagagccugugguuuugcacccacgcagggcugugccugcucgcugccacucccaucugugaaccggcacuuccaguucaugagcccacccugagagucuccuagugucauuuuuuuuccugguguuauuuuugagcucuuaaccagcuugagagaguuuguggcccguccaugagggagccucuguuuacugugcaggcaucauuuugacauuuaugaaugucagagaacaaaugacuucaucucgagcugccuaaggcugcaaagaguucauuagaaagcaaucagaauucagaacgucuuaguacaggcuucaguuuauaaauauacaccaguguuuccaaaacacaguccucagugugugucauggggucugugguguguccccagccuuugaagggugacuucgucgucucuuugcagccuacacagacgaccugggugcuguggguggcgccugccuggaggacgaggccagcgcccugcgccuggaugaggacagcgagcacccgcccaugauucuucggacugacugaacuugaccugugaccucugacccggggagcagagaacacuggcuucacagaggacuuugugcauugcugcuaugaacuuugaccugagucgggggagaggauggcagagacuuuauuaaaaaaaaaaaaagauuguagugguagucuaacuccauaacgcugaggaaauacaucauuuucacuucaguggcuuuuaaauccugcuuaugaauuuuagcuuuuuguuuguuuguuuucucuuuuugccaaaauuaacuguuuggugaagcccgcaaaaccuccucgcuuugcaugcaugaacgugccaagccagcauaggggagcuagaagccacuuuccagccaccugccguuggguuuuuucauaucuguacauaaugccgagugcguaaggaaaccguggcgucgcgcacagugggucugcuugucaaggccaguucugcagugacaggcccaggggcugcccaccaggugugcugggcagacuucagcugggacagaaguccgaucucccuagggccccaccuggaccauuuucccuccguuuuauuuuguuaauuaaauucuuuccaaauuggaucgcucugggauuucuuccaugguggacuuuuguuucugaucuuguuuucccuguggauauuggaggacagcgagguucuuucugauacuaaaaaccuuucuuucaggcagcaaaugaacuugaaagguugccuggacucgcuggagcaaaggaaagcgauuuuguuuguauaauuaaaugaucuguucuucuacuucacucuuccuguugaaaaacugugugauuuuuuuuuuuuuuuaaguaaaguuuguagcuccucccaugcccaggaaagcacagaacucaagugugguggccgucugagcuguccuuucgcuggccccgcuguccgcaggggcuuccuaccugugugagaggucguagcgggagacagcaacagagaguaggcggcugggccacguccuucacagggcgucaugugccuuucuauuuucaucuuagaaaauuuccucagcaaaccgaugagagauugugguugcaagcuucaguauuugccucgcuucccuucccuuuucauauuuacagaauuaaaacaaccucaaguaccucagacucugcauuccaaaccaaggcacccagcagccaaagugucgagggcauuuaaguggcauuaauggcaggagagaugguuuuagaaucuauggagugguggaaguuacggauagaagggaaaaggcaaaaacuauuuacccugccuuugcaggcugggguuuuugaaccgaggaaggcugggacgccuguuuccagaugguugucauggucacgcugggcgaagagcuggaggggaguuguccccucagcugagcggcugcggugaaaugccccaguguuccuggguuggcuuuacggcaaacuaaaugcaggggacgcuggaguccgacucaccuacaccggcuuccucccagccgcuggugugcggcacacacaacaucugcauuaggcagaggugcaagugggcugauugaacuuuuccuucaaaaccugcuugucuguccuggaccuuugaugaaaugggaucccggucacgcaggcugagacaguggggaccgccgaggccagagugggcuaugcuugagcagggaugagaagggccgcggcagcacgcagccuugacccacgccugcgucuuguggugcaaggccagagggcucucucuagaaccugaccgugcacuccaucuccugggagccacuuuuggcaagagugaguguggggggaaaaagugugcacaagagauacggaacccugagcuaggguuuccugucaccaaagagugagcugcauuuccaguucugcguuaaaguaucguuuguucuggugccugccugugguggugauuuggagacucaaauuuccuuugccaggucucuuuugucuuucuuugggauugguaguauagaagaugcugggaauugucuuccucgcucagccucggcuucccgcacuguaagaugaggcaguugcagaggaggccucggacguccugugacccucggcccacacucccccuuggguggcccuggcagggcuggcuaggugcguucccugcagaccacgggaagcccugugcuugccugggucagggcuaagcugugcgcccuagaggagggaggaggacugcagauucuuggucgagaagaaugaagaggauuucuguguuugcugagcagccauuguggaggguuacccgccuccacuuucccguugcccauuucacugccaccagcuccucuuccucugcucgaaccuaugagucccagccucacuggcggccucagacaugcucaggagugacggggacagagggaggccgcugaguugcccguuagaacucuuacugcugcgccagugacccagguggagagggacccugaaccaaacagaacgugugcuaauuuuccgaacuccaaacuguacacucauauucauuuuuaaauuguauuuuuccaaacuucaaaaaggacgaugagcgugggggauaggaaacaaaaccuguaaacguugugaaugggcucaguggacucugggaccaaaccuucuguaaucucuaaaacaaugggaccaagagcuggauggaaccuggagucaaaaagaacugcuucaguccccgcuguaccgccugccuagcugugggagcaggcagggcgccugggagccugcguuuucuggaccguuccaugggacucaucccuaccucacagggcuguugugagguguugugugacugcguguccugcaaacgcccagcucggugcccagccagcggugggcacccaauaaacgcuacaacauaaaugugucuucugcaauuaaacacgauuuuuauuca

SEQ ID NO: 191571 - RNA, 116755 nt, Homo sapiens
ggccgcgggauggcgggcagcaggggcgccuagcugcgccgggagccggggccgccgccggagucguugucgccggagccuggagccgugaacccagccgcgccagguacgccgccggucagccugccggcccccggccgggcgcgauggucuccaaacuucuccagcucgccccccaaccacgccugccccucggggugcgcggggggggauccccgcuacugucuggcuccggauugcagaaucggggaccagggccggcggggagggggcgccccgggaggggugggggugggcugcugggccccgggcacccacgcgagcccccagccccgcuccggcccuccuggcccggccgaggggcggcgguuccucucucgguucccagcaggcggcgggggagcccgggacgccgagacguuuucgauuauaggcuguuuuuaauuaaaagccggaauucagccauuuuaacuccauuuaagagggggagaaaaguaaggagaacgcagcggagcccgcagauagccgaggcagcuucuuugccagugugaggguguuccagggggcuucaccccgacuuccccaaacuggggcgccugggcauacuacgaggcgcuggcuuuuaaagaaagcuacccaaagaaucucuuacaaaaaaaaaucacgggaagcucaucgccuccuuaagacauguauccucggauguggcgaucuuagauuuuuccaaaguaaacgcgaaucugguaaccagagccugaugggagagagggagggaggggguguuuguaaccaaaaccggguuaaaauaggcacccuuagcaaaguuggggagggaggcuggagaggaaggccggcggguuuggcuagggguuuugcagccgagggggucuccugcucggggggcugggcgcggagugcagggcgccgggcgggcacccgggagccgguggcuuuggcgugaucggcuucucuuaagagagcccaggccucccggaaucaggaaugugagcugcugcagacagagaucgagggaagggugggcuccaagacccccucccauccucacgagaaucggcaaaggacaaaucuuuuaaacaaacagcuuuaaccuggaacuacagggggauuuacccaaaggugggggaggcgccccuuggcaggcccgcguugcaaaggcuuucuuuguagguuauuuuggggggugguuguggggggggaagcuagaguaggagcgagacccuugaucccuuuccuuccccucuugacaucccccaaaucccccacgccaggccagguccucgggcugcaggagcucaggccagggcguuggaaaaugaaaccaaagcuuguuuuguaggauucuuuccaguccuuaggcgagaaugccacgucucggguccucggacucgagcucugggacucacagugccccccggggggagaaaggggggggaccacgagccucuuuaaaaauaauaaacccgcuuuggacccucccuccucccacccccagaaaaacaccauuccgucggcgguucaaggcgagcucaggaaaaaccaaacucggaaaagggaggcgaggucuccaaaagguuaaauauuaaacuuugcggaucagauagugccagaguguuuugggagacacuucggaccguuuguggcaaggcuucacgguuuuaaaccccggagcauuugacgccuaggaauaaaauaggagguuuguauuuacgccgucugggcgcagccgaggagcccuccccgguuucgggaggacccggcagccgccgaggcagaguccgggcuggggcgcagcgcgccaccgccgccggucacuuuuccgagccaggucccgggagccugaagccgccggcggaaggaguuuggauuucauuuuucaguggaaaggggcuacucccgauuucauuucuggccacucagucggcaccccccgauccugaagggcgaggcgacuuucugaaacuuguuacuuuauuuuuuuuucccuuuuuucuuucccccuuucuauuucuuccgcggccugucuccuccccgccaagacgccgugugcgccgccucgcgcagcuccgccuggccgcccggaggggccccaccgccggccgccugugcgccccgggccgcgggcccgccgccgagcgcaagccccgcuggccgccgccaugcacgccgcggagcccccgccgcccgaggacucugggacuacgccgaggccgaacuuuuaggucccacugagcuaggccugcgggccggguggggggcugaucgcggcacucccgcggaggauggauggccgagacuucgggccccagcgguccgugcacggucccccgccgccgcugcuguccggccuggccauggacagccaccgcgugggcgcggccacugccggacgcuugcccgccucgggcuugcccggcccgcugccgcccgggaaguacauggccggccugaaucuccauccgcacccggguaagugccccgcgccgugcccguccccuccugucuucccagggagauccacucggccggguccuccugugcacucgcggccggggcucggcgacucuccuucggucggccacgggggugcgggcagacucggcucccagggcugggaaacuccuggucccggagccaaggcgguggagagugucgcgcggcucggcuaccuuuuccguagcgugcuuggcccucgugagccgaaagccggugugguagcccgagccaccgggggcgauuccaauccccggggccccggcggcacgagccugggcuggaguuuucaaaaucugggcgagaaaagaacaaaccggcccccgcaccccgcgagacacccgcuccccgagcucgaaucuuuuucuuggcaaacgcuacuuuuggcgcucgugggcccuccuggguucuguucccagcuccaccacucgcgccgagccgggucccuggcaguuaccgagcgccgggggaugcgggaguacgccgggggaugcgggaguacggugaccccagccuugggacccuggccucggggcgggcgggaugccccuuucuuccccgggagaacggcggcccugggaaccugcaccccgguaggagggcggcgaccccggcccucggggaccccuuguuuuccagcgcgaaagagggugcggaggugcggcagggacaccgaaaccggaccaucgcggucccgaaccuagggggaaagaagagagcgggucgggcagggcccaggcggcggaggggaaaacccugggucucacaucgagcugcuggaggagguggccgagaaggucccgcggccuccaccauuucccgagacgggcugcccaggcgcgguggggacgguacccgggcgggcgcugcgccggggcgggagacucucccuccagucaguccgcggccgcugcagccagaggggugggaaggagacucggggaccuccagaccugcccggcggccgccccaggacaccuggucccuccuucccgggcugucccuggcuuuugugcuuggcgucccaagucucgacuuaaaaaaaaaaaaaaauccaccuccuguucgaauugcaguuucggauuuuugcaauuuccagaguagcccucgaugcuccccucuuccuuggggucucucaggagcugccaccucggccuugccccgcccgcucggcggagcucgccgauuuugcucucucuuugauuuuucuccuggaacuuuucaggaacuggagucccgggggcucggcgggacaaagggccuuugugaggcgccgggcgggggaggggcgcgcgcccgggggccgggagcucggagauccccgccagccggggcgcaagaaccaggucuuggcccccggaccugcuugugucccuccggagcugggggcguauuccgcccggggucugugaccggggcaaggguuuguucucuaguggcguguuguggcgagggaggggcgcgggggacccccgaggaagaacuuggggggcggcccugggguacagagaccaucugagcuguccccuuuugcgcuccccacaaguccaccgugaugugugugugugugcaugcgugugucuuuugggucauuugguccagcccggagugguggcaggggggccccccccaagccugggaaucgguacccgggucucucuggcuggcugggccugcgcuuggcuuuuucgaggcugggaaggggcgucgcgcacuccccgccugcgaucuggcuccggccuggcaaggcaaagugcccuaaugcgaagcggugaaaacaagcuacuacucaugcaugcaugcacagugccagggccgcgccuaaucugacgcagcagucagacggccuaaugcccauuugcuggauggugaggcugagguggagggaaggccaagccaccagccucggaagcccagcgggagguagccucggagcccugccucugcgcaccuucugcgcucgcugggagcugccugacuucugcacgccgaggcugaggucggggaggaaacagcaggaggacagcugccgcccccuugaaccccgugcucacccgggagggaaaggugggggccggugcugguucuggcugucccccucccccacuucgaguagccgcaaggagaccucggaccccaggccaacgcccagagccaagcccgugcuaaucccauuagccacgaggugggagcagcucccauucacucucugcuuggggcugggccggauuacacauuccucaagccagcacauccucccccucccgcguuuucuuuguggggugcaggugcuacauuuucccuucugacgcaccucccucucuuccuuggcugucggcaccuuaggucuugccagcguuaucagucccaucuuuauuuguuuauuuuuguaccgggaaguccugagcgguugagccacuugcuuggggucacccagcuagggagaggcacauuaagguugggcucugcggacguggaugagcgcugucagggcuuauaaagccccuccuaggccgagggagguucccuggagagagcucagagcuggaggggcccucggagaaagauccccggggaggaaucccauccaagcuaguauugacagccaucugcuguggaagguccucuggaagagcugguuucugccuuuugggucaagauggagggguuuggccucuuucucugcagaagaggaggugaauuuaagaaugaaugggguuugggaucagggaagggugguuuuuaaguuuccuauuaccuugagccuugcuacauugugaacaaaauauucacagccugaucugggagaugggcauguaacugacaaacaccuggggcuuggcucugugcucugggcuugggaggccuggacucaguuguccucacaggcugcaauuaaagagcuauuaguaggauuuuguacuuggauguuuauucucccugcccccacacccuaggcuggcccuggagggguacaugaauagagggugggacccaggguucuggguggggagacccugcacucuggcuuggcuaacacuggaggcuuggcuaacaagggaggggcuuggcuuggcuagcacucuggcuuggcaacagggggccacgggccuucuccagggucugaucagauccaucucuggaauccagucugucagccuacugggauugauuuagaaagauuaaucagugaagaccgcuggcagagugauggagagauaaggacgauuugcaaggggcuucuuucucugguuagaggcgacaagggaggcccugggaggguucuggaaucuggaagggccacuugguggggagggggcucucuugguucuucagcucccaaccccagcgcuuuccuucuuuccucacuugcucauuuacucagcaaauaauuuccaagugcuuccugcgugccaggcaccgcucgggucccaggaaugcggcagugaacccaacagacagaagucucugcccucauuggagcucauguucuuccggggauucagggagugaacacacaaauccgagaaggaaauguuuuuuguuuguuuguuuguuuuguuuuugagauaggguuuuacucugucacccaggcuggaaugcaauagcgugaucucagcucauugcaaccuccaccucccaggcugaguccauccuccuaccucagccucccgaguagcuagagcuacaggcaugugucaccaugcccugcuaaguuuuuguauuuuuuaguagagguagggucuugcuauguugccccggcugguguugaacuccugggcucaaguaauccuccugccuuggccucccaaagugcugggauuucagguguguaccacugcgcccagcugauuuuguuacuuaaaauuuuuuuuuuuuuagagacaggguuuuacucugucacccaggcuggagugcaguggugcaauuauagcucauugcagccucaaacuccuggccuccuccugccuuggccucccaaagugcugggauuucaggugugcaccacugcacccagcugauuuuguuacuuaaaaaaaaauuuuuuuuuuaagagacaggguuuuacucugucaaccaggaugagugcaguauugcguuuauagcucauugcagccucaaacuccugggcuccuccugccuuggcaucuugaguagcuaggacuacagguauguaccaccaugccuggcuaauuuuaaaauuuucuauagagacggggucuugcuauguuguccagcuggucucgaacuccugggcucaggagauccuccugccucagccuccugaguagcugggauuacaggugugugccgcgacacccagcuaauuuuuuuuauuuuuaguagagacggaguuuuaccguguuggccaggcuggucuuaaacuccugcccucaagugauccgccugccuuggccucccaaagugcugggauuacaggcaugagccaccaugccuggccuaauuuuaaaauuuucuguagagacagggucucccuauguuguccagcuggucucaaacuccugggcucaagagaucauccugccucagccgcccgaguagcgaggacuacaguccagcaccacugugcuugguuaagcaaauuuuuuuuucuuuuuuugagacggagucucgcucugucgcccaggcuggagugcaguggcuccaucucggcucacugcaagcucugccucccggguucacaccauucuccugccucagccucccgaguagcugggacuacaggugcccgccaccauguccggcuaauuuuuuuguacuuuuaguacagacgggguuucaccguguuagccgggaugaucucgaucuccugaccucuugauccacccgccucggccucccaaagugcugagauuacaggcuugagccaccgcgcuuggcugauuuuuuuuuuuuuuuuuuugcgagagagucuugcucugucgcccaggcuggagugcaguggcacgaucuaggcucaccacaaccuccaccuccuggguucaagcaauucugcuucagccuccccgaguagcugggauuacaggcgccugccaccacgcccagccaauuuuuuuuuuuuguauuuuuaauagagaugggguuucgccauguuggccaggcuggucucgaacuccuggccucaggugauccacccaccuaggccucccaaagugcugggauuacaggcgugagccaccacucccagcuuaacuucgaccuauuuuuaagugaaaauuucccaacagugaaaguugccaacuuucccuggacaaccaccuggagaugggcuucucauauuguuuuguaaucugauguuuaaaaauguaaaacuacaccguggagucuuaugcaggcugggcacgguggcucacgccugugauccuagcacuuugggaggccuaggcaggcugaucaccugaggucaggaguucgagaccagccuggccaacauggcgaaacagcaucucuacugaaaauauaaaaaaaauuggcugggugugguggcgggugccuguaaucccagcuacucggggaggcugaagcaggagaaucacuugaacacgggaggcggagguugcagugagccaagaucaugccacugcacuccagccugggcgacagagacagacuccaucucaaaaaaaaaaaaaaaaaaaaaaaaagagggacacagaccacgcaguaaacaaaaugguaaaggucuggucuggucugagaggugaggggcuguaucagcacagcccacccccacccgacugaucuggaggggugaccuuuuuccugcaugcaaagggcagaaaaguguggugaagguggacggaacacaaaagucagagccuggcguaucugagcuggcagaauggcuggagcuggugggaggggaugugggggaggugggauccuucaggucccugaaagccagucaugaggucuuggaauuuuaaacugaggaaugaggaggcaguggaggguuuuaaguggaaggaguaauugaaauugagggacauuucacagaacuggucuggacucuuaaaaaaaugucaauggcaugcaaggcagaggaaggcggagaacuguuccugauuaaaagagacuggaaaaaugcaacugcuaaaggcaauguauggcucucuauuggaucuugggaucagggaagaaauugcuacaaagaacaucauugggacaauugacaaaacuggaauauggacuguagauuaguugauaguaucagaucacuguuagguuuuaugaaguggauaacugugugugguucuguaagagaauguccuuguucuuaggaaauaagaauacugaaaugugggccgggcgcaguggcucacgccuguaaucccaguacuuugggaggcugaggcggguggaucacgaggucaggagaucgagaccauccuggauaacauggugaaaccccgucucuacuaaaaauacaaaaaaauagccgggcgugguggcgggugccugcagucccagcuacucuggaggcugaggcaggagaauggcgugaaccugggaggcggaguuugcagugagccgagaucgcgccauugcacuccagccugggcgacagagugagacuccgucucaaaaaaaaaacaaaagaaagaauacugaaauguuuacgggcaagggacauagagucuacaacuuguccucggaaugguucaggaaaagaaaaaauaucuauuuuauaucuauaaauauacauauauaauauauauauuuaugggagacgaugguacaucaaguaucauaucaaaaaagacagugaggcugggcacgggguucaugccuguaaucccggcacuuugggagucugaggugggcggaucaccugaggucaggaguucgagaccagccuggccaacauggugaaaucccaucucuacuaaaaauacagaaauuagcugggugugguggagggcaccuguaaucccagcuacuugggaggcugaggcaggagaaucacuugaaccugggagguugcagugagccgagaucgugccacugcacuccagccugggagacagaaugagacuccaucucaaaaaaaacaaauaagacagugagagcaguucacaguuguuggaucuggugaaggucauaggaccauucauuguacuauuucaaacuuuucucugaauuggaaaugauuucaaaauaagcauuuaaagaaaaacuaggggcugggcaugguggcucaugccuguaaucccaccacuuugggaggccuaggcggguggaucgcuugaggccaggaguuaggagagaagucugggcaacauagcaagaccuugucuuuacaaaauguuuaaaaaacuaguuaggcaugguggcgaaugccuguaaaucccagcuacuugggagucugagaugggaggauugcuugagccccagagauccaggcugcagugaguuguggucgcaccacugcacucacaguggucugggcaacagagugagacccugugucaaaacauaaaagaaacgaggcuggguugcuagccagagacagucugguagacgaggagagaagcaggagguaauuaggagguguugguuaccagggagggaggcuggagguguccaggguuauggcccuuuggagguugggcagguaagacggauggggagaggagggaaggagggaggagaacucaauggcuugggugcgaaccacuuguggagggauggggaggggcagauuugaggacaggcuggggacugggcauucuuguuuuggauguggcuggcgggggcugcucuuggcuccccggcaugaaccagucuguggucuggcccagcuccucccacccucucauguacuguagccuuguccuccagccagacccuugccccggcuuuucaggcaucccagcucagcuuuuuacgggaugggcuggagcuguucucagcacaggucucgggccuccccagggccugcugggagcccugguuaguggucagucagggccaggguccuuaccaccucugcugcccacagaggccuggcaugugacuugggaggaagucuaggccacuaggugggagccacucaagugucaccucucccaggccaccaguguacucagcauugcaugugagguuuuuucaggggauaagcaaaaugguggacccucagccuggggggaaacccugacuucccacaucuucaccaaccauuugacacauuucugagcauuuugggggucccuggaagcuccugguaauccccagauagaacacugcuccaucuagaggcaggauggccuccaagcugagguguggauguuguuucuccaguuaaagggcaugugaugacuuucuaaaccucaauuuuuucaucuauaaaauggguucauuagagugaaugaguucauuuggugguugugagguuuguuuuuauuuuuuuauuuuuauuuuauuuuauuuuauuuuuuugagacagugucucgcucugucucccaggcuggggugcgguggcgcgaucucagcccacugcaaccuccaccucccggguucaagcgauucuccugccucagccucccaaguagcugagauuacacacgccugccaccacucccggcuaaauuuuguauuuuuaguagagaugggguuuaaccauguuggccagacuggucucaaacucaugacuucaggugauccacccaccucggccucccaaagugcugggauuacaggcguaagccaccaugcccagccgaaaauucauuuucuggaauuaaugucuuuuuuuuuuuuuuuuuuuuuucauuuggaauuucuuagaauaucuggcuuccaguuucucucucucuuuuuuauuaagacgcugggucucgcucuguuacgcaggcuggagugugguggcauucucguggcucacuacagccucaaccuccugggcucaaaugagccucccacuucagugccuccuaaguagcuaggacuacaggugcguuccaccacaccuggcuaacuguuaaauuuuuuuuagacauggggucucucgcuauguugcccaggcuggucuugaacuccugagcucaaauaauccucuugccuggacuucccuaagugcugagauuauaggugugaguuaccaugcccagccagccuucuggucccuugaugcauuuuuuucacuugucauaucuauuggaugagcugcuuuguuuuuuuuggagauuuccuuccuggaauuuuccaucuuccuucucuagucugguuggcccgguucuugggugugcuggagagccauuguucuucagacucccuuugccucucuccugugugucugauucccuugccuucccguuuccuguuuuacucccuucuuucuguagagcacauccugcgguggcuuucugugaaagggugagaggaaggcaacguuuuuggguccuaguaugccuggaaaaugcuuuuguucuaccuucacacuugagugcuauuugggaaauacuuucccucuaggaauuuuuuuuuuuuuuuuuuuuuugacagagucuugcucugucacccaggcuggagugugauggugucaucuuggcucacugcaaccucugccucccggguucaggugauucuccugccucagccuccugaguagcugggauuacaggugugagucaccacacacggccuucccucuaggauuuugaaagaauugcaacaucaccuuccauauucgacugcuacuuuucaggaauaugaugccauuuuugauugcugaucuuuguguaugaaccuuuccccaccucccccuuccuuuucuuuuuucuuuuuuuuuuuuuuuuuugagauggagucucacucuguagcccaagcgggagugcaguggcacgaucucagcucauugcaaccuccaccuccuggguucaagcgauucuucugccucagccucccaaguagcaaguagcugggauuaacaggcaugugccaccaugcccggguaauucuguauuuuuuaaaauggagacggaguuucaccauguuggccaggcuggucucaaacuccugaccucaagugauccaccugccucggccucccaaagugcugggauuacaggugugagccaccacgcccagccuucuccuuucuuuucucuccucuucucuuuucucuucccuuuuuuuuuuuuuuuuuuuuuuuugagauggagucucacucuguuguccagacuggauugcaguggcgagaucucaguucacugcaaccuccaccacggguucaagcgcugaagccucagccuuccaaguagcugggauuauaggcuuaugccaccacacccgacuaauuuuuguauuuuuaguagagaugggguuuuaccauguuggccaggcugguuucgaacuucuggccucaggugauugacccaccucggucucccagagugcugagauuacaggcgugagccacuccgccuggccacgguuauuguuauucuucaucacuguucugaaauuucauguugauauguuuuguuauggggucuuuuugcauuuacugucuugggugcugcauagacuguagcaaacuggaaacucaagacuuucauucugaaauuuuuuguauuauuuuuauuuuuaaauuuccuucccaguauuuuugcuauucucucuaguauuccuauuaguuagauauccugggucuccugggcuaaucauugaauuuuuucuuuucuuuuuuuuuuuuuuuuuuuugagacagagucuugcucuguugcccaggguggagggcaguggcaugaucuuggcucauugcaaccucugccucuuggguucaaaugauucucauuccucagccucccgaguagcugggauuucaggcgugugccaccaugccuggcuaauuuuuguauuuuuaguagagaugggguuucaccagguuggccaggcuggucucaaacuccuagccucaagugaucugcccgcuucagccuuccaaaaugcugggauuacaggugugagccacugcgucugaucugaucauugaauuuaaaaaaaaauuuuuuuuuuuuuuugagacguagucuugcucuuucacccagccuggagugcaguggugcgaucucggcucacugcaagcuccaccucccggguucaugucauucuccugccucagccucccgaguagcugggacuacaggcaccggccaccacgccuggcuaauuuuuuguauuuuuuuuuuuuuuuuuuuuaguagagacgggguuucaccauguuagccacgauggucucgaucuccugaccucgugauccacccgccucggccucccaaagucugggauuacaagcgugagccacugcgccuggccuucuuuuguauuuucuauaucuugcaguuucuucuuucuaggagauuuucuuaauauuuucuuaaugguaucuucuaaccuuucgauuuaauuauuauuauuuuuuugagacagggucucccuguguuacuggggcuggaguucaguggugcaaucacugcucacugcaaccuugagcucaaacgacuggggcucaaacgauccuccugccucagccuucucggacuacaggggugcgccaccacgccuggcuaguuuuugucgaauuuaauuuuuaaauuugagcuaucauauuuuuaugucccaagagcucuuauaaccugaguuugcuuuuuuuuuuaauagcauccuguucuuguuucaugcauacauuaauucccauuacuaggauauuaauuguauuuuuuuccccuggcguuuucuucuuucaugcauugucuuuguuuucucugagucuuuuuucucuuuucucuuucaccuuggagacuucccgugggcaccugcugauaaucauucucaggugccccuucuuuaagaaaaagcagaugggauucagauguaaggguggggcuuguuggccauugaggagcuucuugaaugcccucuguaaaaagaucuuuccuuguugaccuuguauaucucacaggcaagaauucagcgguuucuugucuguugacguugaagccaggcuguuccugucccaagagcugagugugcauguuaagguugaugauucgcacucugauuccuguuuucccuuugguccacacccuaguccugagaaugcauacccucagugguuccaucuuucccuaguaaacagaggggucagugcuucuguggugaaaccaacucucuuguccucagcuuuuccgugaucccuggcuuuacagguacuagggucucuggauucagucuccagaauugcugguuuccugguugucugcuccaagccuaaguguuucuuuuccccacucuccacugugccaggccgcacaucucuugucucucugcuuucuugcuuccaaaugguuuuuuuuucuuucuguuuuuugagacggagucucauucugucacucaggcuggagugcaguggcgugaucuuggcucacugcaaccuaccuccaccuccuagguucaagcgauucuccugccucagccucccgaguagcugcacgcgcugccacacccggcuaauuuuuauauuuuuaguagagacaggguuucaucauguuggcccggcuggucucaaacuccugaccucaggugaucuacccgccgugggcucccuaagugcugggauuacaggcgugagcuaugcgccuggccagggggauguuuccuccuuuccacuucucuccuauuuugcuuucguuccauuuuuuuuuuuuuuuuuugagacggaagucuuguucugucgccaggcuggagugcaguggcacgaucucagcucgcugcaaccuccgcuucccggguucaagagauuccccugccucagccuccugaguaguggggacuagaggcgcgcgccaccacgcccagcuaauuuuuguauuuuagcagagacggcguuucaccauguuggccaggauggucucgaucuccuaaccucgugauccaccccuacugcgcccggccacuuuuguuccuuuuuguauuacugucauuuuugugagguucugguguuugggaaaggauuuguaaagaucaaauacugugcagucucuuguaggcucacacuccuucucuugcuacuuugccugggagaucugguucuuuugucucugcuaagaggcaucugaugucuucuagcuuuuucuggagcaguuccuagaaggcccuccaccccuaccucuuuuuccacccugggagguggagucucgguaggggggaaaccagucacuggggaaauccuuugugauugcaugagaauugacaaagucuggagcccuaggggcaaggcugagauggacguauuugcauaucauuggcuggccugaggccuugaccucuccuuggccgccuuugggauucccuuuauuuaaauucgaacacuuauuuugugggcuggguaccugauuggagcaagacaaagucccugcccauauuugaggaugggagagggacuggaauuaagccagaauugccggcuggugcugugaucccagguggggaguaacugggagcccagcuugauggaucuuugggaaucugcucaccugguggggaagucagggauggcuuuccgcuggagcggaggcuggagguguaggaggggcaggauggggugaagagguuggggugggccucccuccucccuggggccagcccccaggcucuccugccccagguggggcagggcugaagcggguugaucugggcugguggcuacugcagucuugguccugguucuggucccagcauagcuuggaggagacugcagccucggacucucaccugccucuuuucugcgccgaugggaguuccagaacggcggcgguggccacaggucugauagcccagccgcagugccaaggacgugcagggugagcccccugucccaccaccccagccucgagcucuaucaccggagugugggggugccccagacgucccugcgaggccggggcacagaaucuugccauuuuaggcucagagagugugagacgcccacccccaggucccacagcgggaggugagggguucaaggcccuagcucccugcaggaacgcugggggcuggcagggagguggggguguugauaggaauuugucuguuuuccuuuuucacuucuuggcucuucuuuucuuuucuuuuuucuuuucuuucuuucuuuuuuuuuuuugagacagagucucgcucugucgcccaggcuggagugccgugguacaaucucggcucacugcaaccucugccuccuggguucaagugacucuccugccucagucuccugaguagcuucaauuacaggcaucugccaccaugcccagcuaauuuuuguauuuuuaguagagacgggguuucacccuguuggccaggcuggugucgaacuccugacuucaggugauccgcccgcuucugccuuccaaagugcugggauuacaggcuugagccacugggcccggccucuacuuacugcuuucugucucugugaaugugaguacuguagguaccucaaaaguggcaucacacacaguauuugucuuuaaaaacauuaaaaaaaaauuuuuuuuugagacagagucucgcucuauuacccaggcugcagugcaguggcgcaaucucggcucacugcaaccuccgccuuuuggguucaagcaguccucccaccucagccucccgaguagcugagauuacaggugccgccaccacaaugggcuauuuuuuguauuuuuuguagagaugggauuucaccauguuggucaggcuggucuccaacuccugacuucgaaugauuugcccgucggccucccaaagugcugggauuacaggcgugagccacugcaccuggcccuaguauuuguuguuuaugucuggcuuauuucacucagcuucauguccucaagguacauccacguuguuguggaauguaucggauuguccuuccuuuucagggcugaauaauauuccacuggcuggauggaccccauuuuguuuaucgauuuguagauggacagcuggguucuuucuacccuuugacuguugugaauagugcugcuaugaacaugggugugcaaauacguguucgaguucuggauuucaacgucugcauacuuuucuauuuuuauuuuuuaaaauagaaacgggucucuugauguugccgagacuggucucaaacuccugagcucaagugauccuccugccuuggcuucucaaaauguugggauuaugggcaugagccacugugccugggcuaauuucuguauacuuuuuauuuuuauuuuuuguuuuugagacagagucuugcucuguugcccaggcuuggagugcagugguaugaucucggcucauugcaaccucccccuccuggguucacgugauucuccugucucaaccucccgcguagcugggacuacaggcacaagcuaccaugucuggcuuuuuguuuuguuuuguuuuguuuuuuugagacggagucuugcucugucacccaggcuggagugccguggcacaaucucggcucacugcaaccuccgccucccggguucaagggauucuccugccuuagccuccuuaauagcugggauuacaggugcgcaccaccacacuuggcuaauuuuuguauguuuaguagagacaggguuuuaccauguuggccaggcuugucucaaacuccugaccucaagugauccacucgccucagccucccaaaguguugguauuacaugugugagccgcagugccuagccuuggcuaacuuuuguauuuuuaguagagacaggguuuugccuuguuggccagucuggucuugaaauccugagcccaagugauccuccugccucagcuucccaaaguucugggauuaugggugugagccacugugcccagccuaauuucuguauacuucuuuuuuuuuuuugagacgaagucucacucuguugcccaggcuggagugcaguggcagaaucucggcucagugcaaccucugucucccagguucaagcaguucuccugccucagccucccaauagcugggacuacaggcgcaugcagccacacccagcuaauuuuuuuuuuguauuuuaguagagacuggguuucaccguguuguccaggcuggucgugaacuccugagcucaggcaaucugcccgccucggccucccaaagugcuaggauuacaggcaugagcuaccgugcuccgccauuucuguauacuuuuuagagacaccuuuucauuuuauacacacacacacacacacacacacacacacugaaagugugcaugcgcugcugggguuuugauggggauugcauauggaaucugcagaucauuuuggcugcagcgagcaucccaguaaguaggucugccuguuuccuugggagggauccccagaagugggucugggcgccugcaguccucgguaagccuugcggauuuguuuuccaaaagcuggagaugaauuggcucaguucucauccuucccgggcagcuaaccacccagcgcccuccacaacuagaagcaaaaauuugcugauuugauggaaugaaaaugacaucacuguuucaauacuucuuuguaaugcuaauggccuugaaauuucgauggaguuuagccauuuacagguucucuuuuucaaauugccugggauucuuuuuuuuucucaagacggagucuugcucugucgcccaggcuggagugcaguggcgugaucucggcucacugcaaccuccgccucccagguucaagcaguucuccggccucagccuccugaguagcugggauuacaggcaugugccaccacacccaccuaaguuuuguauucuuaguagagaugggguuucaccacauuggccaagcuggccuugaacucuugaccuugugaucgaaccgccuuggccucccaaagugcugggauuacaggcaugguccaccgcccccggcccugccugggauucuuauggcauucugagaaucuuuauauagccagaguguuaacccauucuuuggcuuagauauuacagaacucucuggaucuugugaucuaugggaguuugaaggucauucuaucuagaggguccuugcaggauuuuuagcugcuaucucggaaacaccuauguuaccugucaguguuuagggccagaauaaugccuuuccugggugacaauucugguuugacugagucuaugagaugcucugauagucuguugacauuuuaagggaugcaguuuuuuuuuuuuuuuaaacagacagggucucacucuguugcccaggcuggugugcaguggugcaaccauagcucaaugccucuaauuccugggcucaaaugauccucgugccuucaaccucccacguagcugggacuacagguguacaccacuaagccuggcuaauuuuuuaauuuuuuuguauagauggggucuugcuagguugcccaggcuggucuugaacuccuggccucaaacgacuccugccucagccucccaaaguccuaggauugacaggugugagccaccacaccgcagucugggaugcaguuguugugagaggucaagauguuuuaaaacgugaagauaaaccgggcaugguggcucacgccuguaaucccaacacuuugggagaccgaggcgggcggaucaccugaggucgagaguucgagaccagccugaccaacauggagaaaccccgucucuacuaaaaauacaaauuuagcugggcgugguggugcaugccuguaaucccagcuacucgggaggcugaggcaggagaauugcuugaacccgggagguagagguugcggugagcugagaucacgccauugcacuccagccugggcaacaagugaaacucugucucaaaaaaaaaaaaaagugaagauaaaauguaauguguuugguuaugaagggcugucugggauugaaaaugugcaaccuaugucuaacagacgcuucugcuuugucuggguggugcggcugaguggagaaguguagguuugggagugagagccucagucucuuuaucuguaaaagggacaccaaucccucuccccguugacaggaguggggagcacaggguagagaagcaggucccagagaaugcugcagggaaggccugggcacccuuccuccagcuaaucaggaccuugcccccccauuccacaccauaaauauauuuuuuuuuuugagacagagucucacucugucgccgaggcuugagugcaguggcacugugucgccucacugcaacuucugucuccuggguucaagcaguucuccugccucagccucccgaguagcugggauuauaggcguccaccaccacgcccggcuaguuuuuauauuuuuaguagagaugcgguuucaccacguugaccaggcuggucuugaacucuugaccucaggugaucugccugccucggccucccaaagugcugggauuacaggcgugagccacugcgcccagccgcauaaauauuauuuucuaauuuuuuuuuuugucuuuuugagacagggucucgcucugucacaggcuggagugugguggcgcgaucucggcucacugcgaccuccgccuccugggcucaagucauucucccaccucagccuccugaguagcugggauuacaggcccacaccgccaugcauggcuaauuguuuuuaauuuuuguagagauggaguuucaccguguugcccaggcuggucucaaacuccugaccucaagugaucugccugccuuggccucccaaagugcugggauuacaggcaugagucacugugccuggccuaaaaaaaauuuuuuugggauggggucuugcucuguugcccaggcuguucuuuuuuuuuuuuuuuuuuuuuuugagacagagucucgcuguguugcccaggcuggaguacaguggcaugaucucagcucacggcaugcuccgccucccggguucaugccguucuccugccucagccuccggaguagcugggacuacaggggcccgccaccacgcccagcuaauuuuuucuuuuuguuuuuaguagagacgggguuucaccguguuagccaggauggucuugaucugcugaccuugugagcugcccgccucggccucccaaagugcugggauuacaggugugagccaccacgcccggccaaccaggccguucuuaagcucccggcgguccucccacuuuggccuuccaaaguguugagauuacaggcaugagccacugugcccaguuccuaccguaaauacuacuugaguaccuccgaugugcagcauaggacuaggaauaaaaaauaacucguagcauaccuaguaaugcuggggugagcagucuagccaaauguggcccacgucuuguuuuuguaaauaaaguuuuauugguacagagcaacgcccaaucguuuacugucugggugcuuuccuggcaacaggcagcagacacccuuucaaagaaaagcuugcugucuucagugggcagagacaauaaggaacuaacaccugugauaacaggugauaagcaguggagaaaaacauuucaggaaagggcguggcaggguaaguugcaaugugaaaaaggacagggaaggcugagcuguaagagaagggagugaaggaguuaggguauagacaggcgggagugugcagggucuucccuguauaucuggagggaggaccugauucagggcgaggggcagaggugggccggagcuacucuggacuagcccauuggcagugacaaagccuucugguucuuugcuguuuaaggaacuuauaucccuaucaugaucacaugcagcccccccgcccccccccgacucgaaccagggaggacuucaggugcccaccauacaguuucuagaaggguccccagcaacuacuguugcagagggaagauugcauuggugggccagacauggugggugagucacucggccucccaaagcauugggauuacaggcgugagccaccgcaccuggccuuaguuuuaauuuuuaauaaauuuuuuuugagacagggucuugcucugucucccaggcugcacgaaaucucagcucacugcagccucagccuccugugcucgagcaauccucccaccucagcuuccaggguagcuggguuacaggcgugcaccaccacacccgguuaauuuuuuuguauuuuuuuguagagauaagagucucuaucagcccaggcuggucuugaacuccugggcugaagugaucugcugcccaccuugaccucugguagugcugagauuaaaggugugagccaccacgccaggcuacagcuugcauuuuuuucauggaggugaaauucacguggcauacaauuaaccauuugaaauguguauacuuuagugguguuugguguauucauccuguguaaucaccagcuaucuaugguuucaaaauugaauauuuauuuauuugagagagagucucacucugucgcccaggcuggagugcaguggcgugaucucggcucacugcaccuuccaccuccuagguucaagugauucuccuuccuaaaaaccucccgaguagcugggacuauagggacacgacaccaugcccggcuaauuuuuguauuuuaaauagagacggaguuucaccauguuggucaggcuggucuagaaccccugaccucaggugauccgcccgccucugccucccaaagugcugugauuacaggcaugagccaccacucccagcucugaauuuuuguuuuaagcaaggacaaauggcauuuggcuagaagcagacacggacucugaccuuguaguaggugcuuuuagcuucucugagcuccaggguuuguaaccauaaauaauaacaauaaucauagaccaggcucaauggcucaggucugucaucccagcacuuugggaggccgaggugggaggaucgcuugagcccaggaauucuagaccccagacuucgcaacauagugagauccugacucuacgaaaaagaaaaaauaaaaaugagcuguacaugguggugcacaccugcagucccagcuacucaggaggcaaagguggggcgauugcuugagcccgggagguugaggcugcagugagucaugaucgcaccaccucagcuccccagguagcugggacuauaggcgccugccaccacgcccagcuaauuuuuguauuuauaguagagacggggcgggggcggggggugguuuucgccauguuggccaggcuggucucgaacuccugaccucaagugauccacgauccacccgccuaggccucccaaagugcugguauuauaggugugagccaucgugccggcuguguguuuuagguuuuuuuguuuuuguuuuugagacacagugucgcacuguugcccaggcuggagugcaguggcgcgaucuuggcucacugcagccucugccuccuggguucaagcaauuccccugccucagccuccugaguagcugggauuacaguugugugccaccacgcccggcuaauuuuguauuauugguagagaugggguuuuaccaugucugccaggcugaacuccuggccucaagugaucugcccgccucguccucccaaagugcugggauuauaggugugagccacugugcccagguguguguuuuagguuuugacggucauuggucuuagcuucuaaggugucgggugagauaauaacuggggugaguaggcggcagccaguuacuugauuuggggagccaggucuugagcucagccuagggcgagaggcagggagacccccauaccgcagguugguaugagggauuccagucaagucuuucgagaggccagugagcucugggccuaacucagugcccccuggcacccugaggcuugcauccuucuuggugaaacggggggauggcaacugcucgguccuugggugugggugugagcaguggguggggcaggggggcacugugggggcuuggaguauagucuagagauggaaggagaccaggcaggauggccuggcaugggcugugcuucuucgggguuuauuuuagagccucuuuugugaguugcgggaugccuugauccucuccucacccuaauguguaucucuuugcguuggcccugggaacauuggaaaucacauuuauggcuggacaggguggcucaugccuguaaucccagcacuuugggaggccaaggcaggaggaucgcacgaggccaggaguuugagaccagccugggcaacauaguaagaccccaucucuacaaaaaagagaaagaaaaaaauuaguggggugugauggugugugccuguggucccugcuacccaggaggcugaggcuggaggauugauugagcucaggaguuggaggcuguagugagcuaugauugagccacugcacuacagccugggugaacagagagagacccugucuuuaaaaaaaagaaaagaggccgggcacgguggcucaugccuguaaucccagcacuuugggaggccaaggcaggaggauugcuugaggccugcaguuugagaccagccugggcaacaucgcaagaccucaucucugcaaaaaagaaaaagaaaaaaauuagcuggguggccaggcacgguggcucacgccuguaaucccagcacuuugggaggaugaggcggguggaucaccugagguugggaguucgagaccagccugaccaacauugagaaaccucaucuuuacuaaaaauacaaaauuagccaggcgucgugggguauaccuguaaucccagcuacuugggaggcugaggcaggagaaacacuugaacccggguggcggaaggugcggugagccgagaucgcgccauugcacuccacccugggcaacaagagcgaaacucccaucucaaaaaaaaaaaaauuuuuuuuugcugggccugaugaugugugccuguggucccagcuacccaagaggcugaggcuggaggauugauugagcucaggaguuggaggcugcagcgagcuaugaucgagccacugcacugcagccugggugaauugaacagagugagacccugucucuaaaaaaagaaacaacacucgugcaauuggguaaucccaaauagaaguauguccuggguggcaggucacagguggcagguuccagccacugugauauggcaggaaguaaggaagauaguccccgcccucaaggagggaacugucucucggggaagacagaggcaugaaauccacaaggaggcuggcagaucuguuuccgagggguuguggguggucacaggucacuuggggccugcuugggucguguggcuguuggaggcuucucuggggcccagggagacccgaggugggagugaaggaggagcauucuaggaggccugggaguucgugccugacgggccaggcgggaaaggggcaggcuccugacgugaccagggagaaguuuguuuguucuggagagugaggugagggggguggcacgcuggccucaucgccauagcugaguggggauuguguguccauuuuacagaguggcagacugaggcacugagaacggcacugccuugcuggggaugcuggggguucccggcugccccgcccagccugggaggaggggcuuugggugccauugagcccuguggugggcaggagccguuggcuggcauccgggccugggugcugcugggcggguuucacaagcccgggcaggggccggccugggccauuaggcuuccgugcagccugcggcaggaagagcuggcggcugauguaagcucuugcgcaaacccuggcugcuggcuuccggagccuucuacccacccgccugccacagcaaggcggaagcccggggcucagcagggcuuggaggcccugcugccccggcuugggccgcauggaugaacugacuggccaccgaggccccggggcccgagggcuuggcgcuggaguccggugagggggcugggccuggcuggacuggaguguugggggccggacacggggugguggugauggcguguggcccgagggcaccccuugcugcucugcccacuccugucuuuggggcccaagguggaggcccugcccuucuuugccucaguuuccccacauguaccccaaagaagauggguuggauauucugggauccugugccccugggaggcggucagugagcacuuguauacaggcccuuuauuggggagaagggaggcacuggggacucagaggcuggacugggaucugugagcucccacaggcuggaccggggccaucuaggagcccacaucuccugcaaagccacauaacuuauccaugcccccuguaaacagugcucacaacacagggccuuaaaggagguagcucuaggguacacacggaaucccuccgcugggggcuggccagugguagcacccagcuggaggugcuuugcugccaccuccugaggguguugcugggaggauuugaaaucagcugcacggugccuggugcauuccagcuuuuagcgaaugggugccauggcugguuauuguuauuauuuauauuuugaguccaggucuuguucugucgccuggauuggagugcaguguuguaauugcagucacagcucacugcagucucccagcuccugggcucaacccauccucucgccucagccuccagagacuauaggcgagagccaccuugcccggccuguugucauuauuuaucauuauauuguuuuuuuuugagacggagucucacucuguugcccaggcgggagugcaguggcacgaucucagcucacugcaaccuccaccuccuggguucaagugauucuccugccucagccucccgaguagcuaaaauuacaggugccugccaccacgcccagcuaauuuuuugcauuuuuuuuuuuuuuuuuuugagacagagucucucucugucgcccaggcuggagugcaguggagcgaucucggcucacugcaaccuccgccuccgggcuucaagugauucuccugccucagccucccgaguagcuaaaauuacaggugcccgccaccacgcccagcuaauuuuuagcauuuuuuuuuuuuuuuugagacggagucucucucugucgcccaggcuggagugcaguggagcgaucucagcucacugcaaccuccgccucccagcuucaagcgauucuccugccucagccucccguguagcugggacuacaggugcccgccaccacauccagcuaauuuuuuguauuugucuuuuuaguaggggcgggguuucaccauguuggugaggcuggucucuaacuccugaccuugugauucgccugccuuggccucccagagugcugggauuauaggcuugagccaccguguucggccucauuauauugucauugugguuaaacacaugcuuccuucccuaucauucccgaagggaggcauguuuaucuccauuuuguugaugugcaaaccgagaccugguaagggaagccccgugcgccagggccugcaugcuucucucugaccugugacccagaggccugccagggucuucccuuagaggggauggcguuuggggcucgugggacagagccccuggguggcagcugggaggcacccuguccgaugugggccuggccacguggggcauggcggggcuggcuguggcuuccacccaggcccugcugauuuccaucauguuucugagcagcagucugccccguggccccuauuggcagugaccccgggguggggccugcugucuggagggguugcccuccacggggcucccuuagcggcccccacgccugccgcuccauucaucacggauucauucccuaagccacuguggcucgguggugccagccaugggcugggggacacccugcagggcugcauucugagucccugcuuucuggcugugugaccuggcacuucccaucucugagccucaccuucuuuuucugugaaaugggcacacggggcuggcuagggcugcugugggaggugauucucuggcuggaggguggguguccucucugggccugcagagcucagcauaugagccccccgccuguaagucccccaccgccuugcccuguggccucuggaagucccagugcgccaccgacuucaggauuccaccugcagauggggagaauggugccgggccggaucugggcugguugggcggcagggguggaaggcccuccuccgagggugcggggugcccagggcugagggucugcuguggggggcuuccugccguauugugcuuucucaagcccugggucugguuggguugauccaggaccaucuugcagcccagggguggggccggagcaggggaacccucuuuggucuccuggccagcaucagcuccacacagcuggggagaggcggcggucucggggcggugggucggggcggugggcuggggcggcggcgccucccugguugucugccugacgguccucccaacuucucucugcaggcgaggccuucuugggcagcuuuguggccagcgggauggggcccucggccucgucccaugggagcccagugccacugcccucugaccugucuuuccgcuccccaaccccuagcaaccugcccauggugcagcugugggccgcccacgcccaugaagguaaggaacaugccggggucggggcugagggcugcugggcugacgucccagccacucuggccacuucaugugccccucuguugucaucgcugagcuggggcuggugggucccaggucaccuggcuucccuguuguuucucaaacgcucagggcuucuucuugucacugucacagggcauuuguaugagcuguuuccucuccuuucagccugacaccccaugccacagaccaccuuccaguccuccuccggcucagcucagagacccccucuuccgcacccacuuccaucacuugcuugugacgacagauuaucucaucauucaugaacuacccgcuuucccaccggagugagcccugaguucagggccuagugugaucuacucagcacuguaucccugguacacaguaggcucauuaauaauuacaggagcaggccgggcaugguggcucacagcuguaaucccaacaguuugggagguggaggugggaagaucaccugagggcaggaguucgagaccagccugggcaacauagcaagaccccaucuccacaaaaaaaauuucccagagcggggggaccuggggcuguuggggccuuuucuucugcauuucugcagccaugccccucaauguaggggcucugcaggccuggcuuccccggggucgugagcagauucuggauuucucuagagccucacuuugauuuucugccugcaaaggaaugggccugcagaccuccaagcuccucugucuucucuggcuuugacagguucuggauguugggcgcuagguacuuccuucucccuccucccuccuuccuccuuccuccucccagguguccuguaggugcucgugguuccuggaagguugcagcccuggagcuccugcugcaggcuuagggcucuuccggcccuccccagccacucucccuccacuuccuccugcggggccaggucugaccgucaucccgaauccugcggcugcuguguucagcccaggaggagacagguucagccagaggcgucucuagucacaggaccccauccaguccuuacaguacuuugcccauuguacagaugaggucagcgagucugcucuuccuggacacucuggggaaggcaucugaauccaggcacgagggugcccagccugcacagagugggccuucuaggcuggggucgcaccugagccucccacuuuaaccagccaaggcagaugccagagggucuggaugaggagagccugccucucgggacugucugccaccagcucacuaccucucugucccugagacuuuucucuuuggccaacaaauccuagugaugaccacaaacacacagggugcuuaccacagcccagugcacacucagcucacuucagccucagagccagcccugcccgggggagggacuguuaggcccuuuuuuuugagacagggucuugcucugucgcccagacuggagugcaguggugcaaucucagcucacugcaaccuccgccucccaggcucaagccauucucccaccucagccuccugaguagcugcgacuacaggugcacaccaucacgcccgguuaacuacuguauucguuuuugguggaguugggguuucaccaugugucccaggcuggucuugaacugcuaggcucaagcgaucgucccaccuugaccucccaaagugcugggauuacaggcaugagccacugugcccggccuauuaagcccauuagguccauuuuacagacgggagagcagagaccugaugccugugugggagagcuguuuuuuuauuguugguuguauuuuacuuauuuauuuauuuuuugaaauggagucuugcucugucgcccaggcuagaguauauaguggcacaaucuuggcucacugcaaccucuaccucccggguucaagcaauucuccugccucagccuccugaguagcugggauuacaggcgugcgccaccacgccuggcuaauuuuuguauuuuuaguacagacagggcuuuaccauguuggucaggcugaucucgguucacugcaaccucugccuccugaguucaagagauccuccugccacagccuccugaggagcugggacuacaggcgccugcuaccacacccgucuaauuuuuuguauuuuuaguagagaugggguuuccccauguugaucaggcuggucucgaacuccugaccucgugauccacccaacucggccucccaaaaugcugggauuacaggcaugagccacugcuccggcugggagugcuguuugaaugauuggaugagagaacagguaucggguagcccuuuuguuuguggguguugucaauggcaugauuauugacaaggcggugcuggagagaagacaucggcccaguggaccagggacagguccugcaucccuggccuuagcaggggcagcuggguaugggguaccugagucccugagagaucucuaauuggccugggaucccauaggacucugggcuuaggcagagaaucaggacccuuacccagcacccuagcaccugccugccucuuagggcugucauucugugugcccuuuaaaaaaaaaaaacuauuuaaauuuuuuuuuuuuuuuuuuaaauagagauggggucacacuauguuucccaggcuggucucaaacuccugggcucaagcaauccucccccaucggccucccagagugcugggauuaaaggugugagccaccaugccuggccucugugugcucucuuaggugacuucuccucucuccauggcuaccccuucuuucuuuguccugcaaggucccaauucuguuuauuuuuauuuuuaaaaaauucugagccggaugugguggcucacaccuguaaucccagcacuuugggaggcugagguggguggaucacuugaagccgggaguucgagaccagccugaucagcauggugaaaccccaucucuacuaaaaauacaaaauuagccgggugugguagcaggcgccuguaaucccagcuccucaggaggcuguggcaggaggaucucuugaacuaaggagguggagguugcagugaaccgagauccugccacugcacuccagccugggccacagaguaagacucugucucaaaaaaaaaaaaaucugaauaguugaagucagcacguccugaugcuggugcugggcauugcuggugaggggguggccuuuggggaggcggggaggauccuuggugggaggaauuccuuccuggcagcuccugccugggagacccagcagcugaagaugcuggguccgcugagguucagagaaggcaggugaccagcuuggggucacacagcagagaaagggccuguguuaggcugagguuaagaguccuggcugcaggguucgauggucucgauccaaagccaggcagcucugcuguaucgucuugggcaaguggccugcucugaguuuucucgucuuuaaagugaggacauuaagucucuuccuuauagguuguuuuugagguuuaaaugaggaugacaguggcaaagcucuuggucauguuugguaggcuguuaucgggccccgcuaguuggauccauucugauccucuuucugggggggacuggagaccccagucccccgugagggcugccugggccuggagagagacccaggguuggggagcaggagaaugcauugcccugaggagcugcuguuaaaccucaaggcgcccuguaccagcggucggcugccaaaauaguuuauuuccaggagcuggaaggaagcuccuggugagcagcacgaauuggcccagcccagcuuuucucuuuucuguuacaggcuucucccaccugcccagugggcuguacccauccuaccuccaccugaaccaccuggagccccccagcagugggagcccccuccucagccagcugggucagcccagcauuuucgauacccagaaaggucaggggccaggaggagguaagacuggaguccgggguuggggguggcacaggggccuucugagaggcuucuggggccuuuggcagcauccagguagcccccagcucuguccaggaugcuggcuuuuuuuuuuuuuuuuuuuuugagacagggucucacuauguugcccaggcuggagugcaguggugcgaucauaggucacugcagccucaaacucccaaaugaugcaccugacucagccccccaaguagcugggacugcagacacaccccaccacagccagcugacuuuuuaacuuuucuguagagguggagucuugcuguguugcccaggaugguuucaaacuccuggccucaagcaauccuccuaccucggcuuuccaaagugcugggauuacagaugugagccauuguggccuaagaugcuuuuuugagaccugagucccuaagaccccccacaggcuccuugggcccacccacagcccugggugccuucuggucacacuguccucuuaggggcccugcuaggccuuccgggcaacuuugaaaacaaacccuggucucuccuuuuacagaugaggaaacugaggcuugggaaggguagauuuaaacuugguuguagguauuuccagagccugcgcucucuagggcugggacgcccauuucuucuugcccuggggggugccuugccuuggugugaaaccucggggcucccugcaccgaaaccguuuaauuuccaagaaaaaacacugggucgagugcggcucaagccuguaaucccagcacuuuggguggccgagacggguggaucaccugaggucaagaguucaagaccagccugacgaacauggugaaaccccaccuguauuaaaaauacaauaauuagccgugcgugguggggugcgccuguaaucccagcuaccggagaggcugaggcaggagaaucgcuugaacccaggagguggagguugcagugagccaagguugcgccacuguacuccagccugggugaggagagcgagacucuuucugaaaaaaaaaaccaaaaccaaaacacugggggaggcauggguugguccaucccccucucagggguccgccuccgcccaggcaggggugggaggggagguggcgcucgcucacugccugcuguucccuucuccgcagacgguuucuaccugcccaccgcgggggcuccgggcucccugcacucucacgcgcccucggcccggaccccuggcggcggccacuccucgggcgccccggccaaaggcucgucgucgcgggacgguccagccaaggagcgggcgggccgcggcggggagccgccuccgcuuuucggcaagaaggacccgcgcgcccggggcgaggaggccucggggccacggggcgugguggaccugacccaggaggcgcgcgccgagggccgccaggaccgggggcccccgcgccuggcugagcgccugucgcccuuccuggcugaguccaagaccaagaaugcggcgcugcagccgucgguacugaccaugugcaacggcggcgccggggacguggggcugcccgcgcugguggccgaagcggggcgcgggggugccaaggaggcugcccggcaggacgagggcgcgcggcugcugcggcgcacggagacccugcucccugggccgcgccccugccccucaccgcugcccccgccgcccgcgccccccaaggggccuccugcaccccccgcggccacccccgccggcgucuacaccgucuuccgcgagcagggccgugagcaccgcgugguggcgcccaccuucgugccuuccguggaggccuucgacgagcgcccggggcccauccagaucgcaucccaggcgcgcgaugcccgggcccgcgagcgcgaggcuggcaggccagggguccugcaggcgccccccggcuccccgcggccucuggaccggcccgagggccugcgcgagaagaacucggucauccgcucgcucaagcggccgccccccgcggaugcccccacggugcgggccacacgcgccuccccggacccccgcgccuacgugccugccaaggagcugcucaagcccgaggcggacccgaggcccugcgagcgugcgccccgcggcccagccgguccugcagcccaacaggccgccaagcucuucggccuggagcccgggcgccccccgcccaccggcccugagcauaaauggaaacccuucgagcugggcaacuucgccgccacgcagauggccgugcuggccgcgcagcaccaccacagccgcgccgaagaggaggccgccguggucgcugccuccuccuccaagaaggccuaccuggacccuggggcugugcugccccgcucggcggccaccugcggccggccggucgcugacaugcacucugcggcccacgggucuggagaggccucggccaugcagagccuuauaaaguacaguggcagcuuugcccgggacgccguggccgugcgcccugguggcuguggcaagaagagccccuuuggagguuugggcaccaugaaacccgagccugcgcccaccucugcgggugccucccgagcccaggcccgucucccacacuccggaggcccugcagcgggcggcggccggcagcugaagcgggaccccgagaggcccgagagcgccaaagcuuucgggcgcgagggcucuggugcccagggugaggcagaagugcgacacccgccugugggcauugcaguggcuguggcccggcagaaggacaguggcggcaguggccggcuggggccugggcugguagaccaggagcgcucucugucgcugaguaacgucaaagguagguccugggcagagcccaggugcggguaggaucuugggucucucugccguuucccguacauuacagugugggcccuuucccuuugcuauugcuaagucuuuauaaguaucauuuuuuaaaauggucuugaauguucuguugcgagcauguaccaugguucaguuuuccacucccuugaugggcauuuucguuuguuccuucuccgauguuuuguguucggaacguugcuuucagucuuugugugcaucgcaccuucgugauacuuucagucauuuccugagaacagauggucuugggaauagacaaauaucaaaccuucaauuugaagucaucgagggaccuaacugugccuuaccgauuccaguguccccgguaccuagccagccugggcucuggcacguaguagguguuugauggaugagugaaugagugaggaacagacagaaacugggguuccaacauccucacggucuugauacucaguacuugagugacuuuuuagguagguagagaguuuacgugccuguaagugguuuaugaguaucuguuauauuuuggauucuuuagaauuguuuuauuuauuuauuuauuuuugaaacggaguuucacucuuguugcccaggcuggaguccaauggcacgaucucagcucaccgcaaccuccgccucccaaguucaagugauucuccuggcucagccuccagaguagcugggauuacagacaugugccaccaugcuuggcuaauuuuguguuuuuaguagagacaggguuucuccaaguuggucaggcuggucucgaacuccugaccucaggugauccgcccaucucagccuuccaaagugcugggcauuacaggcgugagucacugcccccagccuguuuuauuuauuuuuaguuuauaaauuauuauuuuguuuuagagauagagucuugcucuguuacccaggguggagugcaguggugugaucauagcuuaccguagccuugaccuccugggcucaagcgauccuccaaccuuagccucccaaguagcugggaccgcagguaugcgccaccacgcccgacuaauuuuuucuuuuucuuuuuuuuuuuuuggagacagagucuugcauuguugcccagacuggaguacaguggugccaucuuggcucacugcgaccucugccuccuggguucaagcgauugugccucagucuccccaguagcuggcauuacagguaugcaucaccaugccuggcuaauuuuuguauuuuuaguagagaugggguuuugccauguuggccaggcuggucucaaacuucugaccucagaugauccgccugccuuggccuccgaaaguacugaaucuccuaccugugucacuuuuuuuuuguuguuuuuugagauggagucucgcucugucacccaggcuggagugcaguggcacagucucugcucacugcaaccucugccuccuggguucaagcgauucuccugccucagccucccgaguagcugggacuacaggugcgugccaucacgccuggcuaacuuuuguaucuuuuaguagagacaggguuucaccauauuggccaggcucgucucaaacuccugaccucaagugauccacccgccucggccucccaaagugcugggauuacaggcaugagccaccgcaucuguuuuuuuuuuuuuuuuuuuuuuuuugagacagacuuuugcucuguugcccaggcuggagugcaauggcaugaucuuggcucacugcaaccuccgccuccuggguucaagugauucucaugccucagucuucugaguagcugggauuauaggugcacgccaccaugcccagcuauuuuuuuguauuuguuuuucuuuaguagagacaagguuucacuguguuggccaggcuggucucaaacuccuggccgcaguugauccaccugccucagccucccaaagcucugggauuauaggugugagccaccaugcuuggcuuuuuuuuuuuggauggagucucgcucugucaccacgcuggagugcagugguaugaucuuggcucacugcaaccuccgccuccuggguucaagugauucuccggccucagccuccugaggagcuggggucacaggcacccgccaccaugcccggcuaauuuuguauuuuuuuuucuuuuuuuuuuuuuuuuuuuuuuugagacggagucucgcucugucgcccaggccggacugcggacugcaguggcgcaaucucggcucacugcaagcuccgcuucccggguucacgccauucuccugccucagccuccccaguagcugggacuacaggcgcccgccaccgcgcccggcuaauuuuuuguauuuuuaguagagacgggguuucaccuuguuagccaggauggucucgaucuccugaccucaagugaucugcccaccuuggccuccugaaguccugggauuacaggcgugagccaccgcgcccagccagcugugucacuuucccaccacccugaugccugccccagccgguccuggguaucuggugcuggaccucccgccugcagugcccuucccacuuccugcacagccaugucuccccauccucugugccuucaccucccgguggagccaccuuggaccgggccugucucuggccgagcuccagaugcuccugccuuccggggacggcccugaagucuuuggauuuugaguugggagguggggcucugucaggcuugucuuggaauucucuucauccagcagggcuggcucauggugagcgaugcucagugaguguuuguugacugacugaaugaacacacugcucuguguggagcuccuggagccagggaagccccgcuacacucugacccuggggcuuugcaugagaaccugccuuauucugggacagaaggagggaggggccaacagcgcuuggauuggagguggccagcuuggugauggaaaaaggucuccugcucagagguuuggggcugugggccccccugggaggcaggagaucucuuugagccuuucucuggaaggauccucccgucacaugggguggcaccuuuguugggggcucacggucacuggaguccaucugagaucccagaguaccugucugugcccaagaggcugugcguguguuugugugggggagggggacaugcgaaugugagggagggagggagggugugccagagguuugggaugagauguuuggggauuuaucugaagcugcucuucucuguuggugcugauguuugaaaaguaggugacugguugggggcuggguaugguggcucaggccuguaaucccagcacuucggaaggccaacguaggaggaucacuugagcuuaggagguugaggccagccugggcgaccuagcaagaccuugucucuacaaaaaauaaaaauagguugggcgugguggcucacgccuguaaucccagcacuuugggagaccgaggcggguggaucacccgaggucaggaguuugagaucagacugguuaaugugguaaaaccccgucucuacuaacuaaaaauacaauauuagccaagugugguggcacauaccuguaaucccagcuacuugagaggcugaggcaggagaauggcuugaaccuaggaggaggagguugcagugagcugagaucgugccauugcacuccagccugggcaacagagcgaaacucuaucucaaaaaaaaaaaaaaaaaaaaaaaaaucacccggguaugcuggugugccuguagucccagcuacuuaggaggcuaaagugggaggauaguuugagcccaggaggucaaggcugcauugaacuaugauugcaccacugcgcuccagucugggcaacagagugagacccggucucuaaaagaacaaaaaaguagggggcuggauucuuucucuccuuaaaaaaaaaaaucccauaagaaguggucauuucucucugggcaguccagccugagugcugagccacuuugaaaggagggaggagagagacgcccugggacgccugugucugggcaguucccccagcugaggacagucggguugucacacuggucuccuggguucucgccccagucucuugcuuuuuggagcgagcccucugccuuugucaauggguuuaaguccaagcucugcccuuuguagcuacguaaccuugaacaagagccucgagcccucuggccucugggggcggcucaucugcuugaugcugggugggcugacgggcacauagugggugcguuauaaacgccucucucucaucugcucauauucaggcauuagggucuuagaaugcaccugccugugcaggggagcccugggucuuccuguucucacauaggaucuaggucuggccucagggggccuuggaccuugagauggaugaaggacaggcauuaccuacauuugugagccccacgcagucagagcccccaugcccaagaagcuaagaacgauaaggggcauccuugccagaugcggcggcucaugccuguaaucccagcucuuugggaggccaaggugggcagaucgcuugagcucaggaguugggagacuagccuaggcaacauagugaaaccccgacucuacaaaaauaaaaauaaaaauaaaucauccgagcauagugguguggcaucuauagucccagcuacugggaggcugaagcagggaaggaucaccugaccccagcaggucgaggcugcagugagaucgcaccacugagccccaaccuggguggcagaguaagauccugcccccaccccaaaaauagaaagcaaucguugccguugagccagcagcccguaugaacagacagcuccaugaggucuccugugagggcguggaccugugcagaggaggggcuguuacucuccccauucagauggggagacaggccugcagggaugaggcaaggcugagcggggagcccugagcugaguuuugucuuuccuaccucuucacuggcccaucaccucuaggguggggccaggucugggagggaggggcuguggggauguccccaccuccagcuucacagggggcggcugggggugcagagccggguguacgccaugguguuggugacaagccugcuggggccucuauccagucacucccccccgauccgcuuccccggaccccuggagagcaacccuaucuggaacugcucagagagaggccaggaagggguugccaugggaacggggccucugcgugagccuuggguuccuaauggcugcgauguggggcgugugaccugugaguggagucguuagcgcugcagacucgggggcuuuugcugcaggacacccucaccccaccaugggcccugggcuggggcugggccucugggcggccugcagagagggggcggcagugacguggcuggagagggcccuguggcacucccuguguggggccguguauguugguggucagcagggccgacuuggacgcugaucacagccaugacgccuccauguuagucuugugacuugggcauguuucuuuaucucccugugccucaguuuccucaucuggaagauagggaugagggcugggaucugccuccuggguugauggugauugaaugaguucauguuugcaaaguggccuggggcccugcugggcacagggacagccuuuguuuauuuauccacuuuauuuuauuuuuuauuuuuauuauuuaauuaauuaauuuauuuaugagauggagucucacucugucgcccaggcuggagugcagugcugugaucuuggcucacugcaaccuccgccucccggguucaagugauucuccugccucagcuuccugaguugcugggauuacaggcaccugccaccgugcccagcuaauuuuuguauuuuuaguagagccgagguuucaccauguuagccaggcuggucuugaacuccugaccuuggguggucugcccaccuuggccucccaaagugcugggauuacaggcgugagucacugcacccgaccugaguuuacuuuucuuucuuucagucuuuccuucuuuccuuucuuuuucuuuuuuuuuggaaacagggucucacuccguugcccagguuggaguucaguggugcagucauggcucacugcagccucgaggacacagacagugaaugaucaauaagcagaauagcuguguauagucaagagaacgugauggagcagagguggucagggagggcuuccuggaggaaguggcacuugaagcugagcucugaugguggagguccagguggugggaaugguguguguguggcccagagguggggaaggggacaagugugacaugugcagagaggguggggcauccucgagaggccggccagguccccacuugggccuguggggugacagauaggaccaggauuagagcggauggagggccacagagugaggaggguagaggaggggcccggccaagcgcaggggugggggacagagggcucacuaucucucuucagaggccaaccacauuugcagggagcaaccuggggcuguggcccuugaggcccugaggguggcaggugcucugauauggggcuggccagcagacuggcuucuguggcagguggcgcuugggaugggaagccccugagaccauucacagugacagccgggacagucggggggacagagggcuuggggcagcccaggcugcacucuaagugccugccucuucugggggcacggggagagcccugugcucaaagcuugucccagacuccaggaggacccagggggcgugaggguggcccccucagguggcugagccucugggauucuguaagcugggacggcugucuccccugggagaaggaagcuugaucucaugacucgauuucucagcacagcugugggacucuggaguggcccuccguugccccaguccugccugagaccugucacugcccuucugggccucaguuuccccgugagguccacaggcagggccccuugcaguccugacugaggggugcauggugggcucagcuucugcuuugauacaggagcuacguugauguuggagguccagguagcccuggaggcccguguccaggcgcccucgucaacacgcuucuccccgugccgggcugcccggcugucccuccguacacucgguccugcaggcgucugggccggcauggcugugccccucucuggguuccucucuucugcuucugggacugguggguucccaccuuccugcagggaaagggagaugcucuguggccuaggcuggaguauggugguguaaucacagcucacugcagucuccaccuccugggcucaagccauccuccugccucagccuccuaaguagcugggaccacaggggcaugacaccaugccuggcuaauuuuuuauguuuuuguagagauggggacucacuguguugcccagauuggucucaaacuccugggcuccagugauccucccaccucggccucccagagugcugggauuacaggcgugagccauucugucgggccuggggugcugcuuauuaggagcuccugguauuugggggugugggaagggagagaugagaggagaagcuugauuccaaguuuccucacccauuagggucauggcuguggggccgcuguagaccccaguuaggacagcuggguggggaccuugucuccagcagaaggauaguuucucugugcuggcggcugauccccugacauugcagcuggcggugcuggacugggcccuuggggguggcugauggccggggucugcccacaguagcgcugcguaggaggaccuagcucccagcccaccccucuucccggaagcccugggaaggccggccccaaggggaguaucagccgugccuccgccugugcgaauggcaccugggagccgacgggcagguuuucgagcugcacaccugguagccucugccguggggcucagcuuccucccauucccgggccuucaccuguccggugugucccaucucuggcucaugguguugaacacucaaagaggggccagggcaggguggcagggacaaggagguaccaggagggccagacggggcuccugccacuccgccgcucccuguccccucuccucuggugaccauccaugugccaggccugggacucaggggcuggcuauagggagggacagggaugggugagcccgguagcaucucccacucagggggccaaggccacccccuccacccaaguggauaauguucuuuggguuuacuuuucuaucuugauuuuuuuuuuuuuucuuuagagucugggucucgcucugucacccaggcuggagugcaauagugcaaucauaauagggagucacugcagccucgaccuccccggcgcaagagauccucccaccucagccucacgaguaccugggacuaccggugcaugccaccaugcccgccuaauuuuuguguguguguguuuuuuguuuuuuuguuuuuuuuuuugacggagucuuauucugucuguuguccaggcuggagugcaguggugcaaucucggcucacugcaaccucugccuccugaguucaaaugauucuccugccucagccuccugaguagcugggaucacaggugcgcaccaccacgccuggcugauuuuuguauuuuuuuuaguagagacgguguuuugccauguuggccaggcuggucucgaacuccugaccucaggugauccgccccgccccccccacccggccucccaaagugcugggauuacaggugugagccaccucgccuggcuagccauguguauuuaaacugucuugggacacacaggccugcgugguugggaccacagucuggcuucauguggcccagguccggcuaguuuuuggguuguguuuuuuuucuccauuuggacucugcccuguccucaccaaauccccagcucagaaucugccuucccgucauuaaaauagcauuaguggcggggcucggugacucacgccuguaaucccagcacucugggaggcugagguggguggaucacgaggucaggagaucgagaccauccuggcuaacacggugaagccccgucucuacuaaaaauacaaaaaacuagcggggcgugguggugggcaccuguagucccagcuacuugggaggcugaggcaggagaauggcgggaaccugggagguggagcuugcagugagccgagaucgugccacugcacuccagccugggcgacagagcgagacuccaucucaaaaaaaaaaaauaaauaaauaaaaauaaaauaaaauaaaaauagcauuaguaagugcacccggccucacguuucauuguuaugugacaaguuuuaugacauuuucuuacaauaucccuggcuguuggccuaauuaucgccacgguugucugucuaggggacauagacaggccuuuuggaugggggaugacagagcggauggaugauuucuggcccugaggaaccccaguugggguuugggggagcuugaugcgucauaaggaaagauguuggggugaaggcacuacacggauggcugugcaggaccgucggggcucuggggggcccagggaggggugagggcaguggggccaaugggucugggaugggcucggugcuggcugggggcucacuuccaccuggcccccugcagggcacggccgagcagaugaggacuguguggacgaccgggccagacaccgggaggaacggcugcucggggcacggcuggaccgggaucaggagaagcugcucaggugagggugucgggggauccugagggucuaggggguaucuaggagccccugggggugaggggcagcuggaugaccccaggugggcuuggccccucgaccauggaugcuaugguacugagagcgggagucacucugguccucagcaucgggccagcccugcccaggccagguggccccacugccccuacagugaguguggaaggccccgggaggcccuucaguuccgagcagugguuguccugacucauggccugguggcaaacaguuccuuggggcaaccccgcuucucccucucguccccugggcuguccgagcugucgcugacaccuaugauccuccuuccagagagaguaaggagcuggcugaccuggcccgccugcacccuaccagcugugcuccuaacggccugaaccccaaccucauggugacggggggcccggcgcuggcgggcucaggucgcuggucugccgaccccgcagcccaucuggccacgcaccccugguugccccgcucgggcaacgcauccauguggcucgcuggacaccccuacggugaguguggggcacagggucucuccccuucucugagggaggggugggagggggcgggugcaggacaagagcucagggcuggcuccugccugccguuuccuggggggccugggccugccucccgcauucgucggaagaaggaaugauaauggccucugccucguggggccccucugccaugccuguuuggggcagaugcccaaugcggguggcucuggggugcucuuugcagccagccagcaccccugucccuuggcuuccccacuggaggccccaggagguucaggacuugggagguggugcugggcuggggcugcccgaggacaaaccgcuugggggcucccagcacugacucaggccugggcuucuccuccuaggcuugggucccccaucucugcaccagggcauggccccugcguucccaccuggccuggggggcucccucccgucagccuaccaguuugucagggacccccaaucgggccagcugguggucauucccagugaucaccuuccucacuuugguaaguggaccuucuauguggccaccaugggccagacuggccaugcccagcgagauggucucugaugccaagggcuuccugcugagggguggcggccggcagaucuggggcuggggaggcggaccgggguucagagagaacaucuguugccaguguuguaaagccuugggguccuuguugcaaugagcuccugcccaaaaacuccauaaagagaagcgagacaggcagcccugggugggggcugggauuccccuuaccuggcgccaccgccuccccaggaauccaccuuguagaccacugggaggggugggagaaggcguucccuagguccucacagugguccucguacgugucugcgugcugaccugcucugguugcgaggcugugggaacaucccaccccggguguggacagggcuguguuccccgggccuggggugcacacguggcccauggaggacaggacaaacuuccuggccccuggggagcagccgggggcccgcagagagcccagcuccccacuguguggguguggccccucucuggcuucagcuuccccucguaaugggcauggugguggagcaucaggccgcaggugcagcgcacugucucugucccugcagcggagcugauggagcgggccaccguaccgccccucuggcccgcccuguacccgccgggccgcagcccccugcaccacgcccagcagcugcagcucuucucacagcagcacuuccugcggcagcaggaguuccuguaccugcagcagcaggcggcccaggccuuggaacugcagaggagcgcccagcucgugguaagucggggaggaugaggcgcagcucccucugggggcccccaugggugacgaggcagacgagucagccagcagaaucuccagacaguuacagggagggagaaaacagcagaggggcagguggucagggagggcuucuggaggaggcagcaguggaaccgagaccuggagccaucuguagaagaguucuccaggcggagggagcugugagcagaggcagauggagauuggcagggcagggugcaggagcgaggaggaaaccaaggcagagagguggccuuggggacuggggaagggugauuggacacugaaggaguccagugggcucccgcuguugccugagcccagccuggccucuucucuccagguggccucucggagaggcacaaggaggccuggccagcugccuccugacggcauggucccauaagauaggggacacaaagggucugcucuggaggagucggcccagguagugcauacagcaagaagcucucagagccugagcccugggucugaaucuuagcucugccaggccuggcugugugcucgugggcaagugccuuuacuucucugggcuucagguuuccucucccagaaacagaugcuagcguugccuaguccuuggguugcuaaaugugacuguuuaguaaucgggagagcggccuguccuuggagcgcuuuguucugguguuuguuuguuuguuuguuuuuguuguuuuuuugagguggagucuugcucugucgcccaggcuggagugcagugguacuaucucgggucacugcaaccuccgccuccuggguucaaacgauucuccugccucagccucccgaguagcuggaauuacaggcacaugcugucaugcacggcuaauuuuuuucucuauuuuuaguagagaugggguuucgccauguuggccaggcuggucuuccuggccucaggugauccacccgccuuggccucccaaagugcugggauuccaggcgggagcacugugcccggccccuaguguguuuuguguauugacugaccggcccagguaggcauugguggucgccgagcugacucccucccauuuccucauaaaagacaugccuggcuuccuccugcccucuuuggggccuuuugagacccuaaaaugaugacgcagugaagcaggaagguuuagcagguagugagugcgcccaaugccaucgagguguggggccuugugccccccaucuggccccccuuguccugacugugaggguccgugcagggccgggguccugguggaggucccccaucagcccugguucgaaggggcucaccagagcuccucacccccagcgcugccuuuugggguucugcguggaacgcugugcuuaugacacaugggcugggauggaaugucugucucuggccugggacggggugggcagccuggaccccaggcccugcaugagguucuccucggacucggggacccuuggggggacagggcaggugcgggcgucggggagggggaaacucgugccgugcugacccugccugccggccccuucccagcaggagcgguugaaggcgcaggagcaccgggcggagauggaagagaaggggagcaagcggggccuggaggcugcgggcaaggcuggccuggccaccgccggccccgggcugcugccgcggaagcccccuggccuggccgccggccccgcgggcaccuacggcaaggccgugagcccgccaccaucaccccgcgcauccccuguggcugcccugaaggccaaggucauccagaagcuggaggacguguccaagccacccgccuacgccuaccccgccacccccagcucccaccccaccagcccgccgcccgccuccccaccgcccaccccggguaucacccgcaaggaggaggcucccgagaauguggucgagaagaaagacuuggaguuggagaaggaagcccccagccccuuccaggcccuguucucagguaggaugcagcugagacccucagggucucacucugccccuggagcgguaaaacugcucauccaucuuuucauugacccguucgaucguucguucauuccaccuccacggagcaccuccugcgucccaggccugccgccagacacugagacaaacacaggagcucacagucaaauccagccucuccccggccccuccucagcggcagugucagggaaauggguguaauauuagaaacugcuucaggaugaguuguucugaguuuuccaccgagccagaccugucacacgcucagcaugcagucggcgcuaaguucugccuugcugaugaugguccagggacacccauucugggcagcuuuccccccguucugugggucccaugcacacacccgcucuugccgucuucugcaucagaggggaccugcagcagguggcuuugggggcugggacuguguucuuccucccugggggguaucaggugugugagcgugugcuugggaggacuuugguucaacuucagauucuggcaccaaggcugggugagcuugggccagugguggcaaucacugagcuuggcccggcgccugucucuccuuugucaguuuccuuuugugugccuccagcugcugggcugggaguggugcagagaaucaggggcacacagcccugcucucagggagauuacacuugggggacagaacuggguugcuauuccuuuucuuuuuuuugagaugggauccucacucuguugccccagcuuguacugcagugguacaaucacagcucacugcagccuugaacaccuggacucgagcgauccuccuguuucagccucucaagcagcugggaccauaggcacgcaucacuggacuuggcuauuuauuuauuuauuuuugagacggaguuuugcucuuguugcccaggcuggagugcagucgggcaaucuuggcucacugcaaccuccgcuucccagguucaaacgauucuccugccucagucucccuaguagcugggauuacaggcaugugccaccaugcccggcuaauuuugaauuuuuaguagagacgggguuucuccauguuggucaggcuggucucgaacgcccaaccucaggugaucugcccaccucagccucccagagugcugggauuacaggcgugagccaccaugucuggccaauuuauuuuuuauauuuguacagaugugucuugcuuuguugccaaggcuggucuugaucuccugggcucaagcaguccucccacccuggccucccgaacugcugggauuguaggcuugagaccacugcagcuagcccugcuguuacauuuuguuuugcuuugagauagagucucacucugucacccaggcugccgugcaguggugccaucauagcucacugcagccuugaucucccagguucaagugaucuuuccaccuuugccugugaaguagcucggauuacaggggugcgccaccaugaccagcuaauuuuuuuuucuuuuuuuuuuuuuaguagagauggagucuuccaggucaggcacaguggcucacgccuguaaucccagcacuuugggaggcugaggcggguggaucaccugagguuaggaguuugagacuggccugaccaacauggugaauccccgucucuacuaaaaauauaaaaaauuagccgggcacggccgggcacaguggcucacgccuauagucccagcacuuugggaggcugaggcgggcggaucacgaggucaggagaucgagaccauccuggcuaacauggugaaaccccaucucuacuaaaaauacaaaaaaaaaaaaaaaauuagccaggcaugguggcgggcgccugucgucccagcuacuugggagggugagguaggagaagggcgugaacccaggagguggagcuuguagugagccgcgaucgcgccacugcacuccagucugggugacagagcgagacugcgucucaaaaaaaaaaaaaaauuagccaggcgcggugggucaugcuuaugcuucuugucccagcugcucgcgaggcugaggcaggagauucguuggaauccaagaggugcagguugcagugagcugagauggcgccguugcguuccagccugggcaacaagagugaaguucugucucaaaaaaaaaggaaauggggucucacucuguugcucaggcuggucuugaacuucugaauuuaagcgaucaucccccuuuggccuccuaaagugcugggauuacaggcguggcccaccacgccuggcucugcuguuagauuuugaacaacugcuuuaaugggguggagcaguagguuccuggggaguggagaccagaccacacaagguggguaaaggcagcuguaggccuuugcagaccucaugaaguguuggcuucuggucuagccuugugcugggugcugagugggaaaggaacaagagagaccacugugguucuuugccuucaagaccacaagaccuuggggacaagaagguggcugguuuuucacuuuggggccacugcauggcccugggguuucugagaucccaccuagaacagcucccacccuguagcugggugagcagggggcggcugcguccugggucucugucugggguggugggcgggugucaguggggacaugggauaucagauccuagggcucccaugcugaccccuguguccuuggcagauaucccgcccagguacccguuccaagcccugccaccgcacuacgggaggcccuacccuuuccugcugcagcccacggccgccgccgacgcggacggcuuggccccugaugugccgcucccggcugaugggcccgagcgccuggcacucucacccgaagacaagcccauccgcuugucccccuccaagaucacagagccgcugcgggagggcccggaggaagaaccgcuggcugagcgggaggugaaggcagagguggaggacauggacgagggccccacagagcugccgccucuggagucgccgcugccacugcccgccgcggaagccauggcuacccccagcccugcaggggguuguggagguggccuguuggaggcccaggcgcugagugccaccgggcagagcugcgcagagcccucugaguguccagacuuuguggaggggccugaaccacggguggauuccccgggccggacagaacccugcaccgccgcccuggaccugggggugcagcugacacccgagacacugguggaggccaaggaggagccgguggaggugccuguggcggugcccgugguggaggcagugcccgaggaaggccuggcgcagguggcaccgagcgagucccagcccacccuagaaaugucagacugugacgugcccgccggggagggacagugcccgagccuggagccccaagaggccgugccuguacucggcagcaccugcuuccuggaagaggcaagcucugaccaguuccugcccagucuggaggacccacuggcuggcaugaacgcccuggcggcagcugcggagcugccccaggccaggccucugcccuccccgggugcugcuggagcccaggccuuggagaagcuggaagcagccgagagccuugucuuggagcagagcuuccugcauggcaucacccugcuaagugagaucgcagagcuggagcuggagaggaggagccaagagaugggaggugagagugcgcgaccucugaguucugcagauucgugaguuuuaguuuuguggugauggggucuugcuguguugcccaggcuggagugcaguggcacaaucuuagcucacugcagccucaaacuccugggcucaagugaucuucccuccccagccuccccaguagcuugggcuacaggcguccaccaccaugcccagcuaacuuuuuaaaaaguucuuuuuuuuagagauggggucuugcucuguugcccagucuggucucaaacuccuggacucaagugauuuugcccaccuugaccucccaaagugcugggauuauaggugugagucgcucgcugugcccggccucuuaaacauuuuuuuauaagauuuuuaaauuaugaaaaacccggaauaugguuuauucauauuaauuuuuuaaaaaauugugguuaagauacacauaacaaaauguuccaucucgagcauuuuuaagcguccuguugagugaguggcauguuaaguguguuugcacugugcagccagucuguagguuuccugguggugaaauuucucauucuauugaugguguguuuuagcaggauuucuuggguugcaaggaacagaaacucucauuuaaauugguuuaggcaggagagaauuaauuggcucuuggaacugaaguccggcaguaauuagguaauuucagguauggcuggaucuagguguucaagccaagaaaccaagucuuucuuuuccuacacaggcccuucccuagucucucucucucuguguccccgucuccuucccuccuucccuccuucccucuugcuguucgacuuuucucucuguuggccucauucaaggccgacuuacuguccucacuggggugggggguggucugucaguuccucccaggucccugggccugcucagcagccuuccgaaagaggccaccucuuucuugcuagcuuuggcaaaaacacugagauucauucucaagggcugacugcgguucaugcuuuguuguuguuguuuuucuuuuuuugagccauagucucccucuaucacccaggcuggugugcaguggugucaucucggcucacugcagccuccgcccucccggguucaagugauucuccuacuucagccucccagguagcugggauuacaggcaugugccaccaugccuggcuaauuguuguauuuuuaguagagaugggguuuugccauguuggccaggcuggucucgaacucccgaccucaagugacccgccugccuuggccucccaaagugcugggauuacaggugugagccaccgcucccagccucgguucaugcuuuuugcgggcaucaaacugaguucugggacaugggcugcgcugaucauuaccuguccuuugaucugggauguguugccucugggguguagggaagggggaggguaguucucaaagagaaugggaugccuucagcagaaagggcacugaaugcugggccagacacagaaugacugauguucagcauggaaaacugggccuagaacugguuuggaggaagggccggggcaacacccguugaagagaugauaucccugccaguguuuuaguauauuuccucuagaacacacauacacauauuuacuucucaaauuaagaucuuuuuguaaauaguguucuguaaccugcccugcccuuuucacuuaaauuuuuuuuuuuuuuuuuuuuuuuugagacagagucucacucugucacccaggcuggagugcaguggugccaucucggcucacugcaacuuccgccucccagguucaagcgauuuuuccugccucagccuccugaguaccugggauuacaggcacgcaccaccaugccuggcuaucuuuuuguauuuuuaguggagaugggguuucaccauguuggccaggcuggucucguacuccugaccucaagugauccacccgccuuggccacccaaagugcugggauuacaggcgugagccaccgcgcccggacacuuuacuuaaaauguucuuuauuaaacauuuuucaaagcuguggguuuuuuaauuuuuuuuuuuuuuuuacaaaaaguagagaugggguuucgccauguuggccaggcuggucgcgaacucuugaacucaagugauuuucccaccuuggacucccaaauugcugggauuacaagcgugagcacccggcuuaaagcugugguuuuuaaaaaaucauuguuuuagggacugcccaacuuucugccuggugguggcccuggcccuugaugacccagucuuagauggucaggcauuuucgucugcuuuaaaacaaaguuguuuuuuuuuuuucuccguugcaaauaacaugaugguuauccuugaagaaaaaaaaacuuuguccguaucucugauuugccugggauuguaugcccagagguagaacuguuggguccaaacaaggccacauuuuucaaggcuuugugacugucauggucagauggcccucaaggaagccuggagaagccacgcugccauuggccugugugagcaacgccccccuccccacugggaggcacuuguccuaaaguucauugcugcuuuucucucacgaaaauaguucaauagaaacuuuuuuuuuuuuuuggguagaagaaaaucaaaauucccuugguuggccaggcacgguggcacacgccuguaaucccagcauuuugggaggccgaggcgggcagaucaucugaggucaggaguucgagaccagccuggccaacauggugaaaccccaucucuacuaaaaauacaaaaauuagcugggcgugguggcgggcaccuguaaucccagcuacucgggaggcugaggcaggaaaaucacuugaaccugggaggcggagguugcagugagccgagaugguaccacugcccuccagccugggcaacaagaguggaacuccaucucaaaaaaaaaacaaaaaacaaaaaacauucccuuggucuucccaccugguacugguuuuguuuuuguuuuuaauuauuucugggacagaaucucccucuguugcccaggcuggagugcaguggugugaucuccgcucacugcaagcucugccuccuggguucaggugauucuccugccucagcuucccaaguagcugggauuacaggcacaugcuaccacauccagcuaauuuuuguauuuuuaguagagacgggguuuccccauguuggccaugcuggucuugaacuccuggccucaagugauccgcccgccucagccucccaaagugcugggauuacaaguguaagucacugcacccagcccagaauucuccacccuauuaggacaccagccuuacggaaugaaggcccacugucaugacuugaacuugaccaccucugcaaacgcccugucucccacagaggucaccuaaugagguuacuagggguuaggauucucgcauauuaaauuaguggggacacgacugaacccaucaccacuggccuagaggucacuugggcgucccuugccugaucaguuaagagcuuagggauaauagguuugugggagggugaaggaggugacagaguuguaccuugguccccucuuggagaacagaacagcccuccauccuuaccugacauuguagacucuuaagucucgcaggaccucgaggcggggguauggggugggugagaugguuucaaucuaacaucaaccuuugggagcugaucagguuugcggcuuuguggccucaguuucccuaaagauauaagaagagcggccagccgcgguggcucacgccuggaaucccagcacuuugggaggccaaggcaggcggaucacuugaggucaggaauuugagaccagccuggccaacauggggaaaccccaucucuacuaaaaauaaaaaaauuagcuggguguggugacacauaccuguagucccagcuacucaggggacugaggcagaauugcuugaauccaggaggcgaagguugcaugagccaagauuggucacugcacuccagccugggcgacagagugagauucugucucacaaaaaaaaaaaaaaaaaaaaaaaaaagauauaagaagagcaaaacaagcauucucaacuagggaugauuuuguccccccaggggacauuggcaaccacauuuuugguugucacagcuuggggggagcacuacugccaucuaguggguaaaggcagggacucagcaagacacccuacagugaaggcagaggacaagcccccagcagagaugcgaaugaauagugaaaugugaauagugccaaggaagagaagcucccccucagcagcaucauuagucaugucugucucuggaacuuugcacacugccaauagagaauaugguuuucggcucaccgcagucuccgccucccagguucaagcgacucuccugccucagccuccugaguagcuggcauuauaggcaugcgccaccaggcccggcuaguuuuuuguauuuuuaguagagauaggguuucuccauguuggucaggcuggucucgaacuccugaccucaggugauccgcccgccucggccucccaaaaugcugggauuacagacgugagccaccacacccagccaaaaauugguauuuuagaucacaaagaaaaugucagccgggcaugguggcucacgucugcaaucccaguacuuugggaggcugcggcagaaggacugcuugugcccaggaguuuaagacccgcccgggcaacauggcgagaccccaugugcauuaaaaaaaugaaaugucaauugaaaaauuauaauagaacucauuuaaauuugguagagacuaaagcaagaucucugugguuggagcacccuuccuggaggguagggggaguauuuaucagagaacugcacacaccuggucauauucaucacacuggugaggcucuuccugucacacgugucccagcuaugugcccaugugcuccuauuacaaaaagauaggaggccggacacgguggcucacgccuguaaucucagcacuuugggaggcugaggcgggaggaucacuugagcccaggaguucaagaccagccugggaaacauagcaagaccccaucucuacaaaaaaauacaaaaacuagcugggugugacggcaugugccuguggucccagcuacucaggaggcugaggcagggugauugcuugagccuggcagcuugaggcuguggugacgugugauggugaacuccagccagggugggggacagagugagacccuaucuugaaaagacaggaaacaaucuaaaugccaucaaugggagaugacuuagaugaaucaaaacucaucaauucaagaguguucuaggcugcccuuccgcccccgcccccccacaugauucugcguaggcuccuuugcacguuuggccauuuaaaauugcuggcauucuaguguuuuugaccuuuagagauggcaguuuuuauaagguccaagcucauaaugaggagguagauguuugcuuugugcuaauaugagaaaagacauuaagcagaaaaaaagcaaaaugugauacaguauguacugauugagaucuuuuuuuuuuuuuuuuuuuuccugagacagccucccucuguugcccaggcugggguacaguggggcuaucaugccuccccgcaaccucugccuccuggguucaagcgauucuggugccucagccucccaaguagcugggauuacagguggucaccaccaugcccagcuaauuucuguauuuuuaguagagaggggguuuuaccauguuggcuaggcugguuucagacuccuggccucaagccauccacccgccucggccucccaaagugcugggauuacaggcaugagccaccgugcccagccugagaucguguguguguguguguguguguguguguguguguguguguguguguguguguuuucuuugagacaggcucgcucuguugcccaggcuggagugcaguggugugaucauggcuuacugcagucucaacuuccuggguucaagugaucuucuugccucagccucccgaguagcugggacuacaggcacccaguuuacauuuauauuuuauuuaauuuuguuuuugagcuggagucucgcuguguugcccagguuggaguggcucaaucucagcucacugcaacuucugccuccugaguuuaagcaguucuuaugccucaacccccgaauagcugggacuacaggugcuuguuaccaugcccagcuaauuuuugaauuuuuaguagagacaggguuucaccauguuggccagacuggucucaaaacugcucaccucaaauuauccaccugccuuggcaacccaaaguguugggauuacaggcgugagccacugcacccggcuuauuuuuauauuuuaaaggaugcccguggaugucgugugcauuugaauaugcauaaucauuucuggaacugucuacuggaaacugcacccacaguagccucccgagggagggaccuguguguuggaggaggaaggaagcgggcugucuuuuuuuuuuacaccuuucugcuugguuuguguuuuucauccugggcuuuuuucugauuauaagagcuaugcauauucacuauggaaaaaugcacguacaaauaaguggaaggagagccguacugcuggaaagaacccuucggucuuuggaggcccucccucuggaggcuuaugcugugccuagccuguacucugugaauagagcacaggacccugugccaggcgugcugccuucucuccuguucgauugauugauugauugauugagauggagucucccucugucacccaggcuggagugcaguggcgccaucucggcuuacugcaagcuccgccucccagguucucgccauucuccugcuucagccucccgaguagcuggggcuacaggcgcccgccaccacacccggcuaauuuuuuuguauuuuuuaguagagaugggauuucaccguguuagccaggauggucuccaucuccugaccucaugaucugcccgccucggccucccaaagugcugggauuacaggcgugagccaccacgccuggccuauuuauuuauuuuuuuugagauggagucuugcucuguugcucaggcuggcaugcgguggugcaaacucagcucacugcaaccucugccucccggguucaagugguucucccgccuuagucucccgaguagcugggauuccaggcgugugccacuacacccggcuaguuuuuguuauuuuuaguagaggugggguuucacuguuucaccauguuggcuaggcuggucuugaacucccgaccuaaggugaucugcccgccucagccacccaaagugcugggauuacaggcgugagccaccaugccuggccuucuccccguucuuguuuagagaugcucaggacuuccggcaugucacaaaggccucugucuacucagcaccuugggggaugggcacguguggccuggggccugcgcuugcuuugggccucggcauccccguuugggguuggggaagggguggcagcagcgcccuguuaccuaccuccuguccacaggugcggagcgggcccugguggcgcggcccucccuggagagucugcuggcagcuggcagccacaugcugagggaggugcuggaugggcccgugguggacccacucaagaaccugcggcucccgcgggagcugaagcccaacaagaaguacagcuggaugcgcaagaaggaggagcgggugagcggcuggcugcuuccucccugggguccgcgggggaggcugggugggaggccccucuguggaggugcccuacugccuggggcguggcuggcuuuggcgccagagaggccugagcuacguucagcuccuugugcugaugugcuguguggucccagucaagugguugcccuucucggggacucaguuuaccugucugcuagcaugucaggcucaucacacaggucgcggugugauccacuggaaacagaguagcccagggucacauguagcucuggccuuaggugcccacggggccuggggcugcagcauccccuugcugagccuuccguuuauaaaugacacaguggcccucacugauggagcaggugucacacgcaagcacugugcuucaggcaugacaucuaauugagcacugccacagccccgcagagccagcacagggucccuugcauacgaugaggccauggccacagucaggagguggcagcggugggacucgagccccagcucccagugcagucuccccuuccucaggggcaccccugggugggcggugggcgucguuaggcaguggcauccucacccccuccuccucucccgguucuucccccagauguaugccaugaaguccucccuggaggacauggacgcccuggagcuggacuuccggaugcggcuggccgaggugcagcgccaguacaaggagaagcagcgugagcuggugaagcugcagcgccgccgggacuccgagugagugugucccccgcccgccccguggggccccugccccggcccaccaggcccccaggcgcgcagcagccgucgaggugugcguggacccggcgccgugugugcaucgugugcccguucuccgcgccccgcccgccccccagcgucacagccaagcgugugauucuuuuuaagggacaggcgcgaggaaccccauagaagcuuggcacgcagaggcccuggcaggccgcggaaacggacccacgccccgagcgcccugucgcccccccgcaagagagggaagagcggccacaguagcggaaaguaaggcuggccccucggugggucggggacuggcacacagcuugaggggaggagcccgggccccacgcagggccugccucggggugcugggggaccucgcgucccucgggcucugaccuacccgcagcaguggcccucggggagcacggccugugcugcccgggccaggagggagcgaggccggugcugagccuggaggauggcuccugcgacagauuuuucccguguccuaacccagcgcuucaccugucuuccugccacgccugccuccucacgccuagggccuaauuccuccucuuuuccacgcgccuccucccugcggaaggacccgcugggcugccagccuugcuuguugggacgggcuaugacccggcugucgcucggucuccgccgugccggaccugcuggcuugccccgagaccagggcuggccccuucuggcacuuggggacaagcuucuccuccucgggcggcggucgcagccuuguggggcaccugugugggucuuucugaacgccagcuggaaugagagcuuuucccgcagggcgaggcgugcacagaaaagaugcuucguccuucccucggugucuguagcacgaucggaaaggggcccgucaaggaaagggguuggaguguugggagccuggggcaggagggugggguagacgcuaggcggcucaagaccugcccugaggaagcagaaggagcguggggggaccuucggagggcacaggagaggcagugggaaggccacaguucuucucaggauaaaacagccccaaggcccccaugucuugcauuuaacauucuuggauguuucugaccgaagagaggauggagagagguagaaaucucccucaccagccgcagcaggggcagggagagcuucccggagaagagggcaggaggcugcggccaccagcagcgugguggucagggguguggccugcacugguuaaauuuccuguucuugagucccagcaccaccccuuagugugaccgaccucgggccagguguuagcuuuuccgagccuguuuucucaucuauaaaaaaauaaguacacagguuggccacgguggcucacgccuguaaucccagcacuuuaggaggccgaggcaggcggaucacuugaggucaggaguuugagaccagccugggcaacauggagaaaccccuucuuuacuaaaaauacaaaaauuagccaggugugguggugugugccuguaaucccagcuauuugggaggcugaggugggagaauugcuugaaccugggaggcagagguugcagugagcugaaaucgagccauugcacugcauccuggcaacagagugagacuccaucuaaaaauaaauuaaauaaauaaauaaauaaauaaauaaauaaauaaaauacagcagcagcaaacguuuguggccaaaauauaaagccacuaacacagugcaagacacacagugagugagugccaaguacagaucggcuguuucgaucaccugugaaguuucagcuuaaagcaagcaaguggggcuucuaagccaugucuguguccccacugcgcacgggauuccagagaccagcaaguggcuccuucuucguuuuuuuuuucccuuacuggaaaagagagacuggaauccuucuucguguaaacuuguguucugaacucccccugccauccugguggauuuccuuggcguuucugaucuuuguucuuggcacgauuugguaaauagguaucugaccgcacagagaugugugugugugugugugaguguacgcguaaaagcgcacaagaaagaaaaugcuuucuuccuucuuucaccuuaaacucucauucugccucauucacaaauaucccagaauuccagcacuguuguuuuacaagauccaucuccccacgcccgucacucugccaucacuguccacgcucaggguccagagcccaacccuucagggccaugaggguggaccucagccugcgagccuugucuggccagggugcugaccggcagugugucugcguuucaggcugagcagcaagucucugcugacaucagaugauuaugagcugggagcagggauaagaaagagacacaaggggucugaggaggaacaugaugcccucaucggaauggggaaagccagggggaggaaccagacuugggaugaacaugaggccucgucggacuucaucagucaggugaguaacccagucuuccaggugugugagaucuuucagggaggugucuggaggguguguuaagaguucacgcucccuucgcaggcccuuuguuccuguacagaaaccuuagaagugguugucuucaaugccggaaugacucuucuccaaucuuccuuauuguacagagggggagauuaaggcccagaggaggucagagaccuaccgacguaacacagccucagagacaggaggccuaaaagcuaucucccucugugugcugcaugacccuuugcuaaagccaaggagagacacaaguucuuaaccaaguaauacaauugcucuguuguuuaaugguguaauaguuuaaugagcagcucugccauucuguaguucuaagaaacaagggcuuggugccaugguaauuuccucucugaacucuccagggguaaugggcugagagccaacuccuugauucuucuuauuucuucagaacauugaaaucauccacuuaaggugccuuuuuguaaauacuaauguaccuugccaucccuccccauaaaguccagugcaaagggguaguuuuuuuuuguuuguuuguuuuuuugagacagagucacucagucacccaggcuggagugccguggcacgaucucggcucacugcaacauccgccucccagguucaagcgauucuccugccucagccucccaaguagcugggauuacaggugcccaccacuauguccagcugauuuuuguauuuuuaguagagaugggguuucaccaucuuggccaggcuggccucgaacuccugaccucaggugaucugccuaccucagccucccaaagugcuggaauuccaggugugagccacugcacccagcugagggguauuuugguugacuuggcugagaggggcaggcucauggagggagacggggucuaagagaagaaagauugccaguguuaacaccagaucguuuuuacuuucaaauuguggugagggaugcuuuuguuuuaauugacaccaucccagcuuuuuucuuccuuaagaaaugucaccugauuaaagaaaauagagauaaaauguucaaaccuggggcauuaauggcuuugaaacugcguguuucgcuucaacaaaugacuacagcugacgauagacaugcaggcaggaauuuaaucugugaaaucucuaaucguucuuucugcuucaggcauccaaggaacacuugaggcauuuuuuuuggcagcuucggccccuuuaguuggaugaacugguuuggagugugcacuaguacuuugucagcugcuguagguggcugagauaggcauaucagcugcgcuucaaucuggguuuuugaucuugauuccuuuccuccucccuuaauccggcugccuucuucaggccaucggcagcagcacuuggucgaaguacuuccuuaggaggcaccaagcagugccacggaaagccagggccagcgaucaguguaaccacagcaccagcuauuuaauaagugguuaccuuguaccagacguuguggucacugcauaccuuaucugaguucaucuucagaagcaccuugcgauacccagacacaaguacccccauuuuacagaguuacacauugaagcuggccagucguggucagccuggaaucccaacaguuugggaggcugaggugggagaauggcuugagccuaaaaguuugagaccagccugggcaacaugaugaaaccccagcucuacaaaaauaaaaauaauaaaaauuagccaggagugguggcgcacgccuguauucccagcuaccagaaaagcugaggcgggagggucacagagcccagaggucgaggcugcagugacuugcgacucccagcuagucgggagccugaggcaggagaaaugcuuggaccugggagguggagguugcagugagccgagaucgcgccacugaaccccaggcugggcgacagagcgagacuccgucucuaaaaaaaaaauaaauauauaugcgugcuaagaggaguuaaaucacagaggcaggugaaggauuggagcccaggcugggcagagcaugugcacugaaacccacuauacuguuuugucagaucuuuuaacccaugacccaccuucccucuccagcuaaagauuaagaagaagaagauggccagcgaccaggagcaguuggcaagcaagcucgacaaggcccucucccucaccaagcaggacaaguugaagucgcccuucaaguuuucggacagugcuggggggaaaucgaaaacuagcgggggcugcggcagguacuugacuccuuacgacagccugcuggggaagaacaggaaggcgcuggccaagggccucggccugucucugaaauccuccagagaagguaaacacaaaagggcagccaaaaccaggaagauggaggugggguucaaggccagaggccagcccaagucggcccauuccccguuugccucggaagugagcagcuacucuuacaguaaguagcguaugccgcgccaccucugguccgcugcuucucuccuuuucuccccucuucucuccaccguccuccuuccccccccgccccucacucucucucucgcucucgcucucucucuggggcgcacuacagugccugagcuuggcauggccuccaagccggaaguggggggggaggccgccugaagcggauaugccugugacuggcgggugugaugccaggcaggugcuugugauuggugggcgcccgugauuggcgguugggagccgaccuccgccggcccugucuugcccgcccgccauuugccuaccggaugucauaggcgaggaagccuugugcgucauagaguuugcggcuguuuggccuagagaggccuggagcgcgacugcucuugaggguccuagaggugaccggacuccccuacccacaggaagcaugccgucuguugcggaccacggcuuugucgcgaaguguuggcggaagcaguguuuauggagcgcccaccgugcucggcuauggaugcagggguucauuggcguuacugugucuguggcagcucugacagugguacccccauguuguuacuggggaugauguggcccgagagccagaggggagugugugcgcucgggugcggagaggcgacucgggguuaaaccugguucggcccgacccaccuacccacuggaaccugcugccaucauggcugugucccacuauuuucuuucuuuuuuuuuuuuuuuuaauuugagacggagucucacucugucguccaggcuggagugcaguggugcgaucuuggcucacugcaacuucuagcuccuggguucaagcgauucccuuggcucugccucccgaguaacugggacuacaggcuugugccaccacacccagcuaauuuuguauuuuuaguagagacgggguuuugccauguuggccaggcugguccuaaacuccugaccucaggugauccaccugccucggccugcaaagugcugggauuaugggcgugagcuacugugccgugcguuuuuugagacagggucucuucuuauugcuuaggcuggagugcaguggggccaucauaacucacugcagccucgagcuccugggcucaagugaucuuccugccuuagcccuccgaguagcugggacuaggugagcaccaccacacccggcuaauuuuuaaaauuuuuuguagagacagggucuugcaguguuucccaggcuggugccugggcucaagcaauccuccccucugaaccuccugaguaucugggacuacagcuguguaccaccacgugcagcuaauuuauuuuuauuuucguagagauggggucucccuguuuuccaggcuagucuggaacuccuggccuuaagcaagcaucccacuuuagccucccgaauagcugggaccauaggcgcacacuacuacuauuuuuauuuuuauagaggcugaguguugcuguguugcccaugcuggucuuaaacuccugggaucaagagauccuccugccucagccucccaaagugcugggauuacaggcgugagcugccuugccuagcugcuauugagcucuugaaauggagcauuccugaugggacugaagaauggaguuuuaucucauuuaacaagagacugucagauuggagcguccucaugguuauggccucuuguggcccagaaccugcugccuggcagguagugggugcuugcucaguaucuguggacagagcaccucaugcccagggcggacaggugcuaaguuuguggcuagcugcagggaggccagaaggagggagcuuccuggguucuggcccaugucagugucagugguguuuguucugggaauccccaggcccuggggcggguggagagcuuuugcauuggcagcugccugguucugugugucuggggcuuuugauuggcucuggccgguucaugggcggagaagggggaguuugacugucaagggcgaaaagucgccguguuuauugauaccguaaagcauguuuucuuaaggaaauaaaaaguguuuauggacucagaguuaagauaucgucaccugcuuuacggggucguugggggccuuaagugagcuuacgugggcagagagcugaacguggcaccuggcacggaauuaagcugcuaguuuuuucagggugcguguguuucgucuguccuaggcuagcaggucaccaggacucaugcucccugugggugugaguuaagcagcuggcucaugccuucugugcugaggacauaugagagugucgugguuucagugcuucuuugauugggaugggugugaucagagcaguguagccuaggcuccuggccagugugugggcacaagcaggaagagacagugccagagacucaucacucugagggggaagggaggggcuuucuuuugcucucucaaucucugcucauuuuggaaaagugaaggggguucagggaagucgggggagauugcuguucuuuugaucuucugagggauuggggucuguggaugcaguuugggugguagcugaaagaauuccccacuuucagguggacguggaugggguggagcuggaggucagagaugugcucugucucugaugucucuggggugcuccgagcugguguguucacucuuggcacgugugagggaauguccguuuuauuuauuuauuaauuauuacuauuauuauuauuauuuugagauggaguuuugcuguuuuugcccaggcuggaguacgguggcaugaucucggcucacugcgaccuccgccucccggguucaagugauuguccugccucagccuccugaguagcugggguuacaggcacgcaccaccacacccagcuaauguuguuauuuuuaguagagacgggguuucaccacauuggccaggcuggucuugagcuccugaccucaggugauccgccugccucggccucccaaagugcugggauuagaggcaugagcugccgugccuggucugggaauggucaaaugggcaacuucacuccaucgugccugugucgaaaacuccacuguccuggaugagagaaacggacucauggagcagugaggaauucagugggccuggcuccagcaggacgguggcugugggauucaccuggcucugcagagcgcuccucuguuuauuuuuuauaaucugcuuuucugcaauucugggucagagagagugcaggguucacaaggagguagggguguguccagcagggaguugcugagcuggacggaggucgaagcgagaacggucuccucuugcuuuuucaguuucgauuguaggggucgcuggcaugcccuguggguuuuuuuuuuuuuuuuuuucuuuagaugaugucuugcucugucgcccaggcuggagugcaguggugugaucucggccgcacugcaaccuccaccucccggguucaagugauccucccaccucagccuccggaguagcugggauaacaggcccuguccacuacaauacaauacaaauagaaaauacaacaguuuguguauuuuuuaaaaauacagacgggguuuugccauguuggccaggcuggucucgaacuccuggccucacgugagcugcccgccucagccucccaaagugguaggauuacagaugcaagccauugcacccgaccucccuguggguucuuguaggaggccaaguugguugucacccacuuagccucuccagccugggacacagccucgggagggacagauuggagcauacaagagagagcgcacuuugacugguucgaugggcaggggcugguagccuggcggggcuggacccuugucccacccaagaguugccggaccauccugagguuggggucuugcuggagugaaagcuuagguguuggugggagcagucagaggaaugcccgccacggaugcgugcaugugguuucucuuggacucggagguggcaggugcugccagagcuguagcuguguugguucacguuccccccgucuggaguggauuucagcagaucaggggauuauucucugucucuggaaccccugucuucccaucuugcccaguaagaaaagcagaucaaaauggcgugagcauggcgggggccggagcguugccugccuggcaggcuccccucccaaagcuggcugguugucuccccggaagauuugaagacucuuguccuccguuguauaguuaggcuggagacucuggggaagccagcaguggugggccggcucacuggcucguagaaagaagggcaagggaucugcuagcgguaacagcguuugcccauucccaugguguaaacacccuuacuguggccuguuucgugcugccacugggaggcugcugggaggggcacugggaagagaaugcaugauuggcugucaugagcccuuucccuccugagucagguccucugcgguugucacccuugggccaucguaaucccaugggacaggcagugaccaccgugaccuuccugagcauagggcuucucucauccuccggugcccggaaagccuggagugacuggugggugaggcuggcagcauccagucuaggaagggccuggguccagcacucggaagaugccaugcaaugaccgaggcacccagggcaagggagaagccuggacugggaggggagcuggugacauggggcaaggccuuuguacggccgccuacuagguauucggaccuguuuguucuggcaccuuccaguacguucucagaaccauuaaaaccaauaaaaugacaccagcuccugcugcccugugacuuaucucuauuaaaaacuacuuugacugcagauacggacucagaggaagacgaagaauuccugaaggacgaguggcccgcccaaggccccuccagcuccaaacugacgccuucccuccuguguagcaugguggcaaagaacagcaaggcagcugguggccccaagcugaccaagaggggccuggcggccccccggacucugaaacccaagccggccaccagcaggaagcagccguuuugucugcugcuucgagaggccgaggcgcguuccuccuucagcgacucuucggaggaaucguuugaccaagguuacuagcuccaaacacaaaauaccuuccguguuuccuagcgagagagugcgugcgagugagcgagagggaagcgagugggcgcacgggagagauggugggugaggaggcccgugcggauggccgcaagaaggcugccaucuggguucuuggcagcguagccugcuguuaucagccgaaugauuuugauuuuugcuuugauuuguacuguaucauugugauaauauccccggcuggcucuuuuugagcuguuauauggacugcuuuugagucugcguuucucuccacuugcccuccucccugcccuccucccccucccccgaguuccccccacccccgcacucacguuuucugcccacccagagaccccaggcuugguucgggcucucuuugggcacggguucgguggaggcuucccgaggaacauuuuguaaauggaauucugucgugugggcgugugacuugauguuuguaccgcgauuuugguaauaccaagcuuuauuaaacauaucgaguucauuuuuaacuaaaccugugugccuugucucucuugcuguguccuuacuagacauuagguugacgcuucccucucauuuuguuucucccccaccuccuccccucccuccuccccacccagaaggaguagggacgggaccgugccgccugccgcuugccuguguuauucaaauaucccugguagcgauuggcauucauuucauuuuucagguuuaaaaucaagcgccuucaccuccagcaucaucauguuuuuuuaguugcuuguuuugucuuuuauuuucuuaaagcucuauucuuacuugccagugguuaaaaacuauuauuuacaaacacuugucuucucacguguauuucuguuuugaagggugcguaggcagugcagggcccagagccuuugacaccccuggucucugucauucaauacgaaagcggcuccguugccgcaucaagggacggagcaucgugcucuguuuggagagaggcuggccuggucccagcccgggguccucagccaccucgguucucaagagagagcugccaggccccugagaacccgcuggccuugcccuuuccagugucagaauugugcuucugggguuagaugugugugagccuuuugggcccuucaaccagaaaugccccaagaaagggaagcaagugaaucucugacauuuuuuccuagcccugguuuuaggauuugcuucagggcgaacucccacuagggccagcugaggggaucccccaggcccuggguagccacaccuggaugucagcuacucccugaggaaggucuggaggugucaucgugucccugggucugaccuggcucgggcaccccgggaccugaaugcugcccccgccccccgcccgcccuguuuuuccagcccugcucuugaauuccuggucuaccgccuccccucccagaccuccccuccaaauuggcagagauccuuuugggugaccaggaggugguauggcgaggaguacgaugccccggggcccauguuccccugggcugcuacuaccccucugagcgaacaccaccccggaccgagaagagaggcccccgacccacuggccagccucguuuuccgaggccucccccugcccgggcuguccguggaugagcuggguuaguuuacgauccccuucucccuccccggccuccucccuuucccccaucucccccaugggcuggaccccacgcccccuuaaagccgcgguuuccgcuuccaaguuuuugagcccuccugccccagcugagaccccacagagaagcaggcagcgcccuaggccucuuaggaaggggcuccgggcuggcgccgcagugccaaguggacgggacccagauaggggagugcggggggugaggggaggcgggggaggcccaggcuccucagugccccccuccacccccgccaguccaccacugagcaggucuugaaagggauauuuggguaauagggccucgcugaccugguacuaaacuccguaacuggcuuggcuuuucuaguaugucugcuucuuccagcagcccgaccaucccuccacccuugaccccuccccaugacgcuuugaaugucuguuuuggucucuugcauuugcucucacgcugcacucuggacgcaaagcgaaggcugggaguagggcagacggcgcagcgggucacugagcuugggugcgagccuggcucguugcuccguagguaggcaaaacgcuuuucuuucuguccuccgugcaccucccuccucgggguucgcccccaccgggucuggcagcagcagaucgcucugacauuuaccaccaaccugucaccgccaaccccauguccugagccaagaucuuuuuuuguuguugcuuuuuucuuuaaauaauaauaauaauaaaaaguuuuucugcauuuccuuggguuacuuugaugggacuuuuuuccccccucccuguccccagcccucggcaagcugcauugccucagguguggacaacuccagaaagguuuucuugguccucagagccccucugcuccccagccugcugcggacgcuagcggggugugcaccagaccccgcaggagcagcggguguggccuugucaagcacgcagggaggcgggagggucucccaugccgaggugcgggcauugggcugcucucggcuuucugggcucuggcguggacguugcgggcauccagaaacccagagcucgcccuccccccgcagccccagcugcuugagaauuccucuggaugggaaagauuucuggagucugcgcaccugaguggcuagaagggaagaucccuggccucacguccaacccccugcccccaccccacaaccagcccccugcccaccacccugcucaaauuggcccaccccagggagaccugaugugggggacccaggcgcuguugaaaagucugccuacacuuagccugcuuugccgcuguggcccacuggggcggagacagagccaugugacgccugcaaugugaaugaucgcaagugugcacugccugccugccugcccccgccugccuggcuggccucuccagccugcuucauccauugcuccgggggccagucuccccucucacccucuuaacaaaccuccucccucucccucuggcuccugccucccucccucccucccucccucuacuccucugcggacuccucagacucaucaccuucaccgccuuccucucugagguggcccagcagaaauccgggcugucuccaauacaugaguagacagaaccucugcccucauuggcaccucuggggccaccacuuuuggccacaaguugcuuaagcaagcaggcggcuuggggcguuggcaggagacuguggaguuggcuguccgucuuccccgucugucuauccgagccuagacugcuccccgcccuggagagaaagggucugguguccaccucuucuugcuggaaggggccaccuuccagcccugcggccccuagagucacuuucccgcucccagcacucugguccgugaggcagaugggcaccccugucaccugcucauggguggcacuuuggauguugcaucucagggcagaguuugcucucucaggccuuccaccugcccguccuuggaagcaagugucugccucaagacagucucucuuuuuggugggggguuuugguuugugugcagggagccuccugucugccagcugccuuuguccugagagccugggcugggcuccggggacugcagacucucaggcaggcagggaaggucacuggaugaagcucaucuuaagucaccgaccagagaggcaggcuggggcuucuuuauguuuuuaaaguuuuuauuacuuauuauuauuuuuugagacggagucuugcucugucaccuaggcuggagugcaguggcgaucgcggcucacuguaaccuccgccuccgggguucaagugauucuucugccucagccuccugaguagccgggauuacagguguccgccacugcacccgguuaauuuuuguauuuuuaguagagaugggguuucaccagguuggccaggcuggucucgaacuccugacaucaugauccacaugccuuggccucccaaagugcugggauuacaggcgugagccacugcgcuggccuauuuauuuuugagacagggucucgcucugucacccaggcuggacugcaguggugccaccauaacucacugcagccuuggauuccugagcucaggcgauccucccgcuucugccuccggaguugccaggacugcagguguaagccaccacgccuggcuaauuuuaaaauuuuugcgggggggcuggguguggcggcucaugccuguaaucccagcacuuugggaggcugaggcgggcagaucaugaggucaggagauggagaccauccuggcuaacacggugaaaccccgucucuacuaaaaauacaaaaaaaaaaaaaaaauuagccuggugugguggugggcgccuguagucccacuacucgagaggcugaggcaggagaauggcgugaacccaggagguggagcuugcagugcgccgaaaucgugccacugcacuccagccugggugacagagcgagacucuaucucaaaaaaaaaaaaaaaauuuuuuuuuuuguagagacaagguuugcucugucgcccaggcuggucuugaacuccuagccucaagagaucuucccgccucagccucucagagggcugggauuacaggagugagccaccuugcccggcccuggggcuucuuuagacagucugccagcucuggguucgagccugcucuucuacugcccgagugcuuaaccccauugggccucagucuaccccugcccuuccugggcaucccaugagugaagagucacagcugacuuuagcucccugggcauggggacagcacaguuccugccugcaagucacggggguggcccuguuucuguucgauugucuuuaagcuugcaaauggcuuucuccuccaugcaaaugauucucucuggaccccggccuuggcugagccagugggcugggagggucaccccuugcugcaggugagaaaauagaggcucagagagggccgaggacuugcccagccuccccagaaugggggaguugcuaggagucaacuuaauuuuuucuaauuaauuuuucuaaaaaauuagucacggggacucugcguugcccaggcuggucuggaacuccugggcucaagugauccuccugccucggccucccaaaguguugggauuacaggcgugagccacugugcccggcuggggucaacuuuauuuuauuuuauuuuuuugagacugagucucacucuugucacccaggcuggagugcagugaugcgaucucagcucacugcaaccuccgccucccggguucaagcgaugccaggagucgacucuagacuccagaucccuucucggggcugaaaccauggggguccccuggcccccaggaagaguccgaacuccacuuucuccugccgccagcccucaggacucagcuggcgaagcugccacaggcaccugugcccagaaccccuagccugaguccccagggcccucuuccgugcucaccucccuccgcuuccucuuuccuucuccuccugccucuguguuguguguuggggcgugugcgcgugugacuguggagaacgcugucuccaguccuuguccgugugucuggccccugccacagcacaggugcauguuggugccccucacagaagcccacccugacacacaaggccgcugcccaccuccgggcuuucugggaugcccgcguugggcucagcuggccgggggcauugggccaucggauggggggaacccgugggcugggucugcauccacccccagcggcccccugcucaggacugagggacuaggcuggagcccagaggccacucugggccagggggcggugggggguggcccucgccaaggccaaggcucugacucggucccuguuuucugcacgccagaugagagcucggaggaggaggacgaggaggaggagcucgaggaggaggacgaggccagcggugguggcuacaggcugggugcccgggagcgggcccugucaccgggccuggaggagagugggcugggccugcuggcacgcuucgccgccagcgcccuccccagccccacgguggguccaucccugucugugguacagcuggaggccaagcagaaggcccggaagaaagaggagcggcagagccugcuggguaaguggcagcaggugggcugcggugggggugggugggaggggcggacgccauugccccaucccacaggugaggaaacugaggcucagagaugcaggugcagagcugggaaugggcagaaccccagccucgugggccagccccgugcugaucagggaugcucgcgacaggggcccuggccugccaucuccaaggaggggauucuucgccuugcaaagggcgaccuccuucagucucacacugccagcaaacacagcccuguuuugggcacuugaggggcugcgggagcuccauggaggucccugacccagccugggguuugugggggccacuccagguuggugacacccagucuggcccgugagagagacgugggguuacccgagacacaggugcaggggaaggaacagccacgucacgguagaaagaagagagagcgcaucucauucagacuuugugggauggugggggugcggucugugccaugggagaacgggugggacaggccucauguggccugggcuugagccuggaggagucagguggggugggcaggcaccaagcucucuuugacuugcccacaauccagauagguaaaccaaggcagcaggcacucacacuugggcaggcagcuggcgcuuaccccgguccaugucuuuccugucucuccaucucugacuguuucccugcaucagggcccugccuucuugggacccucucgugggcccucccuguucucaccgggcugagugcccucacacggacgcagcucaccugcagcuggggucagugccggagauggagauggucaugcauguguucaggcucugaguuccccuggccccagcaggggaggguccuucugacccccccggcauccuuuucugagccacaguagggguagguaugaggcucuccuggcaggggcuaggacaggaaaacagguauugcugccccugaaggccccccagcugccccuggcuucaugcccucugcagguucguggagcaaagccccaccccugaccuccagugucuuggaaccccauuuguggcacccacgccaggcuccagacccugccuucccccuccucgcucucaugcccugccauuguuugcugggcuccaggccuggcaguccuggaaagaggcaccagggcccccuacaaggcuaccuauucuuagguauuguucauacagaagcagcuggagggugucuucagagugcacacuuggccaggccacucuucugcccagaaccuccaaauggcuucccgcugcccucugaucagugcuaccugucugacccaccaccaucagacucugauugcuuggacaacauuauccuguccacagccccuaaaugcaccagccaggcuaguacucucagacauuuacacuugcuauucauacaccccaaacauccauuucacccagacugcccaagguauuggcauaugguccaaauuauuccuuuauucugcguugacugucugaagggucuguagugaugucuccuuuuucauugcugauacagauuguuucuucuuacucuguuucuuggccagucuggcuagacgugauuaguuucauugguuucuacucuuuguuauuuucuuccuucucauuccuuuggguacacaagcaugucuuggagauacugcaggauugcuuccaaaccauaaagcgaauaucacaguaaagcaagucacgugaauguuuugguuucccagugcauauaaaauuacguuuaaacuauacuguugccuauuaagugugcaguagcauuaugucugagaaaacaguguacauaccuuaauuaaaaaauagauuauuggccaugcacgguggcucacaccuacaaucccggcacuuugggaggccaaggcaggaggauugguugagcucaguaguucaagaccggccugggcaacagagcgagaccccaucucuacaaaaaauaaacagaaaaauuagccaggcacgguagcaugcgccucuggucccagcuacuugggaggcugauguaauaggaucacuggagcucgggaggucgaggcugcagugagccgagaaugcgccacugcacugaagcccaggcaagagaaugagacccugucucaaaaauaaaagaccaaaccaaaagcauauguuuacacuauccuguagucucuuaagugugcaauaguauuaugucuuuuucuuuuuugagauacggucucgcuuugucacccaggcugaaguguaguggcgugaucucugcucacugcaaucuccaccuccuggauucaagugauucuccugccucagccucccgaguagcugggauuacaagcacacaccaccacgccuggcuaauuuuuguauuuuuaauagagacaggguuuccccaucuuggccaggcuggucucgaacuccugaccucaggugaucuguccgccucggccucccaaagugcugggauuccaggugugagccaccgcgccuggacguaauagcauuaugucuaagaaaacauuguacauaucuuaaaaauaguguauugccaaaaacgcuaacgaucaucugaaccuuuagugaguuguaaacuuuuugcugauggugggucuugccucgauguugauggcugcugacugauuaggguggugguugcugacaguugggguggcuguggcaauuucuuagaauaagacaacagugaaguuugccacaucgauugacucuuucaagaaagauuucucuguaacaugcaauacugugauagcguuuuaccuauagaacuucuuucaacauuggaagcaguccucucaaacccugcugcugcuuuaucggcuaagcuugugcaauauucuaaauccuuugucauuucaacaguguucacagcaucuucaccaggaguagaugccaucucaagaaaccacuuucuuugcuccuccauaaaaagcagcuccucaucuuuucaaaugucucaugacauugcaacaauucagucccaucuccaggcuccacucuaacuugaguucuauugcuguuuccaccacgucugcaguaacuuccuccagugaagucuugagccuuucauaguuguccgcgaggguuggaaucaacuucuuuuuuucuuuuuuuuuuuuuuugagacugagucucgcugugucgcccaggcuggaaugcagcggugcgaucucggcucacugcaaccuccgccuccccaguucaagcgguucuugugccuuagccucccgaguagcuggaauuacaagugcccgccaccacaccuggcagauuuuuguauuuuuaguagagacaggguuucgccaugucggccagacuggucuggaacuccuggccucaaaugauccacuugccucggccucccaaagugcugggguuacaggcgugagccacugcacccggccuagaauagugaauucuuuccagaagguuuuccauuuacuuugcccagauccaucagaggaaucaucauccguggcagcuguagccuuacaaauuauauuccuuaaauaacgagacuugaaauucaaaauuacuccuucaucuaugggcugcagaaugggcgccgugcuagcaggcauggaaccaacauucaucuccuuguacgucucccucagagcucuugggugacaagguacaucgucaaugagcaguaguauuuugaaaggaauuuuuuuuugugaacaauaggucucaacagcaggcuuaaaauauucaguaaaucaugcugugaacugagaugcuguuaccaaggcuuuguuauucccuuuuuuuuuuuuuuuuuuuuugagacggagucucgcucuuuugccaggcuggagugugguggugcgaucuuggcucacugcaaccuccgccucccagguucaagcgauuuuucugccucagccucccgaguagcugggauuacaggcgugcaccaccacauguggcugauuuuuguauuuuugguagaaacgggguuuccccauguuggcccagcuggucuugaacuccugaccucaaaugauccuccugccuuggccucccaaagugcugggauuacaggugugagccaccacaccuggucugcuguuccauugauagaguaguggcagaggugauucagcaucuuuuuuuuuuuuuuuuuuuugagauggagucuugcuuugucgcccaggcuggagugcaguggcgugaucucugcucacugcaagcucugccuccuggguucaugccauucuccugccucagccucccgaguaggugagacuacaggugcccgccaccaugccuggcuaauuuuuuugugcuuuuuuuuuuuaguagagacaggguuucacugugguagccaggauggucuccaucuccugacaucgugauccgccugccucagccucccaaagugcugggauuacaggugugagccacugcacccggccuguuguuccacugguagaccccuggcagaggagauuuagcaucauucuuaaggacccugggguuuucagaaugguaauugagcauuggcuucaacuuaaaaguccccagcugcauuagcccccagcaaaagucgggcuguccuuugaagcuuuuaaaccaggcacugacuucuccucucuagcuaugauagccuuagauggcaucuucuuagaaggcuguuuuguccacauugcaaauccauugguugguguagccacuuuaaucagugacccuagcuggaucuucuggagaacucgcugcagcuucuccaucaacaccggcugcuuauccuugcauuuuuauguuauggagacggcuucuuuccuuuucuuuuuuuuuuuuucucugagauggagucucacucuguugcccaggcuggaauguaguggugcaaucucagcucacugcaaccucugccucccggguucaagugauucuccugccucagccucccaaguagcugggauuacaggcacccgccacuacgccuggcuaauuuuuguguuuuuuuuuuuaguagagaugggguuucaccauguuggccaggcuggucucgaacuccugacuucaaaugauccucucgccucggccucccaaagugcugggaugacaggcgugagccaccgugcccaacugauagcuucuuuccuuacaccucaugagacaaucucugcuggcuucaaacuuuucuuuugcagcuuccucacuucucucaaccuucacagaauugaagagaguuggggccuugcuguggaugaggauuuggcuuggcuucaaggaauauugagggugguuugaucuucucuccagaucacucaaacuuucucuaugucagcaaugaaccuguuucacuuucuuauuuguguguucaccagagcacuuuagauuuccuucaagaacuuuuucuuugcauucacagccuggcaguuuggcacaagaggccuugcuucuaggcuaucuuggcuuuugacuggcuuaagccuuccucacuaaguuuaaucauuucuagcuuucgauuuaaagugagagacaugugacucuucaauucacuugaacauuuagaggccauuguaggauuauuaauugaccuaauuucgguauuguugugcuuuagggaauagggaggcccaaggagagggagagagaugaggaaggccgguuggcggagcagucaacacacacuuuuuuuuuuuuucuuccucgcuauauaaagaacauacagccgggugugguggcucaugccugucaucccagcacuuugggaggccgaggugggcggaucacuugaggucaggaguucgagaccagccugaccaacacgaugaaaccccaucucuacuaaaaauacaaaaauuauccagaugugguggcgggcgccuguaaucccaacuacucuggaggcugagacaggagaaucgcuugaaccugggaggcagaguuugcagugagcagagaucgggccauugcacugcccuccauccugggugacaagagcgacacucugucgaaaaacacacacacacacacacacacacacacacacacacauuggcugggcacgauagcucgcgccuguaaucccagcacuuugggaggccgaggcagauagaacaucagaggucaggaguuugagaccagccuggccaacauggugaaagcccaucuguacuaaaaagauaaaaacuagccaggugugguugugggcaccuguaaucccagcuacuugggagguuguggcauaagaaucgcuugagccugggaggcggagauugcagugagcugagacugcaccaccguacuucagccugggcaauagagugagacuccaucucaaaaaacaaaaaaacacaaaaaaaaaaagaaaaaaaaagaaacaaaaaaaacacauuuguuggugaaguuucccaucuuauaugggcacuguucacggagccccaaaacaauugcaauuuuuuguagagaagaggucucgcucuguugcccaggcuggucucgaacuccugaucucaagugaucugcgcucauuggccucccaaagugcugggacuacaggugugagccauugugccuggccuugucuaguaauuuuggauugugugucuuggacguuguggggcugagguuguggagagccagaaugccuuuuuuuuuuuuuuuuuuuuuccuuuugagauggaguuucgcucucauugcccaggcuggagugcaacggcaugaucucggcucaccacaaccuccaccucccggguucaagugauucuccugccucagccucccaaguagcugggauugcaggcaugcgccuccaugccuggcuaauuuuguauuuucaguagagacgggguuucuccauguuggucaagcuggucucaaacucccgaccucacgugaucugccugccuuggccucccaaaaugcugggauuacaggcgugagcuacugugccgagcucuuuuuuuuuuuuuuuuuuuuaaugugcagcguugcccaggcuggagugcagugacacaaucuaagcucacugcaaccucuaccuguugcccaggcugguccugaccucagaugaucugcccacuuuggccucccaaagugcugggauuacaggccugagccacgacgccuggccccuuuuaucauuuuagaauguucuucuuuguugcuaguaacaauuuuugucuuaaaaagucuauuuuguuuguuauuaguauagccacgccagcucucuugguuacaauuggcgugguauaccuuuuucgugcuuugccuuucaguuuauuagugucuuagucuuuaguuuuuugucuaauuuuugguucuccuugccuuuuaaacaaauuuauuugaauauguuuaagaauuccauuuuaauuuuccuguuagcuuucucaguaucauuuugucauuuuuaaaaauagaaaauagagauaacaauauacauuccuuuuuacauccacuuaccauguuuuuuucacauaaaauacagaaaucuugcaacuuuguaaguccauaucauaccucauauuuuauauuauauguaauacuuuuucacaugguaucaaccccuaaagacaauguuacaaacuuaguuuuguuuuguuuuguuuuuugagauggagucucacucugucgcccaggcuggagugcaguggcgugaucuuggcucacugcaaucuccgucuccaggguucaagcgauucuccugccucagucucccaaguagcuaggauuacaggcaccucccaccucgccuggcuaauuuuuguauuuuuaguagagaugggguuucaccaucuuggccaggcuggucuugaacuccugagcucaugauccacccgccucagccuccuaaagugcugggauuacaggcaugagcccccggacccgaccacaaacuuaguuuuaaucauuuaaauggcuuauaaggaaauugagaggaaaagugaacaaagucuuuuguauuuauucagauauuuauuauuucuguugcuuuucauucuugucugaggauuccaguuuuccugcaguuucagcccaaagaacuucauuuagcaguuuugccuuguagagcugcuggugaggaauuuucuugguguuccuuuuuuuuuuuugaaacagucucacucugucacccaggcuggagugcaauggcgcgaucuugacuuacugcaaccuccgccuucuggguucaagugauucugcugccucagccucccgaguaguugggauuacaggugugagccaucaugcccggccucuuaguguucucuuaccugaaaauguuucuauuucaccuucauucuucaguguuguuuuuacuggauauagaauuuuggguugacaguuuuuuuuuuuucuuugaguccuuagaagauauccugcucucuucuggccucugguuucugaugagaaguucgccauuaaucagacgauuguuuuggaagugauagguuacauuuuucuuguuguuccuggggguucguguuuaucuuugucagccguuugacuguggcaugccucguggcggauuuguugauguuuauuuugcuugguguuuaucugacacccaacaucugcaaguuucuguuugucaucaaauuugggaagauuucagcuauugaggaaaagcaaauauucaagcauuuuuucuuguucuuucuuuuccuguuuaacauacauuuuaccauuuguuaucugacaggucucugaggcugguucccccacacccaaacucauaaacucacucgcuuacuuuucucuuaaucauauccauucagcucuuagauccccuccauggauuuuuuauuucugaaauuguacuucucaguuuuauaauuucuuuguguuguuugagacagggucuugcucugucacccaggcuggaaugcaguagcacaaucauggcucacugaagccucaaccuccugggcucaggugauccucccaccucugccuccugaguagcugggaccacaggugcaugccaccaugacuggcuaauuauuguauuuuuuguagagacagagucuugcuauguugcccaggcuggucuugaacucuugaccucagggauccuccugccucagccucccaaauuccgggauuauaggugugagccacugugccuagccaguucuauacuuacaauugguucauuugguucuuuucuguuguuucuuuuuguccuuccuauuucucuggugaaauuuucaugcauugaaaacaaguuuuauuucaccucuuugaggauuucagaaucguuggcuguucuuuccaacaugugguucaucucagggucacguuuaguugguuuucuuuuuucucucuggaaugugaugcauuuucuugguucuucauuugucuaguaauuuuuuuuuuuuuuuuuuaaaacagagucucgcucuguugcccaggcuggagugcaguggugugaucucugcucauggcaaccuccgccuccugggcucaaguaauucuugugccucagcaucccaaguagcuggaauuacagaugcaugccaccacgcccagauaauuuuuguauuuuuuguagagaugggguuuugccauguuggccaggcuggucucaaacuccucaccucaagugaucugcccgccuuggccucccaaagugcugggauuauaggugugagccacugugaauggccuugucuaguaauugcggacuguaucuuggacauuguggggcugagguuguggagagucagaaugccuuuuuuuuuuuuuuuuuuuuuuuccagugaauaugaucuccuuuguuuuagcagauauuuccuuggugggacuugaaguccaguuucuuaggugguaucucuggccucuguucagaucacuuuuugcugagcccugggcugcuuggagucuauucuguguauagguaguuucagggccauuuagagacacuggggagagagagagcauggggaccucucucuggcucccuuucuaauuuuuuuuuuuuuuuuucuagacggagucucacucugucacccagacuggagugcaguggcgcgaucucagcucacugcaaccucugccuccugguucaggcaauuuccugccucagccucuugaguagcugggacuacagugcccaccaccaugccuggcuaauuuuuguauuuuuaucagagaugguguuucaccauguuggccaggcuggucuugaacuccugaccuugugaucugcccaaauuggccucccaaaguguugagauuacaggugugagccacugugccuggccaaauuuuuuuuuuuuuuuuuuuuuuugagacagauucucacucuguggcccaggcuguagugcaguggugcaaugucugcucacugcagccuccaccuccggguccaagugauucuccugccuaagccucccgaguagcugggacuauaggcacccgccaccaugcccggcuaauuuuuguauuuuuagcagagacagguuucucaccauguuagccaggauggucuugaacuccugaccucaggugauccgcccgccuugaccucccaaagggcugggauuacaguugugagccacugugccuggccacuggcucgcuuucuauucucuucuguguugccaguuucuagacuucucuuuccuggugcugaggucagcgggacucuauuucuuuucuaugugggccccaccuucccugcugugugugccaagaagaccgugucuagugccaggguagagggugcagggagaucugccuccugugacuucacucucugccuuccacgugagccuccucucugucuacugucccucccugcaccauacacaaugggccugugaaggauuacguacgccagguguuccaguggaucucuggggggacuguuacggggugguaccucauucugucauacccagagcagagcgcucaugccuguggccugcacccacaucagccucaaaagccccuugcugccuccuugcacaguggaaaguuggaaagucuuguuagcaaaagauuaaugaucacaccuguaaucccagcacuuugggaggccgaggcaggcagaucacaaggucaggaguucgagaccagccugccuaacacggugaaaccccgucucuacuaaaaaaaaaaaaaaaaaugccaggcgugguggcgggcaccuguagucccagcuacucaggaggcugaggcaggagaauggcaugaacccgggaagcggagcuugcagugagccgagaucacgccacugcacuccagccugggcgacaaagcgagacuccgucucaagaaaaaaaaaaaaaaguuaauuaauaggauuauuacacuuugcuggugacuuuuucccacugggcagcccccgccagccccuguugcuguggcuucaucuaccggggcagugcagagcaagccucucacggcugccccccggggucaguaggccugggauugggccuuggcuuuucggcuccugugcuggaggauuuaaggcagaccacuggcucucccugagguuguuaacgcaagggacugucauagagauugcaucccugagugaaggcaccuuggagccccuguccuggggagcagugccaucuacgccucacucacacucuuuuccuggacaccagcucugaccuggggcuugagcuggagaucccagagaacucggaucugcuucccagggucagggcaggcugggauaagcugggaccugggcauggacagaaaugcgaagguguggcauugccugugacaacagaggugcggccauagaggacuucccggguuguggggugggucuccuucugaaggacuuagcgccguuccaaggagaggucgggggagcuggugcuuugugcauaggggauggcagagagcaaagcuugcagcugggaaugaguggggauggugggugcugggcgagugcuggguggcugugcucagaggcugugcauucaagcagcccgggagcugggacccaggauccaggacagagggaagcagggccuuggcugugcaauggguggggccuggggugggaggagggcugcugggguggccaugucguguagagagggcagugggaguggacgauuccugggaccacccaguuccgacaggcagcaccaagaacgggggagagaaggcgagcggggcuuggggauucucugcggguuuccccgccugccugccuuagagggcugcugcccugcagguguggggcccguccugcccagcugcccuggcuucugggauuuccacaagucacaugggguuuuggaggagcucaaggggcccaggaucuucccauggggcaaggggcugggagcagcguccgggcagccgaggcggcguagggacaggcguagggacaggcguggucccgaugagucuuucuccucugggccucaguuuccucuccuggaaacgggcagaagcgcugccauuggcggggaggucccgccggggaggaaugguguccauguggcugggugggagggaagggguccccacgaggcugugaccagcacgcccuccucccgcguucaggcacagaguucgaguacaccgacucagagagcgaggucaaggugcgcaagcggucgccugcggggcugcugcggcccaagaaggggcugggggagccgggacccucccuggccgcacccacgccuggcgcccgcggucccgaccccagcagcccagacaaggccaagcuggcgguggagaaggggcgcaaggcccggaagcugcggggccccaaggagccuggcuucgaggcggggcccgaggccagcgacgacgaccuguggacgcggcgccgcagcgagcgcaucuuccugcacgacgccucggcugcugcaccugcgcccgucagcaccgcgcccgccaccaagaccagccgcugcgccaagggcggcccccugagcccgcgcaaggacgccgggcgugcaaaggacaggaaggaccccaggaagguaggggccgcgcugggagggggugccgcagaagggucccugggguuccgugagggaggggcccucuccccucccagccuagggaagcggcuucacuguuaauaaccauguacucggcuccaggcccgcccggagccccugcuaggacuuagccacagcaggagcugggcaccuguuccuuuguuucuuaagagucaacucuugcucugucaccaggcuggagcgcaguggccugaucauggcucacugcagccuuuaccuccuggccucuagcaguccuccugccucagccucccaaauagcuggaucuucagacacaugucacugcaccuggcuaauuuauuguuuguagagaggggaucucgcuauguugcccaggcugaucuugaacuccugaccuuuagugauucuucugccccaaccucccaaaaugcugagauuacaggcaugagccaccaugcuugaccacccguaucuuacagagguccuuacucucuuuucuccugucucagaagacgacuuuaaaaagugaauaagauaccugggaccccaaaggaagacagugauagugaccauaguuaucaaaauauugaaaagacccuucugugauaugguaccuauacauuccuuuagggauguauuuaauuaauaaacacaucugccaaugggucuaguaaauaccguacuuaaaauuuuauuauuuuauauuuuagagacagagucucacucugucacccaggcuggagugcagugcugugaucauggcucacugcaaccuugaacucuugggcucaagcagcccucccaccucagccuccugaguagcugggacuacaggugcauaccaccgugcccagcuaauuuuuaaauuuuaaguauagacaaggucuugcugcauugcccaggcuggucucaaacucuguucuccugccucagccucucaaaguguugagauuccaggcgugagccacugcacccggcuagugcuguacuucugaagcaguguaaaggauguuuuaaggucccuggaguaacuauugugugcugcaagucucugugguuuccguugcugcaagacucugugguuucaccggcgcugcugguacuuuugugguuuguggccuccacucucaccugaaggaaaaccccauuuuuuuuuuagagguuaaaaugugaaaaugcaggugggauuuucuuuccuacccauuuacagauuuccuaaauucucucuaugaacaccccagauuaagaaaacuugcuuuuagacaacuuuauaaucgggccuguuacccuuuuugcacuggccacuaggaagcugagggccaguugcuuccuccuccuauuuggaugcguucagacuuaacagcuagguuuugacgguauucugucaaaauaccucuccacccugagcccuugauauaggaggaacccucaaauaagggugacauucuagagaagaucacaaaaaagaugagagucacauugauuuccugacaaagggguaguagugaggaaggggccaguguaagcaccauccauaggcaccuuggauuugugcucuugucuccugguggcagaggccaucucagguuuuugaaggccuugcaggacaggugucacaauuagucacaauaauaauaaugauucagccgggcacgguggcacacaccuguaaucccagcacuuugggaggccaagguggguggaucacuugaggucaggaguuugagaccagccuggccaacaugacgaaauccugucucuacuaaaaaauacaaaaauuagccaggcaugguggcgggugccuguaaucccagcuacucaggaggcugaggcaggagaaucucuugagcccggaaggcggagguugcagugagcugagauugugccacugcacuccagccugggcgacagagugagacucugucuccaaaaauaaaauaauaaugcuaccagguagcacauaguaggcccagacauguucuaaccccuucacuucacacacuuaccaugcaggacugugugaaguggguuucuccuaugaaccgcucucuauagguggcucacauauggacaggcaccagacuggcugcgguggcucacgccugcaaucccagcacuuugaggugggaggaucccuugaggccaggaguuuugagacuggccugggcaacacagcaagacccugccucuaccaaaaaaaaaaaacaacaaaaaaacaauuagcugggagugguggugaucagugccuauagucccaccuacucuggaagcuggggcagggggauugcuugagcccaggaggugaaggcugcagugagcuaugaucauacugccucacuccagccuaggcaacagaacccacaacucugucucaaaauaaagaaaaaggcuguuugcaguggcucauuccuguaauccuagcacuuugggaggccgaggugggcagaucaccugaggucaggaguucaagaccagccuggucaacauggugaaacuccguuucuacuaaaaauaaaaaaauuagcuggguguguuggggggcaccuaccacacauuaacagugucuguucuugggaugcugagauguggggugauuuuccuugggugucugagccuccauuugucaacaaugaaucuguucuguuccagguuccugcuacaguaucaaaaggcagacacugggugagccucugguauuauagcuggauauaauagcuggguauucagcuguucagaugccaggaauuggaaacccugggccuccaacagaaggaacucuugggaaaggcccaaagaggcaauguaguccagugguuaaggagccagaacugaagcuaaagcuacguccccaguguucaaagcccaacucuauugaucauucccugcuguaaccuuggacagauagcuauccuuuuuuuuuuuuuuuuuuuuuuuuugagacggagucucacugugucgcccaggcugaagugcaguggcacaaacucggcucacugcaaccuccgccucccagguucaagcaguucuccugccucagccucccaaguagcugagauuacaggugcccaccaccaugcccagcuaauuuuuguauuuuaguagaaacaugguuucaccauguuggucaggcugaucuugaacuccugaccucaaaugaucugcccaccucagccucccaaagugcugggauuacaguugugggccaccgcuccuggcuguauucugcuuuucagacuuaguucagucuguguuauaucauguguacugccacaugggaugggcuuuuacuuuuauuuucuaucuuuuuuuuuuuuuuaaagacagaaucuguccuacugcccagacuggaguacaguggugagaucuuggcucgcugaaaccucugccucccagauuaaagcgauucucuugccucagccucccgaguagcugggaucacaggcgcucaccaccaugcucggcucacuuuuguauuuuuaguagagacaagguuucgccauguuggccagucucgucucgaacuccugaccucaggugaucggcccaccucagccucccaauguguugcgauuauaggcaugagccaccacgccuggccuucuaucaauauuuuuauuguauuuauuuauaagagacagagucuugcucuguuucccagucuggagugcaguggugauuguagcugacugcagccucaaauuuccaaguucgagcaguuuuccugccucagucuccucugaguaggugggaccacaguggcacaccaacacaccuugcuaauuuuucuuuuaauaagagacgguggucucagccgggcgcaauggcucauaccuguaaucccagcacuuugggaggccgaggcggguggaucacgaggucaggaguucgagaccagccuagccaauauggugaaaccccgccucuacuaaaaaaauacaaaaaaguagccgggugugguggcggucaccuguaguccuagcuacucgggaggccgaggcagaagaaucgcucgaacccaggaggcggagguugcagugagccgagauugugccacugcacuccagccuggguggcagagcgagacucugucucaaaaaaaaaaaaaaggcggcggcggggaagguggucucacuguguugcccaggcugguuucaaacucuugggcucaagugauccuccugccucgaccucccaaagugcugggauuacagguguauaccaccacgucugacuaauuaaaaaaaaauuauuuucgugcagaugggguggggucuccuuauguugcccaggauggucuugaacuccugggcucaagcaguccuccugccuuggccucccgaagcguugggauuacaggcgugagccaccacaccuggacaucaguauuuuuuuuguuuuuugcgacagagucucacucuuguggcccaggcuggaguacaguggugcaaccucagcucacugcaaccucugccucccggguucaagugauucucuugucucagccuccagaguagcugggauuacaggcucgugcccucacgccuaauuuuuguauuuuuaguagagacgggguuucaccauguuggcugggcuggucucgaacuccuggccucaagugauccgccugccuuggcuucccgaagugcugggauuacaggcgugagccaccgcgccuggcugucaguauuuuuaaaugguugaaugccaucccacugccugccugucuccugccacugacccugcuggcgguuggugguuuggguggugaugguguuuugcugucauaguuaccaaagcaggcagcgucucuguuuugcauacagaacuucuaucacgucggaaguuauuuucuuauuuacuuuauguuuuuuuuacaaaaaaguaggggaaggcacccagccguggguuuucagaucaaagggaaagaaacaguuacuggcuuuaucugauuauaacaguaauuuggaagauaaagaaaagaaaaauccauucaggccuuuuuuuuucugcugucauuuccuuuuguuucccuguggguacagcugcagggacauguaccaggagcugcagcuaucugcuuaaugacggaucccagagauaaggggacagcgccacuaacauucuuucagcgccuaagaugccucugauuccagaaggaugacuugcauuaaagaguucagcagcaacaagaaaauaaaacacacagacacacacacacacacacacacacacacacacacacacacgcacaaacacacacauauauauuuuucccccccaaaauggggauuaaacuguauauucuuuuucccuagaacauaccauuuuuuguuucuuuuaaugcucucugcuuugacuuucauuuuggauauggacgcugugacuucuguuguugucuugguagcauuugaccauuguuaucuuuauuuauuacuuuucuaccucuccuggccuuggccauuuguuuuggugguuguuguuguuuguuuguuuuuugacacagagucucacucugucgcccaggcuggagugcaguggcacgaugucggcucacuguaacguccgucuccugguucaagcgauucuccugccucagccucccgaguagcugggacuacaggcgugugccaccaugcccagcuacuuuuuuauauuuuuaguagagaugggguuucaccguguuagccaggauggucucgaucuccugaccucgugauccgcccgccucggccucccaaagugcugggauuacaggcaggagccacugcaccuggccuuuuuuuuuuuuuccuuaauuuuauuuuauuuuugagacggaguuuugcucuuuuuugcccaggcuggagugugguggcgcgaucucggcucacugcaaccuccgccuaccgggugcaagugaugauucugccucagccacccgaguagcugagauuacaggcacccgccaccaugcccagcuaauggccauuuguuuuagacgugucccuuuuagaaaguguagauuuuuuagcugggcauggcgguacaugucuguaguccaagcuacuugggaggcugaggcaggaggauugcuugagcccaggagguugaggcuaucagucagcugucauugugccauggcacuccagccugggcaacacagccagacccugucucaaaaacaacaacaaaacagagagugaaaaaacggaggcagccuacaggcccuucucaucgcgggggugguuaaaguaagugcauuaggguuucuccauaccuuggcucaauaggcugcuguuaaaaugaagcuccuuucauauguaucagucauguugaggggaaacguugcaaagcaggacuguugguaaauucccacuuuuuuuuuuuuaaaauacugugugugcaugguugugucugcguagccuucauauuuacacgguugugugugcuuguggaaaguucuagaaggauacaccaugcuguuacuaguagcugacucuguggaguugguaggagggucacuggagaggaacuugcaacauauauacacuucaguggugucuuuuuugggcagacggggcaacaaguaauauauacuaguaauaagauaauacacguuaaaaacagccuguaaucccagcacuuuggaaggccaaggcgggaggauugcuugagaccaggaguuugagaccagccugggcaacauagcaagacccugucucuaaaaaaauaaaaacuuagcugggugugguggugugcaccuguaguccagcuacucaggaggcugagguaggaggauaacgugagcccaggaggucgaggcugcauuuaguggugauggugccacaguccucuggccugggcaacagagcgagaccuugucucuaaaaaaaaaaaaaaaaaaaaaaaaaaaaauugcagggcgcguuugcucaugccuguaaucccagcacuuugggaggccgaggcgggcagaucacaaggucaggagaucgagaccauccucgcaaacacgguaaaaccccgucucuacugaaaauacaaaaacauuagccaggugugguggcgggugccuguagucccagcuacucgggaggcugaggcaggagaauggcgugaacccgggaggcagagcuugcagugagccaagaucgcgccacugcgcuccagccucggugacagagcgagacuccgucucaaaaaaaaaaaaacaaaaaaaaacccaaaaccaaaaacgcuugcaggaagagagagaagggguguuuuguuccuccugggagggcgcacuugggguggcacagaacuugggggugagugagugagggggacaggggugcugccugugcuuucccugccguuugauggcuccucucugcugcuuccuccuccagaagaagaaagggaaagaggcugggccaggagcugggcugccgccgccccgagcuccugccuugcccucugaggccagggcuccucacgccagcucccugaccgcugccaaaaggagcaaagccaaggccaaagggaaggaggugaagaaggaggugaggcucaccgugcccugguugggggcuguggggggcucagccaugcuccuguggucagggcagggggcuccaccugcuccucuguauucacccucccuauagcuguggcucagagagguugcgggugacgagggugauguggccguccccacacuccagggauaaggagauacuggggacucugcuccuguccucaggaaaugucugcucuagcgggggcgagggacacuggaacagagaccaggagaccugggugacaggcccccagcccagcaccagguccucacagggcccucaggcuugggugaaucugcccgaguggcagaugauggcauguccacuccccacaccugcuagccccugcccgagugguuuuuccucaagcccauuggguggaaaugcuggagaugcugcugaaguuucucuaagaagggaacggaggcaccugccauagugauggacugagguaugguagugaguacugagugcugagugcugauacugagcacagaguacugaguauugagcaccgaguacugagcaugggccagcuggguuuugggcccauuucaccuucccccuggccucuggggugccccuaacugggaucccugccaugcacaugacagauucccccugcggccugacuguggcuccagguuuccagagaggguccccaacccggcaggaccccuguucagguccuaagucauuugucggccauguucuguccccagaaccgcggcaaggggggugccgugagcaagcugauggagagcauggcagccgaggaggacuuugaacccaaccaagacucgagcuucucugaggacgagcaccugccgcguggcggggcuguggagcggccgcugaccccgggugaguggccgugaugccacaugugccgggcggggcugcuggagccucccuugggggaggcagaucugagcaaggcuugagacugaagggcugggcuagcugggggcagggaaccacaggagcagagauccugaggcugaguuauccgggucgaugagaaggcuggacuggcugcagcuuagucaacugcagaugaggcaagagagcggcccugggaccagggaggaggcagguccugcggggcuugggaaggaguuccguguuggcccuaaggaaaaugcgaagcuuucugagguuagauguggggaugugauauggucagauuggcuuuaaaaugagcugucugggccgagcgugguggcccaugccuguaaucccagcacuuuaggagaccgaguugggcagaucaccugaggucaggaguuccagaccagccuggccaacauggugaaacccugauucuacugaaaauacaaaaauuagcugggugugguggcgggcgccuguaaucccagcuacccgggaggcuggggcaggagaaucacuugaaaccaggaggcggagguugcggugagccaagaucaugccauugcauugcacuccagccugggcaaagagcaaaacugugucucaaaaaaaaaaaaacugucuggugcugcacagagaacgagugggggccccagggaaggcagggaguccaguuaggaggcugugcuguccaggcgagaguggguuguagccuggggcugccaugggggcagcagggaaggaggcggggcagggugcacacauuaggagggaguguggaugggagguggggucgggggugcaggcagaggagaggggaagggaagggugaggacagguguggggguggggggaagcccugucccugagacccgggucagggagagucaugugcugggcuuugaugacucaaucgggaagucacgcccaggcugggacccaggggucuguagcccagaggcgaaaucguggguauggaugggggagcgagugagaaggagucggccgccccaaggcugcauuggucaccugccgcuaugugacaaccagccgccgccugugugcgucucaggggcauguagggcugcuggguggccaugcagacccccaguggccuugcuccugcggugaugggcuggccaggggucagcugcuccaggucugugguccucucugcguguguuguuuauccugccagacccguggcuuaagaggaaaaguugggcuuaagagcucucucgaggccuaggcucagcauugggccccggccacuucugagagccacauggccaagcccaacgucagggugugggaagucgacucugccagugacaaggccacaggcaggcacagcagggauacggccgucccacccaucccucucccagcgagccaucuggguaaugagaaugucggggacagaccaggugaaaggucccacugaggaggaagggcaggcccaagugucuuggcaggggcagggagagggagggagcagaggguuggggcaaugagaggugaccgccgucggcaaguuugcccccgggcauucauuuccgccagaaagaaaaaguggauggaaagucucagagguaggugggguguggucacaugcaccuguaaucccagugcuuuggggggccgaggugggaggaucacuugagaccaggaguucgagaucaguugggcaacauaguggacccugucucuacaaaaaauaauuagccaggcaugguggugugcaccuauagucccagcuacucaggaggcuaaggugggaggauggcuugaacccaggaguuccaggcugcagugagcuaugaucuugccacugcacuguaggcuggaugacaaagcaagaccuugucucugacaucaugaugaugaugaugaugaugaugauuauugagacggaaucugacucucugucacccgggcuggagugcaguggcgugaucucggcucacugcagccucugccucccagguucaagcaauucuuuugccucagccucccaaguagcugggacuacaggcgugcacugccacaccuggguaauauuuguguuuuuaguagagacaggguuucaccauguuagcuaggauggucuugaucuucugaccuugugaucugcccgccucagccucccaaagugcugggauuacaggugugagccaucgcgccuggcuugaaaaaauuauuaaaaaaaagaaagaggccgggcacgguggcucacaccgguaaucccaguacuugggaggcugaggaggguggaucaccggaggucaggggcucgggaucagccuggccaacaugguggaaccccgucucuacuaaaaauacaaaaauuagccgggccugguggcaggcaccuguaauuccagcugcuugggaggcugaggcaggagaaucgcuugaaccugggaggcagagguugcagugagccgagaucaugccauugcacuccagccugggcaacaagauugaaacuccaucucaaaaauaaauaaauaaauaaauaaauaaauaaauaaauaaauaaauaaaguccuagaaguuuggcugugggcagcaguaagagggggcggacaucaugauggaggaucgucgcugugaguguccggugauggcuggcacccagagcuucaugccaggcccagaggcugcuggucuugaggugggaagaggcagcaggugcaggcuuucaucucuggguucacacccaccuggggucuuugcagacaucuggggccaggcaggggagggggcuaggaggagaggggcuggccacggcacccuguacaugcucacugguacacacaggucugcacggguacacacacaggcagacgaagaagugcacacgucucagccccacaggcccacccgguaccagggccuccauuccaaggggaugacuuggggguaacgggaggagggagaggugucgcagacgcccccggcuccagccucgccucacgauccaaccccugcagccccucgcuccugcaucaucgacaaggaugagcugaaggacggccugcgugugcucauccccauggaugacaagcugcuguacgccgggcacgugcagaccgugcacucgccagacaugugaguggggugggagguccggcacagagccccgugucccauacccgccccgugucccggccgccucugugccuggcugcuucuccuuucugggcugugguuucccccgauggcacagggcaggggcaugagugggcucagagcugacggggaggcccugggcacuuugagggaguacugggugaacccucccaggggcugggcgcggcugcuccgcagcgggaaggggugagagagcgugcuggccucucucaggaucuggacugugccuugcaaccccuaguccuacagaugaggaaaaugaacccagaaaagggggagaauucccaaauucagcaagucagcaaaccucugaguccugguguuaccucccaguggucuaggaggcagugcugugcuggugggauugaggcccucuggggaggucucggccucugccaccucacgccucguuugcuccuacagauaccgcguggugguggagggugagcggggcaaccggccccacaucuacugucuggagcaguugcugcaggaggcggugaggggggaggggcggggccucgggaggcucggggugggcuggguguccaaggccauggccauaacuguguccacaccuugcacucaucccaugcccuucuagaucaucgaugugaggccagccuccacucgcuucuugccacaagggaccaggauugcagccuacuggagccagcaguaccgcugucucuacccaggcacugugguccgaggugagaugccuccuccccagcucuccccugccgccuaacaucucaguauggacuuguuuggcuacuaaaacccaacucuaacuggcuuaagaauaaagacuugugggcucacauaacugaaaacuguauggccuucaggcaugauuggauccaggcaccauuuaaacgaugucaucaggacuccagcucugaguaucugucagcagugcugucaucugugcuggcuucacacuagcuccuuggagauuguauuuuaccaucuuaagaacucuuaucauuggaggauuucucagucucgguuuucccacacaaguucuagugugaacugacuugggccacaugguuuucauugauccuacugccgugagucugaucgaccgggccugggucagauucucaucccuggggcuaaggagugaggucaccucccuuuuauucgugggcugagaaagaugggaggguggcuuccccugcaaaguggacauguuguuagaauaagagagaaugaggcuggaugugguggcucaugccuguaaucccagcacuuugggaggccgagguggguggaaucacuugaggucaggaguucaagaccagcuuggccaacgugguaaaaccccgucucuacuaaaaauacaaaaauuagccgggcgugguggcaggugccuguaaucccagcuacuugggaggcugaggcaggagaaucacucaaaccugggaaguggagguugcagugagccaggauugcaccacugcacucuagccugggugacagagugagacuacgucucaaaaaaagaaaaaagaauggaggcuggauggagaaaaacaacagguacccuaggaaauguagguguggauaucagacaggcaagaaagacagucaaaugguccaacccuuagcuuuugcaaaagcaguguauccuagagaggggguauggauguggauuagacaaaccccgcccgugcaaaaaaaaagcccacucacaugccaaauacaguccacugcuuggccuaccauccauucauacccagaagauggaagccaaugccagcucagcaaaacaacagaugagugguccagccugaguagaggaucucaggccaggaagacuuaguuuuuuccaucauauuagucacucauuuaucauccaaauucugaaagugcuguuaauaaggcagaaguuggccuuagauucggauuuccuagcacaugcugucccccuguacugggaggugcuggcuguguucuaggccugccucauggguaucauucuggauucuugggccuucccugucccucauccugggaaccgcuuuuguugcguugcauguuuuucucuuuuuugguucaguuccuuguuuuaagcaguggaucuuucaguagcuuucugaggaagagucugugggaguuaaauuucucacauccuuguauguuuguaaucgcuucauucuacccugauuuuuuagagauagcugagcuggguacccuuauucuuuagagauaguugagcuggguauaaauucacgacuggaaauaguuccccucaccauuucaaagacauuuuucuauuuuuaucuugcuucccauguugaagacauucaacauugugauuccaaaaucauuguaggagaccugcuuuuuuaucucuggaaacuuuuaggaucuucucauuaucccuagaucuggaauuccguguguguguguguguguucucaucaugcuggguaucugcagagggaggcuuugauuuugaagcaaauuuccuucauucuuggaagcucuacuuguagcacaacuuggauaacuucucuugugaauuucauguuuucccuggaacuugggcuaguuccauggccccuggugugugugucuuuuuuucuguuaauauuugcuuauuuuguucaacuuauggagagauuuucucuacuuuuaucuucuaaccccuucuguuuucuugaauuuuaaaauuuucugcugucauuuaaaaaaauuguccaccagcugcgguggcucacgucuguagucccagcaauuugggagccugaugcggguagaucacuugaacccaggaguucaaaaccagccugggcaacauagcaagacccugucucuacaaaaagauacaaaaauuagccaggcuugggccaggcgugguggcucacaccuguaaucucaacacuuugggaggccaaggugggcagaucaccugaggucaggaguuugagaccagccugggcagcauggugaaaccccgucucuauuaaaaauacaaaaauaagcugggcgugguggcgggugccuguaaucccagcuacucgggaggcugaggcaggaaagaaucaccugaacccgggaaguagagguugcagugagccgagaucacaccgcugcacucuagccuggguaacauagugagacucugucucaaaaaaaaaaaauuauuauccagguuugguggugugcaccuguuguccuagcuacuugggagaccgaagugggaggaucaccugagccuggguggucgaggcugcagugagcuaugauugcgccauugcauuccagccugggugacagaaugacaccaucucaaaaaaaaaaaaaaccuuaagaguucuuucuuauucucugaauauuccuuaaauuuuuuuuuguuuuaucaacacauuucuuuuuaaacuuucucagaggauuguuuuucauuuuaacuuucuguauuuuuuuuugagacagagucuugcucugucacccaggccagagugcggugcagugauuucagcuuacugcagccuccaccucccagguucaagugauucuccugccucagcuucuggaguagcugggauuacaggcaugcaccaccaugcccggcuaauuuuuuguauuuuuaguagagauaggauuucaccauguuggccugacuggccucgaacucgugaccucaggugaucugcuucucucagccucccaaagugcugggauuacaggcgugagccacugcgccaggccucauuuuagcuuucugcagcucccucucucuucccgguccccccuccuucugcuugcuggugcugugcccuuccucugguuagaacuccuuaggcgucuggggacccugaaugaagggaaccuuaucaagccgaugggagcucugugcacucaugaguguuugucauagcgggugggcaggaagguuuuguuagggggcugcccagauucugcaagacucacauccuuggggauauaguaccagcaucuggcguuugggaagagggcugggcuaucacccuuuggggggccuguccaaccuccucccugcgcucagugucuuucagucuggagccucucucuagggugaagcucccagcuccugccagcugggccacccucagccuguucaguguugaggucucccucagcccugccucuggaggugcuuggggccucuccagcacgagccuuggcaggauucucuuaggaaaaccaccuccuccucguggguaucaccuccuccuaggagaucaaagcccguuccugcacguucaucccggcaucucuccggaaaugccacggucucccacugccgcccuccccuuucccauucuuuguguccuucaggguugacaccugcgucccuccuuugcugugguugcaggagggucuugugcaugagcgggcgcaggugcaugugcucagcugucuugugucacccaaagucagcuagaaaugggagacccaggccagagacaguggcucacgccuguaaucccagcacuuugggaggcugaggugggcggaucaccugaggucgggaguucgagaccagccugaccaacauggagaaaccccaucucuacugaaaauacagaauuagccaggcaugguggcgcaugucuguaaucccagcuacuugggaggccgaggcaggagaaucacuugaacccgggaggcggagguugcggcgagccaagaucaugccauugcacuccagccugggcaucgacagcgaaacucugucucaaaaaaaaaaaaaaaaaaaaaagacccauuucuccugcccugcccggguggccuggcucuaacacccacauucugagccgcuguauacccuccacccauguccccacugcuguaccauagagaccagggcugcacaggggccgguuucugccauccugacccuugugcgucacuagggagcuggagguccgagggccuccccugagccuccccucuucccacaggguuacuggaccuggaggacgauggggacuugaucaccguggaguuugacgacggagacacgggcaggaucccccucucacauauccgccuccugcccccugacuauaagauacaguguaagugacaagcucaugacacccggucuccugccaggggccgcccacccaggcucucgcccuccaagcccggcucugagcucugucugaagucauuuggagccacaggugauggaagcagcagaagccaugggugggcucccgugagaucucagggcuccuagguccuggguccaugaggacagcacaagcccaguggcccaggccaugggaagcugaucaaaaauuguuaauggcugggugcgguggcucacgccuguaauccuagcacuuugggaggccaagaugggcggaucacgaggucaagagaucgagaccaucccagccaauauggugaaacccugucucuauuaaaaauacaaaaauuagccgggcguggugacaugcgccuguagucccagcugcucaggaggcugaggcaggagaaucccuugaaccugagaggcagagguugcagugagcugagauccugccacugcacuccauccuggcgacagagcgagacucuguuuuaaaaaaaaaaaaaaaaaaaaaaaaaacccaacaaaagucagcaucuuuauccaccugucccgguuccacaaagugcuuuguuuuacuucauuauucgggagccucuggcugcucccugcagacgggguuuccccugcuggaccucacagccugucaugggagcccauccggggucagccaccuggugucgguugcuuccgcccccaucccugauccccgggacagaccagggucuuggaagcuccaagcuggggaccccaggccugaugagccacucuguccucugccccacaggugcugagccguccccggcccuucuggugccaagugccaagcgccgcagccggaagaccagcaaagacacuggggagggcaaagaugguggcacggcugggucggaggagccaggagccaaggcccgugggcgugggcggaaacccagcgccaaggccaagggugguagguuggccugguccccagggcagggcggugggcggaucuccuucgugcauccaaacucagggcuugggaaccugccgaagugccugccugcugucuguaagaacucugagccgggugcagugccucacaccuguaaucccagcgcuuugggaggccaaggcgagcagaucggcugaugucaggaguucaagaccagucuggccaauguggugaaacuccgucucuacuaaaaauacaaaaauuagcugggcaugguggugagugccuguaaucccaacuacgugggaggcugaggcaggagaaucacuucaaccugggagcuggagguugcagugagccaagaucgcaccauuacacuccagccugggcgacaagagcgaaauuccaucucaaaaaaaaaaaaaaaaaaaaaaaaaagaagagaacucugcaccugcacugcagggccguucugaccaggugacagaugaggaaacugaggcugagggaggcagguugguuugucagaggcacagcugagcugcagcuggccuguguuucuuuccagaauccagagaaaauacuucgugcaggcugaaagcagaggaggacccgcuuuggggccaacacaacuuaagguuguuauaggggaaccgccgaaggaggccuaagaaggcugcagccagguucugcucaagaaguagcagggccaggauugaaaccaggccuuucugcugggcgcagugguccacgccuauucucagcacucuaggaggcccaggcacagggaucgcuugagcccaggaguuuaagaccagccugggcaacggagcaaaacuguaucucuacaaaaaaaaaaauaauaauacaaaaaauuccccaggcauaguggcgcaugcuuguggccucagguuacuugggagacugaggcuggaggcucacaugagcccaggcagguuagggcugcaaugagcccugaugacgccacugcauuccagcuugggugacugagaccccaucucaaaaaaaaaacaaaaacaaaaacaaaacucacagaagcaggccuuucugauaaaagccacagcucaucucugccaggaagcccccgccccagcuucucaucuguuuuguuuugcagacagagccgcuacccuggaggaggggaacccaacagacgagguccccaguacccccuuagcccuggagccgagcagcaccccagguuccaagaagagccccccagagccuguggacaagcgagccaaggcccccaaggcgcgcccggcaccgccgcagcccagucccgcaccacccgccuucaccagcugcccagcacccgagccauuugcagagcugccagcuccugccaccucccuggccccagcaccccucaucaccaugccugccacacgccccaagcccaagaaggcgcgggcagccgaggagucgggugccaagggcccucggaggccgggggaggaggccgagcugcuugucaaacuggaccacgagggugucacgucacccaaaagcaagaaggcuaaagaggcccugcugcuccgggaggauccgggggcggggggcuggcaggagcccaagagccuccugagccugggcagcuauccccccgcggccggcagcagcgagcccaaggcacccuggcccaaggccaccgacggggaccucgcccaggagcccgggccggggcucacguucgaggacucugggaaccccaagagcccagacaaggcccaggcugagcaggacggggccgaagaguccgagagcagcagcagcagcaguaguggcagcaguagcagcagcagcagcagcagcagcagcggcucggagacagaaggggaggaggaaggcgacaagaacggggacgggggcugcggcaccgggggccguaacugcagcgcugccagcuccagggcggccucaccggccuccuccuccuccuccucauccuccuccuccuccuccuccuccuccucauccuccucuuccuccuccuccucuuccuccuccuccucuuccucuucgucuuccuccucuuccuccuccuccucuuccucguccucauccuccuccuccuccuccucuuccuccucuucuuccuccaccacagacgaggacucuuccugcagcucggacgaugaggcagcccccgcccccacggcuggcccuuccgcgcaggcggcgcuccccaccaaggccaccaagcaggccggcaaggcgcggcccucggcccacuccccaggcaagaagacgcccgcgccccagccccaggcgccuccuccgcagcccacacagccucugcagcccaaggcucaggccggggccaagagccgacccaagaagagagagggcguccaccuccccaccaccaaggagcuggccaagcggcagcgccugccguccguggagaaccggcccaagaucgccgccuuccugccagcccggcagcucuggaagugguucggcaagcccacccaggugagcaagcucgcgcccgggcacggccgaggggccgggggccuugugucucucugcugggcccacggcuucaugcugugucuccgugugugguaaccucccagaaccccaggguggagggcuggcgucccacuuuauggauggguacacugagucucagaguguccucaggcaccugggucugucggacuccgaugcccgaguccuucagagcagagugguccugcccucuggucccgggacgcagagccacccucguggagcccagaugaaggaaacgugcaaagaucagcacagacccacaggcgucggcgccacguggaaggggcuuuccaggccucugggauuuuuuccuuuuucuuuuuuugagacugagucucucucuguugcccaggcuggagugugguggugugaucuuggcuuacugcacccucugccucccggguucaagcaauucuccugcgucagccucccaaguagcugggauuacaggcgcacgccaccacgccuggcuaauuuuuguauuuucaguagagauggggguuuccccaugugggucaggaugaucucaaacucuccuggccucaagugaucugccugccucggacucccaaagugcugggauuacaggugugagccaccacgccuggcuuuuucuuuucuuucuuucuuuuuuuuuuuuuaagagacaggaucuugcuccgucacccaggcuggagugcagcggugccaucguggcucacugcagcuuugaacuucugggcccaagcaguuuucccgccucagccuccugaguagcugggauuacagacaugugccaccaugcuacccagcugauuuuuaaauauuuuuguagagacagugucucacuguguugcuugggcuggucuugaaccccugggcucaagugauccucccgccucagccucccagagugcuggaauuccaggugcggggccugacagccuguuguguguggcauuugaguguucccagccacgccccgggcuccuggccacuaguguggcagucccagcagaagguaccuccuucccagguuugcuagcaaaaguccagauugaagcuccuuggccuggccaggaucaugugcccaccccugagugaaucaauauggccuggaagacaaaguccuggcuggccaggucggggucccgugugcccugccugcagcaguggguuagcuguucagaaggagcccuuccagccugccuguggcugucuacacacacgcacacacacuugcacacagugcacucaaaagcaugggcacaugcacacacacacgcacauaugugugcacauguacacaugaaugcacauacagccacacacaaaagcaaguauacacacaugcagauguacaugugaaugcaggcacguacaugaaccauguaaacaugaacaugcacacauaugcaaauacacuacacccacacaaaugcacacuugcacacguacacaaacguaggcacauacaugcgugcacgugcauccaugcacgugcaugcacacgaguacacgugcacacacacaaacacgugcacacacgaacacgugcacacacaugaacacgugcacaaaugcacagaugaacaugugcacacacaggcacauauacauggcaggacccagugugagaaguggugguucagacaggcuggcagggagcccccaacgugcuguagguguggggcaggagcaccugcauguuccagaaggggucaguggugucucaggcagcauuuccaaagcugcucuagaauggaguuucaagucucucuugcccaggugcaguggcuuaagucuguaaucccagcacuuugggaggcccaggcgggaggaucacuuaagcuugggaggucaaggcugcagugagcugugauugugccacuacacuccaaccugggcaauagugugagaccuugucuugaaaaaaauaauaguuuuagccgggcgcaguggcucacaccuguaaucccagcacucugggaggcccaggcaggaggaucacuugaggucaggaguucgagaccacccugccaacauggugaaaccccgucucuacuaaaaauacacacacaaaaauuagccaggcgugguggugcacgccuguaaucccaucuacuugggaggcugaggcaggagaacugcuugaaccugggaggcagaggcuacagugagccaagaucgugccacugcacuccagccugggcgauagagugagacuucaucucaaaaagaauaauaauaauaauaacuauuuuuuaaaagauaaaaaaggccaggugugguagcucacgccuguaaucccagcucuuuggguggcuuaugugggaggaucacuugaggccaaaaguucaagaccaucuugggcaacauagugagacccccaucucuacaaaaauaaaaauauuagccguggauuccuguaaucccaucaacucaggcggccgagggaggaggauggcuugagcccaggagaucgaggcugcagugagcuaugauauuaccacugcaguccugccugggugacagagcaagacccuuucucugaaaaaaguaauuuucaaaagaaaaauaaggccaggugcaguggcugacacugcgauccuagugcuuugggaggcaaaggugggagggugguuugaggccaaaagucugagaccauccugggcaacauagugagaccuuguucucuacaaaaauaaucaaaauuagccgggcguggugugcgccuguauucucagcuccucagaggcugaggugggagaggauuucuugagucuaggaguucguggcugcagugagucaugauggcgccacugcgcuccagccugggcaacagagggagacccugucucaaaaauaagaagucuuguagcggcagaaugcuuagaucaagggaagcgccucuuggagacccagcaugucaaagagauggaagaggggcuuccccacuugaagcgagacaaggagcuuccucaucuccccacaguuggauagggguugauuuagaggccgagggcccagagucccaagcggcagagccugccaggcggcgggcuccuuggggcugggccagggccugugccgugacacacguguccuugcagcggcguggcaugaagggcaaggcccgcaagcucuucuacaaggccaucgugcgcggcaaggagaugauccguaucggggacugugccguguuccucucugccggccgccccaaccugcccuacaucggccgcauccagagcaugugggagucguggggcaacaacauggugguccgcgucaagugguucuaccaccccgaggagaccagcccgggcaagcaguuccaccagggccaggugagccugcggcccggcugcggcccccaguccuaggcgguguagggcagaccugagggcgaggcguucugggugcuggagcaucagcagcccugcccagugggucagcccuguccuggggccuggggucgggugcagcagcccccgggcucacccaagccccuccucucucccccacacagcacugggaccagaaguccagccgcagccucccggcggcccugcgggucuccagccagaggaaggacuucauggagguaggugguggugguggugguggugggcggguuggggauggcugcuuccuuccgggcagcucagacagggcccggcucagcaucugcugcucugucccccauggucucccucagccucugaccuccugucccugccacucucagugccuggcuccuguucucugucucucuggucugugcgucugucucugggucuucucugcucucccagugucugucucugagucucuggccauucuugcccucugacucucucugggucucucccaaccucuaucuuucagucucugugucucucugggucucucucgaucucggucucugucucucugcgucuuuggaucucuuggucugucuauccuugucucucauuugcucuccaucucucggucucugucucucuuuuguuggucugucucuuacucagccucugucucugacuuggucucugucucagucccuggggcucccucugcuucugucucugucccuguggcucccuggggcucccucggccucugugccccccaccugccauccugauauccccgcgugcccgcagcgcgcgcuauaccaguccucgcauguggacgaaaaugacgugcagacggugucgcacaagugccugguggugggccuggagcaguaugagcagaugcugaagaccaagaaguaccaggacagcgagggccuguacuaccucgcgggcaccuacgagcccaccacgggcaugaucuucuccacggacggcgugcccgugcucugcugagcccgccgggcccugcgggccaccugugccccgagggcggccagggacccaucuccaucacugccauggcgcggagaccacgugcguugugugcaugcgagcgcuccugcaggcgugugcauggggccaggugugcacguggaugcccgggugagugugugugcaugcacgugugugcacgcaugugcacaugccuccagccccaccuuccaaccccucagugcccccaggacaggggccccucuuagcuaucaggguauggccggaccggcccuuccugcccagcacguugcaagcacuuggccaggccggcccuccaggcugcugcugcgugggggcccgggugcccccagguccaugcagacuggggauucgguggggaggggcgcuucuaaggaaccaaacugacgcucacucugggcuucccaagcacccuuagcauggagcccaccccaaggccucccaccgugcaugggacagggcagcccgaugccagcuggccuaccugacugugccaggggcccugcccccacccucucaggauggccuagacuuggggaacagagccgggugggguugcagcccggagugucugucaaaggcaccagguggagagggcccggcacaggcccacccugguccaaacccucacacuacagaaaaccccaauggugcugaaacugucgcccggccacgccuggccccuccccacccaggagggagguggcacuucuuaaccuguacaguuuuauuguaccaagagacucgccccgccccuguaucauaagccuuuaaauggagucaacuuuuuaauuauauauauaaagauaaauauauauaaauauauauauaaacuuuuuaaaacugugaaaaauagcuaugaaauuauaaaaaaaaacauucugacgugcagaauauuauuuuuuauuuccuguuagauuauagugucuagcaccggcuucaccggccucccaguccccagcacaccccccgcccaccccaccaaguguacuguacucaccccccaggauagagaaguguuuguuagggagagaagagggagaggcaggagccggcccaagcccagggucccugcuugggccccagaaagcacuuaaccaggccccaagccuucaagggaaaccaaggccucaaccagacaaucuugagggaaggaaaagccagacuuuggguuuguuuuuugggggaauuauugguuuuuuuuuuuauguuucuuuuggaauuuuguuuguuggcaaauucugugugaucuuuuuucauaaaaaaaaagaaaagauuuaauuggaaaaauaa

SEQ ID NO: 191572 - RNA, 13852 nt, Homo sapiens
agcugggcuuuguggagcgcugcggagggugcgugcgggccgcggcagccgaacaaaggagcaggggcgccgccgcagggacccgccacccaccucccggggccgcgcagcggccucucgucuacugccaccaugaccgccaacggcacagccgaggcggugcagauccaguucggccucaucaacugcggcaacaaguaccugacggccgaggcguucggguucaaggugaacgcguccgccagcagccugaagaagaagcagaucuggacgcuggagcagcccccugacgaggcgggcagcgcggccgugugccugcgcagccaccugggccgcuaccuggcggcggacaaggacggcaacgugaccugcgagcgcgaggugcccggucccgacugccguuuccucaucguggcgcacgacgacggucgcuggucgcugcaguccgaggcgcaccggcgcuacuucggcggcaccgaggaccgccuguccugcuucgcgcagacggugucccccgccgagaaguggagcgugcacaucgccaugcacccucaggucaacaucuacagcgucacccguaagcgcuacgcgcaccugagcgcgcggccggccgacgagaucgccguggaccgcgacgugcccuggggcgucgacucgcucaucacccucgccuuccaggaccagcgcuacagcgugcagaccgccgaccaccgcuuccugcgccacgacgggcgccugguggcgcgccccgagccggccacuggcuacacgcuggaguuccgcuccggcaagguggccuuccgcgacugcgagggccguuaccuggcgccgucggggcccagcggcacgcucaaggcgggcaaggccaccaaggugggcaaggacgagcucuuugcucuggagcagagcugcgcccaggucgugcugcaggcggccaacgagaggaacguguccacgcgccagggugaguggggacgcugcccccgccucuccugguccgugcacaaagcgcaccccacccgcgccccuccagccucccgcccuuucucgcucgcggcgccgcugcgguccggagcacugcccauugcgcccccgcuaggcacgcgggcuaccccgccuggagggggcgaggaguggggcuuugcccauccucgggugccgcugcccaccucccaccccgggcugggaucaugggcuccccuaggccccgcggagucgcaaccguacgugcacccuccuaacccccccccccgcccaaucuuggcucuccccacgcgcgcugaucccucggaucagcugucccagcucuugcggagugggagccccucacccauuuccucgugccccuccccccgccggcuguccuggagcucggggguccgaggcaagggucgccacccgcaagggcgcgccuccacccccaccggcagccuuucgcgggcgagaugggggagguuagccaggccuuugaucccggcggggcgcgccuccaccuccccgucugcccggccuuccuccaccuccucccgcugccgggcggggucggccuccgcuggugggggggggcgcggggugucagcccuuccccccagccccuccucccgcgucugccccgcgcucgaggccgcggccuuugugagcaggggggcgggucgccucgacuggguccucccucgcccccuuuguccugcuccaucucugcagaugggaaaaccagaugcggcggggcgggggaggggaucggcuuuugcgguucaccccugcagaggagccccccgcgccgcccccgggcccagggcucgggucccgagguuccccaggaggcggucucccuccucgcgccgcggcccgggaacggcguggcgcggauggcggcccuccaggcaccccgcccuucgcccgccgcgcgcgucuccaggccggugcgcugagcuccgcuccgcgggcgaccgagggcggcuucagcgcgagccgggagaccccaggccagcucccucgggaagccccuacccucuggugaacccauccccuagggcgcucgccgggaacaauugacugcaacucgauccguccccuccggggccuccugcaggcacggcuauuugcgaccggccugugcgccacucuuucccuucuuucucagauucuccccgaggggcuuucucuuccuuuuggcguccucuuccacuccuggcggagaagcuguuccuugcuugcagacagaggccccgcuggagggaggggcguggggggaucuuuuucccuggauaggaagucggaccccaggccuuggagauggcuggacgggagcccaguuuguguccucaucccuccucuuggaaggagcccuccugacggccccccucuuggcugugggcucugcaggagggggaaagaccccccauggcagugggggugaggguggaggccugggugggguaauggccauuuugugccugaaguuugcuaccuuaagucccagagaggugaagcugcuugucaugggucacacagcaagugaccacaaggaagcagcaugcagaagugggugcauuuggcuccagaaaccccguuuccuguuucccacagcgcauggcgggcagagcuccucaccugaucagcaggcauugagcccuacuaaggggaccugcugagccaugagugaaccagugggguucacguucucuuggggacauuacgaagugucaaggaaaaggcagcggguacagguuauuagauggcugaguccuuucugagcaggacauuugagcuggccugaaggaugaauagaagguggcagguauggggggggugcuguguggaccagcguuguaggcugugggugucuccugugcaaaggucuuauggcaggaagguacagagaaagcccaguguggcugggaggaagcuugugaggucugggccacgggaccuugggugagagcuuagugcagggcuaugguccuugccuugggguugcagccacagccucccguggggaagaagucgcagaaguagguggccuuggcccugggggccaggaaguugcagagagccugaggguguuuuuggcgagccugggcagauaacuccccucuccugagaagcuugcugggggcgucuggugugugauucaggcugauagggugggaggaaccagaaauugcagccaggagaggugguggugauggcucagcuuggaguugaaagggaugugggacggcgcggggguggggguacuugggggccgagguuggggcuccucuggccucagaucuugggguccuuaucucguuucuaugucagccaacucccggggggcuuuugggaacuggagucugcaggggugggcguggggggcgugucugcagaggccauuuuggacgggccugcguggcaagggggaggcgucugcuuccgacacacaugcuggggaacgccagccaggaaggggaggauccggacuuagcuggcaggggggaugugaaucaucucugcaggccugcacgggcgggcccggugggggcagggugcuccccuuugaaaaacgcugcgcccugcucuucagccucaguuuccccaucuguaaagugugcauuccaggccuccuugggcuggcccagagcugcccugggcaggggcuuucagcccuucacaccagaggcugggucagcugagugagugcuccuuuguccucccgccaugccccaggcuccucccugcuccccaggauccacaccuacccuggccccgacccugggccaugccucaccacacuuccugucuucucucacaucucucacaucugggaguccucucccgccagccugugcuugcaucuggggauccaugccagggauaggaccuguccucccugcuggcuugggacaugcccucucccagccacucugaggagggcugacugaggaagggcucgucaagcugggcuuugcaggauguguaagaguucuccccacgaggcgcagggcauucugagcccagggaauggcuuguauaaggaugcagaggcauuugaaauggccaaguaguugcaggaaucgacuggaaaccggggugguaaggugaagccauagaacauuccaggcccccuccccuaaaugagauggaaggagugccuguuuugaacaagccaggggcaucuggggaccguuaaggccuggggguggugauggggacuggagggugugaggcaaccagggggugccccucugagccaccacagacagaaugguucagaaggccaggcacacuggcucucgccuguaauccaagcacuuugggaggccaaggagggaagauggcuucggccaaggagggaagauggcuucagcccaggaguucaaggccagccuggaaaacauggcaaaaccucugucuacaaaaaauacaaaaaauuagccaggcauggugaugcacgccugucgucccagcuacucaggaggcuuagaugggaggaucacuugagccggggaguuugaggcugcagugagccgagaucgugccacugcacuccagccugggcaacagaacgagacccugucuuaaaaaaauuuuuuuuggccuggugcgguggcucacgccuguaaugccagcacuuugggaguccaagguggguggaucaccuggaggucgggaguuugagaccagucugaccaacauggagaaaccccaucucuacuaaaaacacaaaaauuagccgggcgugguggcgcaugccuguaaucccagcuacucuggaggcugaggcaggagaaucccuugaacccgggaggcggaaguugcagugagccgagaucgcaccauugcacuccagccugggcaacaagagugaaacuccaucucaaaaaacaaaacaaaacaaaaaaaacaaccaaaacaaacaaacaaaaaacuguaauuaaaauaauuaaaagaaaaaaguuaaaaaaaaaaaaaagagaggauggcucaaaggcuggaaacagggaaggccacugugaggggaggacaggcagggcuagaccucucuggaaggaggagggagagguacccgugggcccggcacaggagacucuuaaucuccuggcucccgggggcuucugugggccugugacucaggauuucugugccucuguugaugaaaagaaaaauccugaagaaaacacuguucccauaguaacacagcucuaauuagagacuccaaggccaagcgagggccuuggagccaggaggggcccugcucuacuggggggacgacaccccuuuccccuaucccucccugcugggguguggccugaugucuacguggcaccaggccccuaaauccuuucaacauccuggcggagcggagaggcugggcccuuuugacagguggggaaacugaggaagguugcagggaaggcacucauccaagggugccuggccccccgcggugggugccucacuggcuggccuaaaccuuugcaucaaaccaguuccaggauugaacgcaacaggcugauggggacugagucgugguacagauggcggcaguuguguggcccugggcccaggaauggcugggaagcucccuuucuucucuggcuugggggaugagguuaguguaaauuucauggaguugccaggaggauuaaggccgacgugcauucacacguggccccguggcugccgccaguuaagcccugcgcagccauuggaagucucauugagaaggagccucccggcuuccugcauuuguuccaggcgggcugguaagcgcccugcuuauuugcaaggcugugugaggacgagcccuguaaacccuaggacgaggcugugcuaaugugguuucuguuccacugucuccccuucuccuuuugccccucuuucuggggaaccuggagccccugaugcccucuguuuuuuccugcugcugggguggaccuagaaccucucccuccauccuuucugcugcuggggugggccugcaggaggcuguccucuuaccuggucccuaacuucccuccgaucagcggggcuucagcggagccccagcgcauuggacagguggugcucuguggccggcacaggccagggcccagggugcggccccugccuguagguagacaugcaggcccuucugagcagaaugagggggcggugagggcagcugugcggguguggcuggccugacggcucccugcagcccugcggcuucugugcaguggggguggggcgggccagaccuuugcagggccucuuggcugguggagggcugagugagcagaggccccagcccucguguucccugggguguggccuuaggauggucccggcacccugggacccagccccugcucaccuuauccuccucccgugcuuggcuggggugugguggcugagccagcccacccagugcgguggaugcucgucggagggcagagggugggcuaccggcuuaaggggccccagggaaccugggggguggagcccaagggguuccaagaaggggcggggccaggaacccauagacaagaggguggggcagggaaagggcguggcaagagggccacccaccuccgguccagagagccagccagacccuuacuuucucuugcugugugaccuuaggcaaggacaugccaccaccggccuuagucucccucuuugugaaguaggaugaagauccccaccuguggagcagauguggggcugcaugguugggucaggauggaacaggauggggaggccgggcgugguggcuuaccccuguaaucccagcacuuugggaggcaaaggugggaggacugcuugaguccuggaguuugggcaacauagcgagaccacccccaucucuacaaaauaauguuaaaguuagccagguguaguggugagugccuguggucccaccuacuggggagacugaggcaagaggauccuuugagcccaggagguggaggcuguagagagccaugcuugggccacuugcacuccagccugggcaacagagcaagacccuaucucuaaaaaaaaaauggaauugaggauguguccucugggugugggcucuaccacccaccagccucccucuccugugggugcugccugccacccaccgcugaggucccugcagcaucaaggugcccaaacgaagacacucuccagcucugagccaggcacccauacagagcccggcagacgccucugcugcugcaguucuuagaauccagagcgcguggggaaugugaauuugugcugcuggagccaaacaucccaccuccagguuuuagcuggaggaauccauguggauaugcaaagcaauguaguuauaaugaauagcaauugugggcugggcgcaguggcucauaccuguaaucccagcacuuugggaggcugagguggguggaucaccugaggucaggaguuugagaccggccuggccaacauaaugaaacuccgucucuacuaaaaauacaaaaaaauuagccgggcauaguggcgggugccuguaaucccagcuacucaggaggcugaggcaggagaaucacuugaacccaggaggcagagguuucagugaggcgagaucgugccauugcacuccagcccgggagacacagcgagacucucuuucucaaaaaaagaauagcagcuuugcuauagcuuaggggagcaaaacccgaaagccaccuuaaguuucccgaagauagagaucccugggguccuauucugagacagagucuugcucugucgcccaggcuggagugcaguggcggaucucagcucacugcagccuccgccuccuggguucaagcaauucuccugcgucagccucccgagcagcugggauuacaggcgcccggcaccacccccagcuaauuuuuuuuuuuuugagacagagucucgcauugucgcccaggcuggagugcaguggcgcgaucuuggcucacugcaagcuccaccucccggguucacgccauucuccugccucagccucccgaguagcagggacuacaggcgcccgccaccgugcccggcuaauuuuuuuuuuuuguauuauuaauagagacggguuucaccguguuaggaugaucucgaucuccugaccucgugauccgccugccucggccucccaaagugcugggauuacaggcaugagccaccuugccugguccuuuuuuuuguauuuuuaguagagaugagguuucaccauguuggccaggcuggucucaaacuccugaccucaugauccgcccgccucggccucccaaagugcugggauuacaggugugggccacugugcccggccagucccauucuacuuuuuagggacauggaaucauguaaagaugccauacagaaaacaguaugcaaauccagagacagaggacaucugugcauguuucuuucuuucuuccuuuuuuuuuuuuuuuuuuuuuuugagauggauucuugcucugucgcccaggcuggagugcaguggugcaaucucagcucacugcaaccucugccucccagguucaagugauucuccugccucagacuuccaaguagcugggauuacaggcaugccccaccaugcccagcuaauuuuuguauuuuuaguagaggcgggguuucaccauguuggcaaggcuggucuugaacucaugaccucaggugauccacccgccucagcuucccaaagugcugggauuacaggcgugagccgccguggcaacccgcaugcuucuuauguauaagaaaaaaacagcuagaaaguuguggguucacuggcugggcacaugguggcuugugucuguaaccucagcacuuugggaggcugaguuaggaggaucaugugaggccgggaguucaagaccauccuaggcaacauagccagacccugucuguaccaaauagaaaaaaaaauuaacuugaugugguggugugugccuguagucucagcuauuugggaggcugaggugggaggaucacuugagcccaggaagucgaggcuacagugagcuaugauugugccacugcacuccaaccugggcaacagagcaagacccugaaucaaaaagaaagagauguauuugccaacacagggguguucugcaguggggugggaaggggacguguaggacuucauaguuuccuuuuuuuuguuuuagagacagggcuuaaaaaaaaauuuuuuuuuuuuuuuugaggcggaauuucauucuuguugcccaggcuggagugaucucggcucacugccaucuccgccucccagguugaagugauucuccugccucagccucaggcaauuuuguauuuuuaguagagacggggugacuccauguuggucaggcuggucucaaacucccgaccucgggugaucugccugccuuggccucccaaacugcugggauuacaggugugagccacugugccuggccccuuuuuuuuuuuuuuaaguagggucuugcuaaguuguccaggcuggucuugaacuccuggucucaaaugauccuccugacuuggccucccaaaaggcugggauugcaggagauaugagccaccgcacccggcccuuuuauaaguuuucuaaaggaaaggaacauguaccaucguguuuuauuuuaauuuuuacauagaagcaggaacaauagcaugaacccccagacacggccccccaagaugcgcuguuccgcugugcugcagccccauuuguccuuuucuauaccauuuuugguuguauuugaagcaaaucccugacaucagggcauuucaucccaaaauacuuccaucuguguuucuaaaaaaacgaggccauuuucuuauguaaccacaacgugaucaacaguaaucaaugcuuaacaucuaauucugggccacguuaagacccuccugauuggcucaagaaugucuuuugugcaguugguuucuugauucuuuuuguuuuuuuugagacagggucucacugugucacccaggcuggagugcaguggugcaaucacggcucacugcagccucagccuccugccucagcgauccuccugccucagccucccaaguagcugggaccacagguuugcaccaccacucccagcuaauuaaaaaaaguaauuuguagagacggggguggggugggggucuugcuauguugcccaggcuggucucaaacuccuagacucaaacaauccuccugccuuggccucccaaaguguugcgaucacaggcaugagccccugucccuggccccuauuauuucucuaacuggggaaagucaugugggaacagauguagcuugccuuggccucugaccggcccugccugcguuccugggugcucucugcugcuucucaugugugccacuguggggacucggccgcccaccccaccccgugguguuaccuugcguguguaguucugugagcucagggcuauggucugccagaacuagggggcguggggccccaguaccagcccaaggccuccucucugcagguauggaccugucugccaaucaggacgaggagaccgaccaggagaccuuccagcuggagaucgaccgcgacaccaaaaagugugccuuccguacccacacgggcaaguacuggacgcugacggccaccgggggcgugcaguccaccgccuccagcaagugagugccucgcucccaccugucaccgcccccaccaccuugccugggcuaccccgccugacccugucccgccaucccccaggaaugccagcugcuacuuugacaucgaguggcgugaccggcgcaucacacugagggcguccaauggcaaguuugugaccuccaagaagaaugggcagcuggccgccucgguggagacagcagguaacacuaaagccccaguucccuggagccguccuggaguccuggagggucuggccaugccguggucacuugguagccccagccaaggccugcucugugcugggcauccccccggacuggccccgcacuguccuacccuggggacugcugugugaccccagcuccuggcccucccucucuggucaccccagccuccaccccacucccugccaggaggcucacugacuccccucuuucugggacaggggacucagagcucuuccucaugaagcucaucaaccgccccaucaucguguuccgcggggagcauggcuucaucggcugccgcaaggucacgggcacccuggacgccaaccgcuccagcuaugacgucuuccagcuggaguucaacgauggcgccuacaacaucaaaggcagguucuccugugggcagcugcugggcagggaaccccucggucggggcuggggucagugcugcggggagcgcccucugcauccacacuggacccuggcuuggcucagggccauuccaggcccuaaagggacaggugucugauggccaccaggggcucugggaugcaagcagccccuuucccucuugucugugugguuggggggacuuaccuugcccaccugacagagagguguguggaggggagagcagggaggggaaggagagcagggaaggggagggaggagagcaggggaggggagagccgggaaggagaggagagcagggguggggagguucuggaaagggugugcaggggaggacgcgccucgguuaugggacuggagccccuucccaggaggacccccaacaauccagaggugccuguuaggauucagaacaugguuuuuuuguuuguuuuuuugagacucacucccucacccuggcuggacugcaguggcguuaucucggcucacugcaaccucugccuccuggguucaagugauucuccugccucagccucccaaguagcugggauuacaggugugcaccaccacgccuggcuaauuuuuauauuuuuaaaauuuauuauuuauuuauuuugagacccagucuggagugcaguggcguuaucucggcucucugcaaccucugccuccuggguucaagcgauucuccugccucagccucccgaguagcugggacuaugugugggagccaccaugccuggcuaauuuuuuuguauuuuucauagagacggguuucaccauguuguccaggcuggucuugaauucguggccucaagugauccgcccaccucagccucccacagugcuggguuuauaggugugagccaccacacccggcuaauuguuuuguauuuuuaguagagacggagcuucacuauguuggcaaggcuggcucgaacuccugaccucaagugauccgcccaccucagccucccaaagugcugggauuacaggcgugagccacugcggccgagcagaacacguucuaggacccuuguucauguguccaucauggacaggaggacgugcgggccauagggacccuggcucauuccggagccgggacuggaggguggggcgucacccuugggaacacccgugcccacccuccgcugcccaggguagggguggggagccaggcuuugggccccacuugauaaaguccccuccccagacuccacaggcaaauacuggacggugggcagugacuccgcggucaccagcagcggcgacacuccuguggacuucuucuucgaguucugcgacuauaacaagguggccaucaaggugggcgggcgcuaccugaagggcgaccacgcaggcguccugaaggccucggcggaaaccguggaccccgccucgcucugggaguacuagggccggcccguccuuccccgccccugcccacauggcggcuccugccaacccucccugcuaaccccuucuccgccaggugggcuccagggcgggaggcaagcccccuugccuuucaaacuggaaaccccagagaaaacggugcccccaccugucgccccuauggacuccccacucuccccuccgcccggguucccuacuccccucgggucagcggcugcggccuggcccugggagggauuucagaugccccugcccucuugucugccacggggcgagucuggcaccucuuucuucugaccucagacggcucugagccuuauuucucuggaagcggcuaagggacgguugggggcugggagcccugggcguguaguguaacuggaaucuuuugccucucccagccaccuccucccagccccccaggagagcugggcacaugucccaagccugucaguggcccucccuggugcacuguccccgaaaccccugcuugggaagggaagcugucgggugggcuaggacugacccuugugguguuuuuuugggugguggcuggaaacagccccucucccacguggcagaggcucagccuggcucccuucccuggagcggcagggcgugacggccacagggucugcccgcugcacguucugccaagguggugguggcgggcggguaggggugugggggccgucuuccuccugucucuuuccuuucacccuagccugacuggaagcagaaaaugaccaaaucaguauuuuuuuuaaugaaauauuauugcuggaggcgucccaggcaagccuggcuguaguagcgagugaucuggcggggggcgucucagcacccuccccagggggugcaucucagcccccucuuuccguccuucccguccagccccagcccugggccugggcugccgacaccugggccagagccccugcugugauuggugcucccugggccucccggguggaugaagccaggcgucgcccccuccgggagcccuggggugagccgccggggccccccugcugccagccucccccguccccaacaugcaucucacucugggugucuuggucuuuuauuuuuuguaagugucauuuguauaacucuaaacgcccaugauaguagcuucaaacuggaaauagcgaaauaaaauaacucagucugcagccccag

SEQ ID NO: 191573 - RNA, 23138 nt, Homo sapiens
agggugccccgcgcgcgcgcgcgccggcaguucggccacgucccuggccacgucgcgggcgaucucgccaucuucgccgcuuccucucaggggccgccgccuccugagccgcccagccccggggccgccgcgcugcgccgaccgccaccgccgccgccgccaugaacauuuuccggcugacuggggaccugucccaccuggcggccaucgucauccugcugcugaagaucuggaagacgcgcuccugcgccggugagcggcgggggaaggcccggagaggcucgggcgugggggccgggucucgccgaggacccgccgaccucggccaccccacggcucgcggggccugcgccggcccgacacacccccucggccggccuaacgggugcccggacccggggggcagcggccugcgggcccucggggugggcuccgggccgggugucgcagcgcgggaccccgcucugcagucgguccccgcgugaacuugagcugucggagcgcacccggcugcgcggggcccugcugugucugaaaaguuggcgugggacgggggguccgacaggcguggccccucucugggcuugaaugggggcgcuucuccggccgggaucucccgugggggucccgggguugcaggaaacccgcgaaucaaugggacgggcgggaggaggaugggcaggaucguggccggcugcgccugacguggcagcccagccagcucgggagguggggcgggcgccgggagaggucacucggcuccccacccugcccgugcaagaccgggcucuaggugugguguaguggggucgggucagaccuguccuuaaguguugugugggcaucacccaagcccuuggguccaggaucacaccgcuggggaggggcuugccgagaggucgucagugauuuucuuggcguaauuaaugcugcuuugggaaacgaucugguuuuuaagugccuccaucuaauaauggguucucuuaaaacugcggcgcccggggaccgccgaggccuccuaugggcuccugcaauucguugcuccacgucaccagugagcuggcugguucccugaucaagaguacagauuucaugcaggcacugcuaggcggcagugaaacgagucuuucccagauaauaguuuuggacuuuuacauuucguuaauuuuaaagguauaauaauugagaguuuuuaacuuauuuuuuuuuuuuuggaggcagggucucgcucugucacccaggcuugagugcagugugugaucacugcucacugcagccucuaccuccccuggcucagguaauccuccugccucagacuccugaauagcugggacuccaugcgugcaccaccaugccuggcuaacuuuuuuuuuuuuuuuuuuuuuugcuauuuuuuguagacacaagguuucaccauguugcccaggcuuuaacuuucuuaaaaaucccuuaaacuuauuuuugaugcucggcaaaauaauuuuuguugaacucaagaacuuaauuuuuucagaggcaguaaaagaugauccugaauuaucugggugcagagacucuauuuaccugauuuauuucuaaaaauuuuggcgucuaaagucacacuuacaucucugaaucugcugucugcaggccucgccugucuccuuggaacauaacugagauccgggaaguaagcaaaaccaaaaagaccuuugaacaguuaagauggguguuacaaaguccaugugccaguguguuugacuuggagguuaucucucaguugauacauaguucugagagguucaacuguaugauuuccagugacagcaaauaacugcugcaguuuggguaagugauguuuaggcacuugcuguauaucaaguagucagccgagugcuuuauauggcuuaucccagguagucauuaaaauaaccuuaggagggccggccgcgauggcucaugccuguaaucacagcacuuugggaggccgaggcagguggaucaccugaggucaggaguucaagaccagccucaacauggagaaaccccgucucuacuaaaaauacaaaauuagccgggcgugguggugcaugccuguaaucccagcuacucgguaggcugaggcaggagaauugcuugaaccugggaggcggagauugcggugagcugagaucgcgccauugcacuccagccugggcaacgagagcgaaaccgucucuaaauaaauaaauaaauaaauaaauaaauaaauaaauaaauaaauaaauaaacgaccuuaggagguaggugcuauuguucccauucuguggaggugggaucugagucuuagggaguggaauaaauuagugauagagccaggauugaagcacaauuaguaacucaaaggauuggauagaugaaugucuaagggagccuaaauaaacauuugauaccaaaccacgauguuuagauccuuuuuuguuacacucagaugauguuaguuuuuuuguuuguuuguuuguuuguuuguuuaaaacagugggaccgaugucucacucugucccccaggcuggagugcaauggcugugucacggcucacuacagccccaaacuccugggcucaagcgauccucccuccucagccuccugaguugcuggguacaggugugagccacagugcccggcgauguuacuuuuaaucuuuaguuuugcuucaaaaucuuugugugagucucuucauuuucuuccauauguuuuucagaauccccuccucuggcaaaucauuaagccuugaagugugcugucuccuaaacuuuuauccaaacuaagauauuugggagaauuuagugcaacuucagaauaaugauuuuuuuuucuuucuuuuuuuuuuuuuuugagaugaacuuuugaucuugugucccaggcuggagcgcaauggugugaucucggcucacugcaaccucugccucccggguucaagcgauucuccucagccuccugauuagcugggacuacaggcgcuugccaccacgcucggcuaauuuuuguauuuuuaguagagacagaguuucaccauguuggccaggcuggucucggucuccugaccucaugauccgcccgcuucggccucacaaagugcugggauuacaggcguaagccacugcgccuggccguuuguuuuuuacuauucacuguuuucauuugagagauucaggagcauauaaggaaaauaugaaauacuucagcuaaaaugcuaacgaaggaagugaaauagaugaguuaacuucguguguguguguuugccaaguauucccgggacauuauuaaauuguucuuguucucagacuuaggaugauuucuguccugguuuguguguuuuccugauuuuaaguaaaucacccagaucauuuauucagaauuaaaugcuaacuuugacaagcugcuuuauuuuuccauacuaaauuauaaaaguuguuuagagucuuuugaaagaguaagaauuugauaugaguuucucaaaugacuggaauaggagaaacgugcauccagauuguguuucucauuuugaaaauacucauaccaagguucauuuuuaggauuuuagcacugauuuugaaaaugcuguuuuagucucggaaccauggugcuuuuuaccccauaaggaucagggaugaggcugacucguguggaagcuggagauucuguguuccucauaggcagauuccagaacagcugccuuuaaggaccguuuuaaagugggggcagugaguugaucauguuugaggcugcauucucuuguggcuguaucugcuguugucauuacagaagggugucaacauggaaugugaguuucuccuauucugaauuaucauugcagcucgauccacgguaugcucaaguugucacuuuauuuuuguccuaaacacugaccuacauaaccucggaagaacaagcggugguuuuagaugaagggcuuccuauucaaauuuuccuguaggccaaugguuauuagugcuguaucuacuguagugcugugucuauuaguaguguguauuacuguagcuaguuaucaguaguguguaucuacuguagcuagaggagucuuucugagauccacgaccccgggccuucccccucuagucugucuccuucccuccuuccccuguugcuuagauuguuguuagcuguuauguagguuguaaacuuuucauccuaccaaaccccauacuggaucuuaugguguccauacauuucagauaugggacaguugauauuuuuggaguaauauaguggguaagauguggaguacuccaagaagcuuuugcuucacauaugcagcucccucuguagcuguuuggccugugcucuuuugagugccagucucugaguaaucauuacucucauuuauugaccacccacuaugugcaaggcacuggcacacaauucagagcagcagcuuguagcuauuaaaaguuuuuguucuuggcugggcgugguggcucacgccuguaauccuaggacuuugggaggccaaggcgggcggaucuugagggcaggagauccagaccauccuggcuaacacggugaaaccccaucucuauuaaaaauacaaaaaaauuagccgggcaugguggcgggcggcuguagucccagcuacuugggaggcugaggcaggagaauggcaugaacccgagagguggagcuugcagcgagccgagacugugcacugcacuccaaccugggugacagagggagacuccgucucaaaaaaucaaacaaacaaacaaaaaaaaaguuuuuguucuuggccggucuuaguggcucaugccuguaauuccagcacuuuaggaggccaagguggguggaucacuugagcacaggaguucaaaaccagcuugggcagcauggugaaacccugucucuaccaaaaauacaaaaguuagccagccgugguggugcgcuguggucccagcuacucagaaggcugaguggggaggauuacuggagcccaggaagucgagguugcagcgagccgugaucacaccauugcacuucagcuugggugacagagugagacugucucaaaaacaaaagacaaacaaaagagagaaaaguuucuauucucaagaaagcugcaauguaguugaaaugauaggaaaauguacaaaagauggccgagcacgguggcuuacaccuguaauuccagcacuuugggaggccgagguagguggaucaccugagucaggaguucaagaccagcuuggccaauauggugaaacccaucucuacuaaaauuacaaaaaaguuacccgggcgugguggcaggcaccuguagucccagccacuagggaggcugaggcaggagaauugcuugaacccaggaggcagagguugcagugagccgagaucgcaccacugcacuccagccugggcgacaagaaugaaacucuugucucaaaaaaauaaaaauaaaaaauaaauauuaaacuuugcugauggacauagaagaugaccugcauguauguucauacuacgguccuggagagcacccaggaaggcuggugaggaagcaagaugacaucucuccaaauugauuucuuaauucagaauaguaucaaagcuaaagacaauaaacugagugaaauaaucuguaauauaccuaagugacaaaagguuaauaucuauaauaaaguacuccuacaaauaaaaacccagcugaaaaaugggcaaaguuggcaauucacugaagaauaacgaaagaccaaugaagcaugaaaggaugcuuagucuugcuaggaguuaggaauuugaauaugaaaauagcagugcggccaggugugguggcagcgcuuugggaggucaaagcuaaaggaucacuugaggccaggagcuugagaccagccugggcaacauagugaaacccugucucuacaaaaaaaaugaaaaauuagcugggcgugguggcgugcaccugugucuuagcuacucagguggcuaaggagggagaaucgcuuaagccccaggcugcagcgagcugugaucaugccauuauacccuggguugggcaacugagugagguucugucucaaaaaaaaaaccggggggcgggcaagcaaagaaaaaagaacagcaguacauaccacuggguaggaaaauguuggcaaggaugugaagaaagggucuuugcauuucguguuaguagauacguaaauuggcauagccuuucuaggagaaauuugacaauaucaaauuuuaaaauguucaugucuuauuuuugguuuauguguuuuaauuugcauuauuugggguuacggauuaaaauuuuuuaauugauacauuaugauuggaucuauuuaugggguacaguuugauguuucaauacauguguauguuguauagucuaaucuggguaguuauuuccgucaccucauguguuuaucauuucuucauucgaaaacuucuaacuauuuuguaauauauaauaccucauugggaagauugcuugagccuaggaggucaaggcuggaagcuaugauugcaccagucuacuccagccugggcuacagagagagaccccaucucgaaaacaaaacagaaaacaaaagacauuuaaccuggcccaguaggauaagacaagaaugauguuguuuaaugacugauuuccauuuaacaaguuguacuccuuaauauagauguuugguguauuugguaaggggauaucaguuucagaaacauuuacaaaagugaguauucugggagaucuuauuaccugguaaccuuagcaugcuuugaucucaaaguggagagaagccgacuaggagcugcucugguuuaauagcagguauucuacucccaaccccuccaggagauucuugccccacccccuucugucuucagcuaggauucccauuuuccuaugaagacaggacaguuuuguuguuuuaaaggaagaagcugcuacuuccuaaucaggaucucaggcuggggaagaacagugugggaccacguuagcauccgcagauuuccagcaaggcuguccugcguggacgcuacuccauggaccggcuucaaaccacacacugcccugugcgcaccuggggcucucucacccucuagcuaguaguuaauuagggcagagcccuauuuacagucacagagacacaguaugaccuggacauucuucagaaguguucucccaaaauaccacaaaaugagaauuugaccccaugacaugaagauaaaaugaaucccauuuucuuuuguccauuuauucauucagcaaauauuuucugaguccugcugugugucagggcccagugucccaugcagggaauacaagauggaauaaggcaugaccccagccuuuaaagaucuugguacugagugagguuuuuggggagaggagaggcaggaaccacaucaucacaguguauuuuuauaaguacuguaauuggagcuagggcagcagcuggcaugaagcaguuccccuuaugugcuugcugaaugaaucaacaguccugagggaggguaucuucagagaugacaucccagaggaggugggauaugagcuggguccccacgggggcugguaaagacaauaugauggucccugguuuucaguauaggaaugcugggaaugaggacacaauuucaaaucugccuggcuuccaaaguucuguuagaguaaaacccuuucccacaaaauucaccuacuuguauccuguauguuuauauuuaaaauauuggaaagaaccauauaggaaauaagcuggaaauugauuucucaaggcuucaacaaacaccagguauggucugacugcucccuguucuuucuucuucccccucugaaaccucccgguuucuugguuagcagcagccuugucauuuccccuuuggaacauuggucucuguaggaagaaaucaguuauccguuacggggaaaagacuaagagcagauucacuguccgugucuccuccuuuggcccuuugguuucuauugauggaucuggaaggguggcaucaacauuuuuuuccauuucuauuuagauguguaugugaauaggcugagacuacaguuauucaucugagaaaguaacauucuuacauucagguuuucaguuucagcaagcugcaaaaugauuguucauaaaauauugaaaaacaacauguaauacaaauauuagccaggugugguggugcacccaccuguagucccagcuacucaggaggcugaggugggaggaucaccucagcccagggaggucaaaggugcagugggcuguacuugugccaccgcacuccagccugggcaacagagugagacccagucucaaaaaaagaaaagaaaaauaaugugcuuuucacguuccagaggaguguugugaaugauuugggugaagugacuuuucuguuaaauucauacuuacuaaaauguguaguggugugaaguaugcauuauagaugaggguggguggguucugacauuuagucagccuucaguuucuuuaaugcauuugcucagucuccagcaucugaaacccauaguuugcguccuuugucacauaaauauuuggccaaauauagaugucagaaaagcugugugcacaccacauaaauguccagccuuccuggcugaguguggcugugccaugcagugcucuggagguggguuggugguuggaaguggaaacacaguuucaaggcuuuaaaaaagacagcugcuuuugaagaccagcuguaguuguggguucauaccuucauguuguccuagcauucaggaacauuuuuauacaaauacaauggaauuucuauuuuauuguaauuaauuuauuuuuugagacagggucuugcucugucacccaggcuagagugcagggaugugaccacagcucacucagccucagccuccuggagucacgcaauccucccaccucaaccucccauguagcugggaccacaggugugugccaccuugccuggcuaucacuuuucuauuuuucguagagauggagucuggucucaaacuccugggcucaagcgauucucccgccuuagccccccuauauguggagauuauaggcaugaccacuaugccuaacugagagggaagcuuuaaaaaucuuaacauauccaaguaauugccgcucuuagcaaagaagucaccaugggaugcgaugccauuauuccagcgggaguuccugcccaacucuuaccugagucggugcuucucaucuacuccucaucccccuuaaugacaguagacuccaucuccguucucaaaagauuucucaccauggagauacuguuuuaccauacaaagaagggaccaggcgacauggcucauaccuguaaugccaacgcuuugggaagcugggcccaggaguucaagaccagugugggcaacauggugaacaaaaaauuuguuuaaaaauuagcugggugugguaguucacaccucuagucccaccuacucuggaggccgaggugggaagauugcugaagcccaggaggucaaggcuacagugagcuugaucgugccucugcacuccagccugggcagcagagggagacccugucucaggggaaaacaaaaaagaaaaaucugaauguaagagacaaguuauaacacuaaaugacagcagaauuauugagaaauuuguuccuacuuaaggugauauauuugagaaguaaaagguucguuugaaugauacacauccuggcauaauaaagccccuuuccuguggucgcccuuuauagugagacagaaaagccuguuagagccucccaaaaggagcauguuugggaaugggaagggauagaaaaacuacaacugcucuuguucauucagagccaucccuagaccugggccuugaccccacgcaccccuccuucccugucugcacucccugcacagugugauccacaggaaucccaaagcucuucaggcccuucuaauacuucccuucuguuucucuagguauuucugggaaaagccagcuucuguuugcacuggucuucacaacucguuaccuggaucuuuuuacuucauuuauuucauuguauaacacaucuaugaagguaugguaugccauccacaggaauguauuucaucuacagugcacaggucuauggacacuuaauuuaugucagcuguguauuuuuaauuaaaaugcuccaaaaauaaugucuuaauaugcuguucuugacuuuaaaacuuucagaccaccuuguauauauaacugggacuaaacgagcuaucaguaagcauacauuuuugguuucaaaacaguaguuaauuaaaauacuuugaaguuagaacuuuuuuauuuuagguuccuuaaguaugauaaaucuaaagcucuugauaacucuguaaguaagagcgguaacuauuauauuuucaagccgugggaaauuacagaguccccagagaaauccagcaaguugguacauaacaaggaacgaaagcaggacuccuaguugcagugucucauuucgcugcugugugaggaacugucuauaggcuucuaucuuuuuucuuugccacugagucaguuuuacuuaaacuguugugugugugucauuuuuauuacauuugccgugcuuaaaugaucucuauaccaucauuuacuuaguaacguauuuuuuuaaaccuuucaacuuguccuaauuauuaguaucuauaacaccuuuguugucuuucuuauauuuuuucuaauucacauuaaaacuaguguauaacuauuaaaauacaaaauguuugcacaccaccuaacacuuuguguagcacugguggcacacaccccacacugggggaaguuguggacuacgugagcuucaguucuuucgcacaguguugaauucaugcuugugaacaccuacagagcugggaacugaggaugcggcagaaaauaagcagaagucucuaggcuggugugggagaguacacagaucauggcaguacaaaugacugcgauuuaugaugggugccacaaaggaaaaguauaagaguugcgaaccuauggauauaaaaaacaugaaacaggcccaguagcucccgccuguaaucccagcacuuugggaggccaagguggguggauugcuugagccaaggaauccgagaccagccugagcaacauaguuagaccccugucucuaaaaaaaaaaaaaaaaaaaaaauacaaaaauuagccaggcaugguggcauacuccuguagucccaacuacucaggaggguaaggugguaggaucgcuugagcccuggagguugaagcugcagugagccguaauugcaccacugcccuccagccuggcagccugggugacagagcaggauccugucugaaaaaaaaaaaaaaaaaaaagaacaggggcucucaggauauguaauaggagucugauuucuuucuuucuuuccuucuuucuacaaauacugagcaccugugcaccaggcacuauucuaggccauuugguuauuagcauacccaaggaaguaauauuucaacugaauccuauugguauggcaccuaaacaaccuccccccaacauuuuguguucaagagcauuuucauaagcacuguugaaaggagacaaagcaguaugugagucuggucuuuacuaaaaagcaaauuugagucacuuauaauggauucuucauuaccaaaugaugggaaccuaguauucaggaaauaaugagcuuacuuaaaaaugguuagguccccacuugucuaggcaaguuaaaacugcaggcauuagaggugugugagcaagaauccucucucccccucaggaugcccagguuucagaggaauccaugcuugcuugguuguaguuucuaagcacgauguccugaaagucuggcgugagacccgaggugcucgugucuuuuuacuuuaacuucugugugcuggugagaggagagaagcagcuguucuucuccaggugcugcuaaggccuuaguggaaauaacgcccaucaaguuuuuauuaauguugagcuggccacagucuagguccuggugagaggccucucugcugugagccuuggcuagaugcgcugagggggcucagugcauguguagauggaugugugucuuguuuaugcauguagauuuuguuuuguauuuauucacauacauggugaggagaucgagaccauccuggccaacauggugaaaccccaucucuacuaaaaauuagcuggguguggcggcaugcgccuguaaucucagcuacuggggaggcugaggcaggagaauugcuugaacccgggaagcggagguugcagugagccgagauugcuccacugcacuccagccuggugacagagcaaggcuccguuucaaaaaaaaaaaaaaaguuaaacuuacacuuaacauaugacccagcagucccaccccuaaguacauacccaagagaagugaaaacuuacauucacacaaacacuuguacgcaaauguucacagcagcuuuauccacuguccucccaaauuagaaaccaccuguccuucaacuggugagugaauaaacaaacuggugcauccauacaauggaccaccaauggacgcagcuauaaaaaggaacaaauuauuaacacuaggcccucacuuaaugucauugguagguucuugaagugaaacaacacacacugcaacuugaagugaaacaacauacacugaagccaguuuuaccauaggcuaauugacaugaguaagaguuaaguuccuacagcauauuuccgguccccaaaacaccaccagacuuuuaaauaaagacccaaaacaggccgggugcuguggcucacgccuguaaucccagcacuuugggaagccgaggcaggcagaucaccugaggucaagaguucgagaccagccugaccaacauggaaaccccgucucuacuacaaauauaaaaauuagcugggcaugguggcaggcgcuuguaaucccagcuacuugggagguugaggcaggagaaucgcuugaaccugggaggcggagguugcagugagccgagauugugccacugcacuccagccugggcgacagagcgagacuccaucucaaaaaaaaaaaaaaaaaaaaaaaccgaaacaaaugugagcuauacauuuauuuauuuauuuauuuauuuauuuuuuauuuuuuuugagacagagucagucugucacccaggcuggagugcaguggcgagaucucggcacacugcaagcuccgccuccuggguucacaccauucuccugccucagccuccugaguagcuggaacuauaggcacccgccaccacgcccggcuaauuuuuuguauuuuuuuuaguagagauaggguuucaccauguuagccaggauggucucgaucuccugaccucaugauccgccugccucggccucccagagugcuaggauuacaggcgugagccaccaugcccagccaacaugagcuauacauuuaagaaagauuaauaaaagcaacauaauuauuuauccaguuuuuggugaauccgugcaugaugguggucauagugguggcggauuaaaucaagaaguauauguuuacaaacaaaaauuauaaggaguaccuccuacuaccauaaaguucaaaaacaaacaauaacaaauauagcaggcucacugagugcuuuuguacuacauuguuuauugugguacauauguauaauuauuguauacuacuuuaugaauuauuuuaccauaguuuguauucauuuuccaacccacuuacuucauuucagggucccagguggccagagccuaucccagcagcucagguucaaggcgcgaacuuucccccaacugcauaggaugccauuccaucacagggcgcgcucacccacacccacucacacuaggacaguucacacaugccaguucaccuaacuggcaucguugagauguaagaggaaaccagaguaucucuggugggagauucuccaagaguaucucuuggagaagacccacguggacucggggagagcaugcaaacgccauggauggcggccccagccgggaaccaguuucuuuucucaucaguguuacaaccaaaggauguuauuggcagaccugcuauacacacaauaaguuugguugccucucagaugcauuaggcuaacugaaauuggacccagaaggcaacauacuaugugacuccauuuauguggcuuucuagaaaaggcaaaacuauggacagagaacauaagugugauugcacugcaggaggugaaggaagccugggggaguuugacugcgaagcggcagcauggcagaauuuuggggaugauggaacuauucuguguccuaauuuugguggugguuaugccucagaacugaacaccuccaaaaaagagaauuuuacuauauuuaaguuuuaaaauuccaaaaacaaagcuaaggaaaaaaaucuugccuuuccaaauacaugggugauuaaaaaagcuggggggugcuggaacaguggcaagguauugacaccugguguuuuuucuuuuauuuguagguuaucuaccuugccugcuccuaugccacaguguaccugaucuaccugaaauuuaaggcaaccuacgauggaaaucaugauaccuuccgaguggaguuucugguggucccugugggaggccucucauuuuuaguuaaucacgauuucucuccucuugagguuaguuuaaaagguuacuuagggccaggcaugguggcucaugccuguaaucccagcauuuugggaggccgaggcggaguucagccuccacuuuggguggaucaugaggucaggaguucgagaccagccuggccaacauggugcaacaccgucucuacuaaaaauacaaaaaauuagcugggugugguggcacgcaccuguaaucucaguuacucagaaggcugaggcaggagaaucacuugaacccaggaggcggaggcugcagugagccgagaucacgccauuguacuccagccugggugacagagcaagacugucucgagggaaaagaaaaaagagguuauggcugggcguaguggcucacgccuguaauuccagcacuuugggaggccaaggugggcacaucacgaggucaggagaucgagacuauacuggcuaacauggugaaaccccgucuguacuaaaaaauaaaaaaaauuagcugggcaugguggcgggcaccuguagucccagcuacuggggaggcugaggcaggagaauggcgugaacccgggagguggagcuugcagugagcugagauugugccacuacacuccagccugggcgagagaguaagacuccgucucucaaaaaaaaaaaagagguuauuuaggucugggccugguggcucaccacaccuguaaucacagcauuuugggaggccgaggugggcagaucacuugaggucagagguucaggcauucagccuggccaacauggugaaacccugucucuauuagaaauacaaaaacuggccaugcgcaguggcucacgccuguaaucccagcacuuugggaggcugaggcaggugggacacgaagucaagggauugagaccauccagcuaacacggugaaaccccgucucuacuaaaaauacaaaaaacuagcugggcgugguggcgggcgccuguagucccaguuacuugggaggcugaggcaggagaauggcgugaaccugggaggcggagcuugcagugagccaagaucgcgcuacugcacuccagccuuggcgacagagcgagacgcugucucaaaaaaaaagaagaaagaaaaucaaaaauuagcugggugugguaucgcacgccuguaaucccagcuacucaggaggcugaggcaggagaaccacuuaaaccuggaggcggaaguugcagugagccgagaucgagccacugcacuccagccuuagcgacagagcaagacuccaucuaaagaaaaaaaguuaauuucauggucaugucugguuaucuagaauggaccuauuugcauguuugcagaucguguagguuuucauggaguuuuuuguuuuuauuuucugguuuggcaaacucuagugcaauguucaugacugguguaaaaaaaucguagaugagaauuaagcacccacauauuuaggugucugcugacaguuuacugucugauucauuugaaauagaaacuugaaacuguauuucauuaucuugacuucagugguaccaaacacagagcccugccugucccagugugggaagaacaaggucucccuccuguagcccacauuuuguuugcuuuucauguacagaugugcacugaugucgugucugugacccugcuuagcagcacucugcaccucuugccuuuaggaaagcugguuuguggugccccuaguacugugcagugagcugaucugcuccugagugccucuucuuucccugcugaacaggcaaacggugcugcuucacauccuggggccgaucaagucacugugcuacccugggugucugaugggugcugggagugccuggacuuuucuuuuuuuuugagacagagucucgcugucacccaggcuggagugcaguggcaugaucucggcucacugcaaccuccgccuccuggguucaagcgauucuccugccucagccucccgaguaggugggauuacaggcacccaccaucaugccuggcuaauuuuuguauuuuuaguagagaccggguuucaccauguuuuccaggcuggucuugaauuccugaucucaggugaucugccugucucggcuucccaaagugcugggauuacaggcaugagccaccacacccagccaugccuggacuuuuaaaauacucaaggacccucugaaaguccuucuaucaucaucgugaauaaagucauacgcugggcagagaauuuccauaauuacaguugugacuucuaccccuuugauuuaaccacaccagaaagcuuaaggaauaagaaaaauagugaaaauauuucaguaguuuggcaagaucagucagugaggaaaaacagcagugaggaaguggaaggagcuuaucaauuaucaguauugucaauccuggcggaaagcaggguugauuugguaucccagaucuggagcaggacaagcuuguccaggagaaaccucuguauguagauucauagaaaauugaagagggaagaauaaaccuggagagacaaggugaugaaaauucaaagagguagagguguccagguuacccagcuugucacacuggcagugccuugccucuuaaagguugcuuaaguuucugugauuuaugccaggaguccucaaccccugggccacugacugguacugguucauagccuguuaggaaccaggccacccaggaggagaugagccgugggugagcaagugaagcuucauuguauuuauagcugcuccccaucacucacauuacugcccaagcuccaccuccugucagauaacuggcagcauucaauucucauaggagcaugagcccuauugugaacugugcaucugagggaucuagguugcaugcuccuuaugaaaaucuaaugccugaugaucugucacugucucccaucacccccagauaggaccaucuaguugcaggaaaacaagcucagggcuccuacugauucugcauuaugacgaguuguauaauuauuucauuguauauuauaguaauaacagaaguaaagugcacaaugauugcaaugugcuugaaucaucccgaaaccauccauccacccugcuggucuguggaaaaauugucuucuaugaaaccgaucacuggugucaaaaaggcugggaccacuggguuaugcaguugccaagcuguuguucuauuuugggccgacaugccccacuccccacucaucuuaggcugcuuugugguaaagaaagcaagaguguuuccucugagcuccuggugggcagugggucgugauggaagcuugccauuucucuuccagauccucuggaccuucuccaucuaccuggaguccguggcuauccuuccgcagcuauuuaugaucagcaagacuggggaggccgagaccaucaccacccacuaccuguucuuccugggccucuaucgugcuuuguaucuugucaacuggaucuggcgcuucuacuuugagggcuucuuugaccucauugcugugguggccggcguaguccagaccauccuauacugugacuucuucuacuuguacauuacaaaagguauguugggugcgaccugcguuguuucuagagugacguguucuuuuaggagugcccuugcccagcacucuucuaaucuggcacucucucauaaacuggcuccagagaaacacuuucaugauuggccaauaacauucuggaucaggauguugucuuuuuaaauauaagaacccuuuuucuuuugcaauagcuuuuccuaaagugacacauuuucacuguaaaagauucaucugguguuucagugaacauuaacaccagauaccucucuaugcauacacagacacaugacuuaaacuguacauugcuguucuauacacugcuuuuauccccucacauuuuucaugucacuagaaaucuacauaauuuucaguagccacagaguguuucauuaugugcauguaccauaauuuauuuacccagcccccauucauggguggucaggccguuacugguuugcuguuaaaauccagucauuaaaucagcauccuuguguauauguguuuuugcauuuguaugaacauaggacgugugaacuuuacaaauauuugaugaaagcuaucauccuuguucagaaaaaaaaaaacauuuaugccaggugcaguggcucacgccuguaaucgagcacuuugggaggccgaggcgggcggaucaugaggucaggagaucgagaccauccuggcuaacacgugaaaccccgucucuacuaaaaauacaaaaaacuuagccaggcgugguggugggcgccuguagucccaguuacucgggaggcugaggcaggagaauggugugaaccugggaggcggagcuugcagugagcccagaucgcgccacugcacuccagccugggugacagugcgagacucucucucucaaaaaaaaaaaaaaaaaagauauuuacgcaaaugcacccaaaugcauguauauaguuuugagggguucaggagccccugaaacccaaccacagaucccaggcuaaaaauccagcuauacaauaaaauuccuaaugguggaauugcuagguaaaaagcauauauaggucgggugcgauggcucacgccuauaaucucagcacuuugggaggccgagauggguggaucgucugaggucaggaguucaagacuagccugaccaacauggcgaaaccccaucucuacuaaaaauacaaaauuagccgggugugguggcacauggccuguaaucccagcuacuuggggggcugaggcaggaaaaucucuugaacccgggaggcagagguugcagugagcugauaucacgccauugcacuccagccuagggaacaagagcaaaacucugucucaaaaaaaaaaaaaaaaaagaaaaaaaagagcauauaugucuuaucucuuuccuuuuguuuuuuuugagaccgagucucucucacccaggcuagaaugcaguggcuugcucucagcucacugcaaccucugccucccaaguucaagcgagucugcugucucagccucccgaguagcugagauuacagucgcgcacuaccaugccuggcuaauuuuguuuuguuuuguuuuguuuugagacugagucuugcucugucacacaggcuggagugcaguggcgcaaucucggcucacugcaaccuccaccuugcagcuucaagugauucucgugccuugaccacccuaguaacugggauuacaggugcgcaccaccacgcccggcuaauuuuuguauuuuuaauagagacgggguuucaccuuguuggccaggcuggucuugaacucccaaccucgugauccgcacaccucagccucccaaaguauugggauuacaggcgugagccaccacgccuagcuuuuuuuuuuuuuuuuuuuuuuuuuuuuuuuuuuuuuuuuuugagacagaguuuugcucuuguugcccaggcuggagugcaaugguacaaucuuggcucaccgcaaccuccaccuccuguguucaagcgauucuccugccucagccuccugaguagcugggauuacaggcaugcaccaccacgcccagcuaauuuuuguauuuuuaguagagauggaguuucucuauguuggucaggcuggucucgaacucccgaccucaggugauccuccugccucagccuccccaagugcugggauuacaagcaugagccacugugcccagccuaauuuuuguauuuuuauuagagaugguguuucaccauguuggcuaggcuggucuugaacuccugaccucaggagauccgcccaccucugccucccacagugccggaaguauaggcgugagcuaccucacccugccauccuuuguguuuuuuuuuuuuuuuaucuuuuuaaagagacagggucucacucuguuacucaggcugcaagaaugcaguggugugauccuuccucacugcagucccaaacuccugggcucaagugauccucccugcucauccuccugaguagcugggacuacaggugcaugccaccacaccugguucuuuuuaaaauuuuuuuuuuauagagauggggucgcucucacuuuuuuugcccaggcuggucuugaacuccuagcuucaagggauccucccacccuggccugccaaaguacugggauuacaggcaugagccacugcauccggccuuuauguuauaguacccagaauuucauaggccucccuacauaagcuauauuuuacuauauauugauuagggugaaagucauaauaacaaaaagccacuaugaauuuaguggcacuuucaaucaaauuuguauuuuuaaaauacaauugcuuauuuccuauaccuuacuauguagaaucuugugugugggagacuucuaggaaugggaagaaggaagcuaaguuugucaauaucaguaaccuuuuguuuucuuuucuucucuuugaaauucuaguacucaagggaaagaagcucaguuugccagcauaagugccaaagaccaucaccagcaucuguccuucagggugcucggacagaauucuuaccacagcaaaggcauaagaugcuugauacggaaaaucagaaacuuaacucuuuuguugcagauagucaucaguggcucuguaaaaacgcagaggaaaagagccagaagguuucuguuuaaugcaucuugccuuaucuuuuuuuauuacuguguacaaagauuuuuuuacacaaagaaacuuaaugcuguauuaauaaauucaguguguagcuucaauugggauaguuccaaaagugaagauuuugugaggaauaagugcaaauuuuuuuuuuauuuuaaaaaauucuuugaaacucuuaagucuuugugucugcaaugaaauuguacuccuugacaguugauagauuauauauucuuccaucccucaaacuugcauuccacuauauuuauuuuuuggcaaaagaugagcuguauuuguuugaaaucugagacacuauguucaauuggauguaucuguucaaauuuauucccacgugacguggaaguccuucguuggaugucacaacacuacauuuaagguugguaaggaugacuuggagguccaugguuuucauuaccaacauuuuaagauucugaaugucgauggagucucacugaagagucaccaaaggugccugcccuccuccccugcugggaagugucaguuggagacugucccaagggugcugaagaauccaguggcagggguucuggcugcuuuccaucugagugugggaugggagggguguucaugaucauuuggauauagcaaucuacucugagaaauggaacacaaggaguuaccuaucacuuucacuuauaauuccaaaagaugacuacaaccauguccaugcucagauucaaacaguuuuccauaucacuuuugggugguaagaugauuuaauuacaguuuuuuuuuuaauuggcagcaccacuaaccauuccuuacauucuuuuuuguaugugugguuuucuuuuuauuuaacccgcagccgacaucguaguuucuuguuuuguuuuguuuuacagagcuguugcaugacuuauguuaccauccuaaaaaacacuauauuaaacauggaauaaauugucuuuuuaugaauuaggcuuuuugaacauccuguguugggauuuuuuuguuuuucaauuggcaacaaaagcucuguagggcugcagacauuuaaaguucacauaaucaucuguaagacauuauguauuuuguggaaauacuagaauuuuuuuccugauuuugccauuauauggauuugcuauuuuuugauuaaugcaaaaguauaugacuuuguuuuuuaugugauacaccauaaauauuaaaguguugaauacuaacagugcugacuacaagaaggauguaguauuuuggcuuucugcauuacaacgucuucuggaggaagggagcaggauggguuucauuuguaucuagugugugucuuaacaucuuucuaaaucggcaguguaacugcauaguuuaacuuccugucugucucccucauuuuacucuucccuccuugucuuauguuuuggcuuuuguguaucagagcaucuuucuuugcagcauccuagucuugcuucaguuucuguggucucuuuucauccugcuugaagauucggaguguggaaggaggcuaggaagucuggugcaguaggugagcagaccucuugcugcccagcccaggguggguggggcgcacaccugucuuugugcaugcaaaucugauacaccuggcgcauccucuggagagcacaacgcauggaaaggucuggaagcucuguguagccauuccuucugcagucauccuacccaaguaaaaguaaccuuggcuauguuaccaccguuuuggucacccaggaggacaucuuagcaagggugccugcgagggagugugggacugggccucauccucgccggcguuggaaaccaaggccuuguaugccacgccuuaugaagcacuguuucacaguuacuuucacuucccgaauaaagguuaccagguaauuaauauuuuua

SEQ ID NO: 191574 - RNA, 14008 nt, Homo sapiens
uuucuuaaaugcuuucauuuauugaaaaaaaaaaaaaaugcccccaaagcacuaugcuggucaugaacugcuucaaaauguggagguaauaaaaugcaacuguguaaaaaaaaaaaaaaaaaaaaaaguaauuauggacaugcuugccuauguggaaggagagguuuuuuguuauuuccuuggggucuugcuaaguuuuccaggcugcacuagaacucgugggagcaauccuucugccucagccucccaaguagcugggacuccagggagagauugguguuugcacggccauagguagauagcuuauuuuuacugcuugccaacaaaauugauccugaagcccaacggccuuaugccaaaugguucccuccccacugcuguccauccugggcugccacucccaaaacugccaguaccaggugucacugauugacuagucaaauuccuggacaaaggggcuacacacuccaggcugguuguggaacuuuuguuuugagauggaguuuugcucgucacccaggcuggagugcaguugugcguucucagcucacugccaccucugccuuccugggaucaagcgauucuccugccucagccucccaaguagcugggauuacaggcauacaccaccaagccugguuaauuuuuguauuuuuaguagagacggaguuucuccauguuggccaggcuggucuugaacuccugaccucagaugauccacccaccucaccucccaaagugcugggauuacaggcaugagccaccaugcccggccugguuguggaacuucacgggaauuuauuuugucauuacaauguuggcaagauauuuuuuucgugugcuguaaacugagguucugucuuggaguuuaugucaugucaccagguccugugcugaagggcauuugcacaucuuuuguggcuucucucaggaaaaugugggccuuggcgacauccaaugcuagugcuauuccccuucuccccuagaguuacagaauuauaaccaccaggggacaccuacaggccaggccaggccaggauccuggugcugcuucagccuacuguggccuggaagggucccugccugcugaggccuaagauccugacuuggcuaaaggaggggagggggcaggcugugguaucuaggguccauccccgcauccugcucggugccaccugacagaugucaugccccagguagguaugugcccugaaccuugccgggugcacgugccugaacguggcaccguacccagcuggguaaaaacggcucgagcacggaagccaaaggauggauugccaaaacaaagauuacgauaaugucaaguuuaaucugccaaauauacaaguugaauuuguggagcauguuuugccugggugccacacaguaaacagagguuucuugaaaugaucaauggguagggcugaaaaugggcacuggcccuagccaggugaguaggaaccgggcagggaagggcagagaggugaggcccugaggucagucagacaggacugaccagggacaagccaugacccucgaggacccaggggcacaggcucccagaugauagccccucucugaaugagcacccaggcaacacaguccggggcuguguguagcaaaccugucagcagcugccuccugggacaaccacccccuuacaugcuaucuaucuaccagacaaaugaaagcucuucuuaccccaucucccaggcaccccccagcaagggcucugaauucuaaaaacagcaaaaacauucaaaugguuacauaugaaaugcuguccugcaucuuucugucucaaagauagcagcuaccccucccccaguccccccccccaucccccaaacaauuucugugccaagaugaagaggaggccccaggccauggggggcuccuggccaugaggggcuguugcagcggcgccagggcacagggugggcgagacacagcagagguccuggcagcgcggcccagguccccggcaucuccucccacgggucgcaguuacuuauucagggagagugacugcauucguuuuccugacaauguggcaucgucuuuugcugaggggugggagaagggcagggguuaaaacaaagcaaccccccacccccucccaacacacgugccagaacccuagaacuuuaggucugaaaggcugcagaaaacauucugugcaacagagaagagccgaggcgugggagaggauuucugcugcagcuguaaccccgggccccccgacauucccgacacgcuucaguggccagaccaccuuauagaaagcuguuccuuccacaaagccccaccaacacacacucuugugggcaaacggaaacuucucaccccaccucccagcagaacccuguaauucuaaccucccuccacggguucugaagucuaaaauuuaaacauuccaacaguuacaugugaaguccuuuccugcuugggguuugugaagcaggguugaaugggaaguugggaucacuggauuucuggugcgggugacaaugucccugagcaauugguuuccccuuuccaggccugcuuccucauggucuggugaggaggcaggacagauggacauguaggggcucucacagacccccgggagauggaauguugcaaguugaaugcuccuauaaacuggaccaacucccauagccacucuggccuagaggaaccuccaccaucucuggccugccuggaggggagagcacaggaaaagggaugccugggcuggaugucaagccagucugcacugcuguguauccagcucacccucccaagcccugcagauggacagcggugaccucaggcaucucuccuggguucccaaggcaccagagaccuuagugggaccugugagccucaggcaaggucuguacuaggggcaugguuuccugugaccucccgcuguugggagcaggagugacuguccaccuacuguggacggugcucugcugagacuucaaccuacauccgaccccaugaugucgcuggacccuccugguccccgagggaguggcaggcacagggaggguggcccucuccugaacgaccuccuaggcagcagucacuccucaccucauugucaccucgcggacagggacacgaguucagugcuuuguggcuggcccaggaccagaguuggggccugucccugcgugcgcagcccagcccuuaccuuuccuuuccucuuccuucuuccgggcagccuccucccgcuguuuccggaugauggccagccgggccaggucagccuuggcuugcucugucuucccggccaagugcauuuucauguaacgcucuuuugccuucugcuucucaaucucuucucuguguggauaaaauggugucauggggacaucuuuccuaccacuguuugccaaacuggacgggagucagaauaaaggccaaggauucggccuagggccgagguggaaggggugcccuggcugugagucccugccuccaugaacccccugcuugguggacguucaccaagcaagugagcaggagggagaggcccagggagaaaacaucugcgauguccagaaagccucagagggaaaggggacaauguccagcuacagcagggaggggaagaugccugagggcuucaugaucaggcucuggcggccauggagagaagggggaccaggccaagaguguuccagagaagaugaccaggaggaugaaagcaguggggaccacauccuacaaggaaggaagggcugggcaugguggcucaggccuguaaucccagcacucugggaggccaagacaagaggaucacuugaggcuguaaguuugagaccugccugggcaauauagcaagacucuguacaaaauagaaaauuuaaaaauuagccaggugugguggcacacauggcuaaggcagcauggcucccagcuacaugggaggcugaggcaggcggauugcuugagcccagaaguucaaggcugcagugagcuacaauugcaccacugcacuccagccugggugacagagugaaauccuaucucuaaaaaauacaaacaaaaaaaggaaugaagaaguggaggaagcagccacagggcauaggaugaggaccacagugggaaacagacacacccagucucaggucaacaccacauggcccauucuuagagcagcucagaugugcacggugcugccccccaaggggacagcccccaucaguagggagaugggaauaauugcugggcucccaugggacaaagugucaggaaugaacccccuaaguagagucaguggugagggucauuagcuuccuuuugaggaucuucccaagcuugagauucugaacuggaguggaugcccuucaggaugagaucggagggccuauuugcacuggguuccuggaagagccaagugcuggaggaggggagggcccugccuggcaggaggcugggagagagacucggccucccagaggccuucaagguacacagaacuggggaguaaugagaaaccaggcaugggagcuagcuagaggggagggagagggacucccgagugggaagagcagaugccucacuacagagcugaggagauaauaccuggcgaaccgcagauccuagcucaggagggaugugccacacucagaagccucuaagcugagccucaggaaugaugacuaaggcagcccaaagacucugcagggcccuucagugaaagcaaaaugccaggcagggugucucugcaaccccaaaggacagaaggagggagcaacaggaucccuuuuacuggagaggacacugaugcccagaaaggcacagccuuaucgaaggcugcacagcugccaauggcagaauaccacaguggcagaacacccagguugcuggguuuuugaagucaaugccaagaggaagcuacugaagggggacagaaggguccuuagcagcugcaaucacacccaagcucauggccuuccccacgaggcuuucacagacacaccccucagccauuauccuaaauucccagucaggagagaaacuagcaggcuucaaccucuuguaaggcccuugaggucaccugguggcugccaaaagucagggcaccagucaaggacugauccugugccaggcacuucaguacaugaucuugauccucauacgacucuugaggaagauauuuacagcuucauuuucacacaggacuugcagaggccugggacagcuggcugagcugcgcugggcuggacugccuucuggccggcacaggcucgcagcccccuuccaguccccauggccacgacauuacagauggaugcaggucaggaauggucagaucagugggguaagggaagucuccccaggguguggugcucuggaagaggggaauggagggcaacccucuguauccugcaccauuaccucaaguguuaugcucaggucugagccuguuguccuauuuccccugauaucauguaucaauuggugaaaacaaauucuguguggcuuuuuaaaggcuacuggagggccauuggggaaugagacagaaauaaacagccacagcucccagccagcuggggaccuuagcaucccacaggccaacugcuggccuguauuccccgugacacaaggcccagccagugauguuaccguucucuccucgaaagcuccuuuggcccguccagauccaguugugugaccuuuuugguugucugugccacccgguugggguucucgaugucgaugagcccuucaacgccuuugcgcuuuugcuagaacagggcaagaagcugguuguuggaguucagguccuguggagccccugagggccacuccugccaucucucaacagcccaucuggaugaggacaaacuccugcuccaccccagcccacguagugcucagcccaagucucacaguggguauagcucucuggagcaucuucaucagccugggaagagcccacagaacggcugcucggggucgaauaacuugcccaagucaaccaggaaguaggugguagaugagaggugcgcccuaccccgacuugcaagcacucacacagcacuacuccccuacuucaagcucggcuuccaaaagcaguuuuccauggaaucccaugccugauucuucuugcaaaaagcgcugggcuggaauccccagggcagggugggccaagugugugcugucaugacuaauuccaauucccacccaccuuagcugauggacuggacuuguaacccaagaauaagcuacuggaucacacacucuacagguuugggacgcuggcccaaaaaccuggaaucugcaccuuccaccuccccugcagaaguuccagaagaaggggguguguucucaaugcagcagguuuggucaaaguuucaggcccugucaauuccaucaauucuccuuaagggggcagggagacagcuuccacuccacagagcucccuccacacacuuccaguccagcugcacacuuacaccuccacucagaugccuggcacuguaaacuuaacauguccaagacagaacucgagauucauccuuuacccaaccggacccucccugcaauccuaagcauauccuugauucgucguuccuucagcaacccccaaauacagcuuaaauuuguccacucuucuccacugccauugucaccauccuagggcaagccacgauuuuuuuucuuuugagacagaguuucccucuucuugcccaggcuggagggcaauggcacaaucucggcucaccacaaccucggucuccuggguucaagcaauucuccugccucagccugaguauuugggauuacaggcaugaaccaccacccccgacuaauuuuguauuuuuaguagagacagguuuucuccauguuggucaggcuggucucgaaaucucgaccucaggugauccgcccgccuuggccucccaaagugcugggauuacaggugugagccaccacacccggcccaggauuucugaucugaacacugcucuuacucucaacauccuaucauucacucuccaugaagaagcuaaaauaaucuuuuuuuuuuuuuuuugagacggagucucacucugucgcccaggcuggagugcaguggcauagucuuggcucacugcacuccgccucccggguucacgccauucuccugccucagccucccaaguagcugggacuacaggcgccugccaccacaccuggcuaauuuuuguauuuuuaguagagacgggguuucacuguguuagccaggauggucucgaucuccugaccuugugauccacccaccuuggcuucccaaaguaaaauaaucuuuuaaaagcauaucuggaggcugggcgcaguggcucacgccuguaaucccagcccuuugagaggccaaggcaggcagaucacgaggucaggagauugagaccauccuggcugacauggugaaacgcuaccucuacgguagucccagcuauucggaaggcugaggcagaagaauggccugaacccgggaggcggagcuugcagugagccgagaucgcaccacugcacuccagccugggcgacagagagacuccaucucccaaaaaaaaaaaaaaaaaaaagcauaucuggucaugucucucaaucccuucaaggccucccccagcugccacuaccuaccauaaagaaaccccaugccaggcaugguggcucaugcugcugcaaucucaacaccucaggagggugaagugggaggauuacuugagcccaggaguuggagaccaccugggcaauauagugagaucccuaucucuacaaaaaauuuaaaaauuagguagaugugguggcgugugccuuuggucccagcuacuuggaaggcugaggcugcggugcuucacugcagcuucacuccacuccagccugggugacagaacgagacccugucucaaaaaaaaaaaaaaaaaaaaaaaaagggggcugggcuaguggcucacgcuuauaaucccaguacuuugggaggcugaugcggguggaucacgaggucaggagauggagaccauucuggcuaacacagugaaacccugucucuacuaaaaauacaaaaaauuagcccggcgugguggcaggcgccuguagucccagcuacucaggaggcuggggcagaagcgcuugaaccugggaggcggaaguugcagugagcugagaucgugccacugcacuccagccucagugacaaagcgacacuucaucucaaaaaaaaaaaaaaaaaagaaaagaaaagaaaagaaaugccaaccccuucaacagcuacacaggaggugcccuugccaauucuccuccugcaucuggaccacuccgcuccuuacccacuaacucacagcuacacuggcccccuucugguccuugaacaugccaagcuuauucccaccacaggaccuuugcacuugcuaauccaguuucucaauugcucugcacgccaauuuucacauagcuggcugcaucuuguuuuuucagaucucaguuuauaaguugcuucaccaccacaacacuuuuccaaguccccucaaucacagucuguuuuguuaguaacacuucucauuacuugaaaugacacugucuguuuacuucuuuguuguaucucccguaguguaaacccucaagagcaaggacguugucugcaucuaccuuugggacuaguacuaaacggucacucaacguuuguuuguugaaugaaugaguccaggcucuaggcccucaaaagaacucaguaccugguagucaucuucuucauccucacucucaucugagucuagagauuucuucuccuuuuuggggucaccugcagccccaucuccaccuucuuuuugcuccucuucuuccuguuucagaaauggacaaccugcagaaucaaaaaugcaaaacaaauccccaagacugugacccuaucaccccccagacuguggaucuugagaaaucaagccucuggaaggcuggaaccaaggaugacaaggguccuacugugacccuggcccccagggaaugggaccugggccagacacaggcagccuaugcacuuagcaccacagcuuagaggccauucccauaguccaggaagccccucacacagccacagaaggcccugcuccccuuccuaacgcagccaccucagcagccagggugagaagcuuguuuccuggggucagaaggacucagccaccaggcugaaaaccaccauccuacucagcucccaccugccacaugcagcugccaaaucaugcuggcauucccaggcgaguccucuccgcacuccacucccacuccauggcaagucauccccccgacccacccacacaggugaccuccugcaccagcuccccagaacaacaccucggaaggcugcuucccuccaccuuucuugccuucccaccaaaaaugucccuuauaggaaccucaugucccuucaccucuuggcaccugcccacacauucuccauguccugcucagcugcuggcucccccaaggaccccucccagaccccacagcuggauguggccuuucccuucuugagacuccugggguacgucacagcuguguacccaucuggcccugacugcucccuuaggcccuugauccaggcaucaaucuaaugauaugguaagaugcagaugcugacgaugggaauguauucuauuuccuaacgguggccuggacaauguacuaugggagcagaggagagggaacuacuaaaucagcucuggcuggaggugaggcaugagucacagaggaggagaggcuaaacaacgucuccagggauggagagcaugcugaugcugggggugugggaaggcagggcauaugucaugugcaguguggcaaaucauccuguguggcugcagcagacaagcaggggugcugggagcucgagcugugaauggacagguccugcaggagggagauccuccugaaaguaggugcacaagaccaagaacagggccccacuaaagcagcugcugcagagcagccacaguucuuucuaacccauccaggcagaggaugcccacgcccugacugucauugguuguucugagacucacaccuggggcucacugcccgcccgacccccacgugcuggcuugucccugcgaauggguaguccuugccuggccucucuaugaaccaaauuggcaaagcgccacccugggccacuggcguggccuggacaggcacguacucacccuggccuucugcuucucagccugcagcugcgcgucgaucuccucagggcuuguauacugccucgcccggccuuuguggccucccuuucuuccugcagagacccgcaguuuaggugagcggaagcagcugccuugacugcucugacccccagagggcuguguccugcuuggaguacucucaucggaggccucaccuaccccucacccagcaccacccaaaccgacaccuccgccacccucauguguucaaaggcacgcaggaagcaacucgugaccaucugaugcaucaccaaacuguguacuaaaugcuggcuccuacacagaagaccggaggggagaacauggcggacggugcacugcaaugacuugcuacauccccuggucccuuacaauccaagcauaguggacucagaugcaaccacagaaacauguaccacuuacaucccugccgucacuauaagggcuuuuuacacgauguucugucacagccaggggcacuuuuuuuuuuuuuuuuuugagacggagucucgcucugucacccaagcuggagugcaguggcgcaaucucggcucaccgcaaccuccaccacccugguugaagugauucuccugccucagccucccgaguagcugggacuacaggcgugcaccacuaugcccagcuuauuuauuuauuuuuaguagagaugggguuuaaccauguugguuggcuagaauggucuugaucucuugaccucgugaucugcccaccucagccucccaaagugcugggauuacaggugugagccaccgcgcccagccagccaggggcacaguugauccucggaacaaaccuaugguacaggggugauagcuggucccauuucauagaccaggagacuuagaccaaagcagacugcgaaacaccacgaaguuuagaguccaacucccagguucuacgcuuacuggcuugaugacuuugggcagguauuuaaccucucagucucaguuuccucaucugugucccuaccuuacaggguugucacaaagauagaugaauuaaucaauauacagaaagcugcuggaacagugccugcuacugaauaagcacuacaaaaauguucgcuaauauccaggcacaguggcugaugccuguaaucccagcacuuugggaggccaaggcgggcagaucacuugaggccaguucaagaccagccuggucaacauggugaaacccccucacuacuaaaaauacaaaaauuagcugggcauggugucacauguuuguaaucccagcuacuugggaggcugagaaaggagaaucgcuugaacccaggaggcagagguugcaguagccgagauugagccacugcacuccagccugggccacagagcgagacuccgucucaaaaaaauaaaaaaaucgcuguucguuacuuuucccucuaaucuaguauuugguggaaaaacaacaacaaaagcaccacugagcacauaagcaauuuacugcagauguuggaaacacaauaaaauaccuuguguucaccuuaguaguauggcaaaaagagaauacuuaagggaaaaaaaagaaacccaaaccuacaggcaaaaacuuugugcuuagacuaagaaaugacuggcaaaguacagaugaaaacaaaccugacuacacagucuaaaaguuaaaaaugugacuagcaguuaaagugucaguuuuauagucugacccucuucagccagaacaccaggcugacccuugcuuaagccaucagccaguuuuaaagcaagguggcaucccccucugcugguccccaaguaugcaaggguggcuguggccucaacuuccacacaggaagcugaggcccaccugauuuccauagucugucucugugagcagagacucuguaaucagccagaguugcucugcacuccagaggcgguagcagagauacuggccuccucugauuccuuacagcagcugcaaagccauaauugggcugcuaaagaucacaccacccauuuuuaaugacuaccuagguucccaggggugucuaagucuaugcuuauuaaaguccuauugugagagagcaagugugccaagaaaaaaaccaacacccuuucuugcucucuuaauacaccaggcaacaguaacaacucaaaauugauuacuauaggcucuccucucaugcacuuggcuaugggacccugaccuuagcuugguccacaguaauuuuauaguagacucuucaagacuuuaaaaaacgauuugcacuuaacauaauggaaacaagcguugguccuuugcucuuagggaguuugauacuuuuaacaccuucacgguuuuuugugguuuucagauuaacccaagaaaauguaaaccuugucuaccccaaaaagcuuuucacaagcccaaagaccauuuagcuaugaauucauauuuaagguuuuaucguuguaaccuccaaccuuuacccaaaguauccauuaaguaaaacuucggagggaggauggcucauucagcaaccuccuuuuacagaugaagggacuggggaacaauagcagagagacuuuuccagccacagaauaaaucaguagagagcuagguuuaaacacauuuagcucuguaaugcccaauuaucucuggagucaggaagcgauuuagguuugaaaacgcuacaggcagauguuucuguggguugagugcauuaaccaauauaacacaugagcuaccaacacaaauauauuuguucugugccaggagguggccaggcacuuuaugagcgcuauaauuuuaccaccccggccccaauucaacaagcuaaggauuagcccaguguuucagaugaggaagagguuaacuuguucagggccacagaauuagacgugacauagcugggauucaaacuggggacuaucgauucuaaagggggaaacaggauagagaacgggcuagaagauagaggacgggcuacaauggacugggcagucaugaaccuacuuacaagaucaagagcuggcaaagccuuaaaaauaagaauaguuacugcuucacugggcacuuuuaacgacugccuggcacuguacugcgcacuccacguggauuaccuaguugaagccucccaacaguacuaagagguagguacaaucguuauucccauuggcaaaugagaaaacggagacacaggagguggagcgacuggcucaaaggaacacaccgagccgcuaccgaacgggggagucgaaaccaggucuggaaggcucaugggcaucuccuuaaguccuccuaggcaggccuggcugaaccgaagccagaaaaagcccacguuuuacgcgagaggcaggcgggcccggcacaagcgcgggacgcggugacucaguuccuagccagccaaagagugggauaaauuccagaaccccuagacccggagaagcgcauccuagauccggcuuucuaggccggcgaggacccagagcuuccgaaacuccucagaccacugacggagugacucugggacaccacaguccucaguuuccccaucgggacaauugggcgucgaggcccaggccuggcucucagccggugcggacagccucccucugcgcugcucucagagacgcgcacgggcugaggggacagcggaagccggaccugggccgccccuccaggccugcgggccaccggcgcccgccccucaccuccuuuaggcauugcggcuccggcggcugcggcggcggcggcggcgccucgaacugacaccggaaccggaaauagcuugggcucgacuucuuccuccugggccagccgccgccgccgcuucaguggccgcaguggccgcaaggacc
